United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 4

SEQ ID NO: 9714 - DNA, 735 bp, Artificial Sequence
  chemically treated genomic DNA (Homo sapiens) CpG-island No: 9714
aaaacaccgaactcgaattaaaacccaacacattaaccaaacacttaaataacgccaaaccacctccaacctccgctcaataccgcacaaaaccgaaccgaaacgcccccaaacgccgcgccgaaaacgatcccaacccgccgcgctccgcactccgaactcctccgcgcgcccaccctaaaaaaaaacgcgtcaaaaaccgattcgtaaaaccaacccccgacgccgccgacgacaaaaaatccgaaaccgcgacctctaccccgaccaaaacgaaaaaatccgaaaatcgcctcccgcacaaccgccaaacgccgccgcccccgaaaccgcaaactaactccaatacgaactaaaataaaaaccgactaacgccgacaccgaaacgctcactaacctaaaaaaatacttcaaaatttatttcttaataatcccgaccataataccgaaactaaaaacgccgcgatctcgtcctattactcactacctcctctcttcgtaaccgtctcctctctatcccgactaacccgaccgacgaaaaaacgctaatcgctcacgaccgaaaaaaacccaaaaccccgaccaaaaccacaaccgccgccgaaaacccgaaacatcacgctcaaaccgccacgaccgccgcgaacgccatcttaactacaacatcacctaaaaaactcgataaaaaacgaaaacgaaacgactccaaacgaaaccgacacgaaacgaaacgaa

SEQ ID NO: 9715 - DNA, 735 bp, Artificial Sequence
  chemically treated genomic DNA (Homo sapiens) CpG-island No: 9715
ggagtatcgaattcgagttagagtttagtatattaattaggtatttgggtgacgttaggttatttttagttttcgtttagtatcgtatagagtcgagtcgggacgtttttagacgtcgcgtcgggagcgattttagttcgtcgcgtttcgtatttcgggttttttcgcgcgtttattttgggagaagacgcgttaggggtcgattcgtgaggttagttttcggcgtcgtcggcgataagagattcggggtcgcgatttttgtttcggttagagcggggaagttcgaaggtcgtttttcgtatagtcgttaggcgtcgtcgttttcgaagtcgtaggttgattttagtgcgggttggggtggaggtcgattggcgtcgatatcgaggcgtttattgatttggagaggtgttttaagatttgttttttgatgatttcggttatggtatcgaggttggagacgtcgcggtttcgttttgttgtttattgtttttttttttcgtggtcgttttttttttgtttcggttagttcggtcggcggagaggcgttgatcgtttacgatcgggagagatttaaggtttcggttaaggttatagtcgtcgtcgagaattcggagtattacgtttaggtcgttacggtcgtcgcgggcgttattttggttgtagtattatttaagagattcggtggagggcgggggcggggcggttttaggcggggtcggtacgaggcggggcggg

SEQ ID NO: 9716 - DNA, 735 bp, Artificial Sequence
  chemically treated genomic DNA (Homo sapiens) CpG-island No: 9716
cccgccccgcctcgtaccgaccccgcctaaaaccgccccgcccccgccctccaccgaatctcttaaataatactacaaccaaaataacgcccgcgacgaccgtaacgacctaaacgtaatactccgaattctcgacgacgactataaccttaaccgaaaccttaaatctctcccgatcgtaaacgatcaacgcctctccgccgaccgaactaaccgaaacaaaaaaaaaacgaccacgaaaaaaaaaaacaataaacaacaaaacgaaaccgcgacgtctccaacctcgataccataaccgaaatcatcaaaaaacaaatcttaaaacacctctccaaatcaataaacgcctcgatatcgacgccaatcgacctccaccccaacccgcactaaaatcaacctacgacttcgaaaacgacgacgcctaacgactatacgaaaaacgaccttcgaacttccccgctctaaccgaaacaaaaatcgcgaccccgaatctcttatcgccgacgacgccgaaaactaacctcacgaatcgacccctaacgcgtcttctcccaaaataaacgcgcgaaaaaacccgaaatacgaaacgcgacgaactaaaatcgctcccgacgcgacgtctaaaaacgtcccgactcgactctatacgatactaaacgaaaactaaaaataacctaacgtcacccaaatacctaattaatatactaaactctaactcgaattcgatactcc

SEQ ID NO: 9717 - DNA, 624 bp, Artificial Sequence
  chemically treated genomic DNA (Homo sapiens) CpG-island No: 9717
  misc_feature (48)..(48): n is either a, c, g or t
ttatcgtagtacggttatattcgtatttttatgacgttcgtatatgtngttattttttttttaatacgcgtagcgtttattttttattttttttatatattttttattttttaattgtttatagagttttatttatttatatatacgttgtttattttatttatacgttacgtttatttatagcgcgcgtttgaattatatttcgtttttatcgttatatcgttttttttttttggtttcgttttatttaataattaattattttttttattggttatttacgtttttacggatattttttgtgtttttatattaattattattcgtcgattttttttatatttatttattcgtcgtttagtttttgattatgcgtcgtttatcgtttttattacgtatacgattatcgattttcgaattttcgtatttacggacgatcgttatattttgcgtataacgttcgaatggacgtcgtttatacgtacgtattattttttgtttgttcgtagttttcgatattttttattatttcgtttttgttgtttttttttatcgatacgtttagttattgtatgattggatttttttttatttatcgatttattagtcgtcgtcgtatttttt

SEQ ID NO: 9718 - DNA, 624 bp, Artificial Sequence
  chemically treated genomic DNA (Homo sapiens) CpG-island No: 9718
  misc_feature (577)..(577): n is either a, c, g or t
aaaaaatacgacgacgactaataaatcgataaataaaaaaaaatccaatcatacaataactaaacgtatcgataaaaaaaaacaacaaaaacgaaataataaaaaatatcgaaaactacgaacaaacaaaaaataatacgtacgtataaacgacgtccattcgaacgttatacgcaaaatataacgatcgtccgtaaatacgaaaattcgaaaatcgataatcgtatacgtaataaaaacgataaacgacgcataatcaaaaactaaacgacgaataaataaatataaaaaaaatcgacgaataataattaatataaaaacacaaaaaatatccgtaaaaacgtaaataaccaataaaaaaaataattaattattaaataaaacgaaaccaaaaaaaaaaaacgatataacgataaaaacgaaatataattcaaacgcgcgctataaataaacgtaacgtataaataaaataaacaacgtatatataaataaataaaactctataaacaattaaaaaataaaaaatatataaaaaaaataaaaaataaacgctacgcgtattaaaaaaaaaataacnacatatacgaacgtcataaaaatacgaatataaccgtactacgataa

SEQ ID NO: 9719 - DNA, 624 bp, Artificial Sequence
  chemically treated genomic DNA (Homo sapiens) CpG-island No: 9719
  misc_feature (577)..(577): n is either a, c, g or t
agagggtgcggcgacggttgatgaatcggtgagtgaagagaagtttagttatatagtggttgggcgtgtcgataggaagaggtaatagaggcgaagtggtgaagggtgtcggaagttgcgggtagatagggagtagtgcgtacgtataagcgacgtttattcgagcgttgtgcgtagggtgtggcggtcgttcgtaggtgcgagggttcgagggtcggtgatcgtgtgcgtagtggagacggtgggcgacgtatggttaggagttgagcgacgggtggataggtgtagggagagtcggcgagtgatagttggtgtggagatataggaggtgttcgtgggaacgtgagtgattaatgagaaaagtggttggttgttgggtaaggcgagattagggaagggggacggtgtgacggtaagggcggagtgtggtttaggcgcgcgttgtaggtgggcgtgacgtgtgagtagagtaggtagcgtgtgtgtggataagtagagttttgtgagtagttagagagtggagggtgtgtgagaagggtgaagagtgagcgttgcgcgtattgaggagagagtggtngtatgtgcggacgttatggaggtgcggatgtggtcgtgttgcgatga

SEQ ID NO: 9720 - DNA, 624 bp, Artificial Sequence
  chemically treated genomic DNA (Homo sapiens) CpG-island No: 9720
  misc_feature (48)..(48): n is either a, c, g or t
tcatcgcaacacgaccacatccgcacctccataacgtccgcacatacnaccactctctcctcaatacgcgcaacgctcactcttcacccttctcacacaccctccactctctaactactcacaaaactctacttatccacacacacgctacctactctactcacacgtcacgcccacctacaacgcgcgcctaaaccacactccgcccttaccgtcacaccgtcccccttccctaatctcgccttacccaacaaccaaccacttttctcattaatcactcacgttcccacgaacacctcctatatctccacaccaactatcactcgccgactctccctacacctatccacccgtcgctcaactcctaaccatacgtcgcccaccgtctccactacgcacacgatcaccgaccctcgaaccctcgcacctacgaacgaccgccacaccctacgcacaacgctcgaataaacgtcgcttatacgtacgcactactccctatctacccgcaacttccgacacccttcaccacttcgcctctattacctcttcctatcgacacgcccaaccactatataactaaacttctcttcactcaccgattcatcaaccgtcgccgcaccctct

SEQ ID NO: 9721 - DNA, 779 bp, Artificial Sequence
  chemically treated genomic DNA (Homo sapiens) CpG-island No: 9721
  misc_feature (713)..(713): n is either a, c, g or t
gtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaaacgttgttgtgcggtgtgaagcgttgtttttcggttatgaggtttttgggtttggtgatcggatttatttggggtttcggtggtcgtatcggggtttttggtttttcggttaagggtggttagttggttcggggatatggttcgggggttttatcgagggtttttcgggggttcgttgnttgtttttttacgaagtttttttcgagtttggattaaaattttggttaggagattcgggttcggga

SEQ ID NO: 9722 - DNA, 779 bp, Artificial Sequence
  chemically treated genomic DNA (Homo sapiens) CpG-island No: 9722
  misc_feature (67)..(67): n is either a, c, g or t
tcccgaacccgaatctcctaaccaaaattttaatccaaactcgaaaaaaacttcgtaaaaaaacaancaacgaacccccgaaaaaccctcgataaaacccccgaaccatatccccgaaccaactaaccacccttaaccgaaaaaccaaaaaccccgatacgaccaccgaaaccccaaataaatccgatcaccaaacccaaaaacctcataaccgaaaaacaacgcttcacaccgcacaacaacgttttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgac

SEQ ID NO: 9723 - DNA, 779 bp, Artificial Sequence
  chemically treated genomic DNA (Homo sapiens) CpG-island No: 9723
  misc_feature (67)..(67): n is either a, c, g or t
tttcgaattcggattttttggttaagattttgatttaagttcggaaaaagtttcgtaaaaaggtagntagcgaattttcgaaaaattttcggtaaagttttcgggttatattttcgagttaattgattatttttgatcgggaaattaaaaatttcgatgcggttatcgaggttttaagtagattcggttattaaatttagaagttttatgatcggaagatagcgttttatatcgtataataacgtttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggt

SEQ ID NO: 9724 - DNA, 779 bp, Artificial Sequence
  chemically treated genomic DNA (Homo sapiens) CpG-island No: 9724
  misc_feature (713)..(713): n is either a, c, g or t
accgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaaacgttattatacgatataaaacgctatcttccgatcataaaacttctaaatttaataaccgaatctacttaaaacctcgataaccgcatcgaaatttttaatttcccgatcaaaaataatcaattaactcgaaaatataacccgaaaactttaccgaaaatttttcgaaaattcgctanctacctttttacgaaactttttccgaacttaaatcaaaatcttaaccaaaaaatccgaattcgaaa

SEQ ID NO: 9725 - DNA, 712 bp, Artificial Sequence
  chemically treated genomic DNA (Homo sapiens) CpG-island No: 9725
gttcgtcgcgttgtagcggtgtttttttagtcgtcgtagttgcgtcgcgtttagcggttcgtttagcgtttttagttagcgcggcgcggattcggtttcggcgtttgtcgttatggtcgtttgagggtttcgtcgtcgttatcgagcgtagttcgcgtttggcgttgggggtagggagaggtggagggagaggttggcggtcgggttttgcgattgtcgggttggatttatcggtcgggttcgtacggcggaggtcgaggttaggtcggtttgttcggttgtcggggttttagttttagaagttgtggggtcgcggttgcggttcgcgggtggggcggggtttcggggaggggttcggttgggggcggggcggagggggttttgttaggggcggggaggcgggtgtcgcgttcgcgggttattttcggcgttcgttaacggtaatttgttatcggcgattaaggtttttgattttttaggggtcggttgtattgcgtttgaggtttgatgttttaatttacggcgtcggattacgttttgaggtcgttttttcgcgggttgtattacgatcgagtcggttttttttttaggggtcggaatacgatttcggtcgtttagtgttagttattgtaggattacgttgttcgtagagtttgggggttttcgtgtgagaatatagttttgtagggttcgggttacgggggtgacggtt

SEQ ID NO: 9726 - DNA, 712 bp, Artificial Sequence
  chemically treated genomic DNA (Homo sapiens) CpG-island No: 9726
aaccgtcacccccgtaacccgaaccctacaaaactatattctcacacgaaaacccccaaactctacgaacaacgtaatcctacaataactaacactaaacgaccgaaatcgtattccgacccctaaaaaaaaaaccgactcgatcgtaatacaacccgcgaaaaaacgacctcaaaacgtaatccgacgccgtaaattaaaacatcaaacctcaaacgcaatacaaccgacccctaaaaaatcaaaaaccttaatcgccgataacaaattaccgttaacgaacgccgaaaataacccgcgaacgcgacacccgcctccccgcccctaacaaaaccccctccgccccgcccccaaccgaacccctccccgaaaccccgccccacccgcgaaccgcaaccgcgaccccacaacttctaaaactaaaaccccgacaaccgaacaaaccgacctaacctcgacctccgccgtacgaacccgaccgataaatccaacccgacaatcgcaaaacccgaccgccaacctctccctccacctctccctacccccaacgccaaacgcgaactacgctcgataacgacgacgaaaccctcaaacgaccataacgacaaacgccgaaaccgaatccgcgccgcgctaactaaaaacgctaaacgaaccgctaaacgcgacgcaactacgacgactaaaaaaacaccgctacaacgcgacgaac

SEQ ID NO: 9727 - DNA, 712 bp, Artificial Sequence
  chemically treated genomic DNA (Homo sapiens) CpG-island No: 9727
ggtcgttattttcgtgattcgagttttgtaaaattgtgtttttatacgaaaatttttaggttttgcgggtagcgtggttttgtagtggttaatattgggcgatcggagtcgtgtttcgatttttaggagaggaatcggttcggtcgtggtgtagttcgcgaggagacgattttagggcgtaattcgacgtcgtgggttaagatattagattttaggcgtagtgtagtcggtttttggggagttaaggattttgatcgtcgataataagttgtcgttggcgggcgtcgagggtgattcgcgagcgcggtattcgttttttcgtttttagtaggatttttttcgtttcgtttttagtcggattttttttcgaggtttcgttttattcgcgagtcgtagtcgcggttttatagtttttggggttggggtttcggtagtcgggtaggtcggtttgatttcgattttcgtcgtgcgggttcgatcggtgagtttagttcggtagtcgtaggattcggtcgttagtttttttttttatttttttttgtttttagcgttaggcgcgggttgcgttcggtggcggcggcggggtttttaggcggttatggcggtaggcgtcggggtcgggttcgcgtcgcgttggttgagggcgttgagcgagtcgttgagcgcggcgtagttgcggcgattggaggagtatcgttatagcgcggcgggt

SEQ ID NO: 9728 - DNA, 712 bp, Artificial Sequence
  chemically treated genomic DNA (Homo sapiens) CpG-island No: 9728
acccgccgcgctataacgatactcctccaatcgccgcaactacgccgcgctcaacgactcgctcaacgccctcaaccaacgcgacgcgaacccgaccccgacgcctaccgccataaccgcctaaaaaccccgccgccgccaccgaacgcaacccgcgcctaacgctaaaaacaaaaaaaaataaaaaaaaaaactaacgaccgaatcctacgactaccgaactaaactcaccgatcgaacccgcacgacgaaaatcgaaatcaaaccgacctacccgactaccgaaaccccaaccccaaaaactataaaaccgcgactacgactcgcgaataaaacgaaacctcgaaaaaaaatccgactaaaaacgaaacgaaaaaaatcctactaaaaacgaaaaaacgaataccgcgctcgcgaatcaccctcgacgcccgccaacgacaacttattatcgacgatcaaaatccttaactccccaaaaaccgactacactacgcctaaaatctaatatcttaacccacgacgtcgaattacgccctaaaatcgtctcctcgcgaactacaccacgaccgaaccgattcctctcctaaaaatcgaaacacgactccgatcgcccaatattaaccactacaaaaccacgctacccgcaaaacctaaaaattttcgtataaaaacacaattttacaaaactcgaatcacgaaaataacgacc

SEQ ID NO: 9729 - DNA, 662 bp, Artificial Sequence
  chemically treated genomic DNA (Homo sapiens) CpG-island No: 9729
tcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggttttggggtcggatcgtgaaacgttgatgtgcggtgtgaaagcgttgtttgtcggttatgagggtttttgggtttggtgatcggaatttgtggggggtttgggggttcgtatatcgggttttggtggttttttcgggttacgggtgggtt

SEQ ID NO: 9730 - DNA, 662 bp, Artificial Sequence
  chemically treated genomic DNA (Homo sapiens) CpG-island No: 9730
aacccacccgtaacccgaaaaaaccaccaaaacccgatatacgaacccccaaaccccccacaaattccgatcaccaaacccaaaaaccctcataaccgacaaacaacgctttcacaccgcacatcaacgtttcacgatccgaccccaaaaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacga

SEQ ID NO: 9731 - DNA, 662 bp, Artificial Sequence
  chemically treated genomic DNA (Homo sapiens) CpG-island No: 9731
gatttattcgtggttcgggaaaattattaaaattcgatatgcgggtttttaagttttttatagatttcggttattaaatttagaagtttttatgatcggtagatagcgtttttatatcgtatattaacgttttacggttcgattttagaattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacgg

SEQ ID NO: 9732 - DNA, 662 bp, Artificial Sequence
  chemically treated genomic DNA (Homo sapiens) CpG-island No: 9732
ccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataattctaaaatcgaaccgtaaaacgttaatatacgatataaaaacgctatctaccgatcataaaaacttctaaatttaataaccgaaatctataaaaaacttaaaaacccgcatatcgaattttaataattttcccgaaccacgaataaatc

SEQ ID NO: 9733 - DNA, 505 bp, Artificial Sequence
  chemically treated genomic DNA (Homo sapiens) CpG-island No: 9733
  misc_feature (488)..(488): n is either a, c, g or t
gtttcgtcgtcgatatcgagcgtagttcgcgtttggcgttgggggtagggagaggtggagggagaggttggcggtcgggttttgcgattgtcgggttggatttatcggtcgggttcgtacggcggaggtcgaggttaggtcggtttgttcggttgtcggggttttagttttagaagttgtggggtcgcggttgcggttcgcgggtggggcggagtttcggggaggggttcggttgggggcggtgcggagggggttttgttaggggcggagaggcgggtgtcgcgttcgcgggttattttcggcgttcgttaacggtaatttgttatcggcgattaaggtttttgattttttaggggtcggttgtattgcgtttgaggtttgatgttttaatttacggcgtcggattacgttttgaggtcgttttttcgcgggttgtattacgatcgagtcgggttttttttaggggtcggaatacgaattcgggtcgnttagtgtagttattgga

SEQ ID NO: 9734 - DNA, 505 bp, Artificial Sequence
  chemically treated genomic DNA (Homo sapiens) CpG-island No: 9734
  misc_feature (18)..(18): n is either a, c, g or t
tccaataactacactaancgacccgaattcgtattccgacccctaaaaaaaacccgactcgatcgtaatacaacccgcgaaaaaacgacctcaaaacgtaatccgacgccgtaaattaaaacatcaaacctcaaacgcaatacaaccgacccctaaaaaatcaaaaaccttaatcgccgataacaaattaccgttaacgaacgccgaaaataacccgcgaacgcgacacccgcctctccgcccctaacaaaaccccctccgcaccgcccccaaccgaacccctccccgaaactccgccccacccgcgaaccgcaaccgcgaccccacaacttctaaaactaaaaccccgacaaccgaacaaaccgacctaacctcgacctccgccgtacgaacccgaccgataaatccaacccgacaatcgcaaaacccgaccgccaacctctccctccacctctccctacccccaacgccaaacgcgaactacgctcgatatcgacgacgaaac

SEQ ID NO: 9735 - DNA, 505 bp, Artificial Sequence
  chemically treated genomic DNA (Homo sapiens) CpG-island No: 9735
  misc_feature (18)..(18): n is either a, c, g or t
tttagtggttatattggncgattcgagttcgtgtttcgatttttagagagaattcggttcggtcgtggtgtagttcgcgaggagacgattttagggcgtaattcgacgtcgtgggttaagatattagattttaggcgtagtgtagtcggtttttgaggagttaaggattttgatcgtcgataataagttgtcgttggcgggcgtcgagggtgattcgcgagcgcggtattcgttttttcgtttttagtaggatttttttcgtatcgtttttagtcggattttttttcgaggtttcgttttattcgcgagtcgtagtcgcggttttatagtttttggggttggggtttcggtagtcgggtaggtcggtttgatttcgattttcgtcgtgcgggttcgatcggtgagtttagttcggtagtcgtaggattcggtcgttagtttttttttttatttttttttgtttttagcgttaggcgcgggttgcgttcggtgtcgacggcggggt

SEQ ID NO: 9736 - DNA, 505 bp, Artificial Sequence
  chemically treated genomic DNA (Homo sapiens) CpG-island No: 9736
  misc_feature (488)..(488): n is either a, c, g or t
accccgccgtcgacaccgaacgcaacccgcgcctaacgctaaaaacaaaaaaaaataaaaaaaaaaactaacgaccgaatcctacgactaccgaactaaactcaccgatcgaacccgcacgacgaaaatcgaaatcaaaccgacctacccgactaccgaaaccccaaccccaaaaactataaaaccgcgactacgactcgcgaataaaacgaaacctcgaaaaaaaatccgactaaaaacgatacgaaaaaaatcctactaaaaacgaaaaaacgaataccgcgctcgcgaatcaccctcgacgcccgccaacgacaacttattatcgacgatcaaaatccttaactcctcaaaaaccgactacactacgcctaaaatctaatatcttaacccacgacgtcgaattacgccctaaaatcgtctcctcgcgaactacaccacgaccgaaccgaattctctctaaaaatcgaaacacgaactcgaatcgnccaatataaccactaaa

SEQ ID NO: 9737 - DNA, 558 bp, Artificial Sequence
  chemically treated genomic DNA (Homo sapiens) CpG-island No: 9737
cgatacgagcgtatacgtcgttcgtttgttattgttagcgagtttagatgatagtttaagagcgtagtttatatattacgagtggtcgcgtcgcgcgttcgcgttagattcggttttttggtattgttgcgtttttgggttttcgcgatttgttgtttgttttattgttgcgtttttttttttatgcgttcgttgggtgttttcgttgttttcgtgtttgttcgtgttgttttttcgttattggcgtttttttgtgtttattggtttaagtttgggattttggcgttcgtattcggtgggaggttgttgtcgttaggtttcggttggtttgtgcgttttggtttttttcggatttgggcgtcgttcgtttgttttttcgtgggttttgtcggtttttttttttttcgttttcgcgtttttggtttcggttgcgggtttttgtgcgttttttttatttcgttcgttcgttcgcgggtcgtcgcgtcgcggtttttcgattttttttgggttttcgttcgttcgttttttttttcggtttcggttcgttttttttttttt

SEQ ID NO: 9738 - DNA, 558 bp, Artificial Sequence
  chemically treated genomic DNA (Homo sapiens) CpG-island No: 9738
aaaaaaaaaaaaacgaaccgaaaccgaaaaaaaaaacgaacgaacgaaaacccaaaaaaaatcgaaaaaccgcgacgcgacgacccgcgaacgaacgaacgaaataaaaaaaacgcacaaaaacccgcaaccgaaaccaaaaacgcgaaaacgaaaaaaaaaaaaaccgacaaaacccacgaaaaaacaaacgaacgacgcccaaatccgaaaaaaaccaaaacgcacaaaccaaccgaaacctaacgacaacaacctcccaccgaatacgaacgccaaaatcccaaacttaaaccaataaacacaaaaaaacgccaataacgaaaaaacaacacgaacaaacacgaaaacaacgaaaacacccaacgaacgcataaaaaaaaaaacgcaacaataaaacaaacaacaaatcgcgaaaacccaaaaacgcaacaataccaaaaaaccgaatctaacgcgaacgcgcgacgcgaccactcgtaatatataaactacgctcttaaactatcatctaaactcgctaacaataacaaacgaacgacgtatacgctcgtatcg

SEQ ID NO: 9739 - DNA, 558 bp, Artificial Sequence
  chemically treated genomic DNA (Homo sapiens) CpG-island No: 9739
ggaaagaggggggcgggtcgaagtcggaaggaggggcgaacggacggaggtttaaagggggtcgagaggtcgcggcgcggcggttcgcggacgggcgagcggagtagagggggcgtataggggttcgtagtcggagttagaagcgcggaagcgaggaagagaaggatcgataggatttacgagagagtaagcgagcggcgtttaaattcgaggagagttaaggcgtataagttagtcggaatttgacggtagtagttttttatcgagtgcgaacgttaaagttttaggtttaagttaatgagtataaggaagcgttagtaacgaaagaatagtacgagtagatacggggataacgagaatatttagcgagcgtatagaggaagaagcgtagtagtaaggtagatagtaggtcgcgaggatttaggagcgtaataatgttagaaagtcgagtttagcgcgagcgcgcgacgcgattattcgtggtgtgtgagttgcgtttttaggttgttatttaagttcgttagtagtagtaggcgggcggcgtgtgcgttcgtgtcg

SEQ ID NO: 9740 - DNA, 558 bp, Artificial Sequence
  chemically treated genomic DNA (Homo sapiens) CpG-island No: 9740
cgacacgaacgcacacgccgcccgcctactactactaacgaacttaaataacaacctaaaaacgcaactcacacaccacgaataatcgcgtcgcgcgctcgcgctaaactcgactttctaacattattacgctcctaaatcctcgcgacctactatctaccttactactacgcttcttcctctatacgctcgctaaatattctcgttatccccgtatctactcgtactattctttcgttactaacgcttccttatactcattaacttaaacctaaaactttaacgttcgcactcgataaaaaactactaccgtcaaattccgactaacttatacgccttaactctcctcgaatttaaacgccgctcgcttactctctcgtaaatcctatcgatccttctcttcctcgcttccgcgcttctaactccgactacgaacccctatacgccccctctactccgctcgcccgtccgcgaaccgccgcgccgcgacctctcgaccccctttaaacctccgtccgttcgcccctccttccgacttcgacccgcccccctctttcc

SEQ ID NO: 9741 - DNA, 947 bp, Artificial Sequence
  chemically treated genomic DNA (Homo sapiens) CpG-island No: 9741
ttcgtcgatttgtaattcgaaatattgtggttgttgttttcggagtcggttttttttttttttttttagttttaagagattcgcgcgtttttagagtttcgtaaagtttagcgcgttgcgttttttgggtagagcggtttttgttaggtattgcggttgtttcgaaagggcgtattgcgtttcgaggacgttcgattttcgaggtttcgattttcggaaaaggtcgggttgcgtcgagattttagttttggttggggtacgtttttgtggtttcgcgcgttttttcgagcgtcgagcggttttttttatcgttgcggttcgagggtgtttagcgtagttagatattataattttcggttcggtttagtttagttcggcggcgaagatgtgttttcggtcgtggcgtcgacgttttggttgttcgcgttttagcgcgtagttttagggtcggttcgcgtcggaggcggttgttatgttaggaatgtgagagttttaggttttttttcgggattaaagcgaattataaataattttttagcgtatcgttttttttcgtttttcgttttttttcgtttttttttttcggttttcgttttttttcggggaggcggcgttgttggtcgagcgtcggttcggttttcgagtttcgttttttcgcgtttagcgttttttaggtcgcggtgtgttcgtttttgttttatgttttgttttcggagttgttggagataatttaatttaattttgtttattatcgtttttatttttagtcgtcgattcgtttttattttttatttttaaatttatcgacgggacgatagtaagggttgtattacgcgtgttttggggttgttgcgggaggggatttcggttgtgtgtgtgtgtgtgtgtgtgtgtgcgtgtgtgtgtatcgggggaggtgggaaagggaggagggattgtaaagatat

SEQ ID NO: 9742 - DNA, 947 bp, Artificial Sequence
  chemically treated genomic DNA (Homo sapiens) CpG-island No: 9742
atatctttacaatccctcctccctttcccacctcccccgatacacacacacgcacacacacacacacacacacacacaaccgaaatcccctcccgcaacaaccccaaaacacgcgtaatacaacccttactatcgtcccgtcgataaatttaaaaataaaaaataaaaacgaatcgacgactaaaaataaaaacgataataaacaaaattaaattaaattatctccaacaactccgaaaacaaaacataaaacaaaaacgaacacaccgcgacctaaaaaacgctaaacgcgaaaaaacgaaactcgaaaaccgaaccgacgctcgaccaacaacgccgcctccccgaaaaaaaacgaaaaccgaaaaaaaaaaacgaaaaaaaacgaaaaacgaaaaaaaacgatacgctaaaaaattatttataattcgctttaatcccgaaaaaaaacctaaaactctcacattcctaacataacaaccgcctccgacgcgaaccgaccctaaaactacgcgctaaaacgcgaacaaccaaaacgtcgacgccacgaccgaaaacacatcttcgccgccgaactaaactaaaccgaaccgaaaattataatatctaactacgctaaacaccctcgaaccgcaacgataaaaaaaaccgctcgacgctcgaaaaaacgcgcgaaaccacaaaaacgtaccccaaccaaaactaaaatctcgacgcaacccgaccttttccgaaaatcgaaacctcgaaaatcgaacgtcctcgaaacgcaatacgccctttcgaaacaaccgcaatacctaacaaaaaccgctctacccaaaaaacgcaacgcgctaaactttacgaaactctaaaaacgcgcgaatctcttaaaactaaaaaaaaaaaaaaaaaaccgactccgaaaacaacaaccacaatatttcgaattacaaatcgacgaa

SEQ ID NO: 9743 - DNA, 947 bp, Artificial Sequence
  chemically treated genomic DNA (Homo sapiens) CpG-island No: 9743
atgtttttgtagtttttttttttttttttatttttttcggtatatatatacgtatatatatatatatatatatatatagtcggagttttttttcgtagtaattttaggatacgcgtggtatagtttttgttgtcgtttcgtcgatgggtttagggatgaagggtgagagcgggtcggcgattgggagtggaggcgataatgggtagagttggattaaattgtttttagtagtttcgaaggtaaagtatggggtaggggcggatatatcgcggtttggagggcgttgggcgcggaggaacggagttcgggggtcgggtcggcgttcggttagtagcgtcgttttttcggaggaaggcgggggtcgggaggagggagcgggagaaggcggagggcggaggagggcggtgcgttgagaggttatttgtggttcgttttgatttcgagggggaatttgaaatttttatatttttggtatagtagtcgttttcggcgcgggtcgattttggggttgcgcgttggggcgcgaatagttagagcgtcggcgttacggtcgagaatatattttcgtcgtcgagttgagttgggtcgagtcggaggttgtggtgtttgattgcgttgggtattttcgggtcgtagcggtaaggaaggtcgttcggcgttcgggagagcgcgcgaggttatagaaacgtgttttagttaaagttggagtttcggcgtaattcggtttttttcgggagtcggagtttcgaggatcgagcgttttcggggcgtagtgcgttttttcgaggtagtcgtagtgtttggtaagggtcgttttgtttagggagcgtagcgcgttgggttttgcggggttttagaaacgcgcgggttttttggggttgggggagaggggagagggtcgatttcggagataatagttatagtgtttcgggttgtaggtcggcggg

SEQ ID NO: 9744 - DNA, 947 bp, Artificial Sequence
  chemically treated genomic DNA (Homo sapiens) CpG-island No: 9744
cccgccgacctacaacccgaaacactataactattatctccgaaatcgaccctctcccctctcccccaaccccaaaaaacccgcgcgtttctaaaaccccgcaaaacccaacgcgctacgctccctaaacaaaacgacccttaccaaacactacgactacctcgaaaaaacgcactacgccccgaaaacgctcgatcctcgaaactccgactcccgaaaaaaaccgaattacgccgaaactccaactttaactaaaacacgtttctataacctcgcgcgctctcccgaacgccgaacgaccttccttaccgctacgacccgaaaatacccaacgcaatcaaacaccacaacctccgactcgacccaactcaactcgacgacgaaaatatattctcgaccgtaacgccgacgctctaactattcgcgccccaacgcgcaaccccaaaatcgacccgcgccgaaaacgactactataccaaaaatataaaaatttcaaattccccctcgaaatcaaaacgaaccacaaataacctctcaacgcaccgccctcctccgccctccgccttctcccgctccctcctcccgacccccgccttcctccgaaaaaacgacgctactaaccgaacgccgacccgacccccgaactccgttcctccgcgcccaacgccctccaaaccgcgatatatccgcccctaccccatactttaccttcgaaactactaaaaacaatttaatccaactctacccattatcgcctccactcccaatcgccgacccgctctcacccttcatccctaaacccatcgacgaaacgacaacaaaaactataccacgcgtatcctaaaattactacgaaaaaaaactccgactatatatatatatatatatatatatacgtatatatataccgaaaaaaataaaaaaaaaaaaaaaaactacaaaaacat

SEQ ID NO: 9745 - DNA, 930 bp, Artificial Sequence
  chemically treated genomic DNA (Homo sapiens) CpG-island No: 9745
ttttcgttcgtttttaggcgtcgatttcgattttagcgggtttcggacggcgtttttttttttttcgtcgtttttcggcggtcgagtcgcgcgtaacggagatatttaaatcgttttttcgggacggcggcgtggaagagatcggaaaggcggcggcggcgttggtttgggggtcggggcggtggtcgcgcgggttagggtcgcggagtcgggcgggtatttattagcgcgtgttgtcgtggaaatgttttagaattgcgtagtcgaagaacgagttagcggggttttggaagtgtacggggcgttgcgggtcgaggttgtaggcgttcgcggggattttcgcgagtattagcgttagtagtagcgcgcggtatttttcggcgtttttcggcgtagtcgggtcgtttatttttagtcggtcgtcgtttttttttttgttcggcgagtagggcgtcgagcgcgcgggtcgcggggttcgtcgacggttaggaagtttttcggtgcgggagttttgcgtttggatacgggcggaatgcgggcgtcgggttcgttatcggggcgcggacggcgggttgagcgggcgttgaaggcgagtataggggcggtttcgagcggcggcgtttttagttcgttcgagaagtttgcgcgagcgggtttcgggtcgggcggcgttggtttgcggaggggcgcgttcgcgaggtgggcggttcgggcggcggcggttggacggcgcggtagcgttttatgcgggtcgtgagttttgcgcgtatttttcgggcgggagttagtttttgggattcgtcggggcgtttcgaattgtttttttttcgtcgcgtacggggcgttcgggttttcggagataaggttgttttttttcgttattataggttttgtcggttttgttgggtttgtttttttgtttttgttttt

SEQ ID NO: 9746 - DNA, 930 bp, Artificial Sequence
  chemically treated genomic DNA (Homo sapiens) CpG-island No: 9746
aaaaacaaaaacaaaaaaacaaacccaacaaaaccgacaaaacctataataacgaaaaaaaacaaccttatctccgaaaacccgaacgccccgtacgcgacgaaaaaaaaacaattcgaaacgccccgacgaatcccaaaaactaactcccgcccgaaaaatacgcgcaaaactcacgacccgcataaaacgctaccgcgccgtccaaccgccgccgcccgaaccgcccacctcgcgaacgcgcccctccgcaaaccaacgccgcccgacccgaaacccgctcgcgcaaacttctcgaacgaactaaaaacgccgccgctcgaaaccgcccctatactcgccttcaacgcccgctcaacccgccgtccgcgccccgataacgaacccgacgcccgcattccgcccgtatccaaacgcaaaactcccgcaccgaaaaacttcctaaccgtcgacgaaccccgcgacccgcgcgctcgacgccctactcgccgaacaaaaaaaaaaacgacgaccgactaaaaataaacgacccgactacgccgaaaaacgccgaaaaataccgcgcgctactactaacgctaatactcgcgaaaatccccgcgaacgcctacaacctcgacccgcaacgccccgtacacttccaaaaccccgctaactcgttcttcgactacgcaattctaaaacatttccacgacaacacgcgctaataaatacccgcccgactccgcgaccctaacccgcgcgaccaccgccccgacccccaaaccaacgccgccgccgcctttccgatctcttccacgccgccgtcccgaaaaaacgatttaaatatctccgttacgcgcgactcgaccgccgaaaaacgacgaaaaaaaaaaaaacgccgtccgaaacccgctaaaatcgaaatcgacgcctaaaaacgaacgaaaa

SEQ ID NO: 9747 - DNA, 930 bp, Artificial Sequence
  chemically treated genomic DNA (Homo sapiens) CpG-island No: 9747
agagataaaggtagggagataggtttagtagggtcggtagagtttgtagtgacggaggggagtagttttattttcgggaattcgagcgtttcgtgcgcggcggggagggggtagttcggggcgtttcggcgggttttaggggttgattttcgttcgggaagtgcgcgtagggtttacggttcgtatggggcgttgtcgcgtcgtttagtcgtcgtcgttcgggtcgtttatttcgcgggcgcgttttttcgtagattagcgtcgttcggttcgggattcgttcgcgtagatttttcgggcggattgaggacgtcgtcgttcggggtcgtttttgtgttcgtttttagcgttcgtttagttcgtcgttcgcgtttcggtggcgggttcgacgttcgtatttcgttcgtgtttaggcgtagagttttcgtatcggggagttttttggtcgtcggcgggtttcgcggttcgcgcgttcggcgttttgttcgtcgggtagaggggaaggcggcggtcggttggggatgggcggttcggttgcgtcgaggggcgtcgggaggtatcgcgcgttgttgttggcgttggtgttcgcggggattttcgcgggcgtttataatttcgattcgtagcgtttcgtgtatttttagggtttcgttgattcgtttttcggttacgtagttttggagtatttttacgataatacgcgttggtgagtgttcgttcgatttcgcgattttggttcgcgcggttatcgtttcggtttttaggttagcgtcgtcgtcgttttttcggttttttttacgtcgtcgtttcgagggggcgatttaaatgttttcgttgcgcgcggttcggtcgtcgggggacggcgggagaagggaggacgtcgttcggggttcgttaaggtcggggtcggcgtttggaggcgggcggggg

SEQ ID NO: 9748 - DNA, 930 bp, Artificial Sequence
  chemically treated genomic DNA (Homo sapiens) CpG-island No: 9748
cccccgcccgcctccaaacgccgaccccgaccttaacgaaccccgaacgacgtcctcccttctcccgccgtcccccgacgaccgaaccgcgcgcaacgaaaacatttaaatcgccccctcgaaacgacgacgtaaaaaaaaccgaaaaaacgacgacgacgctaacctaaaaaccgaaacgataaccgcgcgaaccaaaatcgcgaaatcgaacgaacactcaccaacgcgtattatcgtaaaaatactccaaaactacgtaaccgaaaaacgaatcaacgaaaccctaaaaatacacgaaacgctacgaatcgaaattataaacgcccgcgaaaatccccgcgaacaccaacgccaacaacaacgcgcgatacctcccgacgcccctcgacgcaaccgaaccgcccatccccaaccgaccgccgccttcccctctacccgacgaacaaaacgccgaacgcgcgaaccgcgaaacccgccgacgaccaaaaaactccccgatacgaaaactctacgcctaaacacgaacgaaatacgaacgtcgaacccgccaccgaaacgcgaacgacgaactaaacgaacgctaaaaacgaacacaaaaacgaccccgaacgacgacgtcctcaatccgcccgaaaaatctacgcgaacgaatcccgaaccgaacgacgctaatctacgaaaaaacgcgcccgcgaaataaacgacccgaacgacgacgactaaacgacgcgacaacgccccatacgaaccgtaaaccctacgcgcacttcccgaacgaaaatcaacccctaaaacccgccgaaacgccccgaactaccccctccccgccgcgcacgaaacgctcgaattcccgaaaataaaactactcccctccgtcactacaaactctaccgaccctactaaacctatctccctacctttatctct

SEQ ID NO: 9749 - DNA, 734 bp, Artificial Sequence
  chemically treated genomic DNA (Homo sapiens) CpG-island No: 9749
gtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggacgtgaaatttgttgtgcggtgtgaagcgttgtttgtcggttatgaggtttttgggttggtgatcggatttgtgggggttcggggtcgtatcgggtttgtgtttttcggttaaggtggttagtggttaggggatcggtcgggggttttatcgggtttttttaggtgttcgttgttgtttttgacgaatttgtgtcgagttggatgtatattt

SEQ ID NO: 9750 - DNA, 734 bp, Artificial Sequence
  chemically treated genomic DNA (Homo sapiens) CpG-island No: 9750
aaatatacatccaactcgacacaaattcgtcaaaaacaacaacgaacacctaaaaaaacccgataaaacccccgaccgatcccctaaccactaaccaccttaaccgaaaaacacaaacccgatacgaccccgaacccccacaaatccgatcaccaacccaaaaacctcataaccgacaaacaacgcttcacaccgcacaacaaatttcacgtccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcac

SEQ ID NO: 9751 - DNA, 734 bp, Artificial Sequence
  chemically treated genomic DNA (Homo sapiens) CpG-island No: 9751
ggatgtgtatttagttcggtataagttcgttagaggtagtagcgaatatttgaaaaggttcggtaaagttttcggtcgattttttagttattgattattttgatcggaaaatataaattcgatgcggtttcgagtttttatagattcggttattaatttagaagttttatgatcggtagatagcgttttatatcgtataataagttttacgttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattat

SEQ ID NO: 9752 - DNA, 734 bp, Artificial Sequence
  chemically treated genomic DNA (Homo sapiens) CpG-island No: 9752
ataatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaacgtaaaacttattatacgatataaaacgctatctaccgatcataaaacttctaaattaataaccgaatctataaaaactcgaaaccgcatcgaatttatattttccgatcaaaataatcaataactaaaaaatcgaccgaaaactttaccgaaccttttcaaatattcgctactacctctaacgaacttataccgaactaaatacacatcc

SEQ ID NO: 9753 - DNA, 761 bp, Artificial Sequence
  chemically treated genomic DNA (Homo sapiens) CpG-island No: 9753
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcgagttgtatgataaagaagatagttataagtgcggcgacgatagttatgtttcgcgtttatcggaaggagttgattgggttgaaggtttttaagggtatcggtcgagtttgatattgtaggattat

SEQ ID NO: 9754 - DNA, 761 bp, Artificial Sequence
  chemically treated genomic DNA (Homo sapiens) CpG-island No: 9754
ataatcctacaatatcaaactcgaccgatacccttaaaaaccttcaacccaatcaactccttccgataaacgcgaaacataactatcgtcgccgcacttataactatcttctttatcatacaactcgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 9755 - DNA, 761 bp, Artificial Sequence
  chemically treated genomic DNA (Homo sapiens) CpG-island No: 9755
atagttttataatgttaagttcgatcgatgtttttgagagtttttaatttagttagtttttttcggtgggcgcggggtatgattatcgtcgtcgtatttatgattgttttttttattatgtaattcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 9756 - DNA, 761 bp, Artificial Sequence
  chemically treated genomic DNA (Homo sapiens) CpG-island No: 9756
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgaattacataataaaaaaaacaatcataaatacgacgacgataatcataccccgcgcccaccgaaaaaaactaactaaattaaaaactctcaaaaacatcgatcgaacttaacattataaaactat

SEQ ID NO: 9757 - DNA, 718 bp, Artificial Sequence
  chemically treated genomic DNA (Homo sapiens) CpG-island No: 9757
ggtcggcgaggttcgggggcgtcgcgtcgagttgcggtttttttttttaattttttcgggcgtcgttattttttttttttttagtattagggtatttgtacggcgcgattgaggaaggtgtttgcgtcggtcgttagtttttttacgttgaagtttatgatatttattttaggcggtagtcgggcggagtcggtcgatttagcggcggcgaggcggaggtgtcgcggtcgggttggggcgtagggttagagcggcgagggtagacgtggtaggtggagggaggcggcgttagtttcgtagtcgtagttgtcgttttcgtgaacggggaggatgaaggcggggcgagggaggagaataagcgcgcggcggtagcgttaaggatgggttagtcggttcggagaacggtcgttaacgtcgacgatgggtttcgcgggcgagtcggagatggacgggcgatttcgtcgtgtggattcgggttttaagggaaaaataagcgcgggtcgcggggcggagtttttttcgaggttatcgcgggaatagcgattttttgaggattgcggcggcgtagtttcggggcgcgtcgggagtttcgttcggtttttgtggaggaagcggcgagggcgagtcgcggggtttcggcgtttttgtatgtttgtatttaacgagaatttagagcgaatacgatttatatttttttttttgttttaagaggaaatat

SEQ ID NO: 9758 - DNA, 718 bp, Artificial Sequence
  chemically treated genomic DNA (Homo sapiens) CpG-island No: 9758
atatttcctcttaaaacaaaaaaaaaaatataaatcgtattcgctctaaattctcgttaaatacaaacatacaaaaacgccgaaaccccgcgactcgccctcgccgcttcctccacaaaaaccgaacgaaactcccgacgcgccccgaaactacgccgccgcaatcctcaaaaaatcgctattcccgcgataacctcgaaaaaaactccgccccgcgacccgcgcttatttttcccttaaaacccgaatccacacgacgaaatcgcccgtccatctccgactcgcccgcgaaacccatcgtcgacgttaacgaccgttctccgaaccgactaacccatccttaacgctaccgccgcgcgcttattctcctccctcgccccgccttcatcctccccgttcacgaaaacgacaactacgactacgaaactaacgccgcctccctccacctaccacgtctaccctcgccgctctaaccctacgccccaacccgaccgcgacacctccgcctcgccgccgctaaatcgaccgactccgcccgactaccgcctaaaataaatatcataaacttcaacgtaaaaaaactaacgaccgacgcaaacaccttcctcaatcgcgccgtacaaataccctaatactaaaaaaaaaaaaaataacgacgcccgaaaaaattaaaaaaaaaaaccgcaactcgacgcgacgcccccgaacctcgccgacc

SEQ ID NO: 9759 - DNA, 718 bp, Artificial Sequence
  chemically treated genomic DNA (Homo sapiens) CpG-island No: 9759
atatttttttttaaaataaaaagagaaatgtgggtcgtgttcgttttgggttttcgttaagtgtaagtatatagaggcgtcgagatttcgcggttcgttttcgtcgttttttttataggagtcgggcggagttttcggcgcgtttcggggttgcgtcgtcgtaatttttaaggggtcgttgttttcgcgataatttcgagaaaggtttcgtttcgcggttcgcgtttgttttttttttgggattcgggtttatacggcggggtcgttcgtttattttcggttcgttcgcggggtttatcgtcgacgttagcggtcgtttttcgagtcgattgatttatttttggcgttgtcgtcgcgcgtttgtttttttttttcgtttcgtttttatttttttcgtttacggaaacgatagttgcggttgcggggttggcgtcgtttttttttatttattacgtttgttttcgtcgttttagttttgcgttttagttcggtcgcggtattttcgtttcgtcgtcgttaggtcggtcggtttcgttcggttgtcgtttaggatgaatattatggattttaacgtgaagaagttggcggtcgacgtaggtattttttttagtcgcgtcgtgtaggtattttggtgttggggggaaaaggggtggcggcgttcgggaaggttgagggaggggatcgtagttcgacgcggcgttttcgggtttcgtcgatt

SEQ ID NO: 9760 - DNA, 718 bp, Artificial Sequence
  chemically treated genomic DNA (Homo sapiens) CpG-island No: 9760
aatcgacgaaacccgaaaacgccgcgtcgaactacgatcccctccctcaaccttcccgaacgccgccaccccttttccccccaacaccaaaatacctacacgacgcgactaaaaaaaatacctacgtcgaccgccaacttcttcacgttaaaatccataatattcatcctaaacgacaaccgaacgaaaccgaccgacctaacgacgacgaaacgaaaataccgcgaccgaactaaaacgcaaaactaaaacgacgaaaacaaacgtaataaataaaaaaaaacgacgccaaccccgcaaccgcaactatcgtttccgtaaacgaaaaaaataaaaacgaaacgaaaaaaaaaaacaaacgcgcgacgacaacgccaaaaataaatcaatcgactcgaaaaacgaccgctaacgtcgacgataaaccccgcgaacgaaccgaaaataaacgaacgaccccgccgtataaacccgaatcccaaaaaaaaaacaaacgcgaaccgcgaaacgaaacctttctcgaaattatcgcgaaaacaacgaccccttaaaaattacgacgacgcaaccccgaaacgcgccgaaaactccgcccgactcctataaaaaaaacgacgaaaacgaaccgcgaaatctcgacgcctctatatacttacacttaacgaaaacccaaaacgaacacgacccacatttctctttttattttaaaaaaaaatat

SEQ ID NO: 9761 - DNA, 567 bp, Artificial Sequence
  chemically treated genomic DNA (Homo sapiens) CpG-island No: 9761
atcgtcggaatgggtgattcgtattgttcgtggattatcgttttatttgttgcgatcgtgtatttgggttgggtcgtttcgttgtttattttcgttttttagattttttttttatcgttcgcgtggttggttttttaatttgttattgtatttggagttcggtgggttcggtgggtgtttttattttagataggtcggataatggtggttcgtcgagttgggtcgtatggtcgtattgcgtttttgcgtatattacgttttggttcggttacgtgtattggttattgtgtatagtggttgtgttggtacgttgtttgcggtgtttatgggtagggtgggtttgtacggtcgggtcggtacgtgtgggttgtgttgcggtgtgcgcgtgtcgtggtttgtgggtacgatttgtgtgttttggtgttgtagttgggtatttcgggttttgtcgcgtgtacgtattatttcgcgggtttggcgaggttggcgggtgtgcgtcgtgggtttggggggttgtggtcgttgggttagggttgtgatttggtgttggcgaggggtttgagtttt

SEQ ID NO: 9762 - DNA, 567 bp, Artificial Sequence
  chemically treated genomic DNA (Homo sapiens) CpG-island No: 9762
aaaactcaaacccctcgccaacaccaaatcacaaccctaacccaacgaccacaaccccccaaacccacgacgcacacccgccaacctcgccaaacccgcgaaataatacgtacacgcgacaaaacccgaaatacccaactacaacaccaaaacacacaaatcgtacccacaaaccacgacacgcgcacaccgcaacacaacccacacgtaccgacccgaccgtacaaacccaccctacccataaacaccgcaaacaacgtaccaacacaaccactatacacaataaccaatacacgtaaccgaaccaaaacgtaatatacgcaaaaacgcaatacgaccatacgacccaactcgacgaaccaccattatccgacctatctaaaataaaaacacccaccgaacccaccgaactccaaatacaataacaaattaaaaaaccaaccacgcgaacgataaaaaaaaaatctaaaaaacgaaaataaacaacgaaacgacccaacccaaatacacgatcgcaacaaataaaacgataatccacgaacaatacgaatcacccattccgacgat

SEQ ID NO: 9763 - DNA, 567 bp, Artificial Sequence
  chemically treated genomic DNA (Homo sapiens) CpG-island No: 9763
agagtttaagtttttcgttagtattaagttataattttggtttaacgattatagttttttaaatttacgacgtatattcgttaatttcgttaaattcgcgaaatagtacgtatacgcggtaggattcgaaatatttaattatagtattaaaatatataaatcgtatttatagattacgatacgcgtatatcgtagtataatttatacgtgtcgattcgatcgtatagatttattttgtttataggtatcgtaagtaacgtattagtataattattgtatataatagttagtatacgtaatcgggttaaaacgtagtatacgtaggggcgtaatgcgattatacgatttaattcggcgagttattattattcgatttgtttaaagtgaggatatttatcgggtttatcgggttttaagtgtaatagtaagttaagggattagttacgcggacggtagagggaaggtttagaaaacgggagtgagtagcgaaacggtttagtttagatgtacggtcgtagtagataggacggtaatttacgggtaatgcgggttatttatttcggcgat

SEQ ID NO: 9764 - DNA, 567 bp, Artificial Sequence
  chemically treated genomic DNA (Homo sapiens) CpG-island No: 9764
atcgccgaaataaataacccgcattacccgtaaattaccgtcctatctactacgaccgtacatctaaactaaaccgtttcgctactcactcccgttttctaaaccttccctctaccgtccgcgtaactaatcccttaacttactattacacttaaaacccgataaacccgataaatatcctcactttaaacaaatcgaataataataactcgccgaattaaatcgtataatcgcattacgcccctacgtatactacgttttaacccgattacgtatactaactattatatacaataattatactaatacgttacttacgatacctataaacaaaataaatctatacgatcgaatcgacacgtataaattatactacgatatacgcgtatcgtaatctataaatacgatttatatattttaatactataattaaatatttcgaatcctaccgcgtatacgtactatttcgcgaatttaacgaaattaacgaatatacgtcgtaaatttaaaaaactataatcgttaaaccaaaattataacttaatactaacgaaaaacttaaactct

SEQ ID NO: 9765 - DNA, 534 bp, Artificial Sequence
  chemically treated genomic DNA (Homo sapiens) CpG-island No: 9765
attgacggtcgtcgtttcgcgtcgttttatatattgtttgtagttgttgcgtggcgtgttcgtgcggtattacgttgtttttggtcggagtgttgtttatttgtttggagtttcgttgatcgatcgttgtttgtcgatttcgtaatttgtttggcgatattttttggggttttagttattatatattggttcggtgcgttttaaaattatgtgcgcggttgtgtttgtacgaatatcgatttttatatttcgtgggtaaatttgtgattatttcgacggaatacgacgttattataatggtcggttgtgtttaattttatggtcggacgttttttttatatagcggcggaaaagttgatttggggttggtttcgatttgtatgtcgttttttacgttatatttttttgtttatttcgtgcgtatattttcgatacgcgttgacgtttgcgtaattttgcgggtatcgttgcgagtatttaattataagaatgattgggtaatacgtgcgtgagcgttgttaatttggtacgtcg

SEQ ID NO: 9766 - DNA, 534 bp, Artificial Sequence
  chemically treated genomic DNA (Homo sapiens) CpG-island No: 9766
cgacgtaccaaattaacaacgctcacgcacgtattacccaatcattcttataattaaatactcgcaacgatacccgcaaaattacgcaaacgtcaacgcgtatcgaaaatatacgcacgaaataaacaaaaaaatataacgtaaaaaacgacatacaaatcgaaaccaaccccaaatcaacttttccgccgctatataaaaaaaacgtccgaccataaaattaaacacaaccgaccattataataacgtcgtattccgtcgaaataatcacaaatttacccacgaaatataaaaatcgatattcgtacaaacacaaccgcgcacataattttaaaacgcaccgaaccaatatataataactaaaaccccaaaaaatatcgccaaacaaattacgaaatcgacaaacaacgatcgatcaacgaaactccaaacaaataaacaacactccgaccaaaaacaacgtaataccgcacgaacacgccacgcaacaactacaaacaatatataaaacgacgcgaaacgacgaccgtcaat

SEQ ID NO: 9767 - DNA, 534 bp, Artificial Sequence
  chemically treated genomic DNA (Homo sapiens) CpG-island No: 9767
cgacgtattaaattagtaacgtttacgtacgtgttatttaattatttttgtaattggatattcgtaacggtgttcgtagggttacgtaagcgttaacgcgtgtcgggggtatacgtacggggtggataaaaaaatgtagcgtagggggcggtatgtaggtcgaggttaattttaggttagttttttcgtcgttatatgaaaaaggcgttcggttatgaaattaggtataatcggttattatagtagcgtcgtatttcgtcggggtggttataggtttgtttacggggtataggggtcgatattcgtgtaagtatagtcgcgtatatagttttaaaacgtatcgggttaatgtgtaatagttaaggttttagggggtatcgttaagtaaattacggggtcggtaagtagcggtcggttaacggggttttaggtaggtgggtagtatttcggttaggaatagcgtggtgtcgtacgagtacgttacgtagtagttgtaggtaatgtgtaaagcggcgcggggcggcgatcgttagt

SEQ ID NO: 9768 - DNA, 534 bp, Artificial Sequence
  chemically treated genomic DNA (Homo sapiens) CpG-island No: 9768
actaacgatcgccgccccgcgccgctttacacattacctacaactactacgtaacgtactcgtacgacaccacgctattcctaaccgaaatactacccacctacctaaaaccccgttaaccgaccgctacttaccgaccccgtaatttacttaacgataccccctaaaaccttaactattacacattaacccgatacgttttaaaactatatacgcgactatacttacacgaatatcgacccctataccccgtaaacaaacctataaccaccccgacgaaatacgacgctactataataaccgattatacctaatttcataaccgaacgcctttttcatataacgacgaaaaaactaacctaaaattaacctcgacctacataccgccccctacgctacatttttttatccaccccgtacgtatacccccgacacgcgttaacgcttacgtaaccctacgaacaccgttacgaatatccaattacaaaaataattaaataacacgtacgtaaacgttactaatttaatacgtcg

SEQ ID NO: 9769 - DNA, 571 bp, Artificial Sequence
  chemically treated genomic DNA (Homo sapiens) CpG-island No: 9769
  misc_feature (403)..(403): n is either a, c, g or t
tatagtggtgagcggtgggggttgggtagacgcgcgcggagacgtcgcgggtcgggtgtgcgtagtttcgggtttggtacgcggacggcgtagttgggtatggatgatatgtagtgggtcgttacgtatgatggggggtgtattattgagcggatttgtcgcgttggttattgttagtagaagtgttgcgtgggtttcgtggagtttagtcgttgtgggtggtcggacgggtgtattacggtcgggtagttatagcgcgcgtagggggggcgtcggaggtggttggttttaggagttgcgggttcggcgatttttgcgtatgtgttttgtggtttcgcgcgttgtggttattgtgtttcggggtagatgtgttgttggtgagggttttcgttcgtggtggtgngtatatagattaagagtatatggatacgcgggcgggggcggggtgtgagcgggcgcgtcgtgagtgggtcgggcggtgggggtgtggggtgggtcgttggcggtgtgtggtgtgtcgggagttatatacgggtgatagatatttaatgaatgttggtgggggggtggg

SEQ ID NO: 9770 - DNA, 571 bp, Artificial Sequence
  chemically treated genomic DNA (Homo sapiens) CpG-island No: 9770
  misc_feature (169)..(169): n is either a, c, g or t
cccacccccccaccaacattcattaaatatctatcacccgtatataactcccgacacaccacacaccgccaacgacccaccccacacccccaccgcccgacccactcacgacgcgcccgctcacaccccgcccccgcccgcgtatccatatactcttaatctatatacncaccaccacgaacgaaaaccctcaccaacaacacatctaccccgaaacacaataaccacaacgcgcgaaaccacaaaacacatacgcaaaaatcgccgaacccgcaactcctaaaaccaaccacctccgacgccccccctacgcgcgctataactacccgaccgtaatacacccgtccgaccacccacaacgactaaactccacgaaacccacgcaacacttctactaacaataaccaacgcgacaaatccgctcaataatacaccccccatcatacgtaacgacccactacatatcatccatacccaactacgccgtccgcgtaccaaacccgaaactacgcacacccgacccgcgacgtctccgcgcgcgtctacccaacccccaccgctcaccactata

SEQ ID NO: 9771 - DNA, 571 bp, Artificial Sequence
  chemically treated genomic DNA (Homo sapiens) CpG-island No: 9771
  misc_feature (169)..(169): n is either a, c, g or t
tttatttttttattaatatttattaagtgtttattattcgtatgtgattttcgatatattatatatcgttagcgatttattttatatttttatcgttcgatttatttacgacgcgttcgtttatatttcgttttcgttcgcgtatttatgtatttttgatttgtatatntattattacgaacgaagatttttattaataatatatttatttcgaggtataatggttatagcgcgcgaaattataggatatatgcgtaaagatcgtcggattcgtaatttttggggttagttattttcgacgttttttttacgcgcgttgtgattattcgatcgtagtatattcgttcggttatttataacggttgggttttacgaagtttacgtaatatttttattaatagtgattaacgcggtaaattcgtttagtggtatattttttattatacgtaacggtttattatatgttatttatatttaattacgtcgttcgcgtattaagttcgaagttacgtatattcggttcgcggcgttttcgcgcgcgtttatttaatttttatcgtttattattgtg

SEQ ID NO: 9772 - DNA, 571 bp, Artificial Sequence
  chemically treated genomic DNA (Homo sapiens) CpG-island No: 9772
  misc_feature (403)..(403): n is either a, c, g or t
cacaataataaacgataaaaattaaataaacgcgcgcgaaaacgccgcgaaccgaatatacgtaacttcgaacttaatacgcgaacgacgtaattaaatataaataacatataataaaccgttacgtataataaaaaatataccactaaacgaatttaccgcgttaatcactattaataaaaatattacgtaaacttcgtaaaacccaaccgttataaataaccgaacgaatatactacgatcgaataatcacaacgcgcgtaaaaaaaacgtcgaaaataactaaccccaaaaattacgaatccgacgatctttacgcatatatcctataatttcgcgcgctataaccattatacctcgaaataaatatattattaataaaaatcttcgttcgtaataatanatatacaaatcaaaaatacataaatacgcgaacgaaaacgaaatataaacgaacgcgtcgtaaataaatcgaacgataaaaatataaaataaatcgctaacgatatataatatatcgaaaatcacatacgaataataaacacttaataaatattaataaaaaaataaa

SEQ ID NO: 9773 - DNA, 746 bp, Artificial Sequence
  chemically treated genomic DNA (Homo sapiens) CpG-island No: 9773
  misc_feature (457)..(457): n is either a, c, g or t
gttcgtcgggtaggtagcgtttttcgcggcgtttcgttatttttttttttttttttattggtaggggttcgggttcgggcggaagtggggtaggcgggcgggagcgaggcgttatcgtgtatatttatgaggcgcgcgtagtttagtatgttaatgaggcggggcgcgcggtcggttaagaaggttgttgggcggcggcggtggttgttggttcgggtagtcgggcgcgagcggcgtagataaggggttatttgtcggcgttaataggatatggagtcgttcggcgggggtttggggttcggtcgcggtattcggataagaagaagggtcggagttcggatgagttgtttgcgacgggcggcgcggcggtaaatataagaaatttgtgagtgttttttttattttgtttttcgtttggcggagtggtcgttttttggattcgggcgattttcgttgntttcgggggcgttttgttgtagttggggagtcgtttcgagtttttttttggttggtggttttgggttcgcggtttatttttttttcggggaatcgggggtcgtgttttttgtgttcgttcggtttttgggattttcgcgggagacgtagggttggtcgttttagtttcggggttagttatttatttgcgggttttatatatgttttcgtaatatattttgtcgcgttaggggaatttcgtagcgggaggggttggagcgttgttgatatcgcgtaatggattaattcgt

SEQ ID NO: 9774 - DNA, 746 bp, Artificial Sequence
  chemically treated genomic DNA (Homo sapiens) CpG-island No: 9774
  misc_feature (290)..(290): n is either a, c, g or t
acgaattaatccattacgcgatatcaacaacgctccaacccctcccgctacgaaattcccctaacgcgacaaaatatattacgaaaacatatataaaacccgcaaataaataactaaccccgaaactaaaacgaccaaccctacgtctcccgcgaaaatcccaaaaaccgaacgaacacaaaaaacacgacccccgattccccgaaaaaaaaataaaccgcgaacccaaaaccaccaaccaaaaaaaaactcgaaacgactccccaactacaacaaaacgcccccgaaancaacgaaaatcgcccgaatccaaaaaacgaccactccgccaaacgaaaaacaaaataaaaaaaacactcacaaatttcttatatttaccgccgcgccgcccgtcgcaaacaactcatccgaactccgacccttcttcttatccgaataccgcgaccgaaccccaaacccccgccgaacgactccatatcctattaacgccgacaaataaccccttatctacgccgctcgcgcccgactacccgaaccaacaaccaccgccgccgcccaacaaccttcttaaccgaccgcgcgccccgcctcattaacatactaaactacgcgcgcctcataaatatacacgataacgcctcgctcccgcccgcctaccccacttccgcccgaacccgaacccctaccaataaaaaaaaaaaaaaaaataacgaaacgccgcgaaaaacgctacctacccgacgaac

SEQ ID NO: 9775 - DNA, 746 bp, Artificial Sequence
  chemically treated genomic DNA (Homo sapiens) CpG-island No: 9775
  misc_feature (290)..(290): n is either a, c, g or t
gcgaattgatttattgcgcgatattagtagcgttttaatttttttcgttgcggaatttttttggcgcggtaagatatattgcggagatatgtgtggggttcgtaaataggtggttaatttcggggttggagcggttaattttgcgtttttcgcgggagttttaggggtcgagcgggtataggggatacggttttcgatttttcgaggggaaaatgggtcgcgagtttagagttattaattagaaggaagttcggggcggttttttagttgtagtaagacgttttcgaggntagcgagggtcgttcgagtttagagggcggttatttcgttaggcgaagagtagggtgggagggatatttataaattttttatgtttgtcgtcgcgtcgttcgtcgtaggtagtttattcgggtttcgatttttttttttgttcgggtatcgcggtcgggttttaggttttcgtcggacggttttatgttttgttagcgtcggtaagtgattttttgtttacgtcgttcgcgttcggttgttcgagttagtaattatcgtcgtcgtttagtagtttttttagtcggtcgcgcgtttcgttttattaatatgttgggttgcgcgcgttttatgaatatatacggtgacgtttcgttttcgttcgtttgttttattttcgttcggattcgagtttttattaatgggggaagggaggggggtggcgggacgtcgcggaaggcgttatttgttcggcgggt

SEQ ID NO: 9776 - DNA, 746 bp, Artificial Sequence
  chemically treated genomic DNA (Homo sapiens) CpG-island No: 9776
  misc_feature (457)..(457): n is either a, c, g or t
acccgccgaacaaataacgccttccgcgacgtcccgccacccccctcccttcccccattaataaaaactcgaatccgaacgaaaataaaacaaacgaacgaaaacgaaacgtcaccgtatatattcataaaacgcgcgcaacccaacatattaataaaacgaaacgcgcgaccgactaaaaaaactactaaacgacgacgataattactaactcgaacaaccgaacgcgaacgacgtaaacaaaaaatcacttaccgacgctaacaaaacataaaaccgtccgacgaaaacctaaaacccgaccgcgatacccgaacaaaaaaaaaaatcgaaacccgaataaactacctacgacgaacgacgcgacgacaaacataaaaaatttataaatatccctcccaccctactcttcgcctaacgaaataaccgccctctaaactcgaacgaccctcgctancctcgaaaacgtcttactacaactaaaaaaccgccccgaacttccttctaattaataactctaaactcgcgacccattttcccctcgaaaaatcgaaaaccgtatcccctatacccgctcgacccctaaaactcccgcgaaaaacgcaaaattaaccgctccaaccccgaaattaaccacctatttacgaaccccacacatatctccgcaatatatcttaccgcgccaaaaaaattccgcaacgaaaaaaattaaaacgctactaatatcgcgcaataaatcaattcgc

SEQ ID NO: 9777 - DNA, 726 bp, Artificial Sequence
  chemically treated genomic DNA (Homo sapiens) CpG-island No: 9777
ttcgtttttcgtttcggttagtggtttattttgttgagggttattaggcgcgttaaatcgttttgatgttttattattaaattgattagttgcgtagaatggtggcgcgttttttggcggtgagcgcgcgttagcgggtagggcgcggttggcggcgtcgatagcggcgcgggttttattcggtttattttcggtacgttatttagtttgtcgtcgttcgtcggattggtgcgtcgatggttttattattgttggcgtttagttatttttcgttaattaagtttgttggcggattacgttattgtcgtttatttttatcgttatattttttttttcggtttttcgtttttttgcggcgtgttacgtatttaattacgttcgttcgtatcgtgcgttcggggtattttggtttgttatcgcgttgttttgtcgtttttgtttttataggattgtttgtttcgtcgggcgttttcgcgcggattttcgtttgttttcgaacgtaatttatttcgcgaacgtggtttttcggttcgttgtcgtttagtcggtttttgttcgtatttcgttttttacgtttcgtgttatcgattttttttcgtttaacgtttttttatagtgtttcggtttttcggtttttcgtttgtttcgtttttttttattttttttcggtaatcgattattggtcgtgttaagtttgtttatgtttttgttggtgtatttttagta

SEQ ID NO: 9778 - DNA, 726 bp, Artificial Sequence
  chemically treated genomic DNA (Homo sapiens) CpG-island No: 9778
tactaaaaatacaccaacaaaaacataaacaaacttaacacgaccaataatcgattaccgaaaaaaaataaaaaaaaacgaaacaaacgaaaaaccgaaaaaccgaaacactataaaaaaacgttaaacgaaaaaaaatcgataacacgaaacgtaaaaaacgaaatacgaacaaaaaccgactaaacgacaacgaaccgaaaaaccacgttcgcgaaataaattacgttcgaaaacaaacgaaaatccgcgcgaaaacgcccgacgaaacaaacaatcctataaaaacaaaaacgacaaaacaacgcgataacaaaccaaaataccccgaacgcacgatacgaacgaacgtaattaaatacgtaacacgccgcaaaaaaacgaaaaaccgaaaaaaaaaatataacgataaaaataaacgacaataacgtaatccgccaacaaacttaattaacgaaaaataactaaacgccaacaataataaaaccatcgacgcaccaatccgacgaacgacgacaaactaaataacgtaccgaaaataaaccgaataaaacccgcgccgctatcgacgccgccaaccgcgccctacccgctaacgcgcgctcaccgccaaaaaacgcgccaccattctacgcaactaatcaatttaataataaaacatcaaaacgatttaacgcgcctaataaccctcaacaaaataaaccactaaccgaaacgaaaaacgaa

SEQ ID NO: 9779 - DNA, 726 bp, Artificial Sequence
  chemically treated genomic DNA (Homo sapiens) CpG-island No: 9779
tgttgagagtgtattaataagggtatgggtaagtttggtacggttaatgatcggttgtcgggggggggtggggagaagcggagtagacgaaagatcgggggatcggggtattgtgagggggcgttaggcggggggggatcggtaatacggggcgtgaggggcggggtgcgggtaagggtcggttgggcggtagcgggtcggggggttacgttcgcggggtaggttgcgttcgggggtaggcgggggttcgcgcgagggcgttcggcggggtaggtagttttatgggggtaagggcggtaggataacgcggtggtaagttagagtatttcggacgtacggtgcgagcggacgtagttggatgcgtgatacgtcgtaggagagcgaggaatcgggaaaaaggatgtagcgatgaaagtgaacgatagtaacgtagttcgttagtaggtttgattaacggggaatggttggacgttaataatggtgaagttatcgacgtattaattcggcgaacggcgataagttgggtagcgtgtcgaaaatgggtcggatgaaattcgcgtcgttatcgacgtcgttaatcgcgttttgttcgttggcgcgcgtttatcgttaaagaacgcgttattattttgcgtaattggttaatttgatgatggagtattaggacgatttagcgcgtttgatgatttttaatagggtaaattattggtcgaagcgaaaggcgaa

SEQ ID NO: 9780 - DNA, 726 bp, Artificial Sequence
  chemically treated genomic DNA (Homo sapiens) CpG-island No: 9780
ttcgcctttcgcttcgaccaataatttaccctattaaaaatcatcaaacgcgctaaatcgtcctaatactccatcatcaaattaaccaattacgcaaaataataacgcgttctttaacgataaacgcgcgccaacgaacaaaacgcgattaacgacgtcgataacgacgcgaatttcatccgacccattttcgacacgctacccaacttatcgccgttcgccgaattaatacgtcgataacttcaccattattaacgtccaaccattccccgttaatcaaacctactaacgaactacgttactatcgttcactttcatcgctacatcctttttcccgattcctcgctctcctacgacgtatcacgcatccaactacgtccgctcgcaccgtacgtccgaaatactctaacttaccaccgcgttatcctaccgcccttacccccataaaactacctaccccgccgaacgccctcgcgcgaacccccgcctacccccgaacgcaacctaccccgcgaacgtaaccccccgacccgctaccgcccaaccgacccttacccgcaccccgcccctcacgccccgtattaccgatccccccccgcctaacgccccctcacaataccccgatcccccgatctttcgtctactccgcttctccccacccccccccgacaaccgatcattaaccgtaccaaacttacccatacccttattaatacactctcaaca

SEQ ID NO: 9781 - DNA, 560 bp, Artificial Sequence
  chemically treated genomic DNA (Homo sapiens) CpG-island No: 9781
gcgtttttgtcgtttcgtttatttgtatatggtaggtttcgtttttagcgttagtttcgttatatcgtttattattagtacgcggtagttcggtattttattagtatttggattgttgtagttattgaatcgatattggcgttgtaggatcgtcgagtagtaattggttttttgttagttggatggggaatagacggttggaatagtttttagatttgttagtttcgttttgatagtattaagcgttcgtttacggatatggagagcgtagcggttgttagcgtattcgtaatatttgacgtttcggtaacggtagtagaatatcgacgttatcggttggggttttagggtaaatttcgtatcgtgcgaggttatatggatattggtggcggtgaatcgttgttggcggtattgggtgagaaacgttatattttgcgtgagttattacgttttgttagtttagttagtcgtagttgtcggcgtttataatgggatatcgttattcggtagggcgttaaagatttatttttcgatttcgttgattgtttattttattggtt

SEQ ID NO: 9782 - DNA, 560 bp, Artificial Sequence
  chemically treated genomic DNA (Homo sapiens) CpG-island No: 9782
aaccaataaaataaacaatcaacgaaatcgaaaaataaatctttaacgccctaccgaataacgatatcccattataaacgccgacaactacgactaactaaactaacaaaacgtaataactcacgcaaaatataacgtttctcacccaataccgccaacaacgattcaccgccaccaatatccatataacctcgcacgatacgaaatttaccctaaaaccccaaccgataacgtcgatattctactaccgttaccgaaacgtcaaatattacgaatacgctaacaaccgctacgctctccatatccgtaaacgaacgcttaatactatcaaaacgaaactaacaaatctaaaaactattccaaccgtctattccccatccaactaacaaaaaaccaattactactcgacgatcctacaacgccaatatcgattcaataactacaacaatccaaatactaataaaataccgaactaccgcgtactaataataaacgatataacgaaactaacgctaaaaacgaaacctaccatatacaaataaacgaaacgacaaaaacgc

SEQ ID NO: 9783 - DNA, 560 bp, Artificial Sequence
  chemically treated genomic DNA (Homo sapiens) CpG-island No: 9783
agttaatgaggtgagtagttagcgaaatcgaaaggtgaatttttagcgttttgtcggataacggtattttattatgaacgtcgataattacgattggttgaattggtagagcgtaatggtttacgtaaagtgtggcgttttttatttaatgtcgttaatagcgatttatcgttattaatatttatgtgatttcgtacggtacggaatttattttaaaattttaatcggtagcgtcgatgttttgttgtcgttgtcggggcgttaaatattgcgaatgcgttggtagtcgttgcgttttttatgttcgtgggcgaacgtttgatgttattaaagcggggttggtaaatttgaaagttgttttagtcgtttgttttttatttaattggtagaaaattagttgttgttcgacgattttataacgttaatgtcggtttaatgattgtagtagtttaggtattggtgaaatgtcgggttatcgcgtgttggtggtgggcgatatggcggaattggcgttgaaagcgaagtttgttatgtataggtgggcgaggcggtaaaagcgt

SEQ ID NO: 9784 - DNA, 560 bp, Artificial Sequence
  chemically treated genomic DNA (Homo sapiens) CpG-island No: 9784
acgcttttaccgcctcgcccacctatacataacaaacttcgctttcaacgccaattccgccatatcgcccaccaccaacacgcgataacccgacatttcaccaatacctaaactactacaatcattaaaccgacattaacgttataaaatcgtcgaacaacaactaattttctaccaattaaataaaaaacaaacgactaaaacaactttcaaatttaccaaccccgctttaataacatcaaacgttcgcccacgaacataaaaaacgcaacgactaccaacgcattcgcaatatttaacgccccgacaacgacaacaaaacatcgacgctaccgattaaaattttaaaataaattccgtaccgtacgaaatcacataaatattaataacgataaatcgctattaacgacattaaataaaaaacgccacactttacgtaaaccattacgctctaccaattcaaccaatcgtaattatcgacgttcataataaaataccgttatccgacaaaacgctaaaaattcacctttcgatttcgctaactactcacctcattaact

SEQ ID NO: 9785 - DNA, 519 bp, Artificial Sequence
  chemically treated genomic DNA (Homo sapiens) CpG-island No: 9785
aatagcgtttaggtaacgataggcgttatacgttttagtacgttagcgggtaaaaatttgttcgttttattatttgtttgtattagtaggtttcgttgcgttaacgtttttttttttagcgataacgggttgaaaattatttatataaggcggtaatttgttggggagtttcgggaaagtagagtgttggcggtgatttattttttgtagtagcgtagatgttgcgcgatttgcgttagtgttagatgatcgggatttagtattacgttagtttttttattaatgttagacgtaggttaagcggcgtatttaaatgtcgtcgttcgtttatgtttgaagttgtatacgcgaaagaagttttttattagtcgtttacgaaattgttgttgatgggtttgtggaaggcgggtatattattttgcgttagatttattaaaaagcggggataaatcgattttagacgcgatcggggtcgttaagtaacgttttggttaatatcgttttgtcgtaaaagtgttt

SEQ ID NO: 9786 - DNA, 519 bp, Artificial Sequence
  chemically treated genomic DNA (Homo sapiens) CpG-island No: 9786
aaacacttttacgacaaaacgatattaaccaaaacgttacttaacgaccccgatcgcgtctaaaatcgatttatccccgctttttaataaatctaacgcaaaataatatacccgccttccacaaacccatcaacaacaatttcgtaaacgactaataaaaaacttctttcgcgtatacaacttcaaacataaacgaacgacgacatttaaatacgccgcttaacctacgtctaacattaataaaaaaactaacgtaatactaaatcccgatcatctaacactaacgcaaatcgcgcaacatctacgctactacaaaaaataaatcaccgccaacactctactttcccgaaactccccaacaaattaccgccttatataaataattttcaacccgttatcgctaaaaaaaaaaacgttaacgcaacgaaacctactaatacaaacaaataataaaacgaacaaatttttacccgctaacgtactaaaacgtataacgcctatcgttacctaaacgctatt

SEQ ID NO: 9787 - DNA, 519 bp, Artificial Sequence
  chemically treated genomic DNA (Homo sapiens) CpG-island No: 9787
aaatatttttacggtagaacgatattgattaagacgttatttgacggtttcggtcgcgtttggagtcggtttattttcgttttttagtggatttggcgtagggtgatgtgttcgttttttataagtttattagtagtagtttcgtgaacgattgatgaggaatttttttcgcgtgtgtagttttagatatggacgaacggcggtatttaaatgcgtcgtttagtttgcgtttgatattggtggaaaaattggcgtgatgttggatttcggttatttggtattgacgtagatcgcgtagtatttgcgttgttgtaaaaaatggattatcgttagtattttgttttttcggagttttttagtaaattgtcgttttgtatgagtggtttttagttcgttgtcgttgaaggaaaaggcgttaacgtaacgaggtttattggtgtaggtaggtgatagagcgagtaaatttttattcgttggcgtgttggggcgtataacgtttgtcgttgtttgggcgttgtt

SEQ ID NO: 9788 - DNA, 519 bp, Artificial Sequence
  chemically treated genomic DNA (Homo sapiens) CpG-island No: 9788
aacaacgcccaaacaacgacaaacgttatacgccccaacacgccaacgaataaaaatttactcgctctatcacctacctacaccaataaacctcgttacgttaacgccttttccttcaacgacaacgaactaaaaaccactcatacaaaacgacaatttactaaaaaactccgaaaaaacaaaatactaacgataatccattttttacaacaacgcaaatactacgcgatctacgtcaataccaaataaccgaaatccaacatcacgccaatttttccaccaatatcaaacgcaaactaaacgacgcatttaaataccgccgttcgtccatatctaaaactacacacgcgaaaaaaattcctcatcaatcgttcacgaaactactactaataaacttataaaaaacgaacacatcaccctacgccaaatccactaaaaaacgaaaataaaccgactccaaacgcgaccgaaaccgtcaaataacgtcttaatcaatatcgttctaccgtaaaaatattt

SEQ ID NO: 9789 - DNA, 612 bp, Artificial Sequence
  chemically treated genomic DNA (Homo sapiens) CpG-island No: 9789
tgttgtttcgtagaagacgtgtttttggcgtagggcgacgatgcgttcgtagtagttagggcgtaatttatttgatgtagcgtgacgattacggtgatgtcgtcgtttggttgatgtcgcgtagggtgtttattacgatgcgcgttgattttggtttagcgaggcgatgggtttatcggttagaattattttcgtttgttgtatagcgtacgggtaatcgttatacgttgttgttggtcgtcggagagggtgaaacgcgttgatgggtaaaatgtattatgttaacgcgggttagcgtttgaacgcgcgttgtttttgttcgtcggtgaattagttaaaataggtgcgtcgaacggcgtgttgtcgagcgcgttaattagtacgttttttagtacgttcggcggtttattaggttgaattgttggaatatgtagtcggtatgggcgcgtttttgcggatatcgcgggttaggcggttttcgcgttggattgtgcggttagtagttcgatatggttatcgatagatttatcgtcggtaattaaatcgttaagtgacgtaaaagggtggatttttcggaattcgacggattaagtaggttattattttatcgtg

SEQ ID NO: 9790 - DNA, 612 bp, Artificial Sequence
  chemically treated genomic DNA (Homo sapiens) CpG-island No: 9790
cacgataaaataataacctacttaatccgtcgaattccgaaaaatccacccttttacgtcacttaacgatttaattaccgacgataaatctatcgataaccatatcgaactactaaccgcacaatccaacgcgaaaaccgcctaacccgcgatatccgcaaaaacgcgcccataccgactacatattccaacaattcaacctaataaaccgccgaacgtactaaaaaacgtactaattaacgcgctcgacaacacgccgttcgacgcacctattttaactaattcaccgacgaacaaaaacaacgcgcgttcaaacgctaacccgcgttaacataatacattttacccatcaacgcgtttcaccctctccgacgaccaacaacaacgtataacgattacccgtacgctatacaacaaacgaaaataattctaaccgataaacccatcgcctcgctaaaccaaaatcaacgcgcatcgtaataaacaccctacgcgacatcaaccaaacgacgacatcaccgtaatcgtcacgctacatcaaataaattacgccctaactactacgaacgcatcgtcgccctacgccaaaaacacgtcttctacgaaacaaca

SEQ ID NO: 9791 - DNA, 612 bp, Artificial Sequence
  chemically treated genomic DNA (Homo sapiens) CpG-island No: 9791
tacggtgaaatggtggtttgtttggttcgtcgggtttcggaaaatttatttttttacgttatttaacggtttgattatcggcgataaatttgtcggtagttatatcgagttgttggtcgtatagtttagcgcgaaggtcgtttggttcgcgatattcgtaaaagcgcgtttatatcggttatatattttaataatttaatttggtgaatcgtcgagcgtattggagaacgtgttgattggcgcgttcggtagtacgtcgttcggcgtatttgttttagttggtttatcggcgagtagaaatagcgcgcgtttaggcgttgattcgcgttggtatggtgtattttgtttattagcgcgttttatttttttcggcggttagtagtaacgtgtggcgattgttcgtgcgttgtgtagtaggcgaaagtgattttggtcgatgaatttatcgtttcgttggattagaattagcgcgtatcgtgatggatattttgcgcgatattaattagacgacggtattatcgtggtcgttacgttgtattaggtggattacgttttggttattgcgaacgtatcgtcgttttgcgttaggggtacgttttttacgaggtagta

SEQ ID NO: 9792 - DNA, 612 bp, Artificial Sequence
  chemically treated genomic DNA (Homo sapiens) CpG-island No: 9792
tactacctcgtaaaaaacgtacccctaacgcaaaacgacgatacgttcgcaataaccaaaacgtaatccacctaatacaacgtaacgaccacgataataccgtcgtctaattaatatcgcgcaaaatatccatcacgatacgcgctaattctaatccaacgaaacgataaattcatcgaccaaaatcactttcgcctactacacaacgcacgaacaatcgccacacgttactactaaccgccgaaaaaaataaaacgcgctaataaacaaaatacaccataccaacgcgaatcaacgcctaaacgcgcgctatttctactcgccgataaaccaactaaaacaaatacgccgaacgacgtactaccgaacgcgccaatcaacacgttctccaatacgctcgacgattcaccaaattaaattattaaaatatataaccgatataaacgcgcttttacgaatatcgcgaaccaaacgaccttcgcgctaaactatacgaccaacaactcgatataactaccgacaaatttatcgccgataatcaaaccgttaaataacgtaaaaaaataaattttccgaaacccgacgaaccaaacaaaccaccatttcaccgta

SEQ ID NO: 9793 - DNA, 602 bp, Artificial Sequence
  chemically treated genomic DNA (Homo sapiens) CpG-island No: 9793
tcgttttttttcgtttacgattttggtttcgtttttcgtttaggttgtaacggaggtagagttaacgtttcgcgggtttttacgtattattttaacgcgtgttttcggagaagaacgtattcgggttacgggagtcgtgttttaggtttcgtttttttatttttcgaaaggttaatttttatttcgatttttttaggtttttttcgttttttttttatttttttaggttcgttttttgcgttttttataggaagtcggagggtcgttttgatttcgaatttttataggcgtgaatttgttttgttgtgtatttttgcggggtggtttgcgttaggtttgtcgcgcgcggtgagttcgcgtagatttgattttgcgtttcgcgttcggttgaggtcgtcgtcgttttttcgggatgtcgcggtcggggtttcgtagcgttgggcggtcgtcgcgggtcgttgggggtgtaggttgttcgtttgttgttattggtgtttggattcggcggcgtttttgagattattttcggttttttgataacgttaagtagtgtttttacgaggatatcgtttagggtttaagtgtattttggagttttaggt

SEQ ID NO: 9794 - DNA, 602 bp, Artificial Sequence
  chemically treated genomic DNA (Homo sapiens) CpG-island No: 9794
acctaaaactccaaaatacacttaaaccctaaacgatatcctcgtaaaaacactacttaacgttatcaaaaaaccgaaaataatctcaaaaacgccgccgaatccaaacaccaataacaacaaacgaacaacctacacccccaacgacccgcgacgaccgcccaacgctacgaaaccccgaccgcgacatcccgaaaaaacgacgacgacctcaaccgaacgcgaaacgcaaaatcaaatctacgcgaactcaccgcgcgcgacaaacctaacgcaaaccaccccgcaaaaatacacaacaaaacaaattcacgcctataaaaattcgaaatcaaaacgaccctccgacttcctataaaaaacgcaaaaaacgaacctaaaaaaataaaaaaaaaacgaaaaaaacctaaaaaaatcgaaataaaaattaacctttcgaaaaataaaaaaacgaaacctaaaacacgactcccgtaacccgaatacgttcttctccgaaaacacgcgttaaaataatacgtaaaaacccgcgaaacgttaactctacctccgttacaacctaaacgaaaaacgaaaccaaaatcgtaaacgaaaaaaaacga

SEQ ID NO: 9795 - DNA, 602 bp, Artificial Sequence
  chemically treated genomic DNA (Homo sapiens) CpG-island No: 9795
atttggaattttagggtgtatttgggttttgagcgatgttttcgtagaagtattgtttggcgttgttaggaagtcgaaggtgattttagaggcgtcgtcgggtttaggtattagtagtagtaggcgagtagtttgtatttttaacggttcgcgacggtcgtttagcgttgcgggatttcggtcgcggtatttcgagaaggcggcggcggttttaatcgagcgcgagacgtagggttaggtttgcgcggatttatcgcgcgcggtaggtttagcgtaggttatttcgtaaagatatatagtagagtaggtttacgtttgtggagattcgggattagagcgatttttcggttttttgtgaggggcgtagagggcggatttggggaggtaaaagagaagcggaaaaggtttgagagggtcgaagtggggattagtttttcggggggtgaaggggcggagtttgagatacggttttcgtgattcggatgcgttttttttcgggaatacgcgttggagtggtacgtggaagttcgcgaggcgttggttttgttttcgttgtagtttgggcgaggggcggggttagagtcgtgggcggagaggggcga

SEQ ID NO: 9796 - DNA, 602 bp, Artificial Sequence
  chemically treated genomic DNA (Homo sapiens) CpG-island No: 9796
tcgcccctctccgcccacgactctaaccccgcccctcgcccaaactacaacgaaaacaaaaccaacgcctcgcgaacttccacgtaccactccaacgcgtattcccgaaaaaaaacgcatccgaatcacgaaaaccgtatctcaaactccgccccttcaccccccgaaaaactaatccccacttcgaccctctcaaaccttttccgcttctcttttacctccccaaatccgccctctacgcccctcacaaaaaaccgaaaaatcgctctaatcccgaatctccacaaacgtaaacctactctactatatatctttacgaaataacctacgctaaacctaccgcgcgcgataaatccgcgcaaacctaaccctacgtctcgcgctcgattaaaaccgccgccgccttctcgaaataccgcgaccgaaatcccgcaacgctaaacgaccgtcgcgaaccgttaaaaatacaaactactcgcctactactactaatacctaaacccgacgacgcctctaaaatcaccttcgacttcctaacaacgccaaacaatacttctacgaaaacatcgctcaaaacccaaatacaccctaaaattccaaat

SEQ ID NO: 9797 - DNA, 703 bp, Artificial Sequence
  chemically treated genomic DNA (Homo sapiens) CpG-island No: 9797
gaattcgagttgtttcgggtcgtttcgatggtatagattcggttttcgtgcgtaagcgtttcgttttttagcgcgttgtcgtaggtacgtttttttagtagtttaggtttcgtttttttttcgtcgtttatttcggtcgcgacgtttcgtttcgcgtttaggttgttgttggtcgcgtcgtcgttttttttcggtttaatggcgtggcggtatagttagtgatgtgcgtttaggtttgttcggttttcggttcgtagtttattatattattcgtttagtagtcgttgtagtcgttgtagttcgagtcgattaagggcgggaggcgttcgggtggcggggcgtggcgaatagcgcggtcggatttatttttttgggcgcggagtatggaggagttgtgcggtcgtaggcggagtagggcggtcgggcggcggtggggataacggtttttttttgaaggggacggataaagtcgagtgattagcggcggcggggaggattagttttcgggtaggtagtggcgcggtagcggtttgttagggttcgggtcggggtttgaggtgttcgcggaagtttgggcgggaaggagggcgtcgggggagtcgaaggcgggtagcgggcggagattatagtttggtttatcgggaggggtttgtggtcgatggaggagttgggagggggttgtcgttgtttggaatagggagag

SEQ ID NO: 9798 - DNA, 703 bp, Artificial Sequence
  chemically treated genomic DNA (Homo sapiens) CpG-island No: 9798
ctctccctattccaaacaacgacaaccccctcccaactcctccatcgaccacaaacccctcccgataaaccaaactataatctccgcccgctacccgccttcgactcccccgacgccctccttcccgcccaaacttccgcgaacacctcaaaccccgacccgaaccctaacaaaccgctaccgcgccactacctacccgaaaactaatcctccccgccgccgctaatcactcgactttatccgtccccttcaaaaaaaaaccgttatccccaccgccgcccgaccgccctactccgcctacgaccgcacaactcctccatactccgcgcccaaaaaaataaatccgaccgcgctattcgccacgccccgccacccgaacgcctcccgcccttaatcgactcgaactacaacgactacaacgactactaaacgaataatataataaactacgaaccgaaaaccgaacaaacctaaacgcacatcactaactataccgccacgccattaaaccgaaaaaaaacgacgacgcgaccaacaacaacctaaacgcgaaacgaaacgtcgcgaccgaaataaacgacgaaaaaaaaacgaaacctaaactactaaaaaaacgtacctacgacaacgcgctaaaaaacgaaacgcttacgcacgaaaaccgaatctataccatcgaaacgacccgaaacaactcgaattc

SEQ ID NO: 9799 - DNA, 703 bp, Artificial Sequence
  chemically treated genomic DNA (Homo sapiens) CpG-island No: 9799
ttttttttgttttagataacggtagtttttttttaatttttttatcgattataagtttttttcgatgggttaagttgtggttttcgttcgttgttcgttttcggttttttcggcgttttttttttcgtttaggttttcgcgggtattttaggtttcggttcgagttttggtaggtcgttgtcgcgttattatttgttcggggattagtttttttcgtcgtcgttggttattcggttttgttcgttttttttaaagggaaatcgttgtttttatcgtcgttcggtcgttttgtttcgtttgcggtcgtatagtttttttatgtttcgcgtttaaaggaatgaattcggtcgcgttgttcgttacgtttcgttattcgagcgtttttcgtttttagtcggttcggattgtagcggttgtagcgattgttggacggatggtgtaatgggttgcgagtcgggggtcggataagtttgagcgtatattattgattgtgtcgttacgttattgggtcgggggagggcggcggcgcggttagtaatagtttaggcgcggggcggggcgtcgcggtcggggtgggcgacggggagggggcggggtttgaattattgggaggacgtgtttgcggtaacgcgttggggggcggggcgtttgcgtacgggggtcggatttgtgttatcgaagcggttcgaggtagttcgagttt

SEQ ID NO: 9800 - DNA, 703 bp, Artificial Sequence
  chemically treated genomic DNA (Homo sapiens) CpG-island No: 9800
aaactcgaactacctcgaaccgcttcgataacacaaatccgacccccgtacgcaaacgccccgccccccaacgcgttaccgcaaacacgtcctcccaataattcaaaccccgccccctccccgtcgcccaccccgaccgcgacgccccgccccgcgcctaaactattactaaccgcgccgccgccctcccccgacccaataacgtaacgacacaatcaataatatacgctcaaacttatccgacccccgactcgcaacccattacaccatccgtccaacaatcgctacaaccgctacaatccgaaccgactaaaaacgaaaaacgctcgaataacgaaacgtaacgaacaacgcgaccgaattcattcctttaaacgcgaaacataaaaaaactatacgaccgcaaacgaaacaaaacgaccgaacgacgataaaaacaacgatttccctttaaaaaaaacgaacaaaaccgaataaccaacgacgacgaaaaaaactaatccccgaacaaataataacgcgacaacgacctaccaaaactcgaaccgaaacctaaaatacccgcgaaaacctaaacgaaaaaaaaaacgccgaaaaaaccgaaaacgaacaacgaacgaaaaccacaacttaacccatcgaaaaaaacttataatcgataaaaaaattaaaaaaaaactaccgttatctaaaacaaaaaaaa

SEQ ID NO: 9801 - DNA, 684 bp, Artificial Sequence
  chemically treated genomic DNA (Homo sapiens) CpG-island No: 9801
gtcgtattttgcgatcgtcgttgtaaattagcgtattttaacgtcgttagttttgagcgtagcgttatagttattgtgcgttatatgattttaatggagtcggttttggtcgtttgtgtgattagtcgtcgtatgtcgaattggtaataagttgatttgtattgtagtttatgttattggtagcgtttagatgggtttgatatcgcgtatacgggtaataatgtcggcgcgttaaacgtttcggatattattttattcggcgtatttatatttagaagatgtcgttaacgtcggggttattgattgtttgttgtaggcgagtaatgattcgttgtaattcgttatttcggaataaggttgaagcgtacgggttttacgattagcgtgtcggaaatcggtaagatcgcgatattatttgttatttgaagttgcgtgatggacggggatttatgttattatttttattaaatagcgtagcggttcggttatttgttcggtattaagcgtgatgttagagacggtattgttagtcgggtgatgtttaattggttagttagcgcgtaaaagaaaatcgcgtataggcgggtttaagtattagcggtttattaaaggttatattggtatatgcggaagatatatagttcgtgcggtaaggcgagtatgttgtatattttgattagttcg

SEQ ID NO: 9802 - DNA, 684 bp, Artificial Sequence
  chemically treated genomic DNA (Homo sapiens) CpG-island No: 9802
cgaactaatcaaaatatacaacatactcgccttaccgcacgaactatatatcttccgcatataccaatataacctttaataaaccgctaatacttaaacccgcctatacgcgattttcttttacgcgctaactaaccaattaaacatcacccgactaacaataccgtctctaacatcacgcttaataccgaacaaataaccgaaccgctacgctatttaataaaaataataacataaatccccgtccatcacgcaacttcaaataacaaataatatcgcgatcttaccgatttccgacacgctaatcgtaaaacccgtacgcttcaaccttattccgaaataacgaattacaacgaatcattactcgcctacaacaaacaatcaataaccccgacgttaacgacatcttctaaatataaatacgccgaataaaataatatccgaaacgtttaacgcgccgacattattacccgtatacgcgatatcaaacccatctaaacgctaccaataacataaactacaatacaaatcaacttattaccaattcgacatacgacgactaatcacacaaacgaccaaaaccgactccattaaaatcatataacgcacaataactataacgctacgctcaaaactaacgacgttaaaatacgctaatttacaacgacgatcgcaaaatacgac

SEQ ID NO: 9803 - DNA, 684 bp, Artificial Sequence
  chemically treated genomic DNA (Homo sapiens) CpG-island No: 9803
cgaattagttagggtatataatatgttcgttttatcgtacgagttgtgtatttttcgtatatgttagtatggtttttaatgagtcgttgatgtttgaattcgtttatgcgcggtttttttttgcgcgttggttggttagttgggtattattcggttgataatatcgtttttggtattacgtttgatgtcggataaatagtcgaatcgttgcgttgtttggtgaggatgatgatatggattttcgtttattacgtagttttaggtggtaaatggtatcgcggttttgtcggttttcggtacgttggtcgtaaaattcgtgcgttttagttttatttcgggatgacgggttataacggattattgttcgtttgtagtaggtaattagtgatttcggcgttgacggtattttttggatatggatacgtcgggtggaatggtgttcggggcgtttgacgcgtcgatattattgttcgtatgcgcgatattaaatttatttgggcgttgttaatgatatgaattgtagtgtaggttagtttattgttagttcggtatgcgacggttggttatataaacggttagaatcggttttattggggttatgtggcgtatagtaattatggcgttgcgtttaaaattaacggcgttgaggtacgttgatttatagcggcgatcgtaaggtgcgat

SEQ ID NO: 9804 - DNA, 684 bp, Artificial Sequence
  chemically treated genomic DNA (Homo sapiens) CpG-island No: 9804
atcgcaccttacgatcgccgctataaatcaacgtacctcaacgccgttaattttaaacgcaacgccataattactatacgccacataaccccaataaaaccgattctaaccgtttatataaccaaccgtcgcataccgaactaacaataaactaacctacactacaattcatatcattaacaacgcccaaataaatttaatatcgcgcatacgaacaataatatcgacgcgtcaaacgccccgaacaccattccacccgacgtatccatatccaaaaaataccgtcaacgccgaaatcactaattacctactacaaacgaacaataatccgttataacccgtcatcccgaaataaaactaaaacgcacgaattttacgaccaacgtaccgaaaaccgacaaaaccgcgataccatttaccacctaaaactacgtaataaacgaaaatccatatcatcatcctcaccaaacaacgcaacgattcgactatttatccgacatcaaacgtaataccaaaaacgatattatcaaccgaataatacccaactaaccaaccaacgcgcaaaaaaaaaccgcgcataaacgaattcaaacatcaacgactcattaaaaaccatactaacatatacgaaaaatacacaactcgtacgataaaacgaacatattatataccctaactaattcg

SEQ ID NO: 9805 - DNA, 787 bp, Artificial Sequence
  chemically treated genomic DNA (Homo sapiens) CpG-island No: 9805
  misc_feature (746)..(746): n is either a, c, g or t
  misc_feature (752)..(752): n is either a, c, g or t
  misc_feature (766)..(767): n is either a, c, g or t
atagtcggatttatttgttcgtggaatgttttattcgtcgcgtcgatttattaagatcgacgatgttcgcgttgttgatgtttagtttcggttgttgttaagtgtattattcgtatcggtacgtaatgtttttatttaacgtaggttgttttttgatagtcgttttgatcgttggaaagcgaaatcgtcgtatcgtattgattgttagattttttttattatcgatttttgtcgaatatcggtcgttgcgttataggtttcgttatgttcggttaacgttagttttgtttattatggatgtttagcgtttttagtttatagttaacgtataaatattatttggtgcggtcgtgaggcggaatttataattattttcggcgatatcgtttcgttttgcgtaatgtgtaacgttttgttcgtttttatttcgtgttttgtaaattacgtaacgttaatgagttattcgatttaataatcgttgcgtttttattagttgaacgtcgatatggttatcgtcgtgttttagtaattgagcgtcgttagagggttattcgttatgggattattttacgggtttagtacgtcgataagtacgtcgttcgtttcgtttatttgatagttacggttttttaggtgtagttattcgcgtcgataattagcgtatcgacgttgatatttttttcgcgagcgtcgtagtaggaatattcgtatcgaaagatggatgttacgcgtcgtattttattggntcgagnttatatcgaagtgnngattgttttcgaatttttat

SEQ ID NO: 9806 - DNA, 787 bp, Artificial Sequence
  chemically treated genomic DNA (Homo sapiens) CpG-island No: 9806
  misc_feature (21)..(22): n is either a, c, g or t
  misc_feature (36)..(36): n is either a, c, g or t
  misc_feature (42)..(42): n is either a, c, g or t
ataaaaattcgaaaacaatcnncacttcgatataanctcganccaataaaatacgacgcgtaacatccatctttcgatacgaatattcctactacgacgctcgcgaaaaaaatatcaacgtcgatacgctaattatcgacgcgaataactacacctaaaaaaccgtaactatcaaataaacgaaacgaacgacgtacttatcgacgtactaaacccgtaaaataatcccataacgaataaccctctaacgacgctcaattactaaaacacgacgataaccatatcgacgttcaactaataaaaacgcaacgattattaaatcgaataactcattaacgttacgtaatttacaaaacacgaaataaaaacgaacaaaacgttacacattacgcaaaacgaaacgatatcgccgaaaataattataaattccgcctcacgaccgcaccaaataatatttatacgttaactataaactaaaaacgctaaacatccataataaacaaaactaacgttaaccgaacataacgaaacctataacgcaacgaccgatattcgacaaaaatcgataataaaaaaaatctaacaatcaatacgatacgacgatttcgctttccaacgatcaaaacgactatcaaaaaacaacctacgttaaataaaaacattacgtaccgatacgaataatacacttaacaacaaccgaaactaaacatcaacaacgcgaacatcgtcgatcttaataaatcgacgcgacgaataaaacattccacgaacaaataaatccgactat

SEQ ID NO: 9807 - DNA, 787 bp, Artificial Sequence
  chemically treated genomic DNA (Homo sapiens) CpG-island No: 9807
  misc_feature (21)..(22): n is either a, c, g or t
  misc_feature (36)..(36): n is either a, c, g or t
  misc_feature (42)..(42): n is either a, c, g or t
gtaaaagttcggaagtaattnntatttcggtgtganttcggnttagtggaatgcgacgcgtagtatttatttttcgatacggatatttttgttgcgacgttcgcggagggaatattagcgtcgatacgttggttgtcggcgcgggtgattatatttggaaggtcgtaattattaggtaaacgggacgggcgacgtgtttatcgacgtgttaaattcgtggaatgattttatggcgaataattttttgacgacgtttaattgttggaatacgacgatagttatgtcggcgtttaattggtgaaggcgtaacggttattgggtcgggtggtttattaacgttacgtgatttatagggtacgaggtggaagcggataaaacgttatatattgcgtaaaacggaacggtgtcgtcgagggtgattatggatttcgttttacgatcgtattaggtaatgtttgtacgttaattatgggttgaaagcgttgaatatttatggtgggtaaagttgacgttagtcgaatatggcggagtttatggcgtaacggtcgatattcggtaaaaatcggtggtgaaggggatttggtaattaatacggtgcgacggtttcgttttttaacggttagaacgattattagggggtaatttacgttagatggggatattacgtatcgatgcggatggtgtatttggtaataatcggaattgaatattagtaacgcggatatcgtcgattttaatggatcgacgcgacgggtaagatattttacgggtagatgggttcgattgt

SEQ ID NO: 9808 - DNA, 787 bp, Artificial Sequence
  chemically treated genomic DNA (Homo sapiens) CpG-island No: 9808
  misc_feature (746)..(746): n is either a, c, g or t
  misc_feature (752)..(752): n is either a, c, g or t
  misc_feature (766)..(767): n is either a, c, g or t
acaatcgaacccatctacccgtaaaatatcttacccgtcgcgtcgatccattaaaatcgacgatatccgcgttactaatattcaattccgattattaccaaatacaccatccgcatcgatacgtaatatccccatctaacgtaaattaccccctaataatcgttctaaccgttaaaaaacgaaaccgtcgcaccgtattaattaccaaatccccttcaccaccgatttttaccgaatatcgaccgttacgccataaactccgccatattcgactaacgtcaactttacccaccataaatattcaacgctttcaacccataattaacgtacaaacattacctaatacgatcgtaaaacgaaatccataatcaccctcgacgacaccgttccgttttacgcaatatataacgttttatccgcttccacctcgtaccctataaatcacgtaacgttaataaaccacccgacccaataaccgttacgccttcaccaattaaacgccgacataactatcgtcgtattccaacaattaaacgtcgtcaaaaaattattcgccataaaatcattccacgaatttaacacgtcgataaacacgtcgcccgtcccgtttacctaataattacgaccttccaaatataatcacccgcgccgacaaccaacgtatcgacgctaatattccctccgcgaacgtcgcaacaaaaatatccgtatcgaaaaataaatactacgcgtcgcattccactaanccgaantcacaccgaaatannaattacttccgaacttttac

SEQ ID NO: 9809 - DNA, 591 bp, Artificial Sequence
  chemically treated genomic DNA (Homo sapiens) CpG-island No: 9809
  misc_feature (462)..(462): n is either a, c, g or t
  misc_feature (468)..(468): n is either a, c, g or t
  misc_feature (470)..(471): n is either a, c, g or t
  misc_feature (555)..(555): n is either a, c, g or t
  misc_feature (560)..(560): n is either a, c, g or t
  misc_feature (574)..(574): n is either a, c, g or t
  misc_feature (578)..(578): n is either a, c, g or t
  misc_feature (580)..(580): n is either a, c, g or t
  misc_feature (583)..(585): n is either a, c, g or t
ttttgtaacggcgcgttttttgtatgagtcgttgttttggcgtacggtgtgtattatcgcgtattgttggtcgtttgggttattcgttgtagtcgtcgggtgtgttcgttgtttttcggtcgcggttttgtggagggttttatttggtgcgatagtttcgtatttcgtttgaatggtacgcgcgtagattcgattatataagagtcgttatgaaatttatgcgaataaaggttgtagattcgattttatattatatttgcggaaaattagaatacgtttttatttatataatttcggtcggtttcgcgttttttatagaaaatatataataatatattatattatttattttttttattcgatagcgtgattttgaagttcggtagtttggatttggtcgatggtacgcggtagtggatattaaatcgtattttttttttgtcgaatcgtttttcggattgntttagntnngttagttatgcgtaaagtgcgttagcgtgtagagatgcggtgagttttatcgtagaggtcgaaaagtagtttttgacgttggangagtnggttattttcggtnaggntntannnacgcgt

SEQ ID NO: 9810 - DNA, 591 bp, Artificial Sequence
  chemically treated genomic DNA (Homo sapiens) CpG-island No: 9810
  misc_feature (7)..(9): n is either a, c, g or t
  misc_feature (12)..(12): n is either a, c, g or t
  misc_feature (14)..(14): n is either a, c, g or t
  misc_feature (18)..(18): n is either a, c, g or t
  misc_feature (32)..(32): n is either a, c, g or t
  misc_feature (37)..(37): n is either a, c, g or t
  misc_feature (121)..(122): n is either a, c, g or t
  misc_feature (124)..(124): n is either a, c, g or t
  misc_feature (130)..(130): n is either a, c, g or t
acgcgtnnntanancctnaccgaaaataaccnactcntccaacgtcaaaaactacttttcgacctctacgataaaactcaccgcatctctacacgctaacgcactttacgcataactaacnnanctaaancaatccgaaaaacgattcgacaaaaaaaaaatacgatttaatatccactaccgcgtaccatcgaccaaatccaaactaccgaacttcaaaatcacgctatcgaataaaaaaaataaataatataatatattattatatattttctataaaaaacgcgaaaccgaccgaaattatataaataaaaacgtattctaattttccgcaaatataatataaaatcgaatctacaacctttattcgcataaatttcataacgactcttatataatcgaatctacgcgcgtaccattcaaacgaaatacgaaactatcgcaccaaataaaaccctccacaaaaccgcgaccgaaaaacaacgaacacacccgacgactacaacgaataacccaaacgaccaacaatacgcgataatacacaccgtacgccaaaacaacgactcatacaaaaaacgcgccgttacaaaa

SEQ ID NO: 9811 - DNA, 591 bp, Artificial Sequence
  chemically treated genomic DNA (Homo sapiens) CpG-island No: 9811
  misc_feature (7)..(9): n is either a, c, g or t
  misc_feature (12)..(12): n is either a, c, g or t
  misc_feature (14)..(14): n is either a, c, g or t
  misc_feature (18)..(18): n is either a, c, g or t
  misc_feature (32)..(32): n is either a, c, g or t
  misc_feature (37)..(37): n is either a, c, g or t
  misc_feature (121)..(122): n is either a, c, g or t
  misc_feature (124)..(124): n is either a, c, g or t
  misc_feature (130)..(130): n is either a, c, g or t
acgcgtnnntanantttngtcgggaataattngtttntttagcgttaaaagttgtttttcgatttttgcggtaaaatttatcgtatttttgtacgttggcgtattttgcgtatagttggtnnanttgggntaattcgggaagcgattcggtaaaggggagatacggtttgatatttattatcgcgtattatcgattagatttagattgtcgagttttagaattacgttgtcgggtggggggggtgggtggtgtggtgtgttgttgtgtgttttttgtagaaaacgcggagtcgatcggggttgtatgggtgggggcgtgttttggtttttcgtaggtgtggtgtggagtcgaatttgtagtttttgttcgtatggattttatggcggtttttgtgtgatcgggtttgcgcgcgtgttatttaagcggggtgcgggattgtcgtattagatggaattttttataaagtcgcggtcggggaataacgagtatattcggcggttatagcgggtaatttaggcgattagtaatgcgcggtagtgtatatcgtgcgttaaagtagcggtttatgtaaggaacgcgtcgttatagga

SEQ ID NO: 9812 - DNA, 591 bp, Artificial Sequence
  chemically treated genomic DNA (Homo sapiens) CpG-island No: 9812
  misc_feature (462)..(462): n is either a, c, g or t
  misc_feature (468)..(468): n is either a, c, g or t
  misc_feature (470)..(471): n is either a, c, g or t
  misc_feature (555)..(555): n is either a, c, g or t
  misc_feature (560)..(560): n is either a, c, g or t
  misc_feature (574)..(574): n is either a, c, g or t
  misc_feature (578)..(578): n is either a, c, g or t
  misc_feature (580)..(580): n is either a, c, g or t
  misc_feature (583)..(585): n is either a, c, g or t
tcctataacgacgcgttccttacataaaccgctactttaacgcacgatatacactaccgcgcattactaatcgcctaaattacccgctataaccgccgaatatactcgttattccccgaccgcgactttataaaaaattccatctaatacgacaatcccgcaccccgcttaaataacacgcgcgcaaacccgatcacacaaaaaccgccataaaatccatacgaacaaaaactacaaattcgactccacaccacacctacgaaaaaccaaaacacgcccccacccatacaaccccgatcgactccgcgttttctacaaaaaacacacaacaacacaccacaccacccaccccccccacccgacaacgtaattctaaaactcgacaatctaaatctaatcgataatacgcgataataaatatcaaaccgtatctcccctttaccgaatcgcttcccgaattancccaantnnaccaactatacgcaaaatacgccaacgtacaaaaatacgataaattttaccgcaaaaatcgaaaaacaacttttaacgctaaanaaacnaattattcccgacnaaantntannnacgcgt

SEQ ID NO: 9813 - DNA, 520 bp, Artificial Sequence
  chemically treated genomic DNA (Homo sapiens) CpG-island No: 9813
  misc_feature (69)..(69): n is either a, c, g or t
  misc_feature (101)..(101): n is either a, c, g or t
  misc_feature (111)..(112): n is either a, c, g or t
  misc_feature (177)..(178): n is either a, c, g or t
  misc_feature (410)..(410): n is either a, c, g or t
ttttacgaacgggtcgtgtattggtgtaaaatttttgtgcgttattttaagttttaatatcgcgtttgncgagtatattttcgtttttcgttagattaggncgttaattanngcgatagagtgcgtcgcgattcgatttgcgttttttcgtaagtagggttgcggtaagttttggannatggcgtattgtggcgtttttgaatggcgggtattttatcgtttcgttacgttatttagtagtaggtgatattttataattcgcgataatggtttgcgattttttaggtataaattttgggttttcgattgttcgggattaggttataagcgtaggtttcggagaaatacgggtaaaaaaatcgggtgtaacgcggtttttgtgcggggcgttggttttgggttattcgggnatttcggtttattaggatataattggtgtatcggtttttcgggggaggttgtgtatggtggtttcgtaggttttcgagaatattatgttgtttttttaatcggttttaaa

SEQ ID NO: 9814 - DNA, 520 bp, Artificial Sequence
  chemically treated genomic DNA (Homo sapiens) CpG-island No: 9814
  misc_feature (111)..(111): n is either a, c, g or t
  misc_feature (343)..(344): n is either a, c, g or t
  misc_feature (409)..(410): n is either a, c, g or t
  misc_feature (420)..(420): n is either a, c, g or t
  misc_feature (452)..(452): n is either a, c, g or t
tttaaaaccgattaaaaaaacaacataatattctcgaaaacctacgaaaccaccatacacaacctcccccgaaaaaccgatacaccaattatatcctaataaaccgaaatncccgaataacccaaaaccaacgccccgcacaaaaaccgcgttacacccgatttttttacccgtatttctccgaaacctacgcttataacctaatcccgaacaatcgaaaacccaaaatttatacctaaaaaatcgcaaaccattatcgcgaattataaaatatcacctactactaaataacgtaacgaaacgataaaatacccgccattcaaaaacgccacaatacgccatnntccaaaacttaccgcaaccctacttacgaaaaaacgcaaatcgaatcgcgacgcactctatcgcnntaattaacgncctaatctaacgaaaaacgaaaatatactcgncaaacgcgatattaaaacttaaaataacgcacaaaaattttacaccaatacacgacccgttcgtaaaa

SEQ ID NO: 9815 - DNA, 520 bp, Artificial Sequence
  chemically treated genomic DNA (Homo sapiens) CpG-island No: 9815
  misc_feature (111)..(111): n is either a, c, g or t
  misc_feature (343)..(344): n is either a, c, g or t
  misc_feature (409)..(410): n is either a, c, g or t
  misc_feature (420)..(420): n is either a, c, g or t
  misc_feature (452)..(452): n is either a, c, g or t
tttgaggtcgattaaaagaataatatagtattttcgaaaatttgcggaattattatgtatagtttttttcgagagatcggtatattagttgtgttttgataagtcgagatnttcgggtgatttaagattaacgtttcgtataggggtcgcgttatattcggtttttttgttcgtgttttttcggggtttgcgtttataatttaatttcgggtaatcgaggatttaggatttgtatttgaggagtcgtaagttattatcgcgggttgtggaatattatttgttattgaatggcgtaacgggacgataaagtattcgttatttaggggcgttatagtgcgttatnntttagggtttgtcgtaattttgtttgcggaaaggcgtagatcgggtcgcggcgtattttgtcgtnntaattaacgntttagtttggcgaaaggcgggaatgtgttcgntaagcgcggtattaaagtttgggataacgtataggggttttgtattagtgtacgattcgttcgtaaaa

SEQ ID NO: 9816 - DNA, 520 bp, Artificial Sequence
  chemically treated genomic DNA (Homo sapiens) CpG-island No: 9816
  misc_feature (69)..(69): n is either a, c, g or t
  misc_feature (101)..(101): n is either a, c, g or t
  misc_feature (111)..(112): n is either a, c, g or t
  misc_feature (177)..(178): n is either a, c, g or t
  misc_feature (410)..(410): n is either a, c, g or t
ttttacgaacgaatcgtacactaatacaaaacccctatacgttatcccaaactttaataccgcgcttancgaacacattcccgcctttcgccaaactaaancgttaattannacgacaaaatacgccgcgacccgatctacgcctttccgcaaacaaaattacgacaaaccctaaannataacgcactataacgcccctaaataacgaatactttatcgtcccgttacgccattcaataacaaataatattccacaacccgcgataataacttacgactcctcaaatacaaatcctaaatcctcgattacccgaaattaaattataaacgcaaaccccgaaaaaacacgaacaaaaaaaccgaatataacgcgacccctatacgaaacgttaatcttaaatcacccgaanatctcgacttatcaaaacacaactaatataccgatctctcgaaaaaaactatacataataattccgcaaattttcgaaaatactatattattcttttaatcgacctcaaa

SEQ ID NO: 9817 - DNA, 788 bp, Artificial Sequence
  chemically treated genomic DNA (Homo sapiens) CpG-island No: 9817
ttattggcgatcgttagcggggttataaataaattgtgttgcggtaaatgtatttgtaacgtcgggaattgtttgcgaaatagtttcgttacgttcggttgtatataagagtcgttcgttagttataaattagtaatgttttgttttttaatatgtcgggcgataatgttcgttattttttcgtatatcggttttatcgtaggttaaatttttttatcgtgatcgcgtttgtattgtttcgttttttttagcgaaatacggcgattttcggcgagagttagagagatgtgatgttcgtcggtggttttattcgtcgagtacgttattttgtttttttttacgatggtaatgtcggtagtgtcgtcgtcgatatttattatatcggcgttgtttagttgtagtagattcgtaattgcggttggtttatttagtatatggtttatttttagttcggtagattttagtacgttgatggaaatacgcgggttcgtatttggaggaaatgaagtcgtcgtatggtttaaacgacgatcgaattgttgttcgagcgtgtcgagatggcgacgaataatggtgatagcgtttaagaaattttagacgatgtcgtcgcgaattatatcggtttagttcgaggtatattcgttattggtttgatcgtcgcggtcgataattatcgatattatattcgtagtgtttagatttattttaggtatagcggagatttcgtcgcggcgggcgtttggtttatagcgttgtcgtcgtttgtagacgtggggtgagtttttgtt

SEQ ID NO: 9818 - DNA, 788 bp, Artificial Sequence
  chemically treated genomic DNA (Homo sapiens) CpG-island No: 9818
aacaaaaactcaccccacgtctacaaacgacgacaacgctataaaccaaacgcccgccgcgacgaaatctccgctatacctaaaataaatctaaacactacgaatataatatcgataattatcgaccgcgacgatcaaaccaataacgaatatacctcgaactaaaccgatataattcgcgacgacatcgtctaaaatttcttaaacgctatcaccattattcgtcgccatctcgacacgctcgaacaacaattcgatcgtcgtttaaaccatacgacgacttcatttcctccaaatacgaacccgcgtatttccatcaacgtactaaaatctaccgaactaaaaataaaccatatactaaataaaccaaccgcaattacgaatctactacaactaaacaacgccgatataataaatatcgacgacgacactaccgacattaccatcgtaaaaaaaaacaaaataacgtactcgacgaataaaaccaccgacgaacatcacatctctctaactctcgccgaaaatcgccgtatttcgctaaaaaaaacgaaacaatacaaacgcgatcacgataaaaaaatttaacctacgataaaaccgatatacgaaaaaataacgaacattatcgcccgacatattaaaaaacaaaacattactaatttataactaacgaacgactcttatatacaaccgaacgtaacgaaactatttcgcaaacaattcccgacgttacaaatacatttaccgcaacacaatttatttataaccccgctaacgatcgccaataa

SEQ ID NO: 9819 - DNA, 788 bp, Artificial Sequence
  chemically treated genomic DNA (Homo sapiens) CpG-island No: 9819
aataagggtttattttacgtttgtaaacggcggtaacgttgtgaattagacgttcgtcgcgacggaattttcgttgtgtttggggtgaatttgggtattgcgaatgtggtgtcgatggttgtcgatcgcgacggttaagttagtggcgggtatgtttcggattgggtcgatgtggttcgcgacggtatcgtttgggattttttgggcgttgttattattgttcgtcgttatttcgatacgttcgagtagtaattcggtcgtcgtttaagttatgcggcgattttattttttttaggtacggattcgcgtatttttattaacgtgttggaatttgtcggattggaagtgagttatgtgttggatgagttaatcgtagttgcggatttgttgtaattggataacgtcggtgtagtggatatcggcggcggtattatcggtattgttatcgtgaaaaagggtaaggtgacgtattcggcggatgaagttatcggcggatattatatttttttgattttcgtcggaaatcgtcgtatttcgttggaagaggcggagtagtataagcgcggttacggtgaagagatttggtttgcggtgaaatcggtgtacgaaaaaatggcggatattgtcgttcggtatattgaagggtagggtattattgatttatggttggcgggcggtttttgtatgtaatcgggcgtggcggaattgtttcgtaaataattttcggcgttataggtgtatttatcgtagtatagtttgtttatgatttcgttggcgatcgttagtag

SEQ ID NO: 9820 - DNA, 788 bp, Artificial Sequence
  chemically treated genomic DNA (Homo sapiens) CpG-island No: 9820
ctactaacgatcgccaacgaaatcataaacaaactatactacgataaatacacctataacgccgaaaattatttacgaaacaattccgccacgcccgattacatacaaaaaccgcccgccaaccataaatcaataataccctacccttcaatataccgaacgacaatatccgccattttttcgtacaccgatttcaccgcaaaccaaatctcttcaccgtaaccgcgcttatactactccgcctcttccaacgaaatacgacgatttccgacgaaaatcaaaaaaatataatatccgccgataacttcatccgccgaatacgtcaccttaccctttttcacgataacaataccgataataccgccgccgatatccactacaccgacgttatccaattacaacaaatccgcaactacgattaactcatccaacacataactcacttccaatccgacaaattccaacacgttaataaaaatacgcgaatccgtacctaaaaaaaataaaatcgccgcataacttaaacgacgaccgaattactactcgaacgtatcgaaataacgacgaacaataataacaacgcccaaaaaatcccaaacgataccgtcgcgaaccacatcgacccaatccgaaacatacccgccactaacttaaccgtcgcgatcgacaaccatcgacaccacattcgcaatacccaaattcaccccaaacacaacgaaaattccgtcgcgacgaacgtctaattcacaacgttaccgccgtttacaaacgtaaaataaacccttatt

SEQ ID NO: 9821 - DNA, 848 bp, Artificial Sequence
  chemically treated genomic DNA (Homo sapiens) CpG-island No: 9821
  misc_feature (663)..(664): n is either a, c, g or t
  misc_feature (671)..(672): n is either a, c, g or t
gttgtcgtaaagtaaaaattgggtcgttaatttcgggtgatttattacgtattttacgaagtagagcgtcgtttcgtcgcgtattacgttggagtaggtcgttattattttgaacgcgtatatgatgcgttattggttgttgtttagtagtagtttaaggtttttcgttatcgacgagttcggttgtattttaaaggtgtagcgttttttggtcgtgaagaagtagacgtagagtagtattacgtcgtttagttttagtacgtatatggcgtcgaagtagtttatttgttcgttttttttgtcgatgatgtttattagcggtagcgcgatgtcgttgatagcgagcgagttcgtcgtcgttaggaagaagcgttaggattgtagggcgtgacgttttttcgggtcggcggtgatgacgttcggtatggcgtagtacggtacgttaacgaaggtgtagattagggttaggagaatgtaggttacgtaggcgtagatgattttgtttgtgcggagaagttcggcgtgtagaaggttagtacgtagacgatgtcgaacgggatggttttttatagtaggaacgggcggaattggtcgtgtcgcgtgcgggtgcggtttattagtagttttattagcgggtcggtgacggcgtcgagataacgcggnngagattnnaaaaatagcgtgtttataattttcgtcgataggtcgaagacgtcggtgtagaaataggttagtaggaatatcgtggtttgttagacgaagtcgtaggcggtgttttttagttcgtagttaattttgttttttatggttaattgcgttattagaattatatttttatgtagtgtgtt

SEQ ID NO: 9822 - DNA, 848 bp, Artificial Sequence
  chemically treated genomic DNA (Homo sapiens) CpG-island No: 9822
  misc_feature (177)..(178): n is either a, c, g or t
  misc_feature (185)..(186): n is either a, c, g or t
aacacactacataaaaatataattctaataacgcaattaaccataaaaaacaaaattaactacgaactaaaaaacaccgcctacgacttcgtctaacaaaccacgatattcctactaacctatttctacaccgacgtcttcgacctatcgacgaaaattataaacacgctatttttnnaatctcnnccgcgttatctcgacgccgtcaccgacccgctaataaaactactaataaaccgcacccgcacgcgacacgaccaattccgcccgttcctactataaaaaaccatcccgttcgacatcgtctacgtactaaccttctacacgccgaacttctccgcacaaacaaaatcatctacgcctacgtaacctacattctcctaaccctaatctacaccttcgttaacgtaccgtactacgccataccgaacgtcatcaccgccgacccgaaaaaacgtcacgccctacaatcctaacgcttcttcctaacgacgacgaactcgctcgctatcaacgacatcgcgctaccgctaataaacatcatcgacaaaaaaaacgaacaaataaactacttcgacgccatatacgtactaaaactaaacgacgtaatactactctacgtctacttcttcacgaccaaaaaacgctacacctttaaaatacaaccgaactcgtcgataacgaaaaaccttaaactactactaaacaacaaccaataacgcatcatatacgcgttcaaaataataacgacctactccaacgtaatacgcgacgaaacgacgctctacttcgtaaaatacgtaataaatcacccgaaattaacgacccaatttttactttacgacaac

SEQ ID NO: 9823 - DNA, 848 bp, Artificial Sequence
  chemically treated genomic DNA (Homo sapiens) CpG-island No: 9823
  misc_feature (177)..(178): n is either a, c, g or t
  misc_feature (185)..(186): n is either a, c, g or t
ggtatattatataagggtgtaattttgatgacgtaattaattatgaaagataaaattggttacgggttgggagatatcgtttgcggtttcgtttggtaggttacgatgtttttgttggtttatttttatatcgacgttttcggtttgtcggcggggattatgggtacgttgtttttnnggttttnntcgcgttgtttcgacgtcgttatcgattcgttgatggggttgttggtagatcgtattcgtacgcggtacggttagtttcgttcgtttttgttgtggggggttatttcgttcggtatcgtttgcgtgttgattttttatacgtcggattttttcgtataggtaagattatttacgtttgcgtgatttatatttttttgattttggtttatattttcgttaacgtgtcgtattgcgttatgtcgggcgttattatcgtcgattcgaaagagcgttacgttttgtagttttggcgtttttttttggcggcggcgggttcgttcgttattagcggtatcgcgttgtcgttggtgagtattatcggtaaaggggacgagtaggtgggttatttcggcgttatgtgcgtgttggggttgagcggcgtggtgttgttttacgtttgtttttttacgattaaagagcgttatatttttgaggtgtagtcgggttcgtcggtggcgaaagattttaagttgttgttgggtaatagttagtggcgtattatgtgcgcgtttaagatgatggcgatttgttttaacgtggtgcgcggcggggcgacgttttatttcgtgaaatacgtgatggattattcggagttggcgatttagtttttattttacggtagt

SEQ ID NO: 9824 - DNA, 848 bp, Artificial Sequence
  chemically treated genomic DNA (Homo sapiens) CpG-island No: 9824
  misc_feature (663)..(664): n is either a, c, g or t
  misc_feature (671)..(672): n is either a, c, g or t
actaccgtaaaataaaaactaaatcgccaactccgaataatccatcacgtatttcacgaaataaaacgtcgccccgccgcgcaccacgttaaaacaaatcgccatcatcttaaacgcgcacataatacgccactaactattacccaacaacaacttaaaatctttcgccaccgacgaacccgactacacctcaaaaatataacgctctttaatcgtaaaaaaacaaacgtaaaacaacaccacgccgctcaaccccaacacgcacataacgccgaaataacccacctactcgtcccctttaccgataatactcaccaacgacaacgcgataccgctaataacgaacgaacccgccgccgccaaaaaaaaacgccaaaactacaaaacgtaacgctctttcgaatcgacgataataacgcccgacataacgcaatacgacacgttaacgaaaatataaaccaaaatcaaaaaaatataaatcacgcaaacgtaaataatcttacctatacgaaaaaatccgacgtataaaaaatcaacacgcaaacgataccgaacgaaataaccccccacaacaaaaacgaacgaaactaaccgtaccgcgtacgaatacgatctaccaacaaccccatcaacgaatcgataacgacgtcgaaacaacgcgannaaaaccnnaaaaacaacgtacccataatccccgccgacaaaccgaaaacgtcgatataaaaataaaccaacaaaaacatcgtaacctaccaaacgaaaccgcaaacgatatctcccaacccgtaaccaattttatctttcataattaattacgtcatcaaaattacacccttatataatatacc

SEQ ID NO: 9825 - DNA, 538 bp, Artificial Sequence
  chemically treated genomic DNA (Homo sapiens) CpG-island No: 9825
ttttgggtcgatttgttattttcgcgggtaacgtggcgttagaaaatttcggttttcgtattttcggttttggtgtcggtcgtgaagacgtttgggaatcggatttggatgttaattggggtgatgaaaaagtttggttgatttatcgttattcggaagcgttggcgaaagtatcgttgggtgtaatcgagatgggtttgatttacgttaattcggaaggttcggattatagcggcgaatcgttttttgcggtagtagttattcgcgcgattttcggtaatatgggtatgaacgacgaagaaatcgtggcgttgattgcgggtggttatacgttgggtaaaatttacggtgtcggttcgatattaaatgtaggttttgatttagaagttgtatcgattgaagaataaggtttaggttgggcgagtatttacggtagcggcgttggcgtagatgttattatttttggtttggaagtagtttggatttagacgtcgatttagtggagtaattattttttcgagaatttgtttaagtatga

SEQ ID NO: 9826 - DNA, 538 bp, Artificial Sequence
  chemically treated genomic DNA (Homo sapiens) CpG-island No: 9826
tcatacttaaacaaattctcgaaaaaataattactccactaaatcgacgtctaaatccaaactacttccaaaccaaaaataataacatctacgccaacgccgctaccgtaaatactcgcccaacctaaaccttattcttcaatcgatacaacttctaaatcaaaacctacatttaatatcgaaccgacaccgtaaattttacccaacgtataaccacccgcaatcaacgccacgatttcttcgtcgttcatacccatattaccgaaaatcgcgcgaataactactaccgcaaaaaacgattcgccgctataatccgaaccttccgaattaacgtaaatcaaacccatctcgattacacccaacgatactttcgccaacgcttccgaataacgataaatcaaccaaactttttcatcaccccaattaacatccaaatccgattcccaaacgtcttcacgaccgacaccaaaaccgaaaatacgaaaaccgaaattttctaacgccacgttacccgcgaaaataacaaatcgacccaaaa

SEQ ID NO: 9827 - DNA, 538 bp, Artificial Sequence
  chemically treated genomic DNA (Homo sapiens) CpG-island No: 9827
ttatatttgaataggttttcgaagaaatagttgttttattgggtcggcgtttgggtttagattatttttagattagaggtaatggtatttgcgttaacgtcgttgtcgtaagtgttcgtttaatttaaattttgttttttaatcggtgtagtttttggattaggatttatatttgatgtcggatcggtatcgtgggttttatttagcgtatgattattcgtaattagcgttacggttttttcgtcgtttatgtttatgttgtcgaaggtcgcgcggatagttgttgtcgtagaaagcggttcgtcgttgtgattcgggtttttcgggttaacgtaaattagatttatttcggttgtatttagcggtgttttcgttagcgttttcggatgacggtgagttagttaggtttttttattattttagttaatatttagattcggtttttagacgtttttacgatcggtattaaaatcgaaggtacggaagtcggagttttttagcgttacgttattcgcgaggataataggtcggtttagga

SEQ ID NO: 9828 - DNA, 538 bp, Artificial Sequence
  chemically treated genomic DNA (Homo sapiens) CpG-island No: 9828
tcctaaaccgacctattatcctcgcgaataacgtaacgctaaaaaactccgacttccgtaccttcgattttaataccgatcgtaaaaacgtctaaaaaccgaatctaaatattaactaaaataataaaaaaacctaactaactcaccgtcatccgaaaacgctaacgaaaacaccgctaaatacaaccgaaataaatctaatttacgttaacccgaaaaacccgaatcacaacgacgaaccgctttctacgacaacaactatccgcgcgaccttcgacaacataaacataaacgacgaaaaaaccgtaacgctaattacgaataatcatacgctaaataaaacccacgataccgatccgacatcaaatataaatcctaatccaaaaactacaccgattaaaaaacaaaatttaaattaaacgaacacttacgacaacgacgttaacgcaaataccattacctctaatctaaaaataatctaaacccaaacgccgacccaataaaacaactatttcttcgaaaacctattcaaatataa

SEQ ID NO: 9829 - DNA, 709 bp, Artificial Sequence
  chemically treated genomic DNA (Homo sapiens) CpG-island No: 9829
tcgttcgttaaagtcgttttgttgtattagtcggtttagcgtatcgtaattgaagacgttgtggttgtcgttttcgttggttaggttgatgatacgttcggtagtatcgtattttatattgcgcgttagttcgttttgcgtggtgttgatcgtttttttttacgtatcgtattgtgtttcgtttcggttgtcgttcggggtgataacggtagttaggtcgtttgcggcgttgtatttatatcgcgttttacggttttgtgcgttttttattcgaggttaatcggttacggttgtttatagcggacggtaaggttgatgtttttttcgcggtggatcgcgtatatttggtcgaagcggtcgtatttataacgggtttggtagttcgagtagtcggtgaacgttagtaattgttcgtagcggttttaggttatttgtcgggtgttgttcgtcgtattcgttgtcgtcgtcggtaatttattgtgcgcgttatcgtagcggtagcgtattgttttttcgttgcgcgatgttttcgatattagtttgttcggtttattatattttacggcggttttttagttcgttcggggatatatatacgaacgatttagtttggttttcggatcgattatagataaatatttcgttttttcgtaatcgttataggatgtgggtgatgatttcgtggatatcgtatagggatattaacgat

SEQ ID NO: 9830 - DNA, 709 bp, Artificial Sequence
  chemically treated genomic DNA (Homo sapiens) CpG-island No: 9830
atcgttaatatccctatacgatatccacgaaatcatcacccacatcctataacgattacgaaaaaacgaaatatttatctataatcgatccgaaaaccaaactaaatcgttcgtatatatatccccgaacgaactaaaaaaccgccgtaaaatataataaaccgaacaaactaatatcgaaaacatcgcgcaacgaaaaaacaatacgctaccgctacgataacgcgcacaataaattaccgacgacgacaacgaatacgacgaacaacacccgacaaataacctaaaaccgctacgaacaattactaacgttcaccgactactcgaactaccaaacccgttataaatacgaccgcttcgaccaaatatacgcgatccaccgcgaaaaaaacatcaaccttaccgtccgctataaacaaccgtaaccgattaacctcgaataaaaaacgcacaaaaccgtaaaacgcgatataaatacaacgccgcaaacgacctaactaccgttatcaccccgaacgacaaccgaaacgaaacacaatacgatacgtaaaaaaaaacgatcaacaccacgcaaaacgaactaacgcgcaatataaaatacgatactaccgaacgtatcatcaacctaaccaacgaaaacgacaaccacaacgtcttcaattacgatacgctaaaccgactaatacaacaaaacgactttaacgaacga

SEQ ID NO: 9831 - DNA, 709 bp, Artificial Sequence
  chemically treated genomic DNA (Homo sapiens) CpG-island No: 9831
atcgttggtgtttttgtgcgatatttacgggattattatttatattttgtgacggttgcgggaagacgaaatgtttatttataatcgattcgggaattaggttggatcgttcgtgtgtgtgttttcggacgggttggagagtcgtcgtggaatatgatgaatcgggtaggttggtatcggagatatcgcgtagcggggagatagtacgttatcgttacgatgacgcgtatagtgagttatcggcgacgataacggatgcgacgggtagtattcggtagatgatttggagtcgttacgggtagttgttggcgtttatcgattgttcgggttattagattcgttatgaatacgatcgtttcggttagatgtacgcggtttatcgcgaggaaggtattagttttatcgttcgttatggataatcgtggtcggttaatttcgggtgaaagacgtatagggtcgtgaaacgcggtatgaatataacgtcgtaggcgatttgattgtcgttattatttcggacggtaatcggagcgagatatagtacgatgcgtggggaaaggcggttagtattacgtagggcgggttgacgcgtagtatggagtacgatgttgtcggacgtgttattagtttgattaacgagaacggtagttatagcgtttttagttacgatgcgttggatcggttggtatagtagggcggttttgacgggcgg

SEQ ID NO: 9832 - DNA, 709 bp, Artificial Sequence
  chemically treated genomic DNA (Homo sapiens) CpG-island No: 9832
ccgcccgtcaaaaccgccctactataccaaccgatccaacgcatcgtaactaaaaacgctataactaccgttctcgttaatcaaactaataacacgtccgacaacatcgtactccatactacgcgtcaacccgccctacgtaatactaaccgcctttccccacgcatcgtactatatctcgctccgattaccgtccgaaataataacgacaatcaaatcgcctacgacgttatattcataccgcgtttcacgaccctatacgtctttcacccgaaattaaccgaccacgattatccataacgaacgataaaactaataccttcctcgcgataaaccgcgtacatctaaccgaaacgatcgtattcataacgaatctaataacccgaacaatcgataaacgccaacaactacccgtaacgactccaaatcatctaccgaatactacccgtcgcatccgttatcgtcgccgataactcactatacgcgtcatcgtaacgataacgtactatctccccgctacgcgatatctccgataccaacctacccgattcatcatattccacgacgactctccaacccgtccgaaaacacacacacgaacgatccaacctaattcccgaatcgattataaataaacatttcgtcttcccgcaaccgtcacaaaatataaataataatcccgtaaatatcgcacaaaaacaccaacgat

SEQ ID NO: 9833 - DNA, 1109 bp, Artificial Sequence
  chemically treated genomic DNA (Homo sapiens) CpG-island No: 9833
ttggcgttggtggcgatggtcggtgtaggcgttattcgtaattcgttgtattgttatcgtttttggtagtaattgaaaggttagtcggtcgaatttatttggtagttcgatgacggtattagtttggtggtagtattgcgtatcggttcgatcgaaagtttgatttaggggttgtattagttcgtttttcgcgtagaaaaacgtatcggtttggtattgttcggtaagggtaatatcggttttcgttggttggaattgttcgttcgtgagtagagtacgttttcggtacgtatcggttttgagtttgtgttggtaggtgtggtggatagtcgtcgtagtttgttgagttatgacgggttggacgttagtcgcgcgttagttttttttaacgatgaagcggttgagtaggatgaagagtcgttgtttttgtggatgcgcgtttattcgtatgatgatttagtggtgttggacgttatcgttagttagtagtttgttgattagtattttgatttcgttagttacggtttttacgttattagcgttaataaattggcgggagttagcgatagtaataaatatcgttagatttacgacgttttcgaaaaaatcgggcgttattggttgtataatgttatcgtcggtgcgggtttgtcgattaattatatcgtgcgcgatttgatcgatatgcggcgatattattttgtcgattagcgggatttttttcggtacgtttttttggttgtttttgtaattcgacggtagcgtgtcgtttatcgagttggtggattaggcgtggtagtagggtttaatcgaatttgattcgcgtgacgatttttttggtaaagacgtgatgcgtaagttggtgattttggcgcgtgaagtaggttataatatcgaatcggattaggtacgtgtggaatcgttggtgtttgtttattgcgaaggcggtagtatcgattatttttttgaaaatggcgatgaattgaacgagtagatggtgtaacggttggaagcggttcgcgaaatggggttggtgttgcgttacgtggcgcgtttcgatgttaacggtaaagcgcgtgtaggcgtggaagcggtgcgtgaagattatt

SEQ ID NO: 9834 - DNA, 1109 bp, Artificial Sequence
  chemically treated genomic DNA (Homo sapiens) CpG-island No: 9834
aataatcttcacgcaccgcttccacgcctacacgcgctttaccgttaacatcgaaacgcgccacgtaacgcaacaccaaccccatttcgcgaaccgcttccaaccgttacaccatctactcgttcaattcatcgccattttcaaaaaaataatcgatactaccgccttcgcaataaacaaacaccaacgattccacacgtacctaatccgattcgatattataacctacttcacgcgccaaaatcaccaacttacgcatcacgtctttaccaaaaaaatcgtcacgcgaatcaaattcgattaaaccctactaccacgcctaatccaccaactcgataaacgacacgctaccgtcgaattacaaaaacaaccaaaaaaacgtaccgaaaaaaatcccgctaatcgacaaaataatatcgccgcatatcgatcaaatcgcgcacgatataattaatcgacaaacccgcaccgacgataacattatacaaccaataacgcccgattttttcgaaaacgtcgtaaatctaacgatatttattactatcgctaactcccgccaatttattaacgctaataacgtaaaaaccgtaactaacgaaatcaaaatactaatcaacaaactactaactaacgataacgtccaacaccactaaatcatcatacgaataaacgcgcatccacaaaaacaacgactcttcatcctactcaaccgcttcatcgttaaaaaaaactaacgcgcgactaacgtccaacccgtcataactcaacaaactacgacgactatccaccacacctaccaacacaaactcaaaaccgatacgtaccgaaaacgtactctactcacgaacgaacaattccaaccaacgaaaaccgatattacccttaccgaacaataccaaaccgatacgtttttctacgcgaaaaacgaactaatacaacccctaaatcaaactttcgatcgaaccgatacgcaatactaccaccaaactaataccgtcatcgaactaccaaataaattcgaccgactaacctttcaattactaccaaaaacgataacaatacaacgaattacgaataacgcctacaccgaccatcgccaccaacgccaa

SEQ ID NO: 9835 - DNA, 1109 bp, Artificial Sequence
  chemically treated genomic DNA (Homo sapiens) CpG-island No: 9835
gatgatttttacgtatcgtttttacgtttatacgcgttttatcgttggtatcgaaacgcgttacgtagcgtagtattagttttatttcgcgggtcgtttttagtcgttgtattatttgttcgtttagtttatcgttatttttaaagaaatggtcgatgttgtcgttttcgtaatgagtaggtattagcgattttatacgtatttgattcggttcgatgttgtaatttgttttacgcgttagaattattagtttgcgtattacgtttttgttagagagatcgttacgcgggttaggttcggttaagttttgttgttacgtttgatttattagttcggtaaacggtacgttatcgtcgaattgtaggaatagttaggagagcgtgtcggagaagatttcgttgatcgataaaatagtatcgtcgtatgtcgattagatcgcgtacggtgtggttgatcggtaagttcgtatcgacggtggtattgtatagttagtgacgttcggttttttcgaaggcgtcgtggatttggcgatatttattgttgtcgttggttttcgttagtttgttggcgttgataacgtggaaatcgtggttggcgaaattaagatattgattagtaagttgttggttggcggtaacgtttagtattattaaattattatacggatgggcgcgtatttataggaataacgattttttattttgtttaatcgttttatcgttgaagaaggttaacgcgcggttggcgtttagttcgttatagtttaataggttgcggcggttgtttattatatttgttagtataaatttaaagtcggtacgtgtcgaaagcgtgttttgtttacgggcgaatagttttagttaacgggaatcgatattgtttttatcgaataatattaggtcgatgcgtttttttgcgcggaagacggattgatgtagtttttgaattaggttttcggtcgggtcggtgcgtagtattgttattaggttgatgtcgttatcggattgttaggtaaattcgatcggttggttttttagttgttgttagaagcggtggtaatgtagcgggttacgggtgacgtttgtatcgattatcgttattagcgttag

SEQ ID NO: 9836 - DNA, 1109 bp, Artificial Sequence
  chemically treated genomic DNA (Homo sapiens) CpG-island No: 9836
ctaacgctaataacgataatcgatacaaacgtcacccgtaacccgctacattaccaccgcttctaacaacaactaaaaaaccaaccgatcgaatttacctaacaatccgataacgacatcaacctaataacaatactacgcaccgacccgaccgaaaacctaattcaaaaactacatcaatccgtcttccgcgcaaaaaaacgcatcgacctaatattattcgataaaaacaatatcgattcccgttaactaaaactattcgcccgtaaacaaaacacgctttcgacacgtaccgactttaaatttatactaacaaatataataaacaaccgccgcaacctattaaactataacgaactaaacgccaaccgcgcgttaaccttcttcaacgataaaacgattaaacaaaataaaaaatcgttattcctataaatacgcgcccatccgtataataatttaataatactaaacgttaccgccaaccaacaacttactaatcaatatcttaatttcgccaaccacgatttccacgttatcaacgccaacaaactaacgaaaaccaacgacaacaataaatatcgccaaatccacgacgccttcgaaaaaaccgaacgtcactaactatacaataccaccgtcgatacgaacttaccgatcaaccacaccgtacgcgatctaatcgacatacgacgatactattttatcgatcaacgaaatcttctccgacacgctctcctaactattcctacaattcgacgataacgtaccgtttaccgaactaataaatcaaacgtaacaacaaaacttaaccgaacctaacccgcgtaacgatctctctaacaaaaacgtaatacgcaaactaataattctaacgcgtaaaacaaattacaacatcgaaccgaatcaaatacgtataaaatcgctaatacctactcattacgaaaacgacaacatcgaccatttctttaaaaataacgataaactaaacgaacaaataatacaacgactaaaaacgacccgcgaaataaaactaatactacgctacgtaacgcgtttcgataccaacgataaaacgcgtataaacgtaaaaacgatacgtaaaaatcatc

SEQ ID NO: 9837 - DNA, 729 bp, Artificial Sequence
  chemically treated genomic DNA (Homo sapiens) CpG-island No: 9837
gtttgggtcgcgtagattggcgttaaatttacgcgaaacgcgtggtggttaaatttcgtttgttttagtttataaattagcgcgtaaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtatagcgggcggcgcgcgttaggcgggcgttaattttattggcgtttttacggttacggttttttaggcgttggcggaggattttcggcgaaatttgtaaatagacgggtagtagcgtcgattgatagcgcgttcgcgtttgcggtagatgggcgcgtgagtcgttgattagtacgtcgaattcggcgtgtagttagagattaatttcgacgtcgacgttataatatagatcgttagcgtgttagtttaaggttaatagattttgtttcgcgcgggtaaaaaatttttgttcgtttagggcgatatggtttttattttcggcgttggtatcgcgcgtgatgtagcgatgcgttattagtaattgagtttgttttcgtaggcggagtttcgttagtaggttgtttttttcggagtcggacggttttattaattaaattagtttttttattattagaatatttttttattttgacgttagacgtggtcgatatgaatatga

SEQ ID NO: 9838 - DNA, 729 bp, Artificial Sequence
  chemically treated genomic DNA (Homo sapiens) CpG-island No: 9838
tcatattcatatcgaccacgtctaacgtcaaaataaaaaaatattctaataataaaaaaactaatttaattaataaaaccgtccgactccgaaaaaaacaacctactaacgaaactccgcctacgaaaacaaactcaattactaataacgcatcgctacatcacgcgcgataccaacgccgaaaataaaaaccatatcgccctaaacgaacaaaaattttttacccgcgcgaaacaaaatctattaaccttaaactaacacgctaacgatctatattataacgtcgacgtcgaaattaatctctaactacacgccgaattcgacgtactaatcaacgactcacgcgcccatctaccgcaaacgcgaacgcgctatcaatcgacgctactacccgtctatttacaaatttcgccgaaaatcctccgccaacgcctaaaaaaccgtaaccgtaaaaacgccaataaaattaacgcccgcctaacgcgcgccgcccgctatactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgatttacgcgctaatttataaactaaaacaaacgaaatttaaccaccacgcgtttcgcgtaaatttaacgccaatctacgcgacccaaac

SEQ ID NO: 9839 - DNA, 729 bp, Artificial Sequence
  chemically treated genomic DNA (Homo sapiens) CpG-island No: 9839
ttatatttatatcgattacgtttggcgttagggtaaaagggtgttttgatgatgggaaaattgatttggttaatggggtcgttcggtttcgggaaagatagtttgttggcggaatttcgtttgcgggaataaatttagttattggtggcgtatcgttatattacgcgcgatgttagcgtcggaagtgaaaattatatcgttttgagcgagtaggagttttttattcgcgcggggtaaaatttgttggttttaagttggtacgttaacggtttgtattatggcgtcggcgtcgagattgatttttggttgtacgtcggattcgacgtgttggttaacggtttacgcgtttatttgtcgtaggcgcgggcgcgttattaatcggcgttgttgttcgtttgtttataggtttcgtcggagatttttcgttagcgtttggaaaatcgtggtcgtgaaaacgttagtgaaattaacgttcgtttggcgcgcgtcgttcgttatattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggtttacgcgttgatttgtgagttaaaataggcggagtttgattattacgcgtttcgcgtgggtttaacgttaatttgcgcgatttaaat

SEQ ID NO: 9840 - DNA, 729 bp, Artificial Sequence
  chemically treated genomic DNA (Homo sapiens) CpG-island No: 9840
atttaaatcgcgcaaattaacgttaaacccacgcgaaacgcgtaataatcaaactccgcctattttaactcacaaatcaacgcgtaaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatataacgaacgacgcgcgccaaacgaacgttaatttcactaacgttttcacgaccacgattttccaaacgctaacgaaaaatctccgacgaaacctataaacaaacgaacaacaacgccgattaataacgcgcccgcgcctacgacaaataaacgcgtaaaccgttaaccaacacgtcgaatccgacgtacaaccaaaaatcaatctcgacgccgacgccataatacaaaccgttaacgtaccaacttaaaaccaacaaattttaccccgcgcgaataaaaaactcctactcgctcaaaacgatataattttcacttccgacgctaacatcgcgcgtaatataacgatacgccaccaataactaaatttattcccgcaaacgaaattccgccaacaaactatctttcccgaaaccgaacgaccccattaaccaaatcaattttcccatcatcaaaacacccttttaccctaacgccaaacgtaatcgatataaatataa

SEQ ID NO: 9841 - DNA, 792 bp, Artificial Sequence
  chemically treated genomic DNA (Homo sapiens) CpG-island No: 9841
gcgtgtggcgatgggtcgcgcgattgtgcgcgattcggcggtgtttttgtttgatgagtcgttttttaatttcgatgttaagttgcgcgtgtagatgcgttttgaattgtaatagttgtatcgtcgtttgaaaacgattttattttacgttatttacgattaggttgaagcgatgacgttcgtttagcgagtaatggtgatgaacggcggtgttgtcgaatagattggtatattagttgaagtttacgaaaagttcgttagattgtttgtagcgagttttatcggtagttcggcgatgaatttgttgataggtcgcgtgaattacgaaggtacgtatttcgaattggacggcggttattgagtttgcgttaaacggtggttaacgttagtatgtcgggcgttaaatgattttcggattcgttcggaatatattgcgttagttcgtagtagaagcggcgtacgatgtgatggatacgttggagattttcgggcgtagattatttggcgtacggacgttggggcgagtagaagttggtggtgcgattggcgtattaggagcgttcgacggtaggtagtacgttgtggttgtatttggcggaaaattagttgtatttttttgatggtgaaataggataacgagtatgagtaattggttttattttcgtatcgtttttatcgtggcggcggtaagttggtttcggaaaatattttggcgttatcgacgtcgggtaaaatacggttataagatgatcgaatttgacgcgaagttatcgaaagatggcgagatttttt

SEQ ID NO: 9842 - DNA, 792 bp, Artificial Sequence
  chemically treated genomic DNA (Homo sapiens) CpG-island No: 9842
aaaaaatctcgccatctttcgataacttcgcgtcaaattcgatcatcttataaccgtattttacccgacgtcgataacgccaaaatattttccgaaaccaacttaccgccgccacgataaaaacgatacgaaaataaaaccaattactcatactcgttatcctatttcaccatcaaaaaaatacaactaattttccgccaaatacaaccacaacgtactacctaccgtcgaacgctcctaatacgccaatcgcaccaccaacttctactcgccccaacgtccgtacgccaaataatctacgcccgaaaatctccaacgtatccatcacatcgtacgccgcttctactacgaactaacgcaatatattccgaacgaatccgaaaatcatttaacgcccgacatactaacgttaaccaccgtttaacgcaaactcaataaccgccgtccaattcgaaatacgtaccttcgtaattcacgcgacctatcaacaaattcatcgccgaactaccgataaaactcgctacaaacaatctaacgaacttttcgtaaacttcaactaatataccaatctattcgacaacaccgccgttcatcaccattactcgctaaacgaacgtcatcgcttcaacctaatcgtaaataacgtaaaataaaatcgttttcaaacgacgatacaactattacaattcaaaacgcatctacacgcgcaacttaacatcgaaattaaaaaacgactcatcaaacaaaaacaccgccgaatcgcgcacaatcgcgcgacccatcgccacacgc

SEQ ID NO: 9843 - DNA, 792 bp, Artificial Sequence
  chemically treated genomic DNA (Homo sapiens) CpG-island No: 9843
ggaagatttcgttatttttcgataatttcgcgttaaattcgattattttatgatcgtattttgttcgacgtcgatgacgttagggtgtttttcggggttagtttatcgtcgttacgatgaggacgatgcggggataaggttagttatttatattcgttgttttgttttattattaaaaagatgtagttgatttttcgttagatgtagttatagcgtgttgtttgtcgtcgggcgtttttgatgcgttagtcgtattattagtttttgttcgttttagcgttcgtgcgttaggtaatttgcgttcgaggatttttagcgtgtttattatatcgtacgtcgtttttgttgcgagttagcgtaatatgtttcgggcgaattcgagagttatttaacgttcggtatattgacgttagttatcgtttagcgtaagtttaatgatcgtcgtttagttcgaaatgcgtgttttcgtaatttacgcggtttgttagtaggtttatcgtcggattgtcgataaaattcgttataaatagtttggcgggtttttcgtagattttaattggtgtgttaatttgttcggtaatatcgtcgtttattattattattcgttgggcgagcgttatcgttttaatttgatcgtgagtaacgtagagtgaagtcgtttttaggcgacggtgtaattgttgtagtttaagacgtatttgtacgcgtagtttggtatcgaggttagagagcggtttattaaataggaatatcgtcggatcgcgtataatcgcgcggtttatcgttatacgt

SEQ ID NO: 9844 - DNA, 792 bp, Artificial Sequence
  chemically treated genomic DNA (Homo sapiens) CpG-island No: 9844
acgtataacgataaaccgcgcgattatacgcgatccgacgatattcctatttaataaaccgctctctaacctcgataccaaactacgcgtacaaatacgtcttaaactacaacaattacaccgtcgcctaaaaacgacttcactctacgttactcacgatcaaattaaaacgataacgctcgcccaacgaataataataataaacgacgatattaccgaacaaattaacacaccaattaaaatctacgaaaaacccgccaaactatttataacgaattttatcgacaatccgacgataaacctactaacaaaccgcgtaaattacgaaaacacgcatttcgaactaaacgacgatcattaaacttacgctaaacgataactaacgtcaatataccgaacgttaaataactctcgaattcgcccgaaacatattacgctaactcgcaacaaaaacgacgtacgatataataaacacgctaaaaatcctcgaacgcaaattacctaacgcacgaacgctaaaacgaacaaaaactaataatacgactaacgcatcaaaaacgcccgacgacaaacaacacgctataactacatctaacgaaaaatcaactacatctttttaataataaaacaaaacaacgaatataaataactaaccttatccccgcatcgtcctcatcgtaacgacgataaactaaccccgaaaaacaccctaacgtcatcgacgtcgaacaaaatacgatcataaaataatcgaatttaacgcgaaattatcgaaaaataacgaaatcttcc

SEQ ID NO: 9845 - DNA, 907 bp, Artificial Sequence
  chemically treated genomic DNA (Homo sapiens) CpG-island No: 9845
cgcgcggttacgggttggtgttcggatatgagcgagcgtaaagcgatggcgatggcgttggtcgatcgcgttttgtaagtttcggagtacggcgagtacgcgataggttcggcgtaggatgaagagttcgtgttggtatatgtcgataacgtcgaagtcgtaggttttgttttatattttaaatttttttattacgtcgatttttaggtcgaattggagttatttaaacgtttgtaataggagtagaattatggttaatttagagcggattataattttgtttatttcgacgagtagattaaacgtatgattcgtcgcgttattttaaaagcggtgtgcgattttcggttattaggtgtcgtttggcgggcgcgagatgtcgatgtcgtacggttggggaatcggcggtatttagtttatcgttagcgtgattggcgaaagcgacgtgttgaaggtgattgattagggcgcggatgatattataacgtcgtgtcgattcgtaatttttttaagcgcgtgatcggggtaaatattacggaacgtacggacgatgcgacggttatttagacgcgttatcgtatttcgaaacgtcgtgatcgaagattagataattattttttaggtgttaattttcgagtcgtgcgttttatcgaagttcggcgaaagggaaattcgaattatgtacgcgttggaagaagtataggcgtgatgtaggtgaaattgtatgacgatatcgtatcgcgtatcggttatatcggtagaaattacgtttatacggtgaaggtaatgggggttacgtgattggaattagacgttcggattcgtaagattcgataatttaaagattggttattgacgtttagatacgttattgcgtagggcggggagttagaagtcgtattatgcg

SEQ ID NO: 9846 - DNA, 907 bp, Artificial Sequence
  chemically treated genomic DNA (Homo sapiens) CpG-island No: 9846
cgcataatacgacttctaactccccgccctacgcaataacgtatctaaacgtcaataaccaatctttaaattatcgaatcttacgaatccgaacgtctaattccaatcacgtaacccccattaccttcaccgtataaacgtaatttctaccgatataaccgatacgcgatacgatatcgtcatacaatttcacctacatcacgcctatacttcttccaacgcgtacataattcgaatttccctttcgccgaacttcgataaaacgcacgactcgaaaattaacacctaaaaaataattatctaatcttcgatcacgacgtttcgaaatacgataacgcgtctaaataaccgtcgcatcgtccgtacgttccgtaatatttaccccgatcacgcgcttaaaaaaattacgaatcgacacgacgttataatatcatccgcgccctaatcaatcaccttcaacacgtcgctttcgccaatcacgctaacgataaactaaataccgccgattccccaaccgtacgacatcgacatctcgcgcccgccaaacgacacctaataaccgaaaatcgcacaccgcttttaaaataacgcgacgaatcatacgtttaatctactcgtcgaaataaacaaaattataatccgctctaaattaaccataattctactcctattacaaacgtttaaataactccaattcgacctaaaaatcgacgtaataaaaaaatttaaaatataaaacaaaacctacgacttcgacgttatcgacatataccaacacgaactcttcatcctacgccgaacctatcgcgtactcgccgtactccgaaacttacaaaacgcgatcgaccaacgccatcgccatcgctttacgctcgctcatatccgaacaccaacccgtaaccgcgcg

SEQ ID NO: 9847 - DNA, 907 bp, Artificial Sequence
  chemically treated genomic DNA (Homo sapiens) CpG-island No: 9847
cgtatgatgcggtttttggtttttcgttttgcgtagtggcgtgtttgggcgttagtggttagtttttgggttatcgaattttgcggattcgggcgtttggttttagttacgtagtttttattatttttatcgtataggcgtagtttttgtcgatatgatcgatacgcggtgcgatatcgttatatagttttatttgtattacgtttgtattttttttagcgcgtgtatggttcgggtttttttttcgtcgggtttcgataaagcgtacggttcggggattggtatttggaagataattatttgattttcggttacggcgtttcgggatgcggtgacgcgtttggataatcgtcgtatcgttcgtacgtttcgtggtgtttatttcggttacgcgtttgaagaagttgcgaatcgatacggcgttgtggtgttattcgcgttttggttaattatttttagtacgtcgttttcgttaattacgttggcggtaagttgaatgtcgtcggttttttagtcgtacggtatcggtatttcgcgttcgttaaacggtatttgataatcggggatcgtatatcgtttttaagatggcgcggcggattatgcgtttggtttgttcgtcgaggtaggtaaagttgtagttcgttttagattagttatggttttgtttttgttgtagacgtttgagtagttttagttcggtttggaaatcgacgtagtgggggagtttgaggtgtgagataaagtttgcggtttcgacgttgtcggtatgtgttagtacgaattttttattttgcgtcgggtttgtcgcgtgttcgtcgtatttcggggtttgtagagcgcggtcgattagcgttatcgttatcgttttgcgttcgtttatgttcgaatattagttcgtagtcgcgcg

SEQ ID NO: 9848 - DNA, 907 bp, Artificial Sequence
  chemically treated genomic DNA (Homo sapiens) CpG-island No: 9848
cgcgcgactacgaactaatattcgaacataaacgaacgcaaaacgataacgataacgctaatcgaccgcgctctacaaaccccgaaatacgacgaacacgcgacaaacccgacgcaaaataaaaaattcgtactaacacataccgacaacgtcgaaaccgcaaactttatctcacacctcaaactcccccactacgtcgatttccaaaccgaactaaaactactcaaacgtctacaacaaaaacaaaaccataactaatctaaaacgaactacaactttacctacctcgacgaacaaaccaaacgcataatccgccgcgccatcttaaaaacgatatacgatccccgattatcaaataccgtttaacgaacgcgaaataccgataccgtacgactaaaaaaccgacgacattcaacttaccgccaacgtaattaacgaaaacgacgtactaaaaataattaaccaaaacgcgaataacaccacaacgccgtatcgattcgcaacttcttcaaacgcgtaaccgaaataaacaccacgaaacgtacgaacgatacgacgattatccaaacgcgtcaccgcatcccgaaacgccgtaaccgaaaatcaaataattatcttccaaataccaatccccgaaccgtacgctttatcgaaacccgacgaaaaaaaaacccgaaccatacacgcgctaaaaaaaatacaaacgtaatacaaataaaactatataacgatatcgcaccgcgtatcgatcatatcgacaaaaactacgcctatacgataaaaataataaaaactacgtaactaaaaccaaacgcccgaatccgcaaaattcgataacccaaaaactaaccactaacgcccaaacacgccactacgcaaaacgaaaaaccaaaaaccgcatcatacg

SEQ ID NO: 9849 - DNA, 573 bp, Artificial Sequence
  chemically treated genomic DNA (Homo sapiens) CpG-island No: 9849
ttttttttcggtaagcgtaggttcgtttatcgggatcgatagggttcgcgaagcgttggttggcgggttgacgagttggcgggttggcgggttgatttttcgacggcggcgacggtagtttttggttcggagtttttttttttttatttcggatttgtttttagaatcgaacgagttagtgaggtgagcgttttcgtgtttagagcggttttacgtgttttttattaaataatcggacggtattattttatttattcgattcgttcgattcgtttgttttttagagttattttagacgcgcgcgcgcgtttggttacgttcgtttttttttttttgcgcgtttttgcgatttcgtgcgtgttcgttttgtttgtgaggtcgcgggaagtagcgcgtaggagtagaagtaatagggtgtcgtcgaataggtggggagtggaggtttggaagtacgtttgcggaagacggttcgtttgcggtttttttcgcgtgattagttgcgttcgtttaatttaattatgatttttatttttttattttggtttttttttcgagcgaataaggaaggggcgt

SEQ ID NO: 9850 - DNA, 573 bp, Artificial Sequence
  chemically treated genomic DNA (Homo sapiens) CpG-island No: 9850
acgccccttccttattcgctcgaaaaaaaaaccaaaataaaaaaataaaaatcataattaaattaaacgaacgcaactaatcacgcgaaaaaaaccgcaaacgaaccgtcttccgcaaacgtacttccaaacctccactccccacctattcgacgacaccctattacttctactcctacgcgctacttcccgcgacctcacaaacaaaacgaacacgcacgaaatcgcaaaaacgcgcaaaaaaaaaaaaacgaacgtaaccaaacgcgcgcgcgcgtctaaaataactctaaaaaacaaacgaatcgaacgaatcgaataaataaaataataccgtccgattatttaataaaaaacacgtaaaaccgctctaaacacgaaaacgctcacctcactaactcgttcgattctaaaaacaaatccgaaataaaaaaaaaaaaactccgaaccaaaaactaccgtcgccgccgtcgaaaaatcaacccgccaacccgccaactcgtcaacccgccaaccaacgcttcgcgaaccctatcgatcccgataaacgaacctacgcttaccgaaaaaaaa

SEQ ID NO: 9851 - DNA, 573 bp, Artificial Sequence
  chemically treated genomic DNA (Homo sapiens) CpG-island No: 9851
acgttttttttttgttcgttcggaaagaggattaaaatggaggagtaagaattatgattaaattgagcgagcgtaattaattacgcgaagagggtcgtaggcgggtcgtttttcgtaagcgtgtttttaggtttttattttttatttattcggcggtattttgttatttttgtttttgcgcgttgtttttcgcgattttataggtagagcgaatacgtacggagtcgtaggggcgcgtaaagggggaggagcgggcgtgattaggcgcgcgcgcgcgtttggagtgattttagagagtaggcgagtcgggcggatcgggtgggtagagtggtgtcgttcggttgtttggtgggaggtacgtaagatcgttttgggtacgggggcgtttattttattggttcgttcggttttaggagtagattcggggtagagggaaaagagtttcgggttaggggttgtcgtcgtcgtcgtcggggagttagttcgttagttcgttagttcgttagttcgttagttagcgtttcgcgggttttgtcggtttcggtaagcgggtttgcgtttatcggaaagagg

SEQ ID NO: 9852 - DNA, 573 bp, Artificial Sequence
  chemically treated genomic DNA (Homo sapiens) CpG-island No: 9852
cctctttccgataaacgcaaacccgcttaccgaaaccgacaaaacccgcgaaacgctaactaacgaactaacgaactaacgaactaacgaactaactccccgacgacgacgacgacaacccctaacccgaaactcttttccctctaccccgaatctactcctaaaaccgaacgaaccaataaaataaacgcccccgtacccaaaacgatcttacgtacctcccaccaaacaaccgaacgacaccactctacccacccgatccgcccgactcgcctactctctaaaatcactccaaacgcgcgcgcgcgcctaatcacgcccgctcctccccctttacgcgcccctacgactccgtacgtattcgctctacctataaaatcgcgaaaaacaacgcgcaaaaacaaaaataacaaaataccgccgaataaataaaaaataaaaacctaaaaacacgcttacgaaaaacgacccgcctacgaccctcttcgcgtaattaattacgctcgctcaatttaatcataattcttactcctccattttaatcctctttccgaacgaacaaaaaaaaaacgt

SEQ ID NO: 9853 - DNA, 814 bp, Artificial Sequence
  chemically treated genomic DNA (Homo sapiens) CpG-island No: 9853
attttcggtagtagtacgtcgttgtcgttagaaattatttgtcgtacgtcgcgaattcgttgggtgagcgggttattttgtgttttgtttattagcgttatagttagtaatcgaggtttaaatttgataggttcgattagcggaatggttttttaattgatttgttgttcgttggtttcggtgatggtgcgggttagcgtttcgaggtttttttttttcgttttcgtcgttagcggttgtttgtttattcgttagtcggtaaaattaagtagtggttgttgaatagtaaaaacggtagtgtgcgtgtattttcggtattatcgttagtacgaatataatttcggtgtgcggtgtagagtatcgacggtgtttgttagtagttggttacgtacgttatgggcgatatcgtcgttgtcgttgacgcgggtgacgataatcgtcgtcgcggtggagagtagtagggaagggatttgcgttattaggtcgtcgtcgatggttattagtatatattgttggaaggtagtatcggcgtttaggttgtatttgaagatttcgatatagacgtcgtcgattaggttgatcgttagaattattatttcggcgatggcgtttcgcgtataaatttcgatgtttcgtatatcgcgtcgtataaatcgggttcgtttggtaatatttttacgtcgggtttgttttgcgttttgttggtaattcggcgtaagatcgggttatcgttattgtagtcggtatcgcgtttaggaaaggggagaatttcgaaattttttgtttatgggtattaaaaagttttgtatattta

SEQ ID NO: 9854 - DNA, 814 bp, Artificial Sequence
  chemically treated genomic DNA (Homo sapiens) CpG-island No: 9854
taaatatacaaaactttttaatacccataaacaaaaaatttcgaaattctcccctttcctaaacgcgataccgactacaataacgataacccgatcttacgccgaattaccaacaaaacgcaaaacaaacccgacgtaaaaatattaccaaacgaacccgatttatacgacgcgatatacgaaacatcgaaatttatacgcgaaacgccatcgccgaaataataattctaacgatcaacctaatcgacgacgtctatatcgaaatcttcaaatacaacctaaacgccgatactaccttccaacaatatatactaataaccatcgacgacgacctaataacgcaaatcccttccctactactctccaccgcgacgacgattatcgtcacccgcgtcaacgacaacgacgatatcgcccataacgtacgtaaccaactactaacaaacaccgtcgatactctacaccgcacaccgaaattatattcgtactaacgataataccgaaaatacacgcacactaccgtttttactattcaacaaccactacttaattttaccgactaacgaataaacaaacaaccgctaacgacgaaaacgaaaaaaaaaaacctcgaaacgctaacccgcaccatcaccgaaaccaacgaacaacaaatcaattaaaaaaccattccgctaatcgaacctatcaaatttaaacctcgattactaactataacgctaataaacaaaacacaaaataacccgctcacccaacgaattcgcgacgtacgacaaataatttctaacgacaacgacgtactactaccgaaaat

SEQ ID NO: 9855 - DNA, 814 bp, Artificial Sequence
  chemically treated genomic DNA (Homo sapiens) CpG-island No: 9855
tgagtgtgtagaattttttggtatttataggtaggagatttcgaggttttttttttttttagacgcgatgtcggttatagtggcgatgattcgattttacgtcggattgttaataaggcgtagggtaaattcggcgtaaagatgttgttaagcgagttcgatttgtacggcgcgatgtacggggtatcgaagtttgtgcgcgggacgttatcgtcgggatgatgattttggcgattaatttgatcggcggcgtttgtatcgggatttttaaatataatttgagcgtcgatgttgttttttagtagtatgtgttgatgattatcggcgacggtttggtggcgtagattttttttttgttgttttttatcgcggcggcgattatcgttattcgcgttagcgataacggcgatatcgtttatgacgtgcgtaattagttgttggtaagtatcgtcggtgttttatatcgtatatcgggattatgttcgtgttggcggtggtatcgggaatgtacgtatattgtcgtttttgttgtttagtagttattgtttggttttatcggttggcggatgagtaaatagtcgttggcggcggaggcggaagagaaaagtttcgaaacgttgattcgtattattatcgaaattagcgagtagtaggttagttgggaaattatttcgttgatcgagtttattaagtttaagtttcggttattaattgtggcgttggtggataaagtatagggtaattcgtttatttagcggattcgcggcgtgcggtaggtgatttttgacggtaacggcgtgttgttgtcggagat

SEQ ID NO: 9856 - DNA, 814 bp, Artificial Sequence
  chemically treated genomic DNA (Homo sapiens) CpG-island No: 9856
atctccgacaacaacacgccgttaccgtcaaaaatcacctaccgcacgccgcgaatccgctaaataaacgaattaccctatactttatccaccaacgccacaattaataaccgaaacttaaacttaataaactcgatcaacgaaataatttcccaactaacctactactcgctaatttcgataataatacgaatcaacgtttcgaaacttttctcttccgcctccgccgccaacgactatttactcatccgccaaccgataaaaccaaacaataactactaaacaacaaaaacgacaatatacgtacattcccgataccaccgccaacacgaacataatcccgatatacgatataaaacaccgacgatacttaccaacaactaattacgcacgtcataaacgatatcgccgttatcgctaacgcgaataacgataatcgccgccgcgataaaaaacaacaaaaaaaaaatctacgccaccaaaccgtcgccgataatcatcaacacatactactaaaaaacaacatcgacgctcaaattatatttaaaaatcccgatacaaacgccgccgatcaaattaatcgccaaaatcatcatcccgacgataacgtcccgcgcacaaacttcgataccccgtacatcgcgccgtacaaatcgaactcgcttaacaacatctttacgccgaatttaccctacgccttattaacaatccgacgtaaaatcgaatcatcgccactataaccgacatcgcgtctaaaaaaaaaaaaaacctcgaaatctcctacctataaataccaaaaaattctacacactca

SEQ ID NO: 9857 - DNA, 1592 bp, Artificial Sequence
  chemically treated genomic DNA (Homo sapiens) CpG-island No: 9857
aagttgttcgtcgaagatttagatcgaagtgtttcgtttgttatcgatttgttttcggaagagaacggttttatcgttaatttaggtcgttggttatagtggtatggaaaggtgcggacgtttcggggattgcgttgattgacggcgagattttttcggtatttttttgcgtttgcgtaagatgtatgtcgaatagggtggtcgaattcggattaggtgttgaatatgatatggaattacgttatttcgtagagttatttttagaagaagtggcgatggagagtaacggtaaggcgttggcgatattatcgattcggtaatcggtgcggttatcgttaagaaaggttaaaatttagttcgttcgtttaattgcgcgatgacggtataattttttgtggtgttggattttcgtcggtagttggacgtcggaaggtaattagatggtattcgtgataacgtcgattcgtttggtttcggtaatacgttgggttgggtagggtatggtcgtttaatcgtcgtattttgtataatcgcgttttcgtagatcgtagggtaattcgtgggattcgaagcgttagttgttgaaatgggacgtattaagtggatcggttgggatatttcggattatagcgtagcgttttcggtagcggcgtcgggtcgtttattatgtagtaggaaggtatggggcgttttttgttttcgataagatggcggaaggttcgttttcggaatattacgagcgtttgaaacgtcgttgggaattaattcgttgtatttaaacgttatttcgattcggttgtacgtatttttaaagacgacgtcgaagtattgggtaaagcgataagttttcgtatgtcggaattatttatcgtttgatcgagtatttttttattggattaaatacgcgttgttgaacgcgattttgtagttagagtagttgtggaaatcggggagtcgttggcgaataaatttggtattgtttaggggatatcgtgaaagttttttttaatcgtggttatattaaagttaaagcggggtgattaaacgtattcgtacgttgaaaacgaacggtaggtttaagtttcgtgtcgttgaaagtagttaatttggtcggaagcgtaatcggatcgtgaatcgaaaaacgcggttcggcgattgtttaggcgttcgacgttgaaggtaatcgagtaaagcggtagaaggttgggcgcgtggttgcggtattatcgttattaggttgagcgtttgattatcgataaaggcgaatggttgttgtatcggtttatgtgaagggcgaaagtatcgaagtattgttgtcgaatatggttggatttttttggcgaaattgtcgatttcgaaattgatgcgttggggcgtagcgacgtgtatttcgtgcgttcggtgtatatcgtgattttgttgttggggataaagttatttcggtaattattttgggtatttagttcgatcgcgtgatcgcggttatcgttttatgggcgagtcggaatttattatcgataacgttattagtattcggaaattttgcgtgagcgtgggaaagttatcgtcgattagaagaacgtaaggcgaag

SEQ ID NO: 9858 - DNA, 1592 bp, Artificial Sequence
  chemically treated genomic DNA (Homo sapiens) CpG-island No: 9858
cttcgccttacgttcttctaatcgacgataactttcccacgctcacgcaaaatttccgaatactaataacgttatcgataataaattccgactcgcccataaaacgataaccgcgatcacgcgatcgaactaaatacccaaaataattaccgaaataactttatccccaacaacaaaatcacgatatacaccgaacgcacgaaatacacgtcgctacgccccaacgcatcaatttcgaaatcgacaatttcgccaaaaaaatccaaccatattcgacaacaatacttcgatactttcgcccttcacataaaccgatacaacaaccattcgcctttatcgataatcaaacgctcaacctaataacgataataccgcaaccacgcgcccaaccttctaccgctttactcgattaccttcaacgtcgaacgcctaaacaatcgccgaaccgcgtttttcgattcacgatccgattacgcttccgaccaaattaactactttcaacgacacgaaacttaaacctaccgttcgttttcaacgtacgaatacgtttaatcaccccgctttaactttaatataaccacgattaaaaaaaactttcacgatatcccctaaacaataccaaatttattcgccaacgactccccgatttccacaactactctaactacaaaatcgcgttcaacaacgcgtatttaatccaataaaaaaatactcgatcaaacgataaataattccgacatacgaaaacttatcgctttacccaatacttcgacgtcgtctttaaaaatacgtacaaccgaatcgaaataacgtttaaatacaacgaattaattcccaacgacgtttcaaacgctcgtaatattccgaaaacgaaccttccgccatcttatcgaaaacaaaaaacgccccataccttcctactacataataaacgacccgacgccgctaccgaaaacgctacgctataatccgaaatatcccaaccgatccacttaatacgtcccatttcaacaactaacgcttcgaatcccacgaattaccctacgatctacgaaaacgcgattatacaaaatacgacgattaaacgaccataccctacccaacccaacgtattaccgaaaccaaacgaatcgacgttatcacgaataccatctaattaccttccgacgtccaactaccgacgaaaatccaacaccacaaaaaattataccgtcatcgcgcaattaaacgaacgaactaaattttaacctttcttaacgataaccgcaccgattaccgaatcgataatatcgccaacgccttaccgttactctccatcgccacttcttctaaaaataactctacgaaataacgtaattccatatcatattcaacacctaatccgaattcgaccaccctattcgacatacatcttacgcaaacgcaaaaaaataccgaaaaaatctcgccgtcaatcaacgcaatccccgaaacgtccgcacctttccataccactataaccaacgacctaaattaacgataaaaccgttctcttccgaaaacaaatcgataacaaacgaaacacttcgatctaaatcttcgacgaacaactt

SEQ ID NO: 9859 - DNA, 1592 bp, Artificial Sequence
  chemically treated genomic DNA (Homo sapiens) CpG-island No: 9859
tttcgttttacgtttttttaatcggcgatgatttttttacgtttacgtagaattttcggatattgatggcgttatcgatggtgaatttcggttcgtttataaagcggtggtcgcgattacgcgatcggattgaatgtttagaatggttgtcggaatgattttgtttttagtagtagggttacggtgtgtatcggacgtacgaagtgtacgtcgttgcgttttaacgtattagtttcgggatcggtagtttcgttagagaagtttaattatattcggtagtagtgtttcggtgttttcgttttttatatgggtcgatatagtagttattcgtttttatcggtagttagacgtttagtttggtaacggtaatatcgtaattacgcgtttaattttttgtcgttttgttcggttgtttttagcgtcgaacgtttgggtaatcgtcgggtcgcgtttttcgatttacgattcggttgcgttttcggttaggttagttatttttagcgatacgaggtttggatttgtcgttcgtttttagcgtgcgaatacgtttggttatttcgttttggttttgatatagttacggttggaggagatttttacggtattttttgggtaatgttaagtttattcgttagcgatttttcgatttttataattgttttggttgtaaaatcgcgtttaatagcgcgtgtttggtttagtagggaagtgttcggttagacgataggtggtttcgatatacgggaatttatcgttttatttaatgtttcggcgtcgtttttaaagatacgtgtagtcgggtcgagataacgtttggatgtagcgggttagtttttagcggcgttttaaacgttcgtagtgtttcgggaacggatttttcgttattttatcgagggtaaaagacgttttatgtttttttgttgtatgataaacggttcgacgtcgttatcggaggcgttgcgttgtagttcggaatattttagtcggtttatttagtgcgttttattttagtaattgacgtttcggattttacgggttattttgcggtttgcggaggcgcggttatatagaatgcggcggttaagcggttatgttttgtttagtttagcgtgttatcgaggttagacggatcggcgttattacgggtgttatttggttgtttttcggcgtttagttatcggcgaaaatttagtattataggaggttgtatcgttatcgcgtaattgggcgaacgaattaagttttggttttttttgacgataatcgtatcggttgtcggatcggtaatatcgttagcgttttatcgttgttttttatcgttattttttttgaagatggttttgcggaatggcgtagttttatgttatgtttagtatttggttcgggttcggttattttgttcggtatatattttgcgtaagcgtaggaagatatcggagggatttcgtcgttagttagcgtaattttcggggcgttcgtatttttttatgttattgtaattagcgatttgagttaacgatagaatcgttttttttcggaagtaggtcgatggtagacggaatatttcggtttggattttcgacgagtaattt

SEQ ID NO: 9860 - DNA, 1592 bp, Artificial Sequence
  chemically treated genomic DNA (Homo sapiens) CpG-island No: 9860
aaattactcgtcgaaaatccaaaccgaaatattccgtctaccatcgacctacttccgaaaaaaaacgattctatcgttaactcaaatcgctaattacaataacataaaaaaatacgaacgccccgaaaattacgctaactaacgacgaaatccctccgatatcttcctacgcttacgcaaaatatataccgaacaaaataaccgaacccgaaccaaatactaaacataacataaaactacgccattccgcaaaaccatcttcaaaaaaaataacgataaaaaacaacgataaaacgctaacgatattaccgatccgacaaccgatacgattatcgtcaaaaaaaaccaaaacttaattcgttcgcccaattacgcgataacgatacaacctcctataatactaaattttcgccgataactaaacgccgaaaaacaaccaaataacacccgtaataacgccgatccgtctaacctcgataacacgctaaactaaacaaaacataaccgcttaaccgccgcattctatataaccgcgcctccgcaaaccgcaaaataacccgtaaaatccgaaacgtcaattactaaaataaaacgcactaaataaaccgactaaaatattccgaactacaacgcaacgcctccgataacgacgtcgaaccgtttatcatacaacaaaaaaacataaaacgtcttttaccctcgataaaataacgaaaaatccgttcccgaaacactacgaacgtttaaaacgccgctaaaaactaacccgctacatccaaacgttatctcgacccgactacacgtatctttaaaaacgacgccgaaacattaaataaaacgataaattcccgtatatcgaaaccacctatcgtctaaccgaacacttccctactaaaccaaacacgcgctattaaacgcgattttacaaccaaaacaattataaaaatcgaaaaatcgctaacgaataaacttaacattacccaaaaaataccgtaaaaatctcctccaaccgtaactatatcaaaaccaaaacgaaataaccaaacgtattcgcacgctaaaaacgaacgacaaatccaaacctcgtatcgctaaaaataactaacctaaccgaaaacgcaaccgaatcgtaaatcgaaaaacgcgacccgacgattacccaaacgttcgacgctaaaaacaaccgaacaaaacgacaaaaaattaaacgcgtaattacgatattaccgttaccaaactaaacgtctaactaccgataaaaacgaataactactatatcgacccatataaaaaacgaaaacaccgaaacactactaccgaatataattaaacttctctaacgaaactaccgatcccgaaactaatacgttaaaacgcaacgacgtacacttcgtacgtccgatacacaccgtaaccctactactaaaaacaaaatcattccgacaaccattctaaacattcaatccgatcgcgtaatcgcgaccaccgctttataaacgaaccgaaattcaccatcgataacgccatcaatatccgaaaattctacgtaaacgtaaaaaaatcatcgccgattaaaaaaacgtaaaacgaaa

SEQ ID NO: 9861 - DNA, 594 bp, Artificial Sequence
  chemically treated genomic DNA (Homo sapiens) CpG-island No: 9861
cggttcggttttcgggatagttaaattgtgggggtacggggcggtggtttatttcggaagaaatattcgttcgcggtagtttagaggaagttttttttcggaatatgttttcgcgcgttaagatacgatagttgtttgttttttacgtcgtcgatatatattattttttattttcggtacgtatgatattcgtgacgaaattgaatgagggtagtatggaaattaaagatttgatgtgataggggcggtattaatggtgttggtatcgcggtagacgtcgttggacgcggtttatcgtgttgatgttggaggcgtaggatttcgtttgcgcgatttttttcgtagtttaaaatttatttacggtggtttgcgttattttgagtattatgaattcgtttggttagcgaggcgttggttgaacgtgaagtgttgttgaaaatgtttcgtatatcgttttttcgatgcgttttcgtttgttatatcgttcgtattgcgttcggcgtggatgattcgtattggtttgtttatgtacgattatcgggtaaacgtattagtttgtcgggattaattggtttgcgttttggcgtaatttag

SEQ ID NO: 9862 - DNA, 594 bp, Artificial Sequence
  chemically treated genomic DNA (Homo sapiens) CpG-island No: 9862
ctaaattacgccaaaacgcaaaccaattaatcccgacaaactaatacgtttacccgataatcgtacataaacaaaccaatacgaatcatccacgccgaacgcaatacgaacgatataacaaacgaaaacgcatcgaaaaaacgatatacgaaacattttcaacaacacttcacgttcaaccaacgcctcgctaaccaaacgaattcataatactcaaaataacgcaaaccaccgtaaataaattttaaactacgaaaaaaatcgcgcaaacgaaatcctacgcctccaacatcaacacgataaaccgcgtccaacgacgtctaccgcgataccaacaccattaataccgcccctatcacatcaaatctttaatttccatactaccctcattcaatttcgtcacgaatatcatacgtaccgaaaataaaaaataatatatatcgacgacgtaaaaaacaaacaactatcgtatcttaacgcgcgaaaacatattccgaaaaaaaacttcctctaaactaccgcgaacgaatatttcttccgaaataaaccaccgccccgtacccccacaatttaactatcccgaaaaccgaaccg

SEQ ID NO: 9863 - DNA, 594 bp, Artificial Sequence
  chemically treated genomic DNA (Homo sapiens) CpG-island No: 9863
ttgaattgcgttaaaacgtaaattagttgatttcggtaagttggtgcgtttattcgatgatcgtatataaatagattaatgcgaattatttacgtcgggcgtagtgcggacgatgtggtaggcgaaaacgtatcgggaaggcgatatgcggggtatttttagtagtattttacgtttagttagcgtttcgttgattaggcggatttatagtgtttaaggtagcgtaggttatcgtgaatgagttttgaattgcggaagaggtcgcgtaagcgagattttgcgtttttagtattagtacggtaaatcgcgtttagcggcgtttgtcgcgatattagtattattgatgtcgtttttattatattagatttttggtttttatgttgtttttatttaatttcgttacgggtgttatgcgtgtcgggggtaaggagtaatatgtgtcgacggcgtgaaagataaatagttgtcgtgttttggcgcgcgaaaatatatttcggggggagattttttttggattgtcgcgggcgggtatttttttcgggataaattatcgtttcgtatttttataatttggttatttcggaagtcgaatcg

SEQ ID NO: 9864 - DNA, 594 bp, Artificial Sequence
  chemically treated genomic DNA (Homo sapiens) CpG-island No: 9864
cgattcgacttccgaaataaccaaattataaaaatacgaaacgataatttatcccgaaaaaaatacccgcccgcgacaatccaaaaaaaatctccccccgaaatatattttcgcgcgccaaaacacgacaactatttatctttcacgccgtcgacacatattactccttacccccgacacgcataacacccgtaacgaaattaaataaaaacaacataaaaaccaaaaatctaatataataaaaacgacatcaataatactaatatcgcgacaaacgccgctaaacgcgatttaccgtactaatactaaaaacgcaaaatctcgcttacgcgacctcttccgcaattcaaaactcattcacgataacctacgctaccttaaacactataaatccgcctaatcaacgaaacgctaactaaacgtaaaatactactaaaaataccccgcatatcgccttcccgatacgttttcgcctaccacatcgtccgcactacgcccgacgtaaataattcgcattaatctatttatatacgatcatcgaataaacgcaccaacttaccgaaatcaactaatttacgttttaacgcaattcaa

SEQ ID NO: 9865 - DNA, 584 bp, Artificial Sequence
  chemically treated genomic DNA (Homo sapiens) CpG-island No: 9865
  misc_feature (38)..(38): n is either a, c, g or t
  misc_feature (102)..(102): n is either a, c, g or t
tcgtcgcgtcggcggttaaggttaacgcgggtttcggngggtttttttaggggacgtttttattattgggcggcgtttaggttattttatttttttttaggntttattggcgatttcggttattggtattggcgtaggtaacgttattgacgggcgattttcgtgatgtacgacgtttttggtattatcggcggttatatttttaattcgttaaaaattttttcgtcgaaacgggcgatattcgcgcggttgtcggtagtatatggttgaagtggagttcggcgtttattcgggcgaagaattagtttttattaaggagttacgttgtgttaattatcgaaattttgtcgcgttgcgttagtaaattcgtcgtttgcgtatggaaggtaagcgcgtggcgtggtgtttattatgggtaatttgtacgatggttatatgaagttggtcgagaagttaaagttcgcgtcgatgtggtcgtcgttagtattttcgttaatcgatgtagttcgatcgttcggaagatttggttcgttatttacggattttgaggaggattgcgagaagttaaataaacgtaaagtgga

SEQ ID NO: 9866 - DNA, 584 bp, Artificial Sequence
  chemically treated genomic DNA (Homo sapiens) CpG-island No: 9866
  misc_feature (483)..(483): n is either a, c, g or t
  misc_feature (547)..(547): n is either a, c, g or t
tccactttacgtttatttaacttctcgcaatcctcctcaaaatccgtaaataacgaaccaaatcttccgaacgatcgaactacatcgattaacgaaaatactaacgacgaccacatcgacgcgaactttaacttctcgaccaacttcatataaccatcgtacaaattacccataataaacaccacgccacgcgcttaccttccatacgcaaacgacgaatttactaacgcaacgcgacaaaatttcgataattaacacaacgtaactccttaataaaaactaattcttcgcccgaataaacgccgaactccacttcaaccatatactaccgacaaccgcgcgaatatcgcccgtttcgacgaaaaaatttttaacgaattaaaaatataaccgccgataataccaaaaacgtcgtacatcacgaaaatcgcccgtcaataacgttacctacgccaataccaataaccgaaatcgccaataaancctaaaaaaaaataaaataacctaaacgccgcccaataataaaaacgtcccctaaaaaaacccnccgaaacccgcgttaaccttaaccgccgacgcgacga

SEQ ID NO: 9867 - DNA, 584 bp, Artificial Sequence
  chemically treated genomic DNA (Homo sapiens) CpG-island No: 9867
  misc_feature (483)..(483): n is either a, c, g or t
  misc_feature (547)..(547): n is either a, c, g or t
tttattttacgtttgtttagtttttcgtagttttttttaaggttcgtggataacgagttagatttttcgggcggtcgaattgtatcggttaacgaaaatattgacgacgattatatcggcgcgggttttggtttttcgattagttttatatggttatcgtgtaggttatttatggtaggtattacgttacgcgtttgttttttatacgtaggcggcgaatttgttgacgtagcgcggtagggtttcgataattaatataacgtgattttttaatggaaattggtttttcgttcggataaacgtcggattttattttagttatatattgtcgatagtcgcgcggatgtcgttcgtttcggcgaggaaatttttagcgaattaggaatgtgatcgtcggtaatattaaaggcgtcgtgtattacgaggatcgttcgttagtgacgttgtttgcgttaatgttaataatcgggatcgttagtaagntttggggaaaaatggagtggtttgggcgtcgtttaatagtggaagcgttttttaagaggatttntcggggttcgcgttggttttggtcgtcggcgcggcgg

SEQ ID NO: 9868 - DNA, 584 bp, Artificial Sequence
  chemically treated genomic DNA (Homo sapiens) CpG-island No: 9868
  misc_feature (38)..(38): n is either a, c, g or t
  misc_feature (102)..(102): n is either a, c, g or t
ccgccgcgccgacgaccaaaaccaacgcgaaccccganaaatcctcttaaaaaacgcttccactattaaacgacgcccaaaccactccatttttccccaaancttactaacgatcccgattattaacattaacgcaaacaacgtcactaacgaacgatcctcgtaatacacgacgcctttaatattaccgacgatcacattcctaattcgctaaaaatttcctcgccgaaacgaacgacatccgcgcgactatcgacaatatataactaaaataaaatccgacgtttatccgaacgaaaaaccaatttccattaaaaaatcacgttatattaattatcgaaaccctaccgcgctacgtcaacaaattcgccgcctacgtataaaaaacaaacgcgtaacgtaatacctaccataaataacctacacgataaccatataaaactaatcgaaaaaccaaaacccgcgccgatataatcgtcgtcaatattttcgttaaccgatacaattcgaccgcccgaaaaatctaactcgttatccacgaaccttaaaaaaaactacgaaaaactaaacaaacgtaaaataaa

SEQ ID NO: 9869 - DNA, 1188 bp, Artificial Sequence
  chemically treated genomic DNA (Homo sapiens) CpG-island No: 9869
aggcgttgtttcgcgtcgatttgatgtttggtagtattcgatgtagtggtatagtattttttcgttttttaaatttggatcgataaagtttttttttacggttgggtttacggttatggcggtcggcgttgtatggtaaatatttgttgtgggcggtgacgatcggcggcgggaaagttattttgaaattggtgcgtattcgggttttgatgtgttgtcgcgtcgttataggcgacggtaatttattgcgggttgaattggttgttatcgttgttatgtattgtatttttatttgtgacgacgaaattttcgaagggtagcgcgttattataagtaacgtttgttggaatggtaggaggtttattatgatagttatacgttgatttaggcgttgatttatttcggttcggtagcgttattgtatttattgcggtacgttttggtttgggatcggtatttggttatcgatcgtcggttgtattattggttcgtgggggttgcgattggtgatcgattcgaatttattttgtattttgtcgagattgggttggtgttgatgttgttattatcggtttcgaattcgatttataaaggttgtggaagttgcgtgcggagtgttcggttgtggcgtattgtagatggtgatttgcggcggtttgttgggttgttttgtatgttatttgggttgcgttggtaggtcgcggaattgatggtatgacgttggcgtttttttttacggcgattgttatgtaggcgatgatgaacgtaatttgatggtgacgtaaatgggtcgtagtgtttttgcggtgtgttgttttaggatatcgcggcgatttcgttggtggcgatgatttcgttttggtaacgagtagtgtttcgacgacgatgggcgtatttgttttttcgggttaaaagtggcgggtgcgttggtgttggtggtattgttggggcgttatttacgcgttcggcgttgcgttttgtagttcgttttggtttgcgggaagttttagtgtcgtggcgttatttttcgtgtttggttttggtttgttgttggagagtcggtttgtcgatggcgatgggcgcgtttttgacgggcgtattgcgtaagttcggatatcgattgtcggatgtattttttaattagttcggtattttttatatttatgttttaaatttgttggtatttaa

SEQ ID NO: 9870 - DNA, 1188 bp, Artificial Sequence
  chemically treated genomic DNA (Homo sapiens) CpG-island No: 9870
ttaaataccaacaaatttaaaacataaatataaaaaataccgaactaattaaaaaatacatccgacaatcgatatccgaacttacgcaatacgcccgtcaaaaacgcgcccatcgccatcgacaaaccgactctccaacaacaaaccaaaaccaaacacgaaaaataacgccacgacactaaaacttcccgcaaaccaaaacgaactacaaaacgcaacgccgaacgcgtaaataacgccccaacaataccaccaacaccaacgcacccgccacttttaacccgaaaaaacaaatacgcccatcgtcgtcgaaacactactcgttaccaaaacgaaatcatcgccaccaacgaaatcgccgcgatatcctaaaacaacacaccgcaaaaacactacgacccatttacgtcaccatcaaattacgttcatcatcgcctacataacaatcgccgtaaaaaaaaacgccaacgtcataccatcaattccgcgacctaccaacgcaacccaaataacatacaaaacaacccaacaaaccgccgcaaatcaccatctacaatacgccacaaccgaacactccgcacgcaacttccacaacctttataaatcgaattcgaaaccgataataacaacatcaacaccaacccaatctcgacaaaatacaaaataaattcgaatcgatcaccaatcgcaacccccacgaaccaataatacaaccgacgatcgataaccaaataccgatcccaaaccaaaacgtaccgcaataaatacaataacgctaccgaaccgaaataaatcaacgcctaaatcaacgtataactatcataataaacctcctaccattccaacaaacgttacttataataacgcgctacccttcgaaaatttcgtcgtcacaaataaaaatacaatacataacaacgataacaaccaattcaacccgcaataaattaccgtcgcctataacgacgcgacaacacatcaaaacccgaatacgcaccaatttcaaaataactttcccgccgccgatcgtcaccgcccacaacaaatatttaccatacaacgccgaccgccataaccgtaaacccaaccgtaaaaaaaaactttatcgatccaaatttaaaaaacgaaaaaatactataccactacatcgaatactaccaaacatcaaatcgacgcgaaacaacgcct

SEQ ID NO: 9871 - DNA, 1188 bp, Artificial Sequence
  chemically treated genomic DNA (Homo sapiens) CpG-island No: 9871
ttgaatgttagtaaatttgagatatgagtgtagaaggtatcgagttgattgaagggtatattcggtagtcggtattcgagtttgcgtagtacgttcgttagaaacgcgtttatcgttatcgataagtcgattttttagtagtaaattaaagttaaatacgaggaataacgttacggtattaaaatttttcgtaagttagagcgggttataaaacgtagcgtcggacgcgtgaatagcgttttagtaatattattagtattagcgtattcgttatttttaattcgagagagtaaatgcgtttatcgtcgtcgaggtattgttcgttgttagagcggaattatcgttattagcgggatcgtcgcgatattttggaatagtatatcgtaaaggtattgcgatttatttgcgttattattagattgcgtttattatcgtttgtatggtaatcgtcgtagaggagagcgttagcgttatgttattaatttcgcgatttgttagcgtagtttaagtaatatgtagaatagtttagtaggtcgtcgtaaattattatttgtaatgcgttatagtcgaatatttcgtacgtagtttttatagtttttgtggatcgagttcgaggtcgataataatagtattagtattagtttaatttcggtaaagtgtagaatagattcggatcggttattagtcgtagtttttacgggttaataatgtagtcggcgatcggtagttaagtatcgattttagattaagacgtatcgtaatgggtataatagcgttgtcgaatcgagataaattagcgtttgaattagcgtatggttattatgatgggttttttgttattttagtagacgttgtttatagtgacgcgttgtttttcgagggtttcgtcgttataaataaaggtgtagtgtatggtaacggtggtagttagtttagttcgtagtagattgtcgtcgtttgtagcggcgcgatagtatattaaagttcggatgcgtattaattttaaaatggttttttcgtcgtcggtcgttatcgtttatagtaaatgtttgttatgtagcgtcggtcgttatgatcgtaagtttagtcgtgggagaaaattttatcgatttaagtttgaggagcggaggaatgttgtattattgtatcggatgttgttagatattagatcggcgcgagatagcgttt

SEQ ID NO: 9872 - DNA, 1188 bp, Artificial Sequence
  chemically treated genomic DNA (Homo sapiens) CpG-island No: 9872
aaacgctatctcgcgccgatctaatatctaacaacatccgatacaataatacaacattcctccgctcctcaaacttaaatcgataaaattttctcccacgactaaacttacgatcataacgaccgacgctacataacaaacatttactataaacgataacgaccgacgacgaaaaaaccattttaaaattaatacgcatccgaactttaatatactatcgcgccgctacaaacgacgacaatctactacgaactaaactaactaccaccgttaccatacactacacctttatttataacgacgaaaccctcgaaaaacaacgcgtcactataaacaacgtctactaaaataacaaaaaacccatcataataaccatacgctaattcaaacgctaatttatctcgattcgacaacgctattatacccattacgatacgtcttaatctaaaatcgatacttaactaccgatcgccgactacattattaacccgtaaaaactacgactaataaccgatccgaatctattctacactttaccgaaattaaactaatactaatactattattatcgacctcgaactcgatccacaaaaactataaaaactacgtacgaaatattcgactataacgcattacaaataataatttacgacgacctactaaactattctacatattacttaaactacgctaacaaatcgcgaaattaataacataacgctaacgctctcctctacgacgattaccatacaaacgataataaacgcaatctaataataacgcaaataaatcgcaatacctttacgatatactattccaaaatatcgcgacgatcccgctaataacgataattccgctctaacaacgaacaatacctcgacgacgataaacgcatttactctctcgaattaaaaataacgaatacgctaatactaataatattactaaaacgctattcacgcgtccgacgctacgttttataacccgctctaacttacgaaaaattttaataccgtaacgttattcctcgtatttaactttaatttactactaaaaaatcgacttatcgataacgataaacgcgtttctaacgaacgtactacgcaaactcgaataccgactaccgaatatacccttcaatcaactcgataccttctacactcatatctcaaatttactaacattcaa

SEQ ID NO: 9873 - DNA, 513 bp, Artificial Sequence
  chemically treated genomic DNA (Homo sapiens) CpG-island No: 9873
  misc_feature (317)..(317): n is either a, c, g or t
aagaacgtcgtgtaaattcgattaacggggtcgttaggatcgttgtgatgggggtcgggaaatttatcgaagagagggcggtcgattattgggggaaacgttgaggagaaatttcgtttgatgataagtcgttttttagtgtatacggtttttcggaatagaggtaaatatattacggtaataataattcggtagagagagtttcgcgataataggtatattatttagaataggtattattgaataaagtaataggcggtataaggttatttcgcggtagggttttttcgcgttttttattcgattttttcgtgttngagtgttattggaagtttatggtcgcgtatttttgtagattggtgtcgttacgtcgttattgtagtattgatgttgttgatcgcgtcgaaattgtatcgtagacgtaggatgacgttgtagataaagcggcgaaagtagtcgtagcgtaaatttagggaaatttttttataagtcgttaatttttcgttagcggtt

SEQ ID NO: 9874 - DNA, 513 bp, Artificial Sequence
  chemically treated genomic DNA (Homo sapiens) CpG-island No: 9874
  misc_feature (197)..(197): n is either a, c, g or t
aaccgctaacgaaaaattaacgacttataaaaaaatttccctaaatttacgctacgactactttcgccgctttatctacaacgtcatcctacgtctacgatacaatttcgacgcgatcaacaacatcaatactacaataacgacgtaacgacaccaatctacaaaaatacgcgaccataaacttccaataacactcnaacacgaaaaaatcgaataaaaaacgcgaaaaaaccctaccgcgaaataaccttataccgcctattactttattcaataatacctattctaaataatatacctattatcgcgaaactctctctaccgaattattattaccgtaatatatttacctctattccgaaaaaccgtatacactaaaaaacgacttatcatcaaacgaaatttctcctcaacgtttcccccaataatcgaccgccctctcttcgataaatttcccgacccccatcacaacgatcctaacgaccccgttaatcgaatttacacgacgttctt

SEQ ID NO: 9875 - DNA, 513 bp, Artificial Sequence
  chemically treated genomic DNA (Homo sapiens) CpG-island No: 9875
  misc_feature (197)..(197): n is either a, c, g or t
agtcgttaacgaaaagttagcggtttgtaaaagagtttttttgaatttacgttacggttgttttcgtcgttttgtttgtagcgttattttgcgtttgcggtgtagtttcggcgcggttagtagtattagtattgtaataacggcgtagcgatattaatttgtaagaatacgcgattatagatttttagtgatatttnagtacgggggggtcgggtggggagcgcgaggaggttttgtcgcggggtaattttgtgtcgtttgttgttttgtttagtggtatttgttttgggtgatgtgtttattatcgcggggttttttttatcgggttgttattatcgtggtgtgtttgtttttgtttcgggaaatcgtgtatattagaggacggtttattattaggcggggtttttttttagcgttttttttaatagtcggtcgtttttttttcgataagtttttcggtttttattatagcgattttggcgatttcgttaatcgggtttgtacggcgttttt

SEQ ID NO: 9876 - DNA, 513 bp, Artificial Sequence
  chemically treated genomic DNA (Homo sapiens) CpG-island No: 9876
  misc_feature (317)..(317): n is either a, c, g or t
aaaaacgccgtacaaacccgattaacgaaatcgccaaaatcgctataataaaaaccgaaaaacttatcgaaaaaaaaacgaccgactattaaaaaaaacgctaaaaaaaaaccccgcctaataataaaccgtcctctaatatacacgatttcccgaaacaaaaacaaacacaccacgataataacaacccgataaaaaaaaccccgcgataataaacacatcacccaaaacaaataccactaaacaaaacaacaaacgacacaaaattaccccgcgacaaaacctcctcgcgctccccacccgacccccccgtactnaaatatcactaaaaatctataatcgcgtattcttacaaattaatatcgctacgccgttattacaatactaatactactaaccgcgccgaaactacaccgcaaacgcaaaataacgctacaaacaaaacgacgaaaacaaccgtaacgtaaattcaaaaaaactcttttacaaaccgctaacttttcgttaacgact

SEQ ID NO: 9877 - DNA, 573 bp, Artificial Sequence
  chemically treated genomic DNA (Homo sapiens) CpG-island No: 9877
agcgtcgcgttatttttttgttgcgttgttttagtttttaggtaattagcgaatcgtgttagtcgtttgttagatgttgattacgttttgattgaatttttacgttaatatcggatgttaaagcgtggcgcgtatcgtcgagtcggttttattgatatgttgatcgttcggttcgacgaacgtagcgttttataacggattgtattcgattgtttttgttattagcggtaaaacgtttaatgtttagaaattagtttttgcgtttatgagaggtcgatacggattcggataaatttattgaatagtgttatattagtttcgtttaatgtttatgcgttatcgttatcgagagaaattagcgtcgaattagtgtgttagagtagcggttcgtttttgtttttagtatcgttatcgcgcgttttgtcgggtaaaaacgattaatagagaagaacgttgcgttaatcggtagtcgcgttcggggtgtaaatttggtatttttattacgcgttgtatgtgggtaaatttgtcgtggtgtgtaattgttggatcgttaaattttcgattataggttat

SEQ ID NO: 9878 - DNA, 573 bp, Artificial Sequence
  chemically treated genomic DNA (Homo sapiens) CpG-island No: 9878
ataacctataatcgaaaatttaacgatccaacaattacacaccacgacaaatttacccacatacaacgcgtaataaaaataccaaatttacaccccgaacgcgactaccgattaacgcaacgttcttctctattaatcgtttttacccgacaaaacgcgcgataacgatactaaaaacaaaaacgaaccgctactctaacacactaattcgacgctaatttctctcgataacgataacgcataaacattaaacgaaactaatataacactattcaataaatttatccgaatccgtatcgacctctcataaacgcaaaaactaatttctaaacattaaacgttttaccgctaataacaaaaacaatcgaatacaatccgttataaaacgctacgttcgtcgaaccgaacgatcaacatatcaataaaaccgactcgacgatacgcgccacgctttaacatccgatattaacgtaaaaattcaatcaaaacgtaatcaacatctaacaaacgactaacacgattcgctaattacctaaaaactaaaacaacgcaacaaaaaaataacgcgacgct

SEQ ID NO: 9879 - DNA, 573 bp, Artificial Sequence
  chemically treated genomic DNA (Homo sapiens) CpG-island No: 9879
atgatttgtgatcgagagtttagcgatttaataattatatattacggtaaatttatttatatgtagcgcgtagtggggatgttagatttatatttcggacgcggttatcgattggcgtagcgtttttttttgttggtcgtttttattcggtaagacgcgcggtaacggtgttggaaatagaaacgggtcgttattttgatatattggttcggcgttggtttttttcgatggcgataacgtatgggtattaagcgaagttggtgtggtattatttagtggatttgttcgagttcgtatcggttttttatgggcgtaaaaattggtttttgggtattgggcgttttatcgttgatagtaggaataatcggatgtaattcgttatgagacgttgcgttcgtcgggtcgggcggttaatatgttaataaaatcgattcggcggtacgcgttacgttttggtattcggtattagcgtgaaggtttagttagagcgtagttagtatttaataagcggttggtacgattcgttgattgtttggaagttggagtaacgtaataggaaaatagcgcggcgtt

SEQ ID NO: 9880 - DNA, 573 bp, Artificial Sequence
  chemically treated genomic DNA (Homo sapiens) CpG-island No: 9880
aacgccgcgctattttcctattacgttactccaacttccaaacaatcaacgaatcgtaccaaccgcttattaaatactaactacgctctaactaaaccttcacgctaataccgaataccaaaacgtaacgcgtaccgccgaatcgattttattaacatattaaccgcccgacccgacgaacgcaacgtctcataacgaattacatccgattattcctactatcaacgataaaacgcccaatacccaaaaaccaatttttacgcccataaaaaaccgatacgaactcgaacaaatccactaaataataccacaccaacttcgcttaatacccatacgttatcgccatcgaaaaaaaccaacgccgaaccaatatatcaaaataacgacccgtttctatttccaacaccgttaccgcgcgtcttaccgaataaaaacgaccaacaaaaaaaaacgctacgccaatcgataaccgcgtccgaaatataaatctaacatccccactacgcgctacatataaataaatttaccgtaatatataattattaaatcgctaaactctcgatcacaaatcat

SEQ ID NO: 9881 - DNA, 1347 bp, Artificial Sequence
  chemically treated genomic DNA (Homo sapiens) CpG-island No: 9881
  misc_feature (7)..(7): n is either a, c, g or t
  misc_feature (15)..(15): n is either a, c, g or t
  misc_feature (17)..(17): n is either a, c, g or t
  misc_feature (21)..(21): n is either a, c, g or t
  misc_feature (1204)..(1205): n is either a, c, g or t
  misc_feature (1277)..(1277): n is either a, c, g or t
  misc_feature (1282)..(1282): n is either a, c, g or t
  misc_feature (1293)..(1293): n is either a, c, g or t
  misc_feature (1301)..(1302): n is either a, c, g or t
  misc_feature (1310)..(1310): n is either a, c, g or t
  misc_feature (1317)..(1319): n is either a, c, g or t
  misc_feature (1323)..(1324): n is either a, c, g or t
  misc_feature (1328)..(1328): n is either a, c, g or t
  misc_feature (1331)..(1331): n is either a, c, g or t
  misc_feature (1335)..(1336): n is either a, c, g or t
  misc_feature (1338)..(1338): n is either a, c, g or t
  misc_feature (1340)..(1340): n is either a, c, g or t
  misc_feature (1342)..(1342): n is either a, c, g or t
  misc_feature (1344)..(1344): n is either a, c, g or t
  misc_feature (1346)..(1346): n is either a, c, g or t
cgtgggngttcgggntnttanggttcggtttcgggtcggcgggttagtgtttttatggttgaagttagcgcgagaatttttttttcgatagtttttgtacggttatgcgtttttggaaattgttagttcgaggttggaataggtggcggtgtaatcgtaagtcggtagacgtggttggtgtcggaggcgtaattatttgtcgatttcggtgattagttttaagaaatatcgaatcggcgttggtgatgttatcgattagtttacggggttgcgggtttgaatgattaggtgtttcgggtcgtattggttggagattttacgtattgcgttaaatttttagttacgattaggcggttggcgtttaggtttggcgggcggtttcggtacgcggtagttttgttagttggcgttcgaggtttcggtaacgcgacgcgttatattagtagcgggcgttagtaaaatttttgtgagttcgggtcgtgtttagtttgagagagtaaattagaagttataaattcggcgtagcgtcgttgttagtaattattagtattttcgacgggttgcgggtatatcgatcgtcgtatcgtttagacgttggtttatttgacgttcgtttcggtgataaaggcgttattcggttcgaagattttgtttattttggtatagatttcgtattaaacgttagtgcggtaatggtttgtgcgtcgcgacgttaaatacgttttgtatatcgtatagttgcgtcgtataaaggatttatcggtaatcggcggcggtgagtatagtattatttttttatagttcgtatattcgtcggagtcgttagtattaatatcgttgagaagagcggggcgggtcgttaggaatatataatttaattgaagttatcggacgcgtgatttgcggtaacgtacgtttggttgcgtttttatatttatcggcggtagtttttggtagtgtggaaggttttaatattttttttattgcgtattcggtttaattcgtttgttttagttcgtcgtttaggcgtcgcggcgggggattttcgcgatttcgcgcggtaacgggttattaaattcgcgcgttttcgtaggttttatgcggtgtttttcgttatcgagaatatcgtaatagtgcgggtatgttttaaggcggaatcgcgggggtttatagtggggagtcgttgaaagttttgtgcggagtnngattttttcggtttataatttttcgttatgaacgttttgcggcgttttcgtattacgttaggtacgcgtcgnaggtntgttcggattncggttatnngtttgttncgaggannnttanngtanggnatanntngngntntng

SEQ ID NO: 9882 - DNA, 1347 bp, Artificial Sequence
  chemically treated genomic DNA (Homo sapiens) CpG-island No: 9882
  misc_feature (2)..(2): n is either a, c, g or t
  misc_feature (4)..(4): n is either a, c, g or t
  misc_feature (6)..(6): n is either a, c, g or t
  misc_feature (8)..(8): n is either a, c, g or t
  misc_feature (10)..(10): n is either a, c, g or t
  misc_feature (12)..(13): n is either a, c, g or t
  misc_feature (17)..(17): n is either a, c, g or t
  misc_feature (20)..(20): n is either a, c, g or t
  misc_feature (24)..(25): n is either a, c, g or t
  misc_feature (29)..(31): n is either a, c, g or t
  misc_feature (38)..(38): n is either a, c, g or t
  misc_feature (46)..(47): n is either a, c, g or t
  misc_feature (55)..(55): n is either a, c, g or t
  misc_feature (66)..(66): n is either a, c, g or t
  misc_feature (71)..(71): n is either a, c, g or t
  misc_feature (143)..(144): n is either a, c, g or t
  misc_feature (1327)..(1327): n is either a, c, g or t
  misc_feature (1331)..(1331): n is either a, c, g or t
  misc_feature (1333)..(1333): n is either a, c, g or t
  misc_feature (1341)..(1341): n is either a, c, g or t
cnanancncnanntatnccntacnntaannntcctcgnaacaaacnnataaccgnaatccgaacanacctncgacgcgtacctaacgtaatacgaaaacgccgcaaaacgttcataacgaaaaattataaaccgaaaaaatcnnactccgcacaaaactttcaacgactccccactataaacccccgcgattccgccttaaaacatacccgcactattacgatattctcgataacgaaaaacaccgcataaaacctacgaaaacgcgcgaatttaataacccgttaccgcgcgaaatcgcgaaaatcccccgccgcgacgcctaaacgacgaactaaaacaaacgaattaaaccgaatacgcaataaaaaaaatattaaaaccttccacactaccaaaaactaccgccgataaatataaaaacgcaaccaaacgtacgttaccgcaaatcacgcgtccgataacttcaattaaattatatattcctaacgacccgccccgctcttctcaacgatattaatactaacgactccgacgaatatacgaactataaaaaaataatactatactcaccgccgccgattaccgataaatcctttatacgacgcaactatacgatatacaaaacgtatttaacgtcgcgacgcacaaaccattaccgcactaacgtttaatacgaaatctataccaaaataaacaaaatcttcgaaccgaataacgcctttatcaccgaaacgaacgtcaaataaaccaacgtctaaacgatacgacgatcgatatacccgcaacccgtcgaaaatactaataattactaacaacgacgctacgccgaatttataacttctaatttactctctcaaactaaacacgacccgaactcacaaaaattttactaacgcccgctactaatataacgcgtcgcgttaccgaaacctcgaacgccaactaacaaaactaccgcgtaccgaaaccgcccgccaaacctaaacgccaaccgcctaatcgtaactaaaaatttaacgcaatacgtaaaatctccaaccaatacgacccgaaacacctaatcattcaaacccgcaaccccgtaaactaatcgataacatcaccaacgccgattcgatatttcttaaaactaatcaccgaaatcgacaaataattacgcctccgacaccaaccacgtctaccgacttacgattacaccgccacctattccaacctcgaactaacaatttccaaaaacgcataaccgtacaaaaactatcgaaaaaaaaattctcgcgctaacttcaaccataaaaacactaacccgccgacccgaaaccgaaccntaanancccgaacncccacg

SEQ ID NO: 9883 - DNA, 1347 bp, Artificial Sequence
  chemically treated genomic DNA (Homo sapiens) CpG-island No: 9883
  misc_feature (2)..(2): n is either a, c, g or t
  misc_feature (4)..(4): n is either a, c, g or t
  misc_feature (6)..(6): n is either a, c, g or t
  misc_feature (8)..(8): n is either a, c, g or t
  misc_feature (10)..(10): n is either a, c, g or t
  misc_feature (12)..(13): n is either a, c, g or t
  misc_feature (17)..(17): n is either a, c, g or t
  misc_feature (20)..(20): n is either a, c, g or t
  misc_feature (24)..(25): n is either a, c, g or t
  misc_feature (29)..(31): n is either a, c, g or t
  misc_feature (38)..(38): n is either a, c, g or t
  misc_feature (46)..(47): n is either a, c, g or t
  misc_feature (55)..(55): n is either a, c, g or t
  misc_feature (66)..(66): n is either a, c, g or t
  misc_feature (71)..(71): n is either a, c, g or t
  misc_feature (143)..(144): n is either a, c, g or t
  misc_feature (1327)..(1327): n is either a, c, g or t
  misc_feature (1331)..(1331): n is either a, c, g or t
  misc_feature (1333)..(1333): n is either a, c, g or t
  misc_feature (1341)..(1341): n is either a, c, g or t
tnanantntngnntgtnttntgtnntggnnnttttcgnaataggtnngtaatcgnaattcggatanatttncggcgcgtgtttggcgtagtgcgggaacgtcgtagggcgtttatagcggggaattgtgggtcgaaaggattnngtttcgtataaagtttttaacggttttttattgtaagttttcgcgatttcgttttgaagtatattcgtattgttacgatattttcgataacggaaagtatcgtatgaggtttgcggaaacgcgcgagtttgataattcgttatcgcgcgaggtcgcgagaatttttcgtcgcgacgtttgagcgacgagttaaaataggcgaattgggtcgggtgcgtagtaaaaagaatattgaaattttttatattgttaaaaattgtcgtcggtagatgtagaaacgtagttaggcgtgcgttgtcgtaggttacgcgttcggtagttttagttgggttgtatatttttggcggttcgtttcgttttttttaacggtattaatgttggcgatttcggcgagtatgcgggttgtaaaaaagtggtgttgtgtttatcgtcgtcgattgtcgatggattttttatgcggcgtagttgtgcggtgtgtaggacgtgtttaacgtcgcggcgtataggttattgtcgtattggcgtttggtacggaatttgtgttaaagtggataaaattttcgggtcgggtaacgtttttgttatcgaagcgaacgttaggtgagttagcgtttggacggtgcggcgatcgatatgttcgtagttcgtcggaagtgttggtgattgttgatagcggcgttacgtcggatttgtggtttttgatttgtttttttaggttgaatacggttcggatttatagggattttattgacgttcgttgttgatatggcgcgtcgcgttgtcgaggtttcgaacgttaattggtagaattgtcgcgtgtcgaaatcgttcgttaggtttgaacgttagtcgtttgatcgtgattaaagatttagcgtagtgcgtgggatttttaattagtacggttcggagtatttgattatttagattcgtaatttcgtgaattggtcgatagtattattagcgtcggttcggtattttttgggattggttatcggaatcggtaggtgattacgttttcggtattaattacgtttatcgatttacggttatatcgttatttgttttagtttcgggttggtaatttttagaagcgtatgatcgtataggaattgtcgaaagaggggttttcgcgttggttttaattatagaaatattggttcgtcggttcgaagtcgggttntggnanttcgggtntttacg

SEQ ID NO: 9884 - DNA, 1347 bp, Artificial Sequence
  chemically treated genomic DNA (Homo sapiens) CpG-island No: 9884
  misc_feature (7)..(7): n is either a, c, g or t
  misc_feature (15)..(15): n is either a, c, g or t
  misc_feature (17)..(17): n is either a, c, g or t
  misc_feature (21)..(21): n is either a, c, g or t
  misc_feature (1204)..(1205): n is either a, c, g or t
  misc_feature (1277)..(1277): n is either a, c, g or t
  misc_feature (1282)..(1282): n is either a, c, g or t
  misc_feature (1293)..(1293): n is either a, c, g or t
  misc_feature (1301)..(1302): n is either a, c, g or t
  misc_feature (1310)..(1310): n is either a, c, g or t
  misc_feature (1317)..(1319): n is either a, c, g or t
  misc_feature (1323)..(1324): n is either a, c, g or t
  misc_feature (1328)..(1328): n is either a, c, g or t
  misc_feature (1331)..(1331): n is either a, c, g or t
  misc_feature (1335)..(1336): n is either a, c, g or t
  misc_feature (1338)..(1338): n is either a, c, g or t
  misc_feature (1340)..(1340): n is either a, c, g or t
  misc_feature (1342)..(1342): n is either a, c, g or t
  misc_feature (1344)..(1344): n is either a, c, g or t
  misc_feature (1346)..(1346): n is either a, c, g or t
cgtaaanacccgaantnccanaacccgacttcgaaccgacgaaccaatatttctataattaaaaccaacgcgaaaacccctctttcgacaattcctatacgatcatacgcttctaaaaattaccaacccgaaactaaaacaaataacgatataaccgtaaatcgataaacgtaattaataccgaaaacgtaatcacctaccgattccgataaccaatcccaaaaaataccgaaccgacgctaataatactatcgaccaattcacgaaattacgaatctaaataatcaaatactccgaaccgtactaattaaaaatcccacgcactacgctaaatctttaatcacgatcaaacgactaacgttcaaacctaacgaacgatttcgacacgcgacaattctaccaattaacgttcgaaacctcgacaacgcgacgcgccatatcaacaacgaacgtcaataaaatccctataaatccgaaccgtattcaacctaaaaaaacaaatcaaaaaccacaaatccgacgtaacgccgctatcaacaatcaccaacacttccgacgaactacgaacatatcgatcgccgcaccgtccaaacgctaactcacctaacgttcgcttcgataacaaaaacgttacccgacccgaaaattttatccactttaacacaaattccgtaccaaacgccaatacgacaataacctatacgccgcgacgttaaacacgtcctacacaccgcacaactacgccgcataaaaaatccatcgacaatcgacgacgataaacacaacaccacttttttacaacccgcatactcgccgaaatcgccaacattaataccgttaaaaaaaacgaaacgaaccgccaaaaatatacaacccaactaaaactaccgaacgcgtaacctacgacaacgcacgcctaactacgtttctacatctaccgacgacaatttttaacaatataaaaaatttcaatattctttttactacgcacccgacccaattcgcctattttaactcgtcgctcaaacgtcgcgacgaaaaattctcgcgacctcgcgcgataacgaattatcaaactcgcgcgtttccgcaaacctcatacgatactttccgttatcgaaaatatcgtaacaatacgaatatacttcaaaacgaaatcgcgaaaacttacaataaaaaaccgttaaaaactttatacgaaacnnaatcctttcgacccacaattccccgctataaacgccctacgacgttcccgcactacgccaaacacgcgccgnaaatntatccgaattncgattacnnacctattncgaaaannnccannacanaanacanncnanantntna

SEQ ID NO: 9885 - DNA, 991 bp, Artificial Sequence
  chemically treated genomic DNA (Homo sapiens) CpG-island No: 9885
tcgttgcgtaggcgagtagttagattagtagcgaagtgataatgtcgtttattattgtgatagcgcgatagtcgttaggttttgattaaatagtattatcgttatcgtacgtcgttttacgtttcggtgttaaagtttattacgttagggttgttagcgggttacgtattagcgattgaaaaatcgcgttattgacgtttagtgtgcgttaattaatagcgttattagtacgcgtggtaaacgttattcggtgttattatcgttatattgcgcggcgtatcgtttattagcgcggcgaatattgcgaggtttttagcgtgacggtatcgttgcgtaatttttagatatttgaattatataggcggaaattagtagtaaataggtgatgagtaatcggcgaagacgtaaattatgtattatttcgcgttttacgtcgtacgaggaagatcgtatcggtgtattaataaacgtattgattatagaaacgcgtagttcgtcggtataattattcgttcgatgatatcggtaaatagtagtagggtaggggagtaagtagcgtgacgggtagcgattagcgatgatcggtatttattagtaacgcgttatatgcggtattattaggttaataaaggtaatcgggttaatattgtcgtcgtattattataaagtacggtaatcgttagtagattaattattgtgtgcgcgttacgcgattgtttagcgtcgtcgcggtgtcgttgtcgggtttaaattgtttagcgcgcgatttagtaatagcgtagttgtttcggtattagtattcgggattagtattatttttaaggtatgtagattgcgaatattagcgaatcggtttgttagaaacgtaattgatcgtagacgttaggatagtagggcgattcggttggatttatttgcgtgagggtaacgcgggtattgattgtttattatcggtgtttatagattagtttttcgttgaaatatgaaatgt

SEQ ID NO: 9886 - DNA, 991 bp, Artificial Sequence
  chemically treated genomic DNA (Homo sapiens) CpG-island No: 9886
acatttcatatttcaacgaaaaactaatctataaacaccgataataaacaatcaatacccgcgttaccctcacgcaaataaatccaaccgaatcgccctactatcctaacgtctacgatcaattacgtttctaacaaaccgattcgctaatattcgcaatctacataccttaaaaataatactaatcccgaatactaataccgaaacaactacgctattactaaatcgcgcgctaaacaatttaaacccgacaacgacaccgcgacgacgctaaacaatcgcgtaacgcgcacacaataattaatctactaacgattaccgtactttataataatacgacgacaatattaacccgattacctttattaacctaataataccgcatataacgcgttactaataaataccgatcatcgctaatcgctacccgtcacgctacttactcccctaccctactactatttaccgatatcatcgaacgaataattataccgacgaactacgcgtttctataatcaatacgtttattaatacaccgatacgatcttcctcgtacgacgtaaaacgcgaaataatacataatttacgtcttcgccgattactcatcacctatttactactaatttccgcctatataattcaaatatctaaaaattacgcaacgataccgtcacgctaaaaacctcgcaatattcgccgcgctaataaacgatacgccgcgcaatataacgataataacaccgaataacgtttaccacgcgtactaataacgctattaattaacgcacactaaacgtcaataacgcgatttttcaatcgctaatacgtaacccgctaacaaccctaacgtaataaactttaacaccgaaacgtaaaacgacgtacgataacgataatactatttaatcaaaacctaacgactatcgcgctatcacaataataaacgacattatcacttcgctactaatctaactactcgcctacgcaacga

SEQ ID NO: 9887 - DNA, 991 bp, Artificial Sequence
  chemically treated genomic DNA (Homo sapiens) CpG-island No: 9887
atattttatattttaacgaaagattagtttatgagtatcgataataagtaattagtgttcgcgttatttttacgtaggtgggtttagtcggatcgttttgttattttgacgtttacgattagttgcgtttttggtaagtcggttcgttggtattcgtaatttatatattttaaaagtggtgttgatttcgggtgttgatgtcggagtaattgcgttattattgagtcgcgcgttgaatagtttgagttcggtagcgatatcgcgacggcgttgggtagtcgcgtggcgcgtatatagtgattggtttgttggcgattatcgtgttttgtggtagtgcgacggtaatgttggttcgattgtttttattggtttgatgatgtcgtatatggcgcgttgttggtgggtgtcgattatcgttggtcgttgttcgttacgttatttgtttttttgttttgttgttgtttgtcgatattatcgggcgggtgattgtgtcggcgaattgcgcgtttttgtggttagtgcgtttattggtgtatcggtgcgatttttttcgtgcgacgtaaaacgcgaggtggtgtatgatttacgttttcgtcgattatttattatttgtttgttgttggttttcgtttgtgtggtttaggtatttggggattacgtagcggtgtcgttacgttggaaatttcgtagtattcgtcgcgttgatgggcgatgcgtcgcgtagtatgacgatggtggtatcgaatggcgtttattacgcgtgttgatggcgttgttgattggcgtatattgggcgttagtggcgcgattttttagtcgttgatgcgtaattcgttggtagttttgacgtaatgggttttaatatcggggcgtggagcggcgtgcggtggcgatggtgttgtttggttaggatttgacggttatcgcgttgttataatggtgggcggtattgttatttcgttgttggtttggttgttcgtttgcgtaacgg

SEQ ID NO: 9888 - DNA, 991 bp, Artificial Sequence
  chemically treated genomic DNA (Homo sapiens) CpG-island No: 9888
ccgttacgcaaacgaacaaccaaaccaacaacgaaataacaataccgcccaccattataacaacgcgataaccgtcaaatcctaaccaaacaacaccatcgccaccgcacgccgctccacgccccgatattaaaacccattacgtcaaaactaccaacgaattacgcatcaacgactaaaaaatcgcgccactaacgcccaatatacgccaatcaacaacgccatcaacacgcgtaataaacgccattcgataccaccatcgtcatactacgcgacgcatcgcccatcaacgcgacgaatactacgaaatttccaacgtaacgacaccgctacgtaatccccaaatacctaaaccacacaaacgaaaaccaacaacaaacaaataataaataatcgacgaaaacgtaaatcatacaccacctcgcgttttacgtcgcacgaaaaaaatcgcaccgatacaccaataaacgcactaaccacaaaaacgcgcaattcgccgacacaatcacccgcccgataatatcgacaaacaacaacaaaacaaaaaaacaaataacgtaacgaacaacgaccaacgataatcgacacccaccaacaacgcgccatatacgacatcatcaaaccaataaaaacaatcgaaccaacattaccgtcgcactaccacaaaacacgataatcgccaacaaaccaatcactatatacgcgccacgcgactacccaacgccgtcgcgatatcgctaccgaactcaaactattcaacgcgcgactcaataataacgcaattactccgacatcaacacccgaaatcaacaccacttttaaaatatataaattacgaataccaacgaaccgacttaccaaaaacgcaactaatcgtaaacgtcaaaataacaaaacgatccgactaaacccacctacgtaaaaataacgcgaacactaattacttattatcgatactcataaactaatctttcgttaaaatataaaatat

SEQ ID NO: 9889 - DNA, 522 bp, Artificial Sequence
  chemically treated genomic DNA (Homo sapiens) CpG-island No: 9889
agacgaaaagcgggtagtttacgttacgtagagtaaatagacgattatttacgatggtagatgtatagtggagtacggggtgattttcgtttttttaagaagagaaggatgattgtagacgcgcgttttacgaaaggcgatgtttagttttagttcgggggtgtcggtcggagttaatgtattcgtacgtttgtcggtgataaattagtgttaggggtgtttatcggaagttataaatataggatttatcggggtatagtttagcgtcgtttttgtttttttttttattttttttttttggcgagggatgttagttttttgtagtcgggaagcggatcgttatatttttttgtatgatcgttgacgacgagtatttatcgtttttataattcgcgttattcgtacggaaatagttcgagtgggttagtgtcgattatagattatattttgattatgaggaatttcgattgttgcgcgatggatttgtaggtattataaatagggttagtacggttgcgtttt

SEQ ID NO: 9890 - DNA, 522 bp, Artificial Sequence
  chemically treated genomic DNA (Homo sapiens) CpG-island No: 9890
aaaacgcaaccgtactaaccctatttataatacctacaaatccatcgcgcaacaatcgaaattcctcataatcaaaatataatctataatcgacactaacccactcgaactatttccgtacgaataacgcgaattataaaaacgataaatactcgtcgtcaacgatcatacaaaaaaatataacgatccgcttcccgactacaaaaaactaacatccctcgccaaaaaaaaaaaataaaaaaaaaaacaaaaacgacgctaaactataccccgataaatcctatatttataacttccgataaacacccctaacactaatttatcaccgacaaacgtacgaatacattaactccgaccgacacccccgaactaaaactaaacatcgcctttcgtaaaacgcgcgtctacaatcatccttctcttcttaaaaaaacgaaaatcaccccgtactccactatacatctaccatcgtaaataatcgtctatttactctacgtaacgtaaactacccgcttttcgtct

SEQ ID NO: 9891 - DNA, 522 bp, Artificial Sequence
  chemically treated genomic DNA (Homo sapiens) CpG-island No: 9891
aggacgtagtcgtattgattttatttgtaatgtttataaatttatcgcgtagtaatcgaaattttttatggttaggatgtggtttgtagtcggtattggtttattcgggttgttttcgtacgaatggcgcgaattatgggggcggtaaatattcgtcgttagcggttatgtaagaagatgtgacggttcgtttttcggttgtaaaagattggtatttttcgttaaggggaaggaataaaaggaaaagtaaagacggcgttgaattgtgtttcgatgggttttgtgtttgtaattttcggtgggtatttttaatattggtttgttatcggtagacgtgcgggtatattaatttcgatcggtattttcggattgaaattgaatatcgtttttcgtgagacgcgcgtttgtaattatttttttttttttggagaggcgaagattatttcgtattttattgtgtatttattatcgtggatggtcgtttgtttattttgcgtggcgtgaattgttcgtttttcgttt

SEQ ID NO: 9892 - DNA, 522 bp, Artificial Sequence
  chemically treated genomic DNA (Homo sapiens) CpG-island No: 9892
aaacgaaaaacgaacaattcacgccacgcaaaataaacaaacgaccatccacgataataaatacacaataaaatacgaaataatcttcgcctctccaaaaaaaaaaaaataattacaaacgcgcgtctcacgaaaaacgatattcaatttcaatccgaaaataccgatcgaaattaatatacccgcacgtctaccgataacaaaccaatattaaaaatacccaccgaaaattacaaacacaaaacccatcgaaacacaattcaacgccgtctttacttttccttttattccttccccttaacgaaaaataccaatcttttacaaccgaaaaacgaaccgtcacatcttcttacataaccgctaacgacgaatatttaccgcccccataattcgcgccattcgtacgaaaacaacccgaataaaccaataccgactacaaaccacatcctaaccataaaaaatttcgattactacgcgataaatttataaacattacaaataaaatcaatacgactacgtcct

SEQ ID NO: 9893 - DNA, 1072 bp, Artificial Sequence
  chemically treated genomic DNA (Homo sapiens) CpG-island No: 9893
gggggatggacgtaggataatttgtcgggttgtgaaaaagcggtgtaggtgaaagtgaagttttgtttgatgtttagttcgaagtggtttatttattggcgaagtggaacgttagattttagggtaatacgattttagcgcgggcgaagggttgtaacgtatatgaaagtttttcgtttcgatgaagatcgttttttttcgttgtttcggtttatgttgattagtgggattgggaacgcgtaatgggcgacggtagcgttaattttcgattttgaaaagtacggtagaggcgatttgggcgggattaaagtaatcgaagttgcggttagcgaagagtttggtttggtatcgttttgtcggattagatttatttcgtatatagttaggagttattgtttcgtattcggattttgatgttaaagggcgtgagcgggcgatagcgaaagatttggcgcggtattttttgtcgggattggcggtaagttgagcgatggttattttacgacgtgcgcgtatcggattatgatgattggagtatttcgttagagtgggttatgcgggtttgaacggcgatattttggtgtggaattcggtattgaagatgcgtttgagtttttttttatggggattcgtgtagatgtcgatagttgaagtattaattggcgttgatcggtgacgaagatcgtttggagttgagtggtattaggcgttgttgcgcggtgaaatgtcgtagattatcggcggggtatcggttagtttcgtttgattatgttgttgttgtaattgtcgtatacggttaggtttagtgtggagtatggttagttgttgttcgcgagagcgtttttttttgttgtaataatttatcgtcgttagcgtttgagtaggcggtttgtatttcggtattaaagcgttagatatgatcgaaaatgcgtatgatgtcggttagtcgtgtgtcgatatcgttacggtatgaaagcgatgttgatgtatcgttgtagtttttttattttattcgtttcgtcgttaggtaatcgttgacgataatattagaaattaataacggatcgggatt

SEQ ID NO: 9894 - DNA, 1072 bp, Artificial Sequence
  chemically treated genomic DNA (Homo sapiens) CpG-island No: 9894
aatcccgatccgttattaatttctaatattatcgtcaacgattacctaacgacgaaacgaataaaataaaaaaactacaacgatacatcaacatcgctttcataccgtaacgatatcgacacacgactaaccgacatcatacgcattttcgatcatatctaacgctttaataccgaaatacaaaccgcctactcaaacgctaacgacgataaattattacaacaaaaaaaaacgctctcgcgaacaacaactaaccatactccacactaaacctaaccgtatacgacaattacaacaacaacataatcaaacgaaactaaccgataccccgccgataatctacgacatttcaccgcgcaacaacgcctaataccactcaactccaaacgatcttcgtcaccgatcaacgccaattaatacttcaactatcgacatctacacgaatccccataaaaaaaaactcaaacgcatcttcaataccgaattccacaccaaaatatcgccgttcaaacccgcataacccactctaacgaaatactccaatcatcataatccgatacgcgcacgtcgtaaaataaccatcgctcaacttaccgccaatcccgacaaaaaataccgcgccaaatctttcgctatcgcccgctcacgccctttaacatcaaaatccgaatacgaaacaataactcctaactatatacgaaataaatctaatccgacaaaacgataccaaaccaaactcttcgctaaccgcaacttcgattactttaatcccgcccaaatcgcctctaccgtacttttcaaaatcgaaaattaacgctaccgtcgcccattacgcgttcccaatcccactaatcaacataaaccgaaacaacgaaaaaaaacgatcttcatcgaaacgaaaaactttcatatacgttacaacccttcgcccgcgctaaaatcgtattaccctaaaatctaacgttccacttcgccaataaataaaccacttcgaactaaacatcaaacaaaacttcactttcacctacaccgctttttcacaacccgacaaattatcctacgtccatccccc

SEQ ID NO: 9895 - DNA, 1072 bp, Artificial Sequence
  chemically treated genomic DNA (Homo sapiens) CpG-island No: 9895
gatttcgattcgttgttgatttttgatgttatcgttagcggttgtttgacgacgggacgagtaaagtgaaagagttgtagcggtatattagtatcgtttttatgtcgtggcgatgtcggtatacggttaatcggtattatgcgtattttcgattatatttggcgttttgatatcgggatgtaagtcgtttgtttagacgttggcggcgataaattattatagtagagaaggacgttttcgcgaatagtagttggttatattttatattgaatttggtcgtatgcggtagttgtagtagtagtatagttaaacgagattggtcgatatttcgtcgatggtttgcggtattttatcgcgtagtagcgtttgatgttatttagttttaggcgattttcgttatcggttagcgttagttgatgttttagttgtcggtatttatacggatttttatggaggaaagtttaaacgtatttttagtatcgggttttatattagaatatcgtcgtttagattcgtatggtttattttgacggggtgttttagttattataattcggtgcgcgtacgtcgtgggatgattatcgtttagtttgtcgttaatttcgataaggaatatcgcgttagatttttcgttatcgttcgtttacgttttttggtattaagattcggatacgagatagtaatttttggttgtgtacgaagtggatttgattcggtaggacggtgttaggttaaatttttcgttaatcgtagtttcggttgttttaatttcgtttagatcgtttttatcgtgttttttagagtcgagaattgacgttatcgtcgtttattacgcgtttttagttttattggttaatatagatcgaggtaacggagaaagacggtttttatcggggcgaagggtttttatgtgcgttatagtttttcgttcgcgttgaagtcgtgttgttttaaggtttgacgttttatttcgttagtgaatgaattatttcgaattgggtattaggtagagttttatttttatttgtatcgtttttttatagttcgataagttattttgcgtttatttttt

SEQ ID NO: 9896 - DNA, 1072 bp, Artificial Sequence
  chemically treated genomic DNA (Homo sapiens) CpG-island No: 9896
aaaaaataaacgcaaaataacttatcgaactataaaaaaacgatacaaataaaaataaaactctacctaatacccaattcgaaataattcattcactaacgaaataaaacgtcaaaccttaaaacaacacgacttcaacgcgaacgaaaaactataacgcacataaaaacccttcgccccgataaaaaccgtctttctccgttacctcgatctatattaaccaataaaactaaaaacgcgtaataaacgacgataacgtcaattctcgactctaaaaaacacgataaaaacgatctaaacgaaattaaaacaaccgaaactacgattaacgaaaaatttaacctaacaccgtcctaccgaatcaaatccacttcgtacacaaccaaaaattactatctcgtatccgaatcttaataccaaaaaacgtaaacgaacgataacgaaaaatctaacgcgatattccttatcgaaattaacgacaaactaaacgataatcatcccacgacgtacgcgcaccgaattataataactaaaacaccccgtcaaaataaaccatacgaatctaaacgacgatattctaatataaaacccgatactaaaaatacgtttaaactttcctccataaaaatccgtataaataccgacaactaaaacatcaactaacgctaaccgataacgaaaatcgcctaaaactaaataacatcaaacgctactacgcgataaaataccgcaaaccatcgacgaaatatcgaccaatctcgtttaactatactactactacaactaccgcatacgaccaaattcaatataaaatataaccaactactattcgcgaaaacgtccttctctactataataatttatcgccgccaacgtctaaacaaacgacttacatcccgatatcaaaacgccaaatataatcgaaaatacgcataataccgattaaccgtataccgacatcgccacgacataaaaacgatactaatataccgctacaactctttcactttactcgtcccgtcgtcaaacaaccgctaacgataacatcaaaaatcaacaacgaatcgaaatc

SEQ ID NO: 9897 - DNA, 678 bp, Artificial Sequence
  chemically treated genomic DNA (Homo sapiens) CpG-island No: 9897
acgtattcgggtgaaagttttcgttacggcggggaatgttttaaagcgcgtttagtgagattaagataaaatcggtcggagtaatatcggggtagaacgtcgaaaggggaaaaatttcgtagataaacgcgggatcgatattcggagaggtaaagagagaaagcgtcgtatagcggaatagcggttttatattataggtaagatatatttagtcgtggtatttattatcggaatggttatatgtcgttagtacgtcgagcgtagataacgacggttagaaggttcgataatgtcgagcgttatcggaatggaaatataatcgttggttttattatcgattcgagaattaatttagagtatgttacgcggttacgtcgtcgttcgttagttttttggcgaggaagaagtttttatatcgtacgttagtagtgtttcggcgaatatcgatgggttagcgcgagtatttcgtaaatcggaataattatcggttcgagaacgtgagttagttcggtgttagcgcggttatatcgattatcgttaggtttagtgcgtttatgttataaagtttttttcgaattgatcgtttgatttttcgatatttttacgaatttatcgaggaaacgagtagaatcgtcgaattgcgataggattttgttacggtagttattagtataaaga

SEQ ID NO: 9898 - DNA, 678 bp, Artificial Sequence
  chemically treated genomic DNA (Homo sapiens) CpG-island No: 9898
tctttatactaataactaccgtaacaaaatcctatcgcaattcgacgattctactcgtttcctcgataaattcgtaaaaatatcgaaaaatcaaacgatcaattcgaaaaaaactttataacataaacgcactaaacctaacgataatcgatataaccgcgctaacaccgaactaactcacgttctcgaaccgataattattccgatttacgaaatactcgcgctaacccatcgatattcgccgaaacactactaacgtacgatataaaaacttcttcctcgccaaaaaactaacgaacgacgacgtaaccgcgtaacatactctaaattaattctcgaatcgataataaaaccaacgattatatttccattccgataacgctcgacattatcgaaccttctaaccgtcgttatctacgctcgacgtactaacgacatataaccattccgataataaataccacgactaaatatatcttacctataatataaaaccgctattccgctatacgacgctttctctctttacctctccgaatatcgatcccgcgtttatctacgaaatttttcccctttcgacgttctaccccgatattactccgaccgattttatcttaatctcactaaacgcgctttaaaacattccccgccgtaacgaaaactttcacccgaatacgt

SEQ ID NO: 9899 - DNA, 678 bp, Artificial Sequence
  chemically treated genomic DNA (Homo sapiens) CpG-island No: 9899
tttttatgttgatagttgtcgtagtaggattttgtcgtagttcggcggttttgttcgttttttcggtaagttcgtaaaagtatcgaaggattaggcggttagttcgaagaaggttttatggtatgggcgtattgggtttggcgatggtcggtatgatcgcgttggtatcggattggtttacgttttcgggtcggtaattatttcggtttacgaaatgttcgcgttaatttatcgatgttcgtcggaatattgttggcgtgcgatatgggggtttttttttcgttaaagagttggcgggcggcgacgtagtcgcgtggtatattttgggttaattttcgggtcgatgatggggttaacgattgtgtttttatttcggtggcgttcggtattatcgaattttttgatcgtcgttatttgcgttcggcgtgttggcggtatgtgattatttcgatggtgggtattacggttgggtatattttgtttgtggtgtgggatcgttgtttcgttatgcggcgttttttttttttgttttttcgggtgtcggtttcgcgtttatttgcggagttttttttttttcggcgttttgtttcggtgttatttcggtcggttttattttagttttattgggcgcgttttggaatatttttcgtcgtggcgaagatttttattcggatacgt

SEQ ID NO: 9900 - DNA, 678 bp, Artificial Sequence
  chemically treated genomic DNA (Homo sapiens) CpG-island No: 9900
acgtatccgaataaaaatcttcgccacgacgaaaaatattccaaaacgcgcccaataaaactaaaataaaaccgaccgaaataacaccgaaacaaaacgccgaaaaaaaaaaaactccgcaaataaacgcgaaaccgacacccgaaaaaacaaaaaaaaaaaacgccgcataacgaaacaacgatcccacaccacaaacaaaatatacccaaccgtaatacccaccatcgaaataatcacataccgccaacacgccgaacgcaaataacgacgatcaaaaaattcgataataccgaacgccaccgaaataaaaacacaatcgttaaccccatcatcgacccgaaaattaacccaaaatataccacgcgactacgtcgccgcccgccaactctttaacgaaaaaaaaacccccatatcgcacgccaacaatattccgacgaacatcgataaattaacgcgaacatttcgtaaaccgaaataattaccgacccgaaaacgtaaaccaatccgataccaacgcgatcataccgaccatcgccaaacccaatacgcccataccataaaaccttcttcgaactaaccgcctaatccttcgatacttttacgaacttaccgaaaaaacgaacaaaaccgccgaactacgacaaaatcctactacgacaactatcaacataaaaa

SEQ ID NO: 9901 - DNA, 615 bp, Artificial Sequence
  chemically treated genomic DNA (Homo sapiens) CpG-island No: 9901
ttcgcggtacgttttcgtattagtggatttttagtatttggtaataatacggaatagcggcgtaaaaagcgtttgcgtttattttatgtttgttacgatcgtttagtaatatcgagcgggcgagtaagtggttatttcggttagttttgggcgattaatgttttttttattttttttttgatcggttatagaaaaacggcgagtgggtattggtatttatcgtattgattataatatatgttgcgcgtttagtcgtcgttcggttaatgcggtatttattttatcgtgtaatcggtatgaataaacgtttttttgtttttcgtttttcgcgcgtggtgtcgagataataaaatataatgtcgatgggatcggtgatttcgttagcgcgttatttagttgcggattatggggattaaatatttcgggttatcgtttaacggacgtcgcgtcggcgtagtaatggcgttaattttcggtcgttaattaatattcgtagtaggtgatcgtttattagtttcgttgcgttgtaattagtatttgatttattttcgtttttttatagaattgtttgtttgcgttttacggtttatgtattaggtttaatagattatgagg

SEQ ID NO: 9902 - DNA, 615 bp, Artificial Sequence
  chemically treated genomic DNA (Homo sapiens) CpG-island No: 9902
cctcataatctattaaacctaatacataaaccgtaaaacgcaaacaaacaattctataaaaaaacgaaaataaatcaaatactaattacaacgcaacgaaactaataaacgatcacctactacgaatattaattaacgaccgaaaattaacgccattactacgccgacgcgacgtccgttaaacgataacccgaaatatttaatccccataatccgcaactaaataacgcgctaacgaaatcaccgatcccatcgacattatattttattatctcgacaccacgcgcgaaaaacgaaaaacaaaaaaacgtttattcataccgattacacgataaaataaataccgcattaaccgaacgacgactaaacgcgcaacatatattataatcaatacgataaataccaatacccactcgccgtttttctataaccgatcaaaaaaaaaataaaaaaaacattaatcgcccaaaactaaccgaaataaccacttactcgcccgctcgatattactaaacgatcgtaacaaacataaaataaacgcaaacgctttttacgccgctattccgtattattaccaaatactaaaaatccactaatacgaaaacgtaccgcgaa

SEQ ID NO: 9903 - DNA, 615 bp, Artificial Sequence
  chemically treated genomic DNA (Homo sapiens) CpG-island No: 9903
ttttatggtttattaagtttggtgtatgagtcgtggagcgtaggtagataattttgtaaaggagcgaagatgagttaggtattgattatagcgtaacggggttggtgggcggttatttgttgcggatgttgattaacgatcgaaagttaacgttattgttgcgtcgacgcgacgttcgttgggcgatagttcggggtgtttaatttttatgattcgtaattgagtgacgcgttggcgaggttatcgattttatcgatattgtgttttgttgtttcggtattacgcgcgagaagcggggagtaaagaggcgtttatttatgtcgattatacgatggagtggatatcgtattaatcgggcggcgattgggcgcgtagtatatgttgtagttagtgcgatgggtgttaatgtttattcgtcgtttttttataatcggttaaaggggagatggaagaagtattaatcgtttagaattggtcgaaatgattatttgttcgttcgttcgatgttattgggcgatcgtagtaaatatgggatgaacgtaaacgttttttgcgtcgttgtttcgtgttgttattaggtattggaaatttattgatgcgagaacgtgtcgcggg

SEQ ID NO: 9904 - DNA, 615 bp, Artificial Sequence
  chemically treated genomic DNA (Homo sapiens) CpG-island No: 9904
cccgcgacacgttctcgcatcaataaatttccaatacctaataacaacacgaaacaacgacgcaaaaaacgtttacgttcatcccatatttactacgatcgcccaataacatcgaacgaacgaacaaataatcatttcgaccaattctaaacgattaatacttcttccatctcccctttaaccgattataaaaaaacgacgaataaacattaacacccatcgcactaactacaacatatactacgcgcccaatcgccgcccgattaatacgatatccactccatcgtataatcgacataaataaacgcctctttactccccgcttctcgcgcgtaataccgaaacaacaaaacacaatatcgataaaatcgataacctcgccaacgcgtcactcaattacgaatcataaaaattaaacaccccgaactatcgcccaacgaacgtcgcgtcgacgcaacaataacgttaactttcgatcgttaatcaacatccgcaacaaataaccgcccaccaaccccgttacgctataatcaatacctaactcatcttcgctcctttacaaaattatctacctacgctccacgactcatacaccaaacttaataaaccataaaa

SEQ ID NO: 9905 - DNA, 565 bp, Artificial Sequence
  chemically treated genomic DNA (Homo sapiens) CpG-island No: 9905
  misc_feature (316)..(316): n is either a, c, g or t
  misc_feature (338)..(339): n is either a, c, g or t
gtagatcgaggaaacggttgagtacgattttatttatcgtagtggtgaacggttgggttttgtcgttagggtgttgtttattatattatagatggcgtaatgtattggtaacgcgtatcggtaatgtgtagcgtcggatcgtttatttattacgtagacgggcgagggcggtatttagatgttgcgacgttttacggcgtaggcgcggttgtagatatcgttttttagtatttgtaggtttagtagcgaacgggtatggttttttaaggcgggcggaatcggttcgcggataggggttagtttaaatttgtttttntggttttaaaggtggataattnntgtttcgtttgagtacgcggttgtgcgtaatgtattagttttatattttcgtagttttatagcgattaatcgttagtttgagcgttttaatatcgcgattcgggttgaaattagcgggattatcggatagtttagacgcgtcgatagagattaattttaatacgaatattttgtttttcggtaatgtcgagtatgttcgtgttataatgtagggaatgtcgagttt

SEQ ID NO: 9906 - DNA, 565 bp, Artificial Sequence
  chemically treated genomic DNA (Homo sapiens) CpG-island No: 9906
  misc_feature (227)..(228): n is either a, c, g or t
  misc_feature (250)..(250): n is either a, c, g or t
aaactcgacattccctacattataacacgaacatactcgacattaccgaaaaacaaaatattcgtattaaaattaatctctatcgacgcgtctaaactatccgataatcccgctaatttcaacccgaatcgcgatattaaaacgctcaaactaacgattaatcgctataaaactacgaaaatataaaactaatacattacgcacaaccgcgtactcaaacgaaacannaattatccacctttaaaaccanaaaaacaaatttaaactaacccctatccgcgaaccgattccgcccgccttaaaaaaccatacccgttcgctactaaacctacaaatactaaaaaacgatatctacaaccgcgcctacgccgtaaaacgtcgcaacatctaaataccgccctcgcccgtctacgtaataaataaacgatccgacgctacacattaccgatacgcgttaccaatacattacgccatctataatataataaacaacaccctaacgacaaaacccaaccgttcaccactacgataaataaaatcgtactcaaccgtttcctcgatctac

SEQ ID NO: 9907 - DNA, 565 bp, Artificial Sequence
  chemically treated genomic DNA (Homo sapiens) CpG-island No: 9907
  misc_feature (227)..(228): n is either a, c, g or t
  misc_feature (250)..(250): n is either a, c, g or t
gaattcggtattttttgtattgtggtacgaatatgttcgatattgtcgagaagtaaaatattcgtattgaaattgatttttgtcggcgcgtttgggttgttcggtgatttcgttggttttaattcgggtcgcggtattgaagcgtttaagttggcgattgatcgttataaagttacgagaatgtggaattggtgtattacgtatagtcgcgtgtttaagcgaagtanngattgtttatttttggggttangagaataggtttgaattggtttttgttcgcggatcgatttcgttcgttttggaagattatattcgttcgttgttgggtttgtaaatgttggaaggcgatatttatagtcgcgtttacgtcgtgaagcgtcgtagtatttggatgtcgttttcgttcgtttgcgtaatgagtggacgattcggcgttgtatattgtcgatgcgcgttattagtgtattgcgttatttgtgatgtggtaagtaatattttgacggtagaatttagtcgtttattattgcggtagataaaatcgtgtttaatcgttttttcggtttgt

SEQ ID NO: 9908 - DNA, 565 bp, Artificial Sequence
  chemically treated genomic DNA (Homo sapiens) CpG-island No: 9908
  misc_feature (316)..(316): n is either a, c, g or t
  misc_feature (338)..(339): n is either a, c, g or t
acaaaccgaaaaaacgattaaacacgattttatctaccgcaataataaacgactaaattctaccgtcaaaatattacttaccacatcacaaataacgcaatacactaataacgcgcatcgacaatatacaacgccgaatcgtccactcattacgcaaacgaacgaaaacgacatccaaatactacgacgcttcacgacgtaaacgcgactataaatatcgccttccaacatttacaaacccaacaacgaacgaatataatcttccaaaacgaacgaaatcgatccgcgaacaaaaaccaattcaaacctattctcntaaccccaaaaataaacaatcnntacttcgcttaaacacgcgactatacgtaatacaccaattccacattctcgtaactttataacgatcaatcgccaacttaaacgcttcaataccgcgacccgaattaaaaccaacgaaatcaccgaacaacccaaacgcgccgacaaaaatcaatttcaatacgaatattttacttctcgacaatatcgaacatattcgtaccacaatacaaaaaataccgaattc

SEQ ID NO: 9909 - DNA, 515 bp, Artificial Sequence
  chemically treated genomic DNA (Homo sapiens) CpG-island No: 9909
gttgtgtggagattacggtgtgttttacggtggtgcgtttcgtagggtaatatcgtagcgttagtgatatcggtaattgggttaacgcgatggtgcgattttttatttttatattggtcgtttgaaagtggtcgggaaatatttatttaggtacgtaacgagattatagcgcgtttcgatttagttttgaaagttcgtaagtcgatgttagcgtcgcggcgtttcgatcgtaaaagcgtacgttatcggcgaagttagtaaatcgggttagtagtcgattattatatttttttgattattatggatgcgattaacgtcgcgggcggtttgatttagatgtagattggcgtaacgtggtgtttatttagaatggcgtaaagataaagtgaatttttatgcgttgatgtagcgtggcgatttgcgttagaataattgttgtattcgggcgatattttatttatttcgcgtaacgatgatttgaagttttcgtgatgggtgaagtgggtaaatagagt

SEQ ID NO: 9910 - DNA, 515 bp, Artificial Sequence
  chemically treated genomic DNA (Homo sapiens) CpG-island No: 9910
actctatttacccacttcacccatcacgaaaacttcaaatcatcgttacgcgaaataaataaaatatcgcccgaatacaacaattattctaacgcaaatcgccacgctacatcaacgcataaaaattcactttatctttacgccattctaaataaacaccacgttacgccaatctacatctaaatcaaaccgcccgcgacgttaatcgcatccataataatcaaaaaaatataataatcgactactaacccgatttactaacttcgccgataacgtacgcttttacgatcgaaacgccgcgacgctaacatcgacttacgaactttcaaaactaaatcgaaacgcgctataatctcgttacgtacctaaataaatatttcccgaccactttcaaacgaccaatataaaaataaaaaatcgcaccatcgcgttaacccaattaccgatatcactaacgctacgatattaccctacgaaacgcaccaccgtaaaacacaccgtaatctccacacaac

SEQ ID NO: 9911 - DNA, 515 bp, Artificial Sequence
  chemically treated genomic DNA (Homo sapiens) CpG-island No: 9911
gttttgtttatttattttatttattacgaagattttagattatcgttgcgcggaataaataaaatatcgttcgggtgtagtagttgttttggcgtaagtcgttacgttgtattagcgtatagaggtttattttgtttttacgttattttgggtgagtattacgttgcgttagtttgtatttgggttagatcgttcgcggcgttaatcgtatttatgatggttagaggaatatggtaatcggttgttgattcgatttgttgatttcgtcggtgacgtacgtttttgcgatcggaacgtcgcgacgttgatatcgatttgcgggtttttaagattgaatcgagacgcgttgtaatttcgttgcgtatttgggtaagtgtttttcggttatttttaggcgattaatataggggtagaaaatcgtattatcgcgttaatttagttgtcggtattattggcgttacggtattgttttgcgggacgtattatcgtggggtatatcgtggtttttatatagt

SEQ ID NO: 9912 - DNA, 515 bp, Artificial Sequence
  chemically treated genomic DNA (Homo sapiens) CpG-island No: 9912
actatataaaaaccacgatataccccacgataatacgtcccgcaaaacaataccgtaacgccaataataccgacaactaaattaacgcgataatacgattttctacccctatattaatcgcctaaaaataaccgaaaaacacttacccaaatacgcaacgaaattacaacgcgtctcgattcaatcttaaaaacccgcaaatcgatatcaacgtcgcgacgttccgatcgcaaaaacgtacgtcaccgacgaaatcaacaaatcgaatcaacaaccgattaccatattcctctaaccatcataaatacgattaacgccgcgaacgatctaacccaaatacaaactaacgcaacgtaatactcacccaaaataacgtaaaaacaaaataaacctctatacgctaatacaacgtaacgacttacgccaaaacaactactacacccgaacgatattttatttattccgcgcaacgataatctaaaatcttcgtaataaataaaataaataaacaaaac

SEQ ID NO: 9913 - DNA, 563 bp, Artificial Sequence
  chemically treated genomic DNA (Homo sapiens) CpG-island No: 9913
tgtatcgaaatcggtgaagtggtttattttaaagttcgcgttacgtgttggcgattggcggagtagggcgtatttattagtttattattaacgttatattaatatcggcgacggtgtcggtatggttattcgtgtcggcgtacggtgtaggatatggaaatgtggtagttttattcgatcggtattgtcgggcgggcgtattggttatcgaaggttgtcgtggtgaaggcggttatttgcgaataaatatggcgaacgttttatggagcgttatgcgtcgaacgttaaaatttggcgggtcgtgacgtggttgcgcgttttattatgatcgaaattcggaaggtcgcggttgtgatggttcgtgggggttatacgcgaaattgaaatcgattatttgggtaaagaagttttcgaatttcgtttgtcgggtattttgagttttttcgtattttcgtttacgtcgattcggtgaaagagtcgatttcgttattttaatttgttattatatgatgggcggtatttcgagtaaagttacggttaggtattgattgtgaatgagaaat

SEQ ID NO: 9914 - DNA, 563 bp, Artificial Sequence
  chemically treated genomic DNA (Homo sapiens) CpG-island No: 9914
atttctcattcacaatcaatacctaaccgtaactttactcgaaataccgcccatcatataataacaaattaaaataacgaaatcgactctttcaccgaatcgacgtaaacgaaaatacgaaaaaactcaaaatacccgacaaacgaaattcgaaaacttctttacccaaataatcgatttcaatttcgcgtataacccccacgaaccatcacaaccgcgaccttccgaatttcgatcataataaaacgcgcaaccacgtcacgacccgccaaattttaacgttcgacgcataacgctccataaaacgttcgccatatttattcgcaaataaccgccttcaccacgacaaccttcgataaccaatacgcccgcccgacaataccgatcgaataaaactaccacatttccatatcctacaccgtacgccgacacgaataaccataccgacaccgtcgccgatattaatataacgttaataataaactaataaatacgccctactccgccaatcgccaacacgtaacgcgaactttaaaataaaccacttcaccgatttcgataca

SEQ ID NO: 9915 - DNA, 563 bp, Artificial Sequence
  chemically treated genomic DNA (Homo sapiens) CpG-island No: 9915
gttttttatttatagttagtgtttgatcgtaattttgttcggaatatcgtttattatgtagtgataggttgggataacggaatcggtttttttatcggatcgacgtgagcgaaggtacgggaaagtttaggatattcggtagacgggattcgagaatttttttatttaggtgatcggttttagtttcgcgtgtggtttttacggattattatagtcgcgatttttcggatttcgattatgatggaacgcgtaattacgttacggttcgttaggttttggcgttcggcgtataacgttttataaaacgttcgttatgtttgttcgtagataatcgtttttattacggtaattttcggtgattagtacgttcgttcggtaatgtcggtcgggtggaattgttatatttttatattttgtatcgtacgtcggtacggatagttatgtcgatatcgtcgtcggtgttaatgtggcgttggtggtggattgataaatacgttttgtttcgttagtcgttagtacgtagcgcgggttttgaaataaattattttatcggtttcgatgta

SEQ ID NO: 9916 - DNA, 563 bp, Artificial Sequence
  chemically treated genomic DNA (Homo sapiens) CpG-island No: 9916
tacatcgaaaccgataaaataatttatttcaaaacccgcgctacgtactaacgactaacgaaacaaaacgtatttatcaatccaccaccaacgccacattaacaccgacgacgatatcgacataactatccgtaccgacgtacgatacaaaatataaaaatataacaattccacccgaccgacattaccgaacgaacgtactaatcaccgaaaattaccgtaataaaaacgattatctacgaacaaacataacgaacgttttataaaacgttatacgccgaacgccaaaacctaacgaaccgtaacgtaattacgcgttccatcataatcgaaatccgaaaaatcgcgactataataatccgtaaaaaccacacgcgaaactaaaaccgatcacctaaataaaaaaattctcgaatcccgtctaccgaatatcctaaactttcccgtaccttcgctcacgtcgatccgataaaaaaaccgattccgttatcccaacctatcactacataataaacgatattccgaacaaaattacgatcaaacactaactataaataaaaaac

SEQ ID NO: 9917 - DNA, 1202 bp, Artificial Sequence
  chemically treated genomic DNA (Homo sapiens) CpG-island No: 9917
ttgtttcggtttgttgtcgttggtgaattcgtgtgttcggtatcgggttatcgttggggaatttttgtgatcgtggtttggttcggagtttttttaaattttttgaaggacggcgatttagtttttatcgttggtcgatcgttaattcgggaaacggattacggaagtttgatcgttcggaatgaggtgaaatagtgtagatgtttttgtttagttttattattatattattttggtaataattgtcggtaatatatcggtagatcgacggtagacgagagtaagagatagaacgattgatcgataatttcgttcgttgcgcgtaattggcgcgggaggtaggaacgacggtgtagaggtgatgggtttcgaagggtatttgattaacgaattttgacgttgcgtattaattagcgtagtgattagtggggcggcgattatttaatcggatgcgatttgtcgtagaagtagtgcgtgcggtgcgcgaacgttcggtaacgattttattattatttatcgattgtcgatgttcgatttggtgaagacggcgggatttttgtcgaaacggtagagttggcgtaggttattgagcggcgggcgcgattattattaatatcggtattggttggtatgaagtagtatttcgattattgttacgttcgtgtcgcgcggcgtatttagttgggtacgcgtaaattgaaaggttacgtttcgttgtcgttggtaattattaatcgattaacgattcgtaggttgtcgacgatattttttcgcgcggcgatgttatatggtatcgatggcgcgatcgttttttgttgatgcggagttgttgttaaagcgtaatcgggacgagtcgatgagattaatatttgtattggttgtattaggtttgtttcgattaaattttcgttggtaaagttatttcgtgtttgtgaattttcgcgtttggtacgaaattaaaatggtatttttttcgtcggaaaaaaaatttggcggggtcgtgggggtttgttggcggggttgttataacggggtcgggatacgtatttgttgagttattaaatggggagaaattttaacgcgtataagaggattataaaatacggtttaatacgataagaggagagttaatataaggggcgtatcgtaaaaatttaggatacgttttttttgttatataaattcgtttttattttttcgtt

SEQ ID NO: 9918 - DNA, 1202 bp, Artificial Sequence
  chemically treated genomic DNA (Homo sapiens) CpG-island No: 9918
aacgaaaaaataaaaacgaatttatataacaaaaaaaacgtatcctaaatttttacgatacgccccttatattaactctcctcttatcgtattaaaccgtattttataatcctcttatacgcgttaaaatttctccccatttaataactcaacaaatacgtatcccgaccccgttataacaaccccgccaacaaacccccacgaccccgccaaattttttttccgacgaaaaaaataccattttaatttcgtaccaaacgcgaaaattcacaaacacgaaataactttaccaacgaaaatttaatcgaaacaaacctaatacaaccaatacaaatattaatctcatcgactcgtcccgattacgctttaacaacaactccgcatcaacaaaaaacgatcgcgccatcgataccatataacatcgccgcgcgaaaaaatatcgtcgacaacctacgaatcgttaatcgattaataattaccaacgacaacgaaacgtaacctttcaatttacgcgtacccaactaaatacgccgcgcgacacgaacgtaacaataatcgaaatactacttcataccaaccaataccgatattaataataatcgcgcccgccgctcaataacctacgccaactctaccgtttcgacaaaaatcccgccgtcttcaccaaatcgaacatcgacaatcgataaataataataaaatcgttaccgaacgttcgcgcaccgcacgcactacttctacgacaaatcgcatccgattaaataatcgccgccccactaatcactacgctaattaatacgcaacgtcaaaattcgttaatcaaatacccttcgaaacccatcacctctacaccgtcgttcctacctcccgcgccaattacgcgcaacgaacgaaattatcgatcaatcgttctatctcttactctcgtctaccgtcgatctaccgatatattaccgacaattattaccaaaataatataataataaaactaaacaaaaacatctacactatttcacctcattccgaacgatcaaacttccgtaatccgtttcccgaattaacgatcgaccaacgataaaaactaaatcgccgtccttcaaaaaatttaaaaaaactccgaaccaaaccacgatcacaaaaattccccaacgataacccgataccgaacacacgaattcaccaacgacaacaaaccgaaacaa

SEQ ID NO: 9919 - DNA, 1202 bp, Artificial Sequence
  chemically treated genomic DNA (Homo sapiens) CpG-island No: 9919
aacgagaaaataaaagcgggtttatatgataagaggggcgtgttttgggtttttgcgatacgttttttgtgttggttttttttttgtcgtgttgggtcgtgttttgtagtttttttgtgcgcgttggaatttttttttatttggtggtttaataggtacgtgtttcggtttcgttatggtaatttcgttagtaggtttttacggtttcgttagatttttttttcggcgggaaggatgttattttggtttcgtgttaggcgcgaggatttataggtacgaggtgattttgttaacgaagatttgatcgagataggtttgatgtagttaatataagtgttgattttatcggttcgtttcgattgcgttttgatagtagtttcgtattagtaagaaacggtcgcgttatcgatattatatggtatcgtcgcgcgagagaatatcgtcggtaatttgcggatcgttaatcggttggtggttattagcggtagcgagacgtggttttttagtttgcgcgtatttagttaaatgcgtcgcgcggtacgggcgtggtaatggtcggaatattgttttatgttagttaatgtcggtgttgataatggtcgcgttcgtcgtttaatggtttgcgttagttttatcgtttcggtaaaagtttcgtcgtttttattaggtcgagtatcgatagtcggtagataataatgaagtcgttgtcgagcgttcgcgtatcgtacgtattatttttacggtaaatcgtattcggttgggtaatcgtcgttttattggttattacgttgattggtgcgtagcgttagaattcgttgattaaatatttttcggaatttattatttttatatcgtcgtttttgtttttcgcgttagttgcgcgtagcgggcgaaattgtcgattagtcgttttgttttttgttttcgtttgtcgtcgatttgtcggtgtgttgtcggtagttgttattaggatagtgtagtgatggagttaagtaaggatatttgtattgttttattttatttcgagcggttaaattttcgtggttcgtttttcgagttgacggtcgattagcgataaaagttgggtcgtcgttttttagaaaatttgaaggaatttcgggttaagttacggttataggagttttttagcggtagttcggtatcgaatatacggatttattagcggtaataggtcgggataa

SEQ ID NO: 9920 - DNA, 1202 bp, Artificial Sequence
  chemically treated genomic DNA (Homo sapiens) CpG-island No: 9920
ttatcccgacctattaccgctaataaatccgtatattcgataccgaactaccgctaaaaaactcctataaccgtaacttaacccgaaattccttcaaattttctaaaaaacgacgacccaacttttatcgctaatcgaccgtcaactcgaaaaacgaaccacgaaaatttaaccgctcgaaataaaataaaacaatacaaatatccttacttaactccatcactacactatcctaataacaactaccgacaacacaccgacaaatcgacgacaaacgaaaacaaaaaacaaaacgactaatcgacaatttcgcccgctacgcgcaactaacgcgaaaaacaaaaacgacgatataaaaataataaattccgaaaaatatttaatcaacgaattctaacgctacgcaccaatcaacgtaataaccaataaaacgacgattacccaaccgaatacgatttaccgtaaaaataatacgtacgatacgcgaacgctcgacaacgacttcattattatctaccgactatcgatactcgacctaataaaaacgacgaaacttttaccgaaacgataaaactaacgcaaaccattaaacgacgaacgcgaccattatcaacaccgacattaactaacataaaacaatattccgaccattaccacgcccgtaccgcgcgacgcatttaactaaatacgcgcaaactaaaaaaccacgtctcgctaccgctaataaccaccaaccgattaacgatccgcaaattaccgacgatattctctcgcgcgacgataccatataatatcgataacgcgaccgtttcttactaatacgaaactactatcaaaacgcaatcgaaacgaaccgataaaatcaacacttatattaactacatcaaacctatctcgatcaaatcttcgttaacaaaatcacctcgtacctataaatcctcgcgcctaacacgaaaccaaaataacatccttcccgccgaaaaaaaaatctaacgaaaccgtaaaaacctactaacgaaattaccataacgaaaccgaaacacgtacctattaaaccaccaaataaaaaaaaattccaacgcgcacaaaaaaactacaaaacacgacccaacacgacaaaaaaaaaaccaacacaaaaaacgtatcgcaaaaacccaaaacacgcccctcttatcatataaacccgcttttattttctcgtt

SEQ ID NO: 9921 - DNA, 917 bp, Artificial Sequence
  chemically treated genomic DNA (Homo sapiens) CpG-island No: 9921
gcgagttttcgacgtatattcgttatagcgcgttggcggcggtatttaatattcggtgttggttgtcggtttgacgttaacgttggcggtttggttggtcgaagttcgtagaatttgatgatgtttgtttattatttgatggtagtggcggggttggtttaattatcggcgtaattatgaaagagacggtaatcgttcgtgaaaggtgcgatatcggcggcgttagatatataggaagcgaagaattttgttagcgaaatgtattgttttttgagtattattaattattattattatttcggttaatgagtaaaggtaatcgttcgcgttagattcgggtaatcgttagtaatttcgatatttgatttaacgttagaattcgattacggggagtaattagtttggtaataaatcgatattcggtagtcgttgcgtattaagcggtaattttttattttggttttagtttgttgggcgattattagttagggacgaggttgcgtggtgttttgttacgttgataataattttatcgttcggttgtagacgggacgcgtatagtattgtgttattatgttgatggatttagtggtgtcgtcgtttagacgatagttttattattcggtgtatttagtaattgcgttatttttttcgtgtagttttataacgcgcggttaggcgttgggtttcggtaaatggttgcgatggacgttttcggcgtttagattgtaaaattgttgggtggtttaattacggttttaggtttaagcgcggtcgcggcgttgtcgagatagcgttcgtattttgtagtgcgggaaattgggcgcgaaattgcgcgggattaaaacgtttatggtatttttcggtttgatgtatcgatcgtgacgtaaaattattttgatataaggagagtgtta

SEQ ID NO: 9922 - DNA, 917 bp, Artificial Sequence
  chemically treated genomic DNA (Homo sapiens) CpG-island No: 9922
taacactctccttatatcaaaataattttacgtcacgatcgatacatcaaaccgaaaaataccataaacgttttaatcccgcgcaatttcgcgcccaatttcccgcactacaaaatacgaacgctatctcgacaacgccgcgaccgcgcttaaacctaaaaccgtaattaaaccacccaacaattttacaatctaaacgccgaaaacgtccatcgcaaccatttaccgaaacccaacgcctaaccgcgcgttataaaactacacgaaaaaaataacgcaattactaaatacaccgaataataaaactatcgtctaaacgacgacaccactaaatccatcaacataataacacaatactatacgcgtcccgtctacaaccgaacgataaaattattatcaacgtaacaaaacaccacgcaacctcgtccctaactaataatcgcccaacaaactaaaaccaaaataaaaaattaccgcttaatacgcaacgactaccgaatatcgatttattaccaaactaattactccccgtaatcgaattctaacgttaaatcaaatatcgaaattactaacgattacccgaatctaacgcgaacgattacctttactcattaaccgaaataataataataattaataatactcaaaaaacaatacatttcgctaacaaaattcttcgcttcctatatatctaacgccgccgatatcgcacctttcacgaacgattaccgtctctttcataattacgccgataattaaaccaaccccgccactaccatcaaataataaacaaacatcatcaaattctacgaacttcgaccaaccaaaccgccaacgttaacgtcaaaccgacaaccaacaccgaatattaaataccgccgccaacgcgctataacgaatatacgtcgaaaactcgc

SEQ ID NO: 9923 - DNA, 917 bp, Artificial Sequence
  chemically treated genomic DNA (Homo sapiens) CpG-island No: 9923
tagtattttttttgtattaaagtgattttgcgttacgatcggtgtattaagtcgaggagtattatgaacgttttaatttcgcgtagtttcgcgtttagtttttcgtattataggatgcgggcgttatttcgatagcgtcgcgatcgcgtttaaatttgaagtcgtggttgaattatttaatagttttatagtttgagcgtcggaaacgtttatcgtagttatttgtcgaagtttaacgtttgatcgcgcgttatgaagttgtacgagagaagtggcgtaattattgaatgtatcggatgataaaattatcgtttggacggcggtattattgaatttattaatatggtggtataatgttatgcgcgtttcgtttgtaatcgggcgatgagattattgttagcgtggtagaatattacgtaatttcgtttttggttgatggtcgtttaataaattggagttaaagtgggaaattgtcgtttaatgcgtagcgattgtcggatgtcgatttgttgttaaattgattatttttcgtagtcggattttggcgttgggttagatgtcgaagttattggcggttgttcggatttggcgcgagcgattatttttgtttattagtcgggatggtggtgatggttgatggtgtttagggggtagtgtatttcgttgatagaatttttcgttttttgtatatttgacgtcgtcggtgtcgtattttttacggacgattgtcgttttttttatggttacgtcggtgattaaattaatttcgttattattattaggtaataggtaggtattattagattttgcgagtttcgattagttaggtcgttagcgttggcgttagatcggtaattagtatcgaatattaaatgtcgtcgttagcgcgttgtaacggatatgcgtcgggaattcgt

SEQ ID NO: 9924 - DNA, 917 bp, Artificial Sequence
  chemically treated genomic DNA (Homo sapiens) CpG-island No: 9924
acgaattcccgacgcatatccgttacaacgcgctaacgacgacatttaatattcgatactaattaccgatctaacgccaacgctaacgacctaactaatcgaaactcgcaaaatctaataatacctacctattacctaataataataacgaaattaatttaatcaccgacgtaaccataaaaaaaacgacaatcgtccgtaaaaaatacgacaccgacgacgtcaaatatacaaaaaacgaaaaattctatcaacgaaatacactaccccctaaacaccatcaaccatcaccaccatcccgactaataaacaaaaataatcgctcgcgccaaatccgaacaaccgccaataacttcgacatctaacccaacgccaaaatccgactacgaaaaataatcaatttaacaacaaatcgacatccgacaatcgctacgcattaaacgacaatttcccactttaactccaatttattaaacgaccatcaaccaaaaacgaaattacgtaatattctaccacgctaacaataatctcatcgcccgattacaaacgaaacgcgcataacattataccaccatattaataaattcaataataccgccgtccaaacgataattttatcatccgatacattcaataattacgccacttctctcgtacaacttcataacgcgcgatcaaacgttaaacttcgacaaataactacgataaacgtttccgacgctcaaactataaaactattaaataattcaaccacgacttcaaatttaaacgcgatcgcgacgctatcgaaataacgcccgcatcctataatacgaaaaactaaacgcgaaactacgcgaaattaaaacgttcataatactcctcgacttaatacaccgatcgtaacgcaaaatcactttaatacaaaaaaaatacta

SEQ ID NO: 9925 - DNA, 566 bp, Artificial Sequence
  chemically treated genomic DNA (Homo sapiens) CpG-island No: 9925
ttgtttacggcgtagaagtagaatattagtcgtaaatttgtttgttgtatgagttgttttagttcgtttattcggtgtgtgttggtcggttcgtttataatgggggtttaaggtgatggtcgagcggatgattagtgtttgttacgtgaggttattagttcggtggtgtcgtaattttatttttttttcgtacgacggtagttcgggaataggttcgtagcgattttggtgaatcgtcggggtcgtattcgatagtattagtgtttttttttgatattcgttcggtgcgggtcgttatttaggtcgtgcgtattacggtggtgttagtgttcgcgtcgtgggagttttttcgggattttatttattcgtgatttcgtgcgttcgaagtataggagttttaatagtgtttcgaaagagagcgaaacgcgggttttttggggattaatttggagtacgtgttcggaagaatttggttcgtattatgaatagtatcgggggataatatttacgttagagaaggcgatattatcgtagcggaataaatattggagggaattaaagttata

SEQ ID NO: 9926 - DNA, 566 bp, Artificial Sequence
  chemically treated genomic DNA (Homo sapiens) CpG-island No: 9926
tataactttaattccctccaatatttattccgctacgataatatcgccttctctaacgtaaatattatcccccgatactattcataatacgaaccaaattcttccgaacacgtactccaaattaatccccaaaaaacccgcgtttcgctctctttcgaaacactattaaaactcctatacttcgaacgcacgaaatcacgaataaataaaatcccgaaaaaactcccacgacgcgaacactaacaccaccgtaatacgcacgacctaaataacgacccgcaccgaacgaatatcaaaaaaaaacactaatactatcgaatacgaccccgacgattcaccaaaatcgctacgaacctattcccgaactaccgtcgtacgaaaaaaaaataaaattacgacaccaccgaactaataacctcacgtaacaaacactaatcatccgctcgaccatcaccttaaacccccattataaacgaaccgaccaacacacaccgaataaacgaactaaaacaactcatacaacaaacaaatttacgactaatattctacttctacgccgtaaacaa

SEQ ID NO: 9927 - DNA, 566 bp, Artificial Sequence
  chemically treated genomic DNA (Homo sapiens) CpG-island No: 9927
tgtagttttagttttttttaatatttgtttcgttgcggtaatgtcgttttttttagcgtgggtattatttttcggtgttgtttatgatgcggattagattttttcggatacgtgttttagattggtttttagagaattcgcgtttcgttttttttcgggatattattagggtttttatatttcgaacgtacggaattacggatgggtaaaatttcgaagggatttttacggcgcgggtattgatattatcgtggtgcgtacggtttgaatgacggttcgtatcgggcgggtattagggaaaggtattgatgttatcgagtacggtttcgacggtttattaaaatcgttacgagtttgttttcggattatcgtcgtgcgaaaggaggatggagttgcgatattatcgggttggtggttttacgtggtaggtattaattattcgttcggttattattttaagtttttattgtagacggatcgattagtatatatcggatggacgggttggaatagtttatgtagtaggtagatttgcggttgatattttgtttttgcgtcgtggataa

SEQ ID NO: 9928 - DNA, 566 bp, Artificial Sequence
  chemically treated genomic DNA (Homo sapiens) CpG-island No: 9928
ttatccacgacgcaaaaacaaaatatcaaccgcaaatctacctactacataaactattccaacccgtccatccgatatatactaatcgatccgtctacaataaaaacttaaaataataaccgaacgaataattaatacctaccacgtaaaaccaccaacccgataatatcgcaactccatcctcctttcgcacgacgataatccgaaaacaaactcgtaacgattttaataaaccgtcgaaaccgtactcgataacatcaatacctttccctaatacccgcccgatacgaaccgtcattcaaaccgtacgcaccacgataatatcaatacccgcgccgtaaaaatcccttcgaaattttacccatccgtaattccgtacgttcgaaatataaaaaccctaataatatcccgaaaaaaaacgaaacgcgaattctctaaaaaccaatctaaaacacgtatccgaaaaaatctaatccgcatcataaacaacaccgaaaaataatacccacgctaaaaaaaacgacattaccgcaacgaaacaaatattaaaaaaaactaaaactaca

SEQ ID NO: 9929 - DNA, 859 bp, Artificial Sequence
  chemically treated genomic DNA (Homo sapiens) CpG-island No: 9929
gttggcggggaatttttatcgtagattaatgaaggcgattgtgtatatgttatcgacgttgtcggggattttcgtagtagaggcggtagtatgttgtaaaaaatcgataagttaattatgagcgtatttgaagtgggcgggtatttggtaaaatcgggaaagcggaaatcgttatcgattttgttcgttggagatggtagaaacgattatttagtttaagtcgtaggagtagtgcggttaggtatgacgatggataaaattattgaggaattggataatatcggcggttgtcggggttggcgaatttgtgggtgtcgttaattcgtaatcgttcgatatgtttttaatcggtattaaaagttttatcggtattaaagtttcggtattgtgttggcggatatcgacgcgatggttgagtaaattgaagaagagcgcgaacggtgttaggcgtagtttttgcgtttgtcgagcggttggaagtgggcgttatattaacgttgagattaatcgtgaaaaagtcgtacgttaggtatgacggtggcggatgtgtagttgtttgtgatttttgcggtgggcgggcgatggttggcgaaacggtggaagggattgttcgttatttaattaattgcgttattcgtaaagttggcgcgatagttcgtaggtattgcgttagtttcgattttgacgtcgatgaagtagtaaattattttggtagacgtggtcgtattaaagtttttatcggatcgtcgatgttgaaaatcgagaatgcgcgtcgacgagttggatttatatcgatgttcgcgatcgtgatatggtgtcggtgtttacgatttgtaaaaagcgatagttgaaaaagtgt

SEQ ID NO: 9930 - DNA, 859 bp, Artificial Sequence
  chemically treated genomic DNA (Homo sapiens) CpG-island No: 9930
acactttttcaactatcgctttttacaaatcgtaaacaccgacaccatatcacgatcgcgaacatcgatataaatccaactcgtcgacgcgcattctcgattttcaacatcgacgatccgataaaaactttaatacgaccacgtctaccaaaataatttactacttcatcgacgtcaaaatcgaaactaacgcaatacctacgaactatcgcgccaactttacgaataacgcaattaattaaataacgaacaatcccttccaccgtttcgccaaccatcgcccgcccaccgcaaaaatcacaaacaactacacatccgccaccgtcatacctaacgtacgactttttcacgattaatctcaacgttaatataacgcccacttccaaccgctcgacaaacgcaaaaactacgcctaacaccgttcgcgctcttcttcaatttactcaaccatcgcgtcgatatccgccaacacaataccgaaactttaataccgataaaacttttaataccgattaaaaacatatcgaacgattacgaattaacgacacccacaaattcgccaaccccgacaaccgccgatattatccaattcctcaataattttatccatcgtcatacctaaccgcactactcctacgacttaaactaaataatcgtttctaccatctccaacgaacaaaatcgataacgatttccgctttcccgattttaccaaatacccgcccacttcaaatacgctcataattaacttatcgattttttacaacatactaccgcctctactacgaaaatccccgacaacgtcgataacatatacacaatcgccttcattaatctacgataaaaattccccgccaac

SEQ ID NO: 9931 - DNA, 859 bp, Artificial Sequence
  chemically treated genomic DNA (Homo sapiens) CpG-island No: 9931
gtatttttttagttatcgttttttgtaaatcgtgaatatcgatattatgttacgatcgcgggtatcgatataaatttagttcgtcggcgcgtattttcggtttttagtatcgacggttcggtagagattttaatgcggttacgtttgttagggtgatttgttgttttatcggcgttaggatcggagttggcgtagtgtttgcggattatcgcgttagttttgcggataacgtaattaattggataacgggtaattttttttatcgtttcgttaattatcgttcgtttatcgtagaagttataaataattgtatattcgttatcgttatatttaacgtgcggtttttttacggttaattttaacgttgatatagcgtttatttttagtcgttcggtaagcgtagaagttacgtttggtatcgttcgcgtttttttttaatttgtttagttatcgcgtcgatattcgttagtatagtgtcgaaattttaatgtcgatggggtttttaatgtcggttgagagtatatcgaacggttacgaattggcggtatttatagattcgttagtttcggtagtcgtcggtgttatttagttttttaatgattttgtttatcgttatgtttggtcgtattgtttttgcggtttaagttggatggtcgtttttattatttttagcgagtagaatcggtggcggttttcgttttttcggttttgttaaatattcgtttattttaggtacgtttataattagtttgtcggttttttgtagtatattgtcgtttttgttgcggaaattttcggtagcgtcgatggtatatatataatcgtttttattgatttgcggtaaaaatttttcgttaat

SEQ ID NO: 9932 - DNA, 859 bp, Artificial Sequence
  chemically treated genomic DNA (Homo sapiens) CpG-island No: 9932
attaacgaaaaatttttaccgcaaatcaataaaaacgattatatatataccatcgacgctaccgaaaatttccgcaacaaaaacgacaatatactacaaaaaaccgacaaactaattataaacgtacctaaaataaacgaatatttaacaaaaccgaaaaaacgaaaaccgccaccgattctactcgctaaaaataataaaaacgaccatccaacttaaaccgcaaaaacaatacgaccaaacataacgataaacaaaatcattaaaaaactaaataacaccgacgactaccgaaactaacgaatctataaataccgccaattcgtaaccgttcgatatactctcaaccgacattaaaaaccccatcgacattaaaatttcgacactatactaacgaatatcgacgcgataactaaacaaattaaaaaaaaacgcgaacgataccaaacgtaacttctacgcttaccgaacgactaaaaataaacgctatatcaacgttaaaattaaccgtaaaaaaaccgcacgttaaatataacgataacgaatatacaattatttataacttctacgataaacgaacgataattaacgaaacgataaaaaaaattacccgttatccaattaattacgttatccgcaaaactaacgcgataatccgcaaacactacgccaactccgatcctaacgccgataaaacaacaaatcaccctaacaaacgtaaccgcattaaaatctctaccgaaccgtcgatactaaaaaccgaaaatacgcgccgacgaactaaatttatatcgatacccgcgatcgtaacataatatcgatattcacgatttacaaaaaacgataactaaaaaaatac

SEQ ID NO: 9933 - DNA, 766 bp, Artificial Sequence
  chemically treated genomic DNA (Homo sapiens) CpG-island No: 9933
  misc_feature (711)..(711): n is either a, c, g or t
cgagtagtcgcgtcgttttttgtttatgtttttgcgtatgtcgtaatcggtcgttagtaacgttcgttttagttttggttgcgtttcggaaagtagttttgatgatcggaacgtagcgttttgtttgtttattgcgtaagaagcgcgtttagttgttcggttgtatttgcgaagtatttttcgtaatcgttgattaaatagttcgtcgggtaaattttgaattaatattttttgttcggcggtattatcgttagttagcggtaggtgttttttagttggcgtacgttgtttgttacgttagacgcgttagagtagtttcggttttcggatgtagtaatttttttttacgtttagttcgcgcgcggtaatttgtaaaaaatggcgcgttagcggggaatattttttcgacgttcgcgtagcggcggtagatgaacgcggaaacgtttaggcggtggaatagatttttacggaatttatttttttgtattgttgttcgagattttggtgagtggtagcgataattcgtatatttattttatcggcgtatagtcgttaacgcggtaaaattgatcgtttgttagtacgttagtaaacgcgtttgtatatttagcggtatattattaatttcgtcgaggataatgtatcgttatcggtttgtttaaaacgtttttgacgaatggtattgcgttagtaaacgcgtttttttcgtgngttaatagttttgattcgatttatttttcgcgataggtggtatatttagcgcgat

SEQ ID NO: 9934 - DNA, 766 bp, Artificial Sequence
  chemically treated genomic DNA (Homo sapiens) CpG-island No: 9934
  misc_feature (56)..(56): n is either a, c, g or t
atcgcgctaaatataccacctatcgcgaaaaataaatcgaatcaaaactattaacncacgaaaaaaacgcgtttactaacgcaataccattcgtcaaaaacgttttaaacaaaccgataacgatacattatcctcgacgaaattaataatataccgctaaatatacaaacgcgtttactaacgtactaacaaacgatcaattttaccgcgttaacgactatacgccgataaaataaatatacgaattatcgctaccactcaccaaaatctcgaacaacaatacaaaaaaataaattccgtaaaaatctattccaccgcctaaacgtttccgcgttcatctaccgccgctacgcgaacgtcgaaaaaatattccccgctaacgcgccattttttacaaattaccgcgcgcgaactaaacgtaaaaaaaaattactacatccgaaaaccgaaactactctaacgcgtctaacgtaacaaacaacgtacgccaactaaaaaacacctaccgctaactaacgataataccgccgaacaaaaaatattaattcaaaatttacccgacgaactatttaatcaacgattacgaaaaatacttcgcaaatacaaccgaacaactaaacgcgcttcttacgcaataaacaaacaaaacgctacgttccgatcatcaaaactactttccgaaacgcaaccaaaactaaaacgaacgttactaacgaccgattacgacatacgcaaaaacataaacaaaaaacgacgcgactactcg

SEQ ID NO: 9935 - DNA, 766 bp, Artificial Sequence
  chemically treated genomic DNA (Homo sapiens) CpG-island No: 9935
  misc_feature (56)..(56): n is either a, c, g or t
atcgcgttgaatatgttatttatcgcgaaagatggatcgaattagaattgttggtntacgagaaaggcgcgtttattggcgtaatattattcgttaggggcgttttgaataggtcgatggcggtatattattttcgacgaaattggtgatatgtcgttggatgtgtagacgcgtttgttggcgtgttggtagacggttagttttatcgcgttggcggttatgcgtcggtaaagtggatgtgcggattatcgttgttatttattagaatttcgaatagtagtgtaggaaggtaagtttcgtgaggatttgttttatcgtttgaacgttttcgcgtttatttgtcgtcgttgcgcgaacgtcgggaagatatttttcgttggcgcgttattttttataggttgtcgcgcgcgaattgggcgtagaaggaagttattgtattcggaaatcgaagttgttttgacgcgtttggcgtggtaggtaacgtgcgttagttggaaaatatttgtcgttggttaacggtgatgtcgtcgggtaggaagtgttgatttaggatttgttcggcgaattgtttgattaacggttgcggagagtatttcgtaaatgtaatcggatagttgggcgcgttttttgcgtagtgggtagatagagcgttgcgtttcggttattaaaattgtttttcgaagcgtagttagagttggagcggacgttattgacgatcggttgcgatatacgtaggggtataaataggaagcggcgcggttattcg

SEQ ID NO: 9936 - DNA, 766 bp, Artificial Sequence
  chemically treated genomic DNA (Homo sapiens) CpG-island No: 9936
  misc_feature (711)..(711): n is either a, c, g or t
cgaataaccgcgccgcttcctatttatacccctacgtatatcgcaaccgatcgtcaataacgtccgctccaactctaactacgcttcgaaaaacaattttaataaccgaaacgcaacgctctatctacccactacgcaaaaaacgcgcccaactatccgattacatttacgaaatactctccgcaaccgttaatcaaacaattcgccgaacaaatcctaaatcaacacttcctacccgacgacatcaccgttaaccaacgacaaatattttccaactaacgcacgttacctaccacgccaaacgcgtcaaaacaacttcgatttccgaatacaataacttccttctacgcccaattcgcgcgcgacaacctataaaaaataacgcgccaacgaaaaatatcttcccgacgttcgcgcaacgacgacaaataaacgcgaaaacgttcaaacgataaaacaaatcctcacgaaacttaccttcctacactactattcgaaattctaataaataacaacgataatccgcacatccactttaccgacgcataaccgccaacgcgataaaactaaccgtctaccaacacgccaacaaacgcgtctacacatccaacgacatatcaccaatttcgtcgaaaataatataccgccatcgacctattcaaaacgcccctaacgaataatattacgccaataaacgcgcctttctcgtanaccaacaattctaattcgatccatctttcgcgataaataacatattcaacgcgat

SEQ ID NO: 9937 - DNA, 668 bp, Artificial Sequence
  chemically treated genomic DNA (Homo sapiens) CpG-island No: 9937
gacgcgttatcgtgagcgatcggagtagtttagacgttgattgttaataatttggtaatttttaggtttttgttcgcgattagtattatattattttttttagtttgtataacgcgtaagttatcgttttagtacggttttttattattttggtatgttcggatttaatattttcgttagaatatcgttgatgatggtacgcggtttttcgtacgcgggttatcgttcgttattatcgttacgttagtaaatttttcggtattgcgtttattagtggacgtttatttttatcgcgatcgttattatagtaaagatatattatagtttgttcgtatagtgtagacgcgttgtttgtaagttttttttagtgtattcggcgtatgcgcgtaatttattattatcgtcggttgtttggcgtagtgaatatttttatacgttcgtaaatcggttgtagatcgcggcggtttttagtagattagttagtggatagtcgagtgttaatagttcgttagcgcgagtagtaggttgttgacgttaaaagcgtttattagatgtttttaatttcgttatcgttttaatttgagttaaagcgaatcgtcgtacgttgtcgtgatagtttatttcggtcgtttttaattagcgttcgtgatagtcggattaatatgatt

SEQ ID NO: 9938 - DNA, 668 bp, Artificial Sequence
  chemically treated genomic DNA (Homo sapiens) CpG-island No: 9938
aatcatattaatccgactatcacgaacgctaattaaaaacgaccgaaataaactatcacgacaacgtacgacgattcgctttaactcaaattaaaacgataacgaaattaaaaacatctaataaacgcttttaacgtcaacaacctactactcgcgctaacgaactattaacactcgactatccactaactaatctactaaaaaccgccgcgatctacaaccgatttacgaacgtataaaaatattcactacgccaaacaaccgacgataataataaattacgcgcatacgccgaatacactaaaaaaaacttacaaacaacgcgtctacactatacgaacaaactataatatatctttactataataacgatcgcgataaaaataaacgtccactaataaacgcaataccgaaaaatttactaacgtaacgataataacgaacgataacccgcgtacgaaaaaccgcgtaccatcatcaacgatattctaacgaaaatattaaatccgaacataccaaaataataaaaaaccgtactaaaacgataacttacgcgttatacaaactaaaaaaaataatataatactaatcgcgaacaaaaacctaaaaattaccaaattattaacaatcaacgtctaaactactccgatcgctcacgataacgcgtc

SEQ ID NO: 9939 - DNA, 668 bp, Artificial Sequence
  chemically treated genomic DNA (Homo sapiens) CpG-island No: 9939
gattatattaattcgattgttacggacgttggttgaaagcgatcgaagtgaattattacgatagcgtgcgacgattcgttttagtttaagttggggcgatggcgaaattgaaagtatttgatgggcgtttttaacgttagtaatttgttgttcgcgttggcgaattgttggtattcggttatttattggttgatttgttgaaaatcgtcgcggtttgtaatcggtttgcggacgtatggaagtgtttattgcgttaggtaatcgacggtggtggtggattacgcgtatacgtcggatgtattggaaaaagtttataggtagcgcgtttgtattgtgcgggtaagttgtggtgtgtttttgttgtggtggcgatcgcgataaaggtaagcgtttattgatgggcgtaatgtcgaagagtttgttgacgtggcggtggtgacggacgataattcgcgtacgaagaatcgcgtgttattattaacgatattttggcgggaatgttagattcggatatgttaaagtgatggaaggtcgtgttgaagcggtgatttgcgcgttatgtaggttaaagagaatgatgtggtattggtcgcgggtaaaggtttgaagattattagattgttggtaattagcgtttggattatttcgatcgtttacggtggcgcgtt

SEQ ID NO: 9940 - DNA, 668 bp, Artificial Sequence
  chemically treated genomic DNA (Homo sapiens) CpG-island No: 9940
aacgcgccaccgtaaacgatcgaaataatccaaacgctaattaccaacaatctaataatcttcaaacctttacccgcgaccaataccacatcattctctttaacctacataacgcgcaaatcaccgcttcaacacgaccttccatcactttaacatatccgaatctaacattcccgccaaaatatcgttaataataacacgcgattcttcgtacgcgaattatcgtccgtcaccaccgccacgtcaacaaactcttcgacattacgcccatcaataaacgcttacctttatcgcgatcgccaccacaacaaaaacacaccacaacttacccgcacaatacaaacgcgctacctataaactttttccaatacatccgacgtatacgcgtaatccaccaccaccgtcgattacctaacgcaataaacacttccatacgtccgcaaaccgattacaaaccgcgacgattttcaacaaatcaaccaataaataaccgaataccaacaattcgccaacgcgaacaacaaattactaacgttaaaaacgcccatcaaatactttcaatttcgccatcgccccaacttaaactaaaacgaatcgtcgcacgctatcgtaataattcacttcgatcgctttcaaccaacgtccgtaacaatcgaattaatataatc

SEQ ID NO: 9941 - DNA, 557 bp, Artificial Sequence
  chemically treated genomic DNA (Homo sapiens) CpG-island No: 9941
  misc_feature (520)..(520): n is either a, c, g or t
gcggtgttgttgttggcgattgggttagtcgggttaaggtttgagtacggatgcggttggcgtttacgttttgggtgattaacgcgttggaacggaattcgtacgttgttgggagagacgtatgtttaggtcgtgattatcgtgttgtcggtataattaattacgttaatcgtcgttttcggatattttttagtattattgttacgtcggttagggtgttagcgttcgtcggttttaggtcgcgttgttgttgtcgaaggttatattgttcggtatattgaggatatgttattttcgttgcgggttacgttaatattagtgtcgcgtattttgttcgtagtttcgttttttgtatatttatgtaataattaacgtcgtcgtttaagttgcgtttgttgttgcgttaattagcgcgtttttatcgcgatttttttcgaagaagagagcgtataaatatcgcgtttagagagagttagattggggatgtaattattgttcggtcgcgggtaggttatgtggntaatcggaaggttataggggataaaatttttttgaat

SEQ ID NO: 9942 - DNA, 557 bp, Artificial Sequence
  chemically treated genomic DNA (Homo sapiens) CpG-island No: 9942
  misc_feature (38)..(38): n is either a, c, g or t
attcaaaaaaattttatcccctataaccttccgattanccacataacctacccgcgaccgaacaataattacatccccaatctaactctctctaaacgcgatatttatacgctctcttcttcgaaaaaaatcgcgataaaaacgcgctaattaacgcaacaacaaacgcaacttaaacgacgacgttaattattacataaatatacaaaaaacgaaactacgaacaaaatacgcgacactaatattaacgtaacccgcaacgaaaataacatatcctcaatataccgaacaatataaccttcgacaacaacaacgcgacctaaaaccgacgaacgctaacaccctaaccgacgtaacaataatactaaaaaatatccgaaaacgacgattaacgtaattaattataccgacaacacgataatcacgacctaaacatacgtctctcccaacaacgtacgaattccgttccaacgcgttaatcacccaaaacgtaaacgccaaccgcatccgtactcaaaccttaacccgactaacccaatcgccaacaacaacaccgc

SEQ ID NO: 9943 - DNA, 557 bp, Artificial Sequence
  chemically treated genomic DNA (Homo sapiens) CpG-island No: 9943
  misc_feature (38)..(38): n is either a, c, g or t
gtttagagaggttttattttttataatttttcgattgnttatataatttattcgcgatcgaatagtaattgtatttttagtttggttttttttgggcgcggtatttgtgcgttttttttttcgagaaagatcgcggtaaaggcgcgttgattggcgtagtagtaggcgtagtttgggcggcggcgttggttattatatggatgtgtaggaagcgaagttgcggataaaatgcgcggtattggtgttagcgtaattcgtagcggggataatatatttttaatatgtcgaataatgtgattttcgatagtagtagcgcgatttgaaatcggcgggcgttaatattttgatcggcgtggtaatggtattgaagagtattcgaaaacggcggttaacgtgattggttatatcgatagtacggtggttacgatttgaatatgcgttttttttagtaacgtgcggatttcgttttagcgcgttgattatttagggcgtggacgttagtcgtattcgtatttaggttttggttcggttaatttaatcgttagtaatagtatcgt

SEQ ID NO: 9944 - DNA, 557 bp, Artificial Sequence
  chemically treated genomic DNA (Homo sapiens) CpG-island No: 9944
  misc_feature (520)..(520): n is either a, c, g or t
acgatactattactaacgattaaattaaccgaaccaaaacctaaatacgaatacgactaacgtccacgccctaaataatcaacgcgctaaaacgaaatccgcacgttactaaaaaaaacgcatattcaaatcgtaaccaccgtactatcgatataaccaatcacgttaaccgccgttttcgaatactcttcaataccattaccacgccgatcaaaatattaacgcccgccgatttcaaatcgcgctactactatcgaaaatcacattattcgacatattaaaaatatattatccccgctacgaattacgctaacaccaataccgcgcattttatccgcaacttcgcttcctacacatccatataataaccaacgccgccgcccaaactacgcctactactacgccaatcaacgcgcctttaccgcgatctttctcgaaaaaaaaaacgcacaaataccgcgcccaaaaaaaaccaaactaaaaatacaattactattcgatcgcgaataaattatataancaatcgaaaaattataaaaaataaaacctctctaaac

SEQ ID NO: 9945 - DNA, 596 bp, Artificial Sequence
  chemically treated genomic DNA (Homo sapiens) CpG-island No: 9945
atggcggtataggttattgggcggtgcgatggttagtgaatagtattttttttaaattatagaatggggttaagtcgaagttatcgttaattattagacgggacggtattcggtttttcggcgataaaaaatcgtatattcgcgtggttggtggaatatacggttatgcggatgtattatatagtgaaggtcggtatcgattattaggatcgaaagatgtagttggtaatatcgcgttgcgtatggcgatgtagattgcgagtaatatattcgtcgtgagaaagcgaattttaatatttgtatttttaggtattgttggtaaatatcgttagtttgtatgtcgtttattacggtcggttggtttgaaacgtatcgttaatcgtatttatcgtttgatcgatatttggcggcgggtttgtaataaaaaggtttgaaattgcgttatgcgtattattcgatattttgtgtgtggaagtggtcgataaagcgggcgtattgacgttgtcgaagcggttgaaattaatttgcgtagcgatattttgaacgcggttggattatttttgatgaaataattacgcgtgaaaacgtaatgtagt

SEQ ID NO: 9946 - DNA, 596 bp, Artificial Sequence
  chemically treated genomic DNA (Homo sapiens) CpG-island No: 9946
actacattacgttttcacgcgtaattatttcatcaaaaataatccaaccgcgttcaaaatatcgctacgcaaattaatttcaaccgcttcgacaacgtcaatacgcccgctttatcgaccacttccacacacaaaatatcgaataatacgcataacgcaatttcaaacctttttattacaaacccgccgccaaatatcgatcaaacgataaatacgattaacgatacgtttcaaaccaaccgaccgtaataaacgacatacaaactaacgatatttaccaacaatacctaaaaatacaaatattaaaattcgctttctcacgacgaatatattactcgcaatctacatcgccatacgcaacgcgatattaccaactacatctttcgatcctaataatcgataccgaccttcactatataatacatccgcataaccgtatattccaccaaccacgcgaatatacgattttttatcgccgaaaaaccgaataccgtcccgtctaataattaacgataacttcgacttaaccccattctataatttaaaaaaaatactattcactaaccatcgcaccgcccaataacctataccgccat

SEQ ID NO: 9947 - DNA, 596 bp, Artificial Sequence
  chemically treated genomic DNA (Homo sapiens) CpG-island No: 9947
gttgtattacgtttttacgcgtggttgttttattaagggtgatttaatcgcgtttagaatatcgttacgtaggttgattttagtcgtttcggtagcgttagtacgttcgttttgtcggttatttttatatataaggtgtcgaatagtgcgtatggcgtagttttagatttttttgttgtaggttcgtcgttagatatcggttagacggtgaatgcggttagcgatacgttttaggttaatcggtcgtgataaacggtatataggttggcgatgtttgttagtagtatttggaagtataaatgttggagttcgtttttttacggcggatatgttgttcgtagtttgtatcgttatgcgtagcgcggtattgttagttgtatttttcgattttagtagtcggtatcggtttttattgtgtagtgtattcgtataatcgtatgttttattagttacgcgaatgtgcggttttttatcgtcgaaaaatcgggtgtcgtttcgtttggtggttggcggtggtttcgatttaattttattttatggtttgaagaagatgttatttattggttatcgtatcgtttagtgatttgtgtcgttat

SEQ ID NO: 9948 - DNA, 596 bp, Artificial Sequence
  chemically treated genomic DNA (Homo sapiens) CpG-island No: 9948
ataacgacacaaatcactaaacgatacgataaccaataaataacatcttcttcaaaccataaaataaaattaaatcgaaaccaccgccaaccaccaaacgaaacgacacccgatttttcgacgataaaaaaccgcacattcgcgtaactaataaaacatacgattatacgaatacactacacaataaaaaccgataccgactactaaaatcgaaaaatacaactaacaataccgcgctacgcataacgatacaaactacgaacaacatatccgccgtaaaaaaacgaactccaacatttatacttccaaatactactaacaaacatcgccaacctatataccgtttatcacgaccgattaacctaaaacgtatcgctaaccgcattcaccgtctaaccgatatctaacgacgaacctacaacaaaaaaatctaaaactacgccatacgcactattcgacaccttatatataaaaataaccgacaaaacgaacgtactaacgctaccgaaacgactaaaatcaacctacgtaacgatattctaaacgcgattaaatcacccttaataaaacaaccacgcgtaaaaacgtaatacaac

SEQ ID NO: 9949 - DNA, 723 bp, Artificial Sequence
  chemically treated genomic DNA (Homo sapiens) CpG-island No: 9949
  misc_feature (380)..(380): n is either a, c, g or t
  misc_feature (452)..(452): n is either a, c, g or t
ttacggtttggatatcgatacgttggataagacgtggtttacgatagtcgttttatttagtttgcgatgttgcgcgatacgaaatttttatttattcggtgtttaatcgttattatagcgaaatcgaatgatgcgttatatgtattcgttggagcgtaaagatttggcgttgaatcggcgatgatttcgttgggtttttgtattatgaaattgaacgtcgtcgttagatgattttaattatttggtcggaatttggcgaattgtattcgttttgtcgtcggagtaggtcgaatgttattagtagatgattgcgtagttggttgttggttggtgaaattgacgggttacgacgtcgtttgtatgttggcgaagttggcgtntaagaggaataagcgggttgttggggatcgtttttttttgaagtcgtcgaagtatgcgaaattgtgatcggnttggtacggataaattcgcgggtatttagtagtatatagcggcgtgcgtgtgtaattacgcgttttgtgcgcgtagaagggggaattttcggagttgtttcgcggaaataaggggtatgcgttatgaaatattttagattatattgggttgttagtttatcgcgcggacggatatcggtaggaagacgataaagtcgatttttagttcgttgtcgtcggtaaaacgtatgttttacgcgttttaatatttttttgtataattttaagggtg

SEQ ID NO: 9950 - DNA, 723 bp, Artificial Sequence
  chemically treated genomic DNA (Homo sapiens) CpG-island No: 9950
  misc_feature (272)..(272): n is either a, c, g or t
  misc_feature (344)..(344): n is either a, c, g or t
cacccttaaaattatacaaaaaaatattaaaacgcgtaaaacatacgttttaccgacgacaacgaactaaaaatcgactttatcgtcttcctaccgatatccgtccgcgcgataaactaacaacccaatataatctaaaatatttcataacgcataccccttatttccgcgaaacaactccgaaaattcccccttctacgcgcacaaaacgcgtaattacacacgcacgccgctatatactactaaatacccgcgaatttatccgtaccaanccgatcacaatttcgcatacttcgacgacttcaaaaaaaaacgatccccaacaacccgcttattcctcttanacgccaacttcgccaacatacaaacgacgtcgtaacccgtcaatttcaccaaccaacaaccaactacgcaatcatctactaataacattcgacctactccgacgacaaaacgaatacaattcgccaaattccgaccaaataattaaaatcatctaacgacgacgttcaatttcataatacaaaaacccaacgaaatcatcgccgattcaacgccaaatctttacgctccaacgaatacatataacgcatcattcgatttcgctataataacgattaaacaccgaataaataaaaatttcgtatcgcgcaacatcgcaaactaaataaaacgactatcgtaaaccacgtcttatccaacgtatcgatatccaaaccgtaa

SEQ ID NO: 9951 - DNA, 723 bp, Artificial Sequence
  chemically treated genomic DNA (Homo sapiens) CpG-island No: 9951
  misc_feature (272)..(272): n is either a, c, g or t
  misc_feature (344)..(344): n is either a, c, g or t
tatttttgagattgtgtaggaaggtgttgaagcgcgtaaaatatgcgttttgtcgacggtagcgaattggaagtcgattttatcgtttttttatcggtattcgttcgcgcgataagttggtaatttagtgtggtttggagtgttttatagcgtatattttttgttttcgcgggataatttcgagggtttttttttttgcgcgtatagagcgcgtgattatatacgtacgtcgttgtgtgttattaaatgttcgcgggtttgttcgtgttagntcgattataatttcgtatatttcggcggttttaaaaaaggacgatttttagtagttcgtttattttttttgngcgttagtttcgttagtatataagcggcgtcgtaattcgttagttttattagttagtagttagttgcgtaattatttgttgataatattcggtttgtttcggcggtagaacgggtgtagttcgttaaatttcggttaggtgattgggattatttggcggcggcgtttagttttatggtgtaggaatttagcgggattatcgtcgatttagcgttagatttttacgttttagcgagtgtatatagcgtattattcggtttcgttgtggtagcgattaaatatcggatgggtgaggatttcgtgtcgcgtagtatcgtaggttggatagagcggttgtcgtgagttacgttttgtttagcgtgtcgatgtttaggtcgtgg

SEQ ID NO: 9952 - DNA, 723 bp, Artificial Sequence
  chemically treated genomic DNA (Homo sapiens) CpG-island No: 9952
  misc_feature (380)..(380): n is either a, c, g or t
  misc_feature (452)..(452): n is either a, c, g or t
ccacgacctaaacatcgacacgctaaacaaaacgtaactcacgacaaccgctctatccaacctacgatactacgcgacacgaaatcctcacccatccgatatttaatcgctaccacaacgaaaccgaataatacgctatatacactcgctaaaacgtaaaaatctaacgctaaatcgacgataatcccgctaaattcctacaccataaaactaaacgccgccgccaaataatcccaatcacctaaccgaaatttaacgaactacacccgttctaccgccgaaacaaaccgaatattatcaacaaataattacgcaactaactactaactaataaaactaacgaattacgacgccgcttatatactaacgaaactaacgcncaaaaaaaataaacgaactactaaaaatcgtccttttttaaaaccgccgaaatatacgaaattataatcganctaacacgaacaaacccgcgaacatttaataacacacaacgacgtacgtatataatcacgcgctctatacgcgcaaaaaaaaaaaccctcgaaattatcccgcgaaaacaaaaaatatacgctataaaacactccaaaccacactaaattaccaacttatcgcgcgaacgaataccgataaaaaaacgataaaatcgacttccaattcgctaccgtcgacaaaacgcatattttacgcgcttcaacaccttcctacacaatctcaaaaata

SEQ ID NO: 9953 - DNA, 726 bp, Artificial Sequence
  chemically treated genomic DNA (Homo sapiens) CpG-island No: 9953
cgatgtgttggcgttgtcgttgcgtagtaacgtttggttggacgtgaaggttcggttcgtgtgttggtagtggtggtttttagggcgtacgtatttttaattagataatgtcgtaggttgtgcgaaattgggtgatttagttattatttggtattagagcggtaaaggtcgtaataattcgttgaataggcgtatgtcgaagcggggtaatcgtagtaaaagtgacggaatttattgatgatatggcggcggcgtatgcgtgggcggtgtcgtcgtttgtcgtttcggtgcgttaacggtgagtgaaatcgtcgcgtaggattatcggcgttgtttgtgtcgttttaatataaagatcgttagtatattggaatgcgttatcgttggaaaaagcgggcgtagttaaattatcgatagttatagtttagcgtggatgttgtcggtaataatttgtcggtggtcgaaatttttattatggggaagcgttcgggttggtttattcgatgtttcgagagtgggatgagtggtcggtgtcggggatgttggagttttggtcgtgagttacgtaggggcgatgttttttttggggggggtgttcgtttcgcggtgtttcggggtttttcgatatcgtttagtacggcggtaaagtggtggatggcgtagtgaaaagatgtatgagatcgtcgatagttcgaagaaaattgtcgatattattagtttatcgat

SEQ ID NO: 9954 - DNA, 726 bp, Artificial Sequence
  chemically treated genomic DNA (Homo sapiens) CpG-island No: 9954
atcgataaactaataatatcgacaattttcttcgaactatcgacgatctcatacatcttttcactacgccatccaccactttaccgccgtactaaacgatatcgaaaaaccccgaaacaccgcgaaacgaacaccccccccaaaaaaaacatcgcccctacgtaactcacgaccaaaactccaacatccccgacaccgaccactcatcccactctcgaaacatcgaataaaccaacccgaacgcttccccataataaaaatttcgaccaccgacaaattattaccgacaacatccacgctaaactataactatcgataatttaactacgcccgctttttccaacgataacgcattccaatatactaacgatctttatattaaaacgacacaaacaacgccgataatcctacgcgacgatttcactcaccgttaacgcaccgaaacgacaaacgacgacaccgcccacgcatacgccgccgccatatcatcaataaattccgtcacttttactacgattaccccgcttcgacatacgcctattcaacgaattattacgacctttaccgctctaataccaaataataactaaatcacccaatttcgcacaacctacgacattatctaattaaaaatacgtacgccctaaaaaccaccactaccaacacacgaaccgaaccttcacgtccaaccaaacgttactacgcaacgacaacgccaacacatcg

SEQ ID NO: 9955 - DNA, 726 bp, Artificial Sequence
  chemically treated genomic DNA (Homo sapiens) CpG-island No: 9955
gtcgataagttgataatgtcggtaatttttttcgaattatcggcgattttatgtatttttttattacgttatttattattttgtcgtcgtgttgggcggtgtcggaaggtttcgagatatcgcgggacgggtattttttttaaggggaatatcgtttttacgtaatttacgattagggttttaatattttcggtatcggttatttattttattttcggggtatcggatggattagttcgggcgtttttttatgataaaagtttcgattatcggtaggttgttgtcgatagtatttacgttaagttgtggttgtcgataatttggttgcgttcgttttttttagcggtagcgtattttagtatgttggcggtttttatgttgaaacggtataaataacgtcggtagttttgcgcggcgattttatttatcgttaacgtatcggagcggtaaacgacgatatcgtttacgtatacgtcgtcgttatattattaataaatttcgttatttttgttgcggttgtttcgtttcggtatacgtttgtttaacggattgttgcgatttttgtcgttttgatgttagatagtgattgaattatttagtttcgtataatttgcggtattgtttggttaagaatgcgtgcgttttgagaattattattattagtatacgaatcggatttttacgtttagttaaacgttgttgcgtaacggtagcgttaatatatcg

SEQ ID NO: 9956 - DNA, 726 bp, Artificial Sequence
  chemically treated genomic DNA (Homo sapiens) CpG-island No: 9956
cgatatattaacgctaccgttacgcaacaacgtttaactaaacgtaaaaatccgattcgtatactaataataataattctcaaaacgcacgcattcttaaccaaacaataccgcaaattatacgaaactaaataattcaatcactatctaacatcaaaacgacaaaaatcgcaacaatccgttaaacaaacgtataccgaaacgaaacaaccgcaacaaaaataacgaaatttattaataatataacgacgacgtatacgtaaacgatatcgtcgtttaccgctccgatacgttaacgataaataaaatcgccgcgcaaaactaccgacgttatttataccgtttcaacataaaaaccgccaacatactaaaatacgctaccgctaaaaaaaacgaacgcaaccaaattatcgacaaccacaacttaacgtaaatactatcgacaacaacctaccgataatcgaaacttttatcataaaaaaacgcccgaactaatccatccgataccccgaaaataaaataaataaccgataccgaaaatattaaaaccctaatcgtaaattacgtaaaaacgatattccccttaaaaaaaatacccgtcccgcgatatctcgaaaccttccgacaccgcccaacacgacgacaaaataataaataacgtaataaaaaaatacataaaatcgccgataattcgaaaaaaattaccgacattatcaacttatcgac

SEQ ID NO: 9957 - DNA, 549 bp, Artificial Sequence
  chemically treated genomic DNA (Homo sapiens) CpG-island No: 9957
  misc_feature (461)..(463): n is either a, c, g or t
  misc_feature (490)..(490): n is either a, c, g or t
tcggcgagatttcgttgtttagttattattagatcgagtatagatcgagttcgttttttagcgtgaagttcgtttgtcgtttggtggtttattgttatcgatagtatcgaagcgttaacggttatcgatattaattcgtacgcgcgattcgcggcggcgatatcgaagaaatcgcgtttaatattatttcgaagttgtcgatgagattgttcgttagttgcgtttgcgtgatttggcggtttgattgttatcgattttatcgatatgacgttagtacgttatcgcgtgcggtagaaaatcgtttgcgtgaagcggtgcgttaggatcgtgcggtatttaaattagttatatttttcgttttggtttgttggaaatgtttcgtagcgtttgagtttattattgggtgaatttagttattacgtttgttcgtttgttttggtattggtatcgtgcgtgataannncgaattcggtttttggttttttcgggnttttttttttcgtttgttttttaaaaatttttgtgttttttgggtttcggtttttcgtt

SEQ ID NO: 9958 - DNA, 549 bp, Artificial Sequence
  chemically treated genomic DNA (Homo sapiens) CpG-island No: 9958
  misc_feature (60)..(60): n is either a, c, g or t
  misc_feature (87)..(89): n is either a, c, g or t
aacgaaaaaccgaaacccaaaaaacacaaaaatttttaaaaaacaaacgaaaaaaaaaancccgaaaaaaccaaaaaccgaattcgnnnttatcacgcacgataccaataccaaaacaaacgaacaaacgtaataactaaattcacccaataataaactcaaacgctacgaaacatttccaacaaaccaaaacgaaaaatataactaatttaaataccgcacgatcctaacgcaccgcttcacgcaaacgattttctaccgcacgcgataacgtactaacgtcatatcgataaaatcgataacaatcaaaccgccaaatcacgcaaacgcaactaacgaacaatctcatcgacaacttcgaaataatattaaacgcgatttcttcgatatcgccgccgcgaatcgcgcgtacgaattaatatcgataaccgttaacgcttcgatactatcgataacaataaaccaccaaacgacaaacgaacttcacgctaaaaaacgaactcgatctatactcgatctaataataactaaacaacgaaatctcgccga

SEQ ID NO: 9959 - DNA, 549 bp, Artificial Sequence
  chemically treated genomic DNA (Homo sapiens) CpG-island No: 9959
  misc_feature (60)..(60): n is either a, c, g or t
  misc_feature (87)..(89): n is either a, c, g or t
ggcgaaaaatcggagtttaaagggtataaaaatttttaaggggtaaacggggaaaagggnttcggggaaattaaaggtcgaattcgnnnttgttacgtacggtgttagtattagaataagcggataaacgtgatgattggatttatttagtgatgggtttaggcgttgcgggatatttttagtaggttaaagcgagaaatatggttgatttgaatatcgtacggttttgacgtatcgttttacgtagacggttttttatcgtacgcggtggcgtattggcgttatgtcgatgaagtcgataataattaggtcgttaggttacgtaggcgtagttgacgagtaattttatcggtagtttcgaggtagtgttaaacgcggttttttcgatatcgtcgtcgcgggtcgcgcgtgcgagttgatgtcgatggtcgttaacgtttcggtgttgtcgataataatggattattagacggtagacgaattttacgttggaaggcggattcgatttgtgttcgatttggtagtggttgaatagcgggatttcgtcgg

SEQ ID NO: 9960 - DNA, 549 bp, Artificial Sequence
  chemically treated genomic DNA (Homo sapiens) CpG-island No: 9960
  misc_feature (461)..(463): n is either a, c, g or t
  misc_feature (490)..(490): n is either a, c, g or t
ccgacgaaatcccgctattcaaccactaccaaatcgaacacaaatcgaatccgccttccaacgtaaaattcgtctaccgtctaataatccattattatcgacaacaccgaaacgttaacgaccatcgacatcaactcgcacgcgcgacccgcgacgacgatatcgaaaaaaccgcgtttaacactacctcgaaactaccgataaaattactcgtcaactacgcctacgtaacctaacgacctaattattatcgacttcatcgacataacgccaatacgccaccgcgtacgataaaaaaccgtctacgtaaaacgatacgtcaaaaccgtacgatattcaaatcaaccatatttctcgctttaacctactaaaaatatcccgcaacgcctaaacccatcactaaataaatccaatcatcacgtttatccgcttattctaatactaacaccgtacgtaacaannncgaattcgacctttaatttccccgaancccttttccccgtttaccccttaaaaatttttataccctttaaactccgatttttcgcc

SEQ ID NO: 9961 - DNA, 557 bp, Artificial Sequence
  chemically treated genomic DNA (Homo sapiens) CpG-island No: 9961
taagtgttagtttcggacgttgtatttttttagttatgttagcgtcgtattattcgtatagttatttttagtcgcgagttggggagatttttggttagtacgtttattgcgtcgttttataaatatcgttagcggttaaatttagattcggttatgttttttcggaatgtaaattacgttaggtttaattttttcgttaatgatcgtttcggtagaatttgttcgcgtgcgttttataatcgaatagtatcgttattttgtagtcgcgtttttgggtatcgttaggatgaatggtgataggtttacgatttttatcgcgtataattcgcgtagagaattgtaatttagttggttgtgtagcggtgcgtcggatgggtagaaagtatttgtaattgttttggttcggtatgttttgttattcgttcggttttagttatattggatgtttagggtaattcggtaatcgtaatcggtaatacgttgtgagaagattttaattttgtcgttgcggtttttaacggatgcgttagcggatcgcggtaaaaattagcgaagta

SEQ ID NO: 9962 - DNA, 557 bp, Artificial Sequence
  chemically treated genomic DNA (Homo sapiens) CpG-island No: 9962
tacttcgctaatttttaccgcgatccgctaacgcatccgttaaaaaccgcaacgacaaaattaaaatcttctcacaacgtattaccgattacgattaccgaattaccctaaacatccaatataactaaaaccgaacgaataacaaaacataccgaaccaaaacaattacaaatactttctacccatccgacgcaccgctacacaaccaactaaattacaattctctacgcgaattatacgcgataaaaatcgtaaacctatcaccattcatcctaacgatacccaaaaacgcgactacaaaataacgatactattcgattataaaacgcacgcgaacaaattctaccgaaacgatcattaacgaaaaaattaaacctaacgtaatttacattccgaaaaaacataaccgaatctaaatttaaccgctaacgatatttataaaacgacgcaataaacgtactaaccaaaaatctccccaactcgcgactaaaaataactatacgaataatacgacgctaacataactaaaaaaatacaacgtccgaaactaacactta

SEQ ID NO: 9963 - DNA, 557 bp, Artificial Sequence
  chemically treated genomic DNA (Homo sapiens) CpG-island No: 9963
tgtttcgttgatttttgtcgcgattcgttggcgtattcgttaaaaatcgtagcggtaagattgaaatttttttatagcgtattgtcgattacggttatcggattgttttgggtatttaatgtggttggagtcggacgaatggtagggtatgtcgaattagaatagttgtaggtattttttgtttattcggcgtatcgttgtatagttagttgaattatagttttttgcgcgaattgtacgcggtggaaatcgtgagtttgttattatttattttgacgatgtttaggagcgcggttataagatggcgatattgttcggttgtggaacgtacgcgggtaaattttgtcggagcggttattagcgagggaattaaatttggcgtgatttgtatttcgaaggggtatggtcggatttggatttaatcgttgacggtatttgtaaaacggcgtagtgaacgtgttgattaaagatttttttagttcgcggttgggaatggttgtgcgggtaatacggcgttggtatggttggaaaaatataacgttcggaattgatattta

SEQ ID NO: 9964 - DNA, 557 bp, Artificial Sequence
  chemically treated genomic DNA (Homo sapiens) CpG-island No: 9964
taaatatcaattccgaacgttatatttttccaaccataccaacgccgtattacccgcacaaccattcccaaccgcgaactaaaaaaatctttaatcaacacgttcactacgccgttttacaaataccgtcaacgattaaatccaaatccgaccataccccttcgaaatacaaatcacgccaaatttaattccctcgctaataaccgctccgacaaaatttacccgcgtacgttccacaaccgaacaatatcgccatcttataaccgcgctcctaaacatcgtcaaaataaataataacaaactcacgatttccaccgcgtacaattcgcgcaaaaaactataattcaactaactatacaacgatacgccgaataaacaaaaaatacctacaactattctaattcgacataccctaccattcgtccgactccaaccacattaaatacccaaaacaatccgataaccgtaatcgacaatacgctataaaaaaatttcaatcttaccgctacgatttttaacgaatacgccaacgaatcgcgacaaaaatcaacgaaaca

SEQ ID NO: 9965 - DNA, 887 bp, Artificial Sequence
  chemically treated genomic DNA (Homo sapiens) CpG-island No: 9965
tatttcgatggtgacgtcgagtatagatatgacggtgaagtcgaggtcggttatagcgcgtggatgatatatagaattggcgttacgaataggaataggaatttagcggttcggtagtgtcgttaacgacgtaggcgattaggttagaaatagtagatttttaattttatggcgatttttcgggcgcgcgtagtgatataagttaacgttgtatttggtagatcgtcgagaaacgtaggtattttatttgcgaaaggaaacgcgtggcgtttttagaaaaatcgtgagtggtcgggtatttaattgcgtttggaagatggttagtgcgtcgttgacgtttgatcgtattttttgtattcgcgtgcgggattattgggtaaaacgggtgtttttttttttttgggtcgcgtaaaattcggttttttttttacgtttagatattttatacgtaaatttcggggcgtgcgtaaattttttattttttatcggtttgttttatataagaaatattcggacgttagttatttcgaacgtttattcgtagatatagcgtttaatgtggtcgatggtatcgcgttaaatttatcgtttagagtgtaggaattttcgtatagacggtttgcgggtagattcgttcgtaaattttcggtagggtgttggtttggtgtatagtttcgtcgttttaaaaatacgtttttcgttggcgagttttagttattcgggatgtagttgtgtatcgggtatttttattcgtagtatgggttgcgtacgataggtagcggttagtttgcgttttggtttggttttcggaaaacgttcgtaaattttaataaatttaattttgcggatttttagcggttttttggcggattaacgcgttgtaggtt

SEQ ID NO: 9966 - DNA, 887 bp, Artificial Sequence
  chemically treated genomic DNA (Homo sapiens) CpG-island No: 9966
aacctacaacgcgttaatccgccaaaaaaccgctaaaaatccgcaaaattaaatttattaaaatttacgaacgttttccgaaaaccaaaccaaaacgcaaactaaccgctacctatcgtacgcaacccatactacgaataaaaatacccgatacacaactacatcccgaataactaaaactcgccaacgaaaaacgtatttttaaaacgacgaaactatacaccaaaccaacaccctaccgaaaatttacgaacgaatctacccgcaaaccgtctatacgaaaattcctacactctaaacgataaatttaacgcgataccatcgaccacattaaacgctatatctacgaataaacgttcgaaataactaacgtccgaatatttcttatataaaacaaaccgataaaaaataaaaaatttacgcacgccccgaaatttacgtataaaatatctaaacgtaaaaaaaaaaccgaattttacgcgacccaaaaaaaaaaaaacacccgttttacccaataatcccgcacgcgaatacaaaaaatacgatcaaacgtcaacgacgcactaaccatcttccaaacgcaattaaatacccgaccactcacgatttttctaaaaacgccacgcgtttcctttcgcaaataaaatacctacgtttctcgacgatctaccaaatacaacgttaacttatatcactacgcgcgcccgaaaaatcgccataaaattaaaaatctactatttctaacctaatcgcctacgtcgttaacgacactaccgaaccgctaaattcctattcctattcgtaacgccaattctatatatcatccacgcgctataaccgacctcgacttcaccgtcatatctatactcgacgtcaccatcgaaata

SEQ ID NO: 9967 - DNA, 887 bp, Artificial Sequence
  chemically treated genomic DNA (Homo sapiens) CpG-island No: 9967
gatttgtagcgcgttgattcgttaagaaatcgttgaagattcgtaaaattgagtttgttgaaatttacgagcgtttttcgaaggttaggttaaagcgtaggttgatcgttgtttgtcgtgcgtaatttatattgcgagtggaaatgttcggtatataattatatttcgaatggttgaagttcgttaacgaggggcgtatttttgaagcggcggaattgtgtattagattaatattttgtcggaagtttgcggacgagtttgttcgtaaatcgtttgtgcgaaggtttttgtattttgaacgatgagtttggcgcggtattatcggttatattgagcgttatatttacggataagcgttcgagatggttggcgttcggatattttttgtgtggaatagatcggtgaaaagtggggaatttgcgtacgtttcgaggtttgcgtgtgggatgtttgaacgtaaagggaaaatcgggttttacgcggtttaaaagggggggggtattcgttttgtttagtggtttcgtacgcggatgtaggaagtgcggttaaacgttagcggcgtattgattattttttaggcgtaattgagtgttcgattatttacggtttttttgaaagcgttacgcgttttttttcgtaggtaaaatgtttgcgtttttcggcggtttgttaggtgtagcgttagtttgtattattgcgcgcgttcggaaaatcgttataaaattaaaggtttgttatttttggtttgatcgtttgcgtcgttggcggtattatcgaatcgttggatttttgtttttgttcgtagcgttagttttgtatgttatttacgcgttgtaatcggtttcggttttatcgttatgtttgtgttcggcgttattatcggaata

SEQ ID NO: 9968 - DNA, 887 bp, Artificial Sequence
  chemically treated genomic DNA (Homo sapiens) CpG-island No: 9968
tattccgataataacgccgaacacaaacataacgataaaaccgaaaccgattacaacgcgtaaataacatacaaaactaacgctacgaacaaaaacaaaaatccaacgattcgataataccgccaacgacgcaaacgatcaaaccaaaaataacaaacctttaattttataacgattttccgaacgcgcgcaataatacaaactaacgctacacctaacaaaccgccgaaaaacgcaaacattttacctacgaaaaaaaacgcgtaacgctttcaaaaaaaccgtaaataatcgaacactcaattacgcctaaaaaataatcaatacgccgctaacgtttaaccgcacttcctacatccgcgtacgaaaccactaaacaaaacgaatacccccccccttttaaaccgcgtaaaacccgattttccctttacgttcaaacatcccacacgcaaacctcgaaacgtacgcaaattccccacttttcaccgatctattccacacaaaaaatatccgaacgccaaccatctcgaacgcttatccgtaaatataacgctcaatataaccgataataccgcgccaaactcatcgttcaaaatacaaaaaccttcgcacaaacgatttacgaacaaactcgtccgcaaacttccgacaaaatattaatctaatacacaattccgccgcttcaaaaatacgcccctcgttaacgaacttcaaccattcgaaatataattatataccgaacatttccactcgcaatataaattacgcacgacaaacaacgatcaacctacgctttaacctaaccttcgaaaaacgctcgtaaatttcaacaaactcaattttacgaatcttcaacgatttcttaacgaatcaacgcgctacaaatc

SEQ ID NO: 9969 - DNA, 501 bp, Artificial Sequence
  chemically treated genomic DNA (Homo sapiens) CpG-island No: 9969
gtttgagagtcggtatgttgtatatgttcggtgataagattacgtagatgtttttatggatcgttagagcgttaacgtttaagatttcgattagtttcggttaacgcgtttgcggaaatcgtcgtttttatcgagaacgtaagcgaaacgtcggttatgttcgtatcgaagttaacgtcggttttatttagaatgtagcgatattattcgttatatatttataatcgttgtcgttaatgttttttatacggtgatagtatcggagttacgtacgttcgaaacgtttattcgcgcggttgcggtatatagacgattacggtcgcgttataaagtaggtgttgtcgaatgttgcgttatggtgcggagggggattatcggcgagacgggggttatcgtcgttgtttttcgttattttcgtttcgtagtagttttcgcgcgtttattcgagatttttttggcgttagaatttttttttgttgtgtttaatttcgtggggtatta

SEQ ID NO: 9970 - DNA, 501 bp, Artificial Sequence
  chemically treated genomic DNA (Homo sapiens) CpG-island No: 9970
taataccccacgaaattaaacacaacaaaaaaaaattctaacgccaaaaaaatctcgaataaacgcgcgaaaactactacgaaacgaaaataacgaaaaacaacgacgataacccccgtctcgccgataatccccctccgcaccataacgcaacattcgacaacacctactttataacgcgaccgtaatcgtctatataccgcaaccgcgcgaataaacgtttcgaacgtacgtaactccgatactatcaccgtataaaaaacattaacgacaacgattataaatatataacgaataatatcgctacattctaaataaaaccgacgttaacttcgatacgaacataaccgacgtttcgcttacgttctcgataaaaacgacgatttccgcaaacgcgttaaccgaaactaatcgaaatcttaaacgttaacgctctaacgatccataaaaacatctacgtaatcttatcaccgaacatatacaacataccgactctcaaac

SEQ ID NO: 9971 - DNA, 501 bp, Artificial Sequence
  chemically treated genomic DNA (Homo sapiens) CpG-island No: 9971
taatattttacggggttgggtataataaaaagaggttttagcgttagagaaatttcggataaacgcgcgggaattattgcggaacgaaaatagcgaaaagtagcggcgataattttcgtttcgtcggtggttttttttcgtattatgacgtaatattcggtaatatttgttttatggcgcgatcgtggtcgtttgtatgtcgtagtcgcgcgggtgaacgtttcgggcgtgcgtaatttcggtgttattatcgtgtagaaggtattggcgataacggttgtgaatatatgacgggtggtatcgttgtattttgggtaaaatcggcgttaatttcggtgcgggtatgatcggcgtttcgtttacgttttcgatgaaagcggcgattttcgtaaacgcgttaatcggaattggtcgaggttttaagcgttgacgttttggcgatttatgaaggtatttgcgtggttttattatcgagtatgtgtagtatatcggtttttaggt

SEQ ID NO: 9972 - DNA, 501 bp, Artificial Sequence
  chemically treated genomic DNA (Homo sapiens) CpG-island No: 9972
acctaaaaaccgatatactacacatactcgataataaaaccacgcaaataccttcataaatcgccaaaacgtcaacgcttaaaacctcgaccaattccgattaacgcgtttacgaaaatcgccgctttcatcgaaaacgtaaacgaaacgccgatcatacccgcaccgaaattaacgccgattttacccaaaatacaacgataccacccgtcatatattcacaaccgttatcgccaataccttctacacgataataacaccgaaattacgcacgcccgaaacgttcacccgcgcgactacgacatacaaacgaccacgatcgcgccataaaacaaatattaccgaatattacgtcataatacgaaaaaaaaccaccgacgaaacgaaaattatcgccgctacttttcgctattttcgttccgcaataattcccgcgcgtttatccgaaatttctctaacgctaaaacctctttttattatacccaaccccgtaaaatatta

SEQ ID NO: 9973 - DNA, 981 bp, Artificial Sequence
  chemically treated genomic DNA (Homo sapiens) CpG-island No: 9973
tatttgtcgttcggttaataataattattgcgggtttgcgtttatcgtcgattttttttagtaggcgttcgtatagtggatgtcggtggttttacgtagatagcgatgcgtaattcgtgatatgggtatcggttggtttgttatttggttcgttcgtagcgggaagtcgtcgcgatcgatttcgtaaggtggtaagattcggcgtaacgtttatttgttttatcgtaaatagcgtgcggtacgtttcgcgtcgttttgtattttatcggtaattagtatgatttttgttcgttatatagagcgcgtaaacgttgtataaaggttggcgacgagggtagaaatcgttttcgttttgaatcggtttaattacgatggcggcgatattttcggcgcggtattatttttgaagattcggtggatgttggcgatagtttattttcgtttatgtcgtgtagcgggtaaggataaagcgcgcgataaaatgattcggtattagttttatgttcgtagagtacggatttattttgtcgttagcgttagcgtgtaatgcgtgcgttcgtgatacgcgtcgttaaaagtatggtgtcgttacgtttggtggcggcgcgggcgatttttatcgcgtttttatcgtttcggaatcggtcgtaattagtagcgtttttttggcgaaatcgtcggtattttttgatttataatttcgtatagttttagatacggttcgtagttagtatttggaagtaggtgtgcgatagtttttttaattgcgtttttacgcggttattattttcggatgtaggtgttcggtattgagtatcgtaattcgttcgcgaaattaagatatttacggtttttaacgttttatattcggtatttttcgcgcggttagcgaaaatcgggtgaatttgtttaacgttacgggaatcgtttgattgcggcgttgtattaattttttattgttgtttattcgtttttttagtt

SEQ ID NO: 9974 - DNA, 981 bp, Artificial Sequence
  chemically treated genomic DNA (Homo sapiens) CpG-island No: 9974
aactaaaaaaacgaataaacaacaataaaaaattaatacaacgccgcaatcaaacgattcccgtaacgttaaacaaattcacccgattttcgctaaccgcgcgaaaaataccgaatataaaacgttaaaaaccgtaaatatcttaatttcgcgaacgaattacgatactcaataccgaacacctacatccgaaaataataaccgcgtaaaaacgcaattaaaaaaactatcgcacacctacttccaaatactaactacgaaccgtatctaaaactatacgaaattataaatcaaaaaataccgacgatttcgccaaaaaaacgctactaattacgaccgattccgaaacgataaaaacgcgataaaaatcgcccgcgccgccaccaaacgtaacgacaccatacttttaacgacgcgtatcacgaacgcacgcattacacgctaacgctaacgacaaaataaatccgtactctacgaacataaaactaataccgaatcattttatcgcgcgctttatccttacccgctacacgacataaacgaaaataaactatcgccaacatccaccgaatcttcaaaaataataccgcgccgaaaatatcgccgccatcgtaattaaaccgattcaaaacgaaaacgatttctaccctcgtcgccaacctttatacaacgtttacgcgctctatataacgaacaaaaatcatactaattaccgataaaatacaaaacgacgcgaaacgtaccgcacgctatttacgataaaacaaataaacgttacgccgaatcttaccaccttacgaaatcgatcgcgacgacttcccgctacgaacgaaccaaataacaaaccaaccgatacccatatcacgaattacgcatcgctatctacgtaaaaccaccgacatccactatacgaacgcctactaaaaaaaatcgacgataaacgcaaacccgcaataattattattaaccgaacgacaaata

SEQ ID NO: 9975 - DNA, 981 bp, Artificial Sequence
  chemically treated genomic DNA (Homo sapiens) CpG-island No: 9975
aattggagaagcgaatgaatagtaataaagagttaatgtagcgtcgtagttaggcgattttcgtggcgttgggtaaatttattcgattttcgttgatcgcgcggaaaatgtcgggtgtgggacgttgaaggtcgtgagtattttgatttcgcgggcggattgcggtgtttaatatcgggtatttgtattcgaaggtggtggtcgcgtggaagcgtagttgaaaaaattgtcgtatatttgtttttaggtgttggttacgagtcgtatttggagttgtgcgagattatgaattagaaggtgtcggcgatttcgttaagaaaacgttgttggttacgatcggtttcgaagcggtgaaaacgcggtaaaaatcgttcgcgtcgttattaaacgtagcggtattatgtttttagcggcgcgtattacgggcgtacgtattatacgttggcgttgacggtaaggtgaattcgtattttgcgggtatggggttgatgtcgggttattttatcgcgcgttttatttttgttcgttgtacggtataagcgaggatgagttatcgttagtatttatcggatttttaaaaatgatgtcgcgtcggaagtatcgtcgttatcgtgattgagtcggtttagggcgaaggcggtttttattttcgtcgttagtttttatgtagcgtttacgcgttttgtgtgacgagtagggattatgttgattgtcgatgaagtgtagagcggcgcggggcgtatcgtacgttgtttgcgatggagtagatgggcgttgcgtcggattttattattttgcgaaatcgatcgcggcggtttttcgttgcgggcgggttaggtagtagattagtcgatatttatattacgagttgcgtatcgttgtttgcgtgaaattatcgatatttattgtacgaacgtttgttggaagagatcgacgataagcgtaagttcgtagtggttgttgttagtcgaacggtagatg

SEQ ID NO: 9976 - DNA, 981 bp, Artificial Sequence
  chemically treated genomic DNA (Homo sapiens) CpG-island No: 9976
catctaccgttcgactaacaacaaccactacgaacttacgcttatcgtcgatctcttccaacaaacgttcgtacaataaatatcgataatttcacgcaaacaacgatacgcaactcgtaatataaatatcgactaatctactacctaacccgcccgcaacgaaaaaccgccgcgatcgatttcgcaaaataataaaatccgacgcaacgcccatctactccatcgcaaacaacgtacgatacgccccgcgccgctctacacttcatcgacaatcaacataatccctactcgtcacacaaaacgcgtaaacgctacataaaaactaacgacgaaaataaaaaccgccttcgccctaaaccgactcaatcacgataacgacgatacttccgacgcgacatcatttttaaaaatccgataaatactaacgataactcatcctcgcttataccgtacaacgaacaaaaataaaacgcgcgataaaataacccgacatcaaccccatacccgcaaaatacgaattcaccttaccgtcaacgccaacgtataatacgtacgcccgtaatacgcgccgctaaaaacataataccgctacgtttaataacgacgcgaacgatttttaccgcgttttcaccgcttcgaaaccgatcgtaaccaacaacgttttcttaacgaaatcgccgacaccttctaattcataatctcgcacaactccaaatacgactcgtaaccaacacctaaaaacaaatatacgacaattttttcaactacgcttccacgcgaccaccaccttcgaatacaaatacccgatattaaacaccgcaatccgcccgcgaaatcaaaatactcacgaccttcaacgtcccacacccgacattttccgcgcgatcaacgaaaatcgaataaatttacccaacgccacgaaaatcgcctaactacgacgctacattaactctttattactattcattcgcttctccaatt

SEQ ID NO: 9977 - DNA, 510 bp, Artificial Sequence
  chemically treated genomic DNA (Homo sapiens) CpG-island No: 9977
ttttcgattttttttcggttttagttagcgtttagatcgattatcgatatggcggttattttgttgtgttatgattttaatcgggagttggttagtgtgtaggtcgtgcgagaagtataaattttttatttcggcgtattgggtagaatcgaatttatacgttaggtttgcgagagttttacgagttgggatggtttaggaggaaataacgtaaatcgggtattcgtcgggatattttttaaagtcgggatgcgtatattttggtatttttcgtgttggtagaagtcgtttttgacgtttttattaggaggaggatttatgtttgttttcgtcgttttgattttgcggtcgggcgtggagagtgttttttcgttttcgggggaaatatttatagtgtatcggttggcgttagttttcggaggttgcgttttatcgttggtttttgaagaaaacgggagaattttcgattttgcgattgaatcgtagattagattaatgatttgcgtttga

SEQ ID NO: 9978 - DNA, 510 bp, Artificial Sequence
  chemically treated genomic DNA (Homo sapiens) CpG-island No: 9978
tcaaacgcaaatcattaatctaatctacgattcaatcgcaaaatcgaaaattctcccgttttcttcaaaaaccaacgataaaacgcaacctccgaaaactaacgccaaccgatacactataaatatttcccccgaaaacgaaaaaacactctccacgcccgaccgcaaaatcaaaacgacgaaaacaaacataaatcctcctcctaataaaaacgtcaaaaacgacttctaccaacacgaaaaataccaaaatatacgcatcccgactttaaaaaatatcccgacgaatacccgatttacgttatttcctcctaaaccatcccaactcgtaaaactctcgcaaacctaacgtataaattcgattctacccaatacgccgaaataaaaaatttatacttctcgcacgacctacacactaaccaactcccgattaaaatcataacacaacaaaataaccgccatatcgataatcgatctaaacgctaactaaaaccgaaaaaaaatcgaaaa

SEQ ID NO: 9979 - DNA, 510 bp, Artificial Sequence
  chemically treated genomic DNA (Homo sapiens) CpG-island No: 9979
ttagacgtagattattagtttaatttgcggtttaatcgtaaggtcgaaagttttttcgttttttttaaaggttagcgataaggcgtaattttcggggattgacgttagtcgatatattatgggtatttttttcggaggcgagaaagtattttttacgttcggtcgtaggattaggacgacgggggtaggtatgaattttttttttgatggagacgttagaggcgatttttgttagtacggagagtgttagagtatgcgtatttcggttttggggaatatttcgacgggtgttcgatttgcgttgtttttttttggattattttagttcgtggagttttcgtagatttaacgtgtgggttcgattttgtttaatgcgtcgagataaaaggtttatgtttttcgtacggtttgtatattagttagttttcggttgagattatggtatagtaaaatgatcgttatatcggtaatcgatttgagcgttggttgaggtcggaaaaagatcgaaga

SEQ ID NO: 9980 - DNA, 510 bp, Artificial Sequence
  chemically treated genomic DNA (Homo sapiens) CpG-island No: 9980
tcttcgatctttttccgacctcaaccaacgctcaaatcgattaccgatataacgatcattttactataccataatctcaaccgaaaactaactaatatacaaaccgtacgaaaaacataaaccttttatctcgacgcattaaacaaaatcgaacccacacgttaaatctacgaaaactccacgaactaaaataatccaaaaaaaaacaacgcaaatcgaacacccgtcgaaatattccccaaaaccgaaatacgcatactctaacactctccgtactaacaaaaatcgcctctaacgtctccatcaaaaaaaaaattcatacctacccccgtcgtcctaatcctacgaccgaacgtaaaaaatactttctcgcctccgaaaaaaatacccataatatatcgactaacgtcaatccccgaaaattacgccttatcgctaacctttaaaaaaaacgaaaaaactttcgaccttacgattaaaccgcaaattaaactaataatctacgtctaa

SEQ ID NO: 9981 - DNA, 510 bp, Artificial Sequence
  chemically treated genomic DNA (Homo sapiens) CpG-island No: 9981
tcggtgcggtaattattattttattttcgttgttatcgaagttatttgcgtttaggtttgcgttatgacgcgtaatttatcgttgaaatttgttatcgtagtgttattaggtttttgtttgttcgttgagcgttatcggcgcgttgcggtcgtatatttttgtgttgtgttcgggggtttttttcgtttgtttttttcgcgcggaaggaagtggtatgttttttttttaatgcgcgatgtattttcgcgggggcgtaaagtttgcgggagcggggcgcgggggtttgttaattcgcgaggcgttttagtgttttttcgcgggatataagggtgggtacggggttcgtacggtgtcgagtattgtgggagacggcgtatgtttgaaaggtatcgtcgggggaagttttgttgttagcgttagaaacgtcgtttaattagcgtcgaagtgagcgtagtgattaaagttatgtagtggtaatggattttcgtaaattgaaaaaaggcgatgaa

SEQ ID NO: 9982 - DNA, 510 bp, Artificial Sequence
  chemically treated genomic DNA (Homo sapiens) CpG-island No: 9982
ttcatcgccttttttcaatttacgaaaatccattaccactacataactttaatcactacgctcacttcgacgctaattaaacgacgtttctaacgctaacaacaaaacttcccccgacgatacctttcaaacatacgccgtctcccacaatactcgacaccgtacgaaccccgtacccacccttatatcccgcgaaaaaacactaaaacgcctcgcgaattaacaaacccccgcgccccgctcccgcaaactttacgcccccgcgaaaatacatcgcgcattaaaaaaaaaacataccacttccttccgcgcgaaaaaaacaaacgaaaaaaacccccgaacacaacacaaaaatatacgaccgcaacgcgccgataacgctcaacgaacaaacaaaaacctaataacactacgataacaaatttcaacgataaattacgcgtcataacgcaaacctaaacgcaaataacttcgataacaacgaaaataaaataataattaccgcaccga

SEQ ID NO: 9983 - DNA, 510 bp, Artificial Sequence
  chemically treated genomic DNA (Homo sapiens) CpG-island No: 9983
tttatcgtttttttttagtttgcggaaatttattgttattgtatggttttaattattgcgtttatttcggcgttggttaaacggcgtttttggcgttggtaataaagtttttttcgacggtattttttagatatgcgtcgttttttatagtgttcgatatcgtacgggtttcgtgtttatttttgtatttcgcgggaggatattggggcgtttcgcgggttagtaagttttcgcgtttcgttttcgtaggttttacgttttcgcgaaaatatatcgcgtattaaagggggggtatattattttttttcgcgcgaggagaataaacggggggaattttcgggtataatataaaaatgtgcggtcgtagcgcgtcggtaacgtttaacgaataggtagaagtttggtaatattgcgatggtagattttaacggtgaattgcgcgttatggcgtaagtttggacgtagatgatttcggtagtaacgaaagtaaagtgatagttgtcgtatcgg

SEQ ID NO: 9984 - DNA, 510 bp, Artificial Sequence
  chemically treated genomic DNA (Homo sapiens) CpG-island No: 9984
ccgatacgacaactatcactttactttcgttactaccgaaatcatctacgtccaaacttacgccataacgcgcaattcaccgttaaaatctaccatcgcaatattaccaaacttctacctattcgttaaacgttaccgacgcgctacgaccgcacatttttatattatacccgaaaattccccccgtttattctcctcgcgcgaaaaaaaataatataccccccctttaatacgcgatatattttcgcgaaaacgtaaaacctacgaaaacgaaacgcgaaaacttactaacccgcgaaacgccccaatatcctcccgcgaaatacaaaaataaacacgaaacccgtacgatatcgaacactataaaaaacgacgcatatctaaaaaataccgtcgaaaaaaactttattaccaacgccaaaaacgccgtttaaccaacgccgaaataaacgcaataattaaaaccatacaataacaataaatttccgcaaactaaaaaaaaacgataaa

SEQ ID NO: 9985 - DNA, 656 bp, Artificial Sequence
  chemically treated genomic DNA (Homo sapiens) CpG-island No: 9985
attatttcgttataacgcggtttttcggtcgtaaattttaaaatttgtttcggtcgcgaatcgatttttttgcgcgttagatagcgaaaatcgtgttttagtcgaatatttcgaagagatcgatgttttcggtttttgcgtttagtaacgtcgtaagtcggaggggcggtttttttgttagttatagcgtagacggtttattttattttaattacgtttagagtgatgcgttcgttagtggtaaaggtggttatttcgtgacgttggtagaaagttcgcgaaagttatcgcgttatgttgtttgggagaggtcgtaaaagttaattaggcgcgtcgcgtttcggtgttaaaacgacgttgtcgttagtgagtgaggcgtggcgttttattttataatttaggtcggtttaatatttttttggcgttggcgtagattcggtagggtgaaggttagagattgattcgcgcgtatagattttcgcgaaatttgttttcggtaatagttggcgtaaatcgcgtatcgtttcggcgataagttgaaaattattgttatttggcgatcgttgttaaacgggtaaaaggttttttttttaatggttttagtagtattgtttgttcgtttgcgtttagttcgttaattttattaagaataatat

SEQ ID NO: 9986 - DNA, 656 bp, Artificial Sequence
  chemically treated genomic DNA (Homo sapiens) CpG-island No: 9986
atattattcttaataaaattaacgaactaaacgcaaacgaacaaacaatactactaaaaccattaaaaaaaaaaccttttacccgtttaacaacgatcgccaaataacaataattttcaacttatcgccgaaacgatacgcgatttacgccaactattaccgaaaacaaatttcgcgaaaatctatacgcgcgaatcaatctctaaccttcaccctaccgaatctacgccaacgccaaaaaaatattaaaccgacctaaattataaaataaaacgccacgcctcactcactaacgacaacgtcgttttaacaccgaaacgcgacgcgcctaattaacttttacgacctctcccaaacaacataacgcgataactttcgcgaactttctaccaacgtcacgaaataaccacctttaccactaacgaacgcatcactctaaacgtaattaaaataaaataaaccgtctacgctataactaacaaaaaaaccgcccctccgacttacgacgttactaaacgcaaaaaccgaaaacatcgatctcttcgaaatattcgactaaaacacgattttcgctatctaacgcgcaaaaaaatcgattcgcgaccgaaacaaattttaaaatttacgaccgaaaaaccgcgttataacgaaataat

SEQ ID NO: 9987 - DNA, 656 bp, Artificial Sequence
  chemically treated genomic DNA (Homo sapiens) CpG-island No: 9987
atgttgtttttgatgagattggcgaattgggcgtagacgaataggtaatgttgttgaagttattgaagagaaaattttttattcgtttggtagcgatcgttaggtggtagtgatttttagtttatcgtcggaacggtgcgcgatttgcgttagttgttgtcgaaggtaaatttcgcgaagatttgtacgcgcggattaatttttgatttttattttgtcgggtttacgttagcgttaggaagatattgaatcgatttggattatgaagtggagcgttacgttttatttattggcgatagcgtcgttttaatatcgaagcgcggcgcgtttggttggtttttgcgattttttttaggtaatatggcgcggtaattttcgcgaattttttgttagcgttacgggatggttatttttgttattagcggacgtattattttggacgtggttgagatgagataaatcgtttgcgttataattggtaggagagtcgttttttcggtttacggcgttgttgggcgtagaggtcgaaaatatcgattttttcgaggtgttcgattgggatacggttttcgttatttggcgcgtagggaaatcggttcgcggtcgaggtaggttttgaagtttgcggtcggggagtcgcgttataacggggtggt

SEQ ID NO: 9988 - DNA, 656 bp, Artificial Sequence
  chemically treated genomic DNA (Homo sapiens) CpG-island No: 9988
accaccccgttataacgcgactccccgaccgcaaacttcaaaacctacctcgaccgcgaaccgatttccctacgcgccaaataacgaaaaccgtatcccaatcgaacacctcgaaaaaatcgatattttcgacctctacgcccaacaacgccgtaaaccgaaaaaacgactctcctaccaattataacgcaaacgatttatctcatctcaaccacgtccaaaataatacgtccgctaataacaaaaataaccatcccgtaacgctaacaaaaaattcgcgaaaattaccgcgccatattacctaaaaaaaatcgcaaaaaccaaccaaacgcgccgcgcttcgatattaaaacgacgctatcgccaataaataaaacgtaacgctccacttcataatccaaatcgattcaatatcttcctaacgctaacgtaaacccgacaaaataaaaatcaaaaattaatccgcgcgtacaaatcttcgcgaaatttaccttcgacaacaactaacgcaaatcgcgcaccgttccgacgataaactaaaaatcactaccacctaacgatcgctaccaaacgaataaaaaattttctcttcaataacttcaacaacattacctattcgtctacgcccaattcgccaatctcatcaaaaacaacat

SEQ ID NO: 9989 - DNA, 502 bp, Artificial Sequence
  chemically treated genomic DNA (Homo sapiens) CpG-island No: 9989
ttacggttgatttgaatgtagtagtcgtgtatcgtattaaagttaattttagcgtgtttaggtcggtacgtttacgttcgcggatttttagacgtttagataatcggtcgcgtcgttagttagcgcgcgttatttatttagtttttgttatagttcgatgcgataatattatcgtcgcgtattagtatcggcggttgtcgatgattgttcgttttagtagatcgcgtagttcggtaaattcgttatttttttacgtagcgtttgtatcggtgtattatcgatagtttttaattcgtacgtagtttcggtagttgttggaaagcgtggcgtatacgggttagacgcgtgggcgagtagttcgtaaagttagacgtgttagaatacgttttagtcgtcgatttgacgtagtatcggttgtagttcggcggtgaaattttgtatgcgttaatagtttgttggcgtttaaggtaggtagttgttatttttaggtgattttagagga

SEQ ID NO: 9990 - DNA, 502 bp, Artificial Sequence
  chemically treated genomic DNA (Homo sapiens) CpG-island No: 9990
tcctctaaaatcacctaaaaataacaactacctaccttaaacgccaacaaactattaacgcatacaaaatttcaccgccgaactacaaccgatactacgtcaaatcgacgactaaaacgtattctaacacgtctaactttacgaactactcgcccacgcgtctaacccgtatacgccacgctttccaacaactaccgaaactacgtacgaattaaaaactatcgataatacaccgatacaaacgctacgtaaaaaaataacgaatttaccgaactacgcgatctactaaaacgaacaatcatcgacaaccgccgatactaatacgcgacgataatattatcgcatcgaactataacaaaaactaaataaataacgcgcgctaactaacgacgcgaccgattatctaaacgtctaaaaatccgcgaacgtaaacgtaccgacctaaacacgctaaaattaactttaatacgatacacgactactacattcaaatcaaccgtaa

SEQ ID NO: 9991 - DNA, 502 bp, Artificial Sequence
  chemically treated genomic DNA (Homo sapiens) CpG-island No: 9991
ttttttagagttatttgaggatgatagttgtttgttttgagcgttagtaaattattggcgtatgtaggattttatcgtcgggttatagtcggtattgcgttaggtcggcgattggaacgtattttggtacgtttggttttacgaattgttcgtttacgcgtttggttcgtatgcgttacgttttttagtaattgtcggagttgcgtgcgagttagaaattgtcgatagtgtatcggtataggcgttacgtgagaagatggcgagtttgtcgagttgcgcgatttgttggagcgagtaattatcgataatcgtcggtgttggtacgcgacggtggtgttatcgtatcgggttataataagagttggatgagtggcgcgcgttggttgacggcgcgatcgattatttgagcgtttggaagttcgcgagcgtgaacgtatcggtttggatacgttgaagttggttttaatgcggtgtacggttattatatttaaattagtcgtgg

SEQ ID NO: 9992 - DNA, 502 bp, Artificial Sequence
  chemically treated genomic DNA (Homo sapiens) CpG-island No: 9992
ccacgactaatttaaatataataaccgtacaccgcattaaaaccaacttcaacgtatccaaaccgatacgttcacgctcgcgaacttccaaacgctcaaataatcgatcgcgccgtcaaccaacgcgcgccactcatccaactcttattataacccgatacgataacaccaccgtcgcgtaccaacaccgacgattatcgataattactcgctccaacaaatcgcgcaactcgacaaactcgccatcttctcacgtaacgcctataccgatacactatcgacaatttctaactcgcacgcaactccgacaattactaaaaaacgtaacgcatacgaaccaaacgcgtaaacgaacaattcgtaaaaccaaacgtaccaaaatacgttccaatcgccgacctaacgcaataccgactataacccgacgataaaatcctacatacgccaataatttactaacgctcaaaacaaacaactatcatcctcaaataactctaaaaaa

SEQ ID NO: 9993 - DNA, 567 bp, Artificial Sequence
  chemically treated genomic DNA (Homo sapiens) CpG-island No: 9993
cgtgtatacgttatcgtaaatagtgcgttcggtcgggtaggtgtgtttaaagtatttagattttcgtgatattagcgtattagtatcgattgagcggtttttttagataaggtatatggatttgaatatcgtgcgtttggtcgatacgattagacgattaatacgttgttttagtagattcgggttgaatggtaggttaatattattatgtggttggcgaattggaagttacgttttttagaatcgattttgagtatagtagtatttgtgcgtcggtgtttttttcggtaaattagcggtagcgcggttacgttcgataatcgatatattttcgtggaatatcgcgcgcgaatatttttacgttcgcgtagtatttgttttagttgtagcgtagggtagttttggcgtagattattagtattttttgagagcgatggttggtcggtagtttattagttatttaacgcgcggatcgaagttttattaggtggtttattatttttaaatttttgataaatacgtttcgggtagagtatatcgtagtacgatttttcgtatttttacgtg

SEQ ID NO: 9994 - DNA, 567 bp, Artificial Sequence
  chemically treated genomic DNA (Homo sapiens) CpG-island No: 9994
cacgtaaaaatacgaaaaatcgtactacgatatactctacccgaaacgtatttatcaaaaatttaaaaataataaaccacctaataaaacttcgatccgcgcgttaaataactaataaactaccgaccaaccatcgctctcaaaaaatactaataatctacgccaaaactaccctacgctacaactaaaacaaatactacgcgaacgtaaaaatattcgcgcgcgatattccacgaaaatatatcgattatcgaacgtaaccgcgctaccgctaatttaccgaaaaaaacaccgacgcacaaatactactatactcaaaatcgattctaaaaaacgtaacttccaattcgccaaccacataataatattaacctaccattcaacccgaatctactaaaacaacgtattaatcgtctaatcgtatcgaccaaacgcacgatattcaaatccatataccttatctaaaaaaaccgctcaatcgatactaatacgctaatatcacgaaaatctaaatactttaaacacacctacccgaccgaacgcactatttacgataacgtatacacg

SEQ ID NO: 9995 - DNA, 567 bp, Artificial Sequence
  chemically treated genomic DNA (Homo sapiens) CpG-island No: 9995
tacgtaaaagtgcggaagatcgtgttgcgatatgttttattcggagcgtatttattaggaatttgaaggtgataagttatttggtggaatttcgattcgcgcgttgagtggttgatgggttatcgattagttatcgtttttagaaagtgttggtgatttgcgttaaagttgttttgcgttgtaattggagtaggtattgcgcgaacgtgaaggtattcgcgcgcggtgttttacgaaggtatgtcgattatcgaacgtgatcgcgttgtcgttggtttgtcgaagaagatatcggcgtataggtattgttgtgtttagaatcggttttgaaggacgtaatttttagttcgttagttatatggtgatgttgatttgttatttaattcggatttattggagtagcgtattggtcgtttggtcgtatcggttaggcgtacgatatttagatttatgtgttttatttggagaaatcgtttagtcggtgttggtgcgttggtattacgaaggtttggatgttttgagtatatttgttcgatcggacgtattatttacgatagcgtatatacg

SEQ ID NO: 9996 - DNA, 567 bp, Artificial Sequence
  chemically treated genomic DNA (Homo sapiens) CpG-island No: 9996
cgtatatacgctatcgtaaataatacgtccgatcgaacaaatatactcaaaacatccaaaccttcgtaataccaacgcaccaacaccgactaaacgatttctccaaataaaacacataaatctaaatatcgtacgcctaaccgatacgaccaaacgaccaatacgctactccaataaatccgaattaaataacaaatcaacatcaccatataactaacgaactaaaaattacgtccttcaaaaccgattctaaacacaacaatacctatacgccgatatcttcttcgacaaaccaacgacaacgcgatcacgttcgataatcgacataccttcgtaaaacaccgcgcgcgaataccttcacgttcgcgcaatacctactccaattacaacgcaaaacaactttaacgcaaatcaccaacactttctaaaaacgataactaatcgataacccatcaaccactcaacgcgcgaatcgaaattccaccaaataacttatcaccttcaaattcctaataaatacgctccgaataaaacatatcgcaacacgatcttccgcacttttacgta

SEQ ID NO: 9997 - DNA, 515 bp, Artificial Sequence
  chemically treated genomic DNA (Homo sapiens) CpG-island No: 9997
attgcgtcggtagcggtagtttaatggtgtgtagtttcgtttcgggaatttttttatatcgttacgcgtgttacggaatagtacgcgttggtgtcgtggcgatttattagtatcgaaattagtttttgacgggcgtttgggtattttcgttgtcgttgtttgttgtttgtaatagcggttcgatttttgttcgtcgattatttcgtcgagtatgtttagttcgttattgtttatttgttatttgttagtagtatggtaacggcgttcgtaatcggacgataattttttgttttttaacgaattgcgtaaaatcgtggaaacggttcgggttagtagacgtagacgggcgaagtggttttttatttttagttgtttcggggcgcggttagtagtagaacgttcggtacgtgttttgttagttgtttaatgtttgatttgaacgttaggcgcggtaacggggttattaattgttgattgttgtttagaagattagtaagataagcggtattattgat

SEQ ID NO: 9998 - DNA, 515 bp, Artificial Sequence
  chemically treated genomic DNA (Homo sapiens) CpG-island No: 9998
atcaataataccgcttatcttactaatcttctaaacaacaatcaacaattaataaccccgttaccgcgcctaacgttcaaatcaaacattaaacaactaacaaaacacgtaccgaacgttctactactaaccgcgccccgaaacaactaaaaataaaaaaccacttcgcccgtctacgtctactaacccgaaccgtttccacgattttacgcaattcgttaaaaaacaaaaaattatcgtccgattacgaacgccgttaccatactactaacaaataacaaataaacaataacgaactaaacatactcgacgaaataatcgacgaacaaaaatcgaaccgctattacaaacaacaaacaacgacaacgaaaatacccaaacgcccgtcaaaaactaatttcgatactaataaatcgccacgacaccaacgcgtactattccgtaacacgcgtaacgatataaaaaaattcccgaaacgaaactacacaccattaaactaccgctaccgacgcaat

SEQ ID NO: 9999 - DNA, 515 bp, Artificial Sequence
  chemically treated genomic DNA (Homo sapiens) CpG-island No: 9999
attagtggtatcgtttgttttgttgattttttgagtagtaattagtagttgataatttcgttgtcgcgtttggcgtttaaattaggtattgaataattggtagagtacgtgtcgggcgttttgttgttgatcgcgtttcggaatagttggggatggaaagttatttcgttcgtttgcgtttgttgattcgaatcgtttttacgattttgcgtagttcgttgaagagtagaaaattatcgttcggttgcggacgtcgttgttatgttgttggtaggtaataaatgagtaatgacgaattgaatatgttcggcgagatgatcggcgagtaggaatcgagtcgttgttgtaggtagtaaatagcgatagcgaagatgtttagacgttcgttaggagttggtttcgatgttgatggatcgttacggtattagcgcgtgttgtttcgtaatacgcgtaacggtgtgaaaggattttcgaaacggagttgtatattattaagttgtcgttatcgacgtagt

SEQ ID NO: 10000 - DNA, 515 bp, Artificial Sequence
  chemically treated genomic DNA (Homo sapiens) CpG-island No: 10000
actacgtcgataacgacaacttaataatatacaactccgtttcgaaaatcctttcacaccgttacgcgtattacgaaacaacacgcgctaataccgtaacgatccatcaacatcgaaaccaactcctaacgaacgtctaaacatcttcgctatcgctatttactacctacaacaacgactcgattcctactcgccgatcatctcgccgaacatattcaattcgtcattactcatttattacctaccaacaacataacaacgacgtccgcaaccgaacgataattttctactcttcaacgaactacgcaaaatcgtaaaaacgattcgaatcaacaaacgcaaacgaacgaaataactttccatccccaactattccgaaacgcgatcaacaacaaaacgcccgacacgtactctaccaattattcaatacctaatttaaacgccaaacgcgacaacgaaattatcaactactaattactactcaaaaaatcaacaaaacaaacgataccactaat

SEQ ID NO: 10001 - DNA, 731 bp, Artificial Sequence
  chemically treated genomic DNA (Homo sapiens) CpG-island No: 10001
tcgtatcgtcggtttttcggtttaagttttaatattcgggcgaattggcgtgttttattattcggtagtatgaattattattcgttagttattttattggagacgacggagatcgttgtcgaagcggcgttttatcgtttttagtatgacgttttgtatgttttattgttgaagtcgtcggtagtgatcgtttagtgtagtgttttagattatagtagtttagcgcgaacgtgatacgtagttttttttcgttatttagtagaattcgaattcgttagagtattatcgttgattgtttttttttaggttattttgtttgtatgtgttcgtttcgatggcggtatagtaggttttgtttaagtaatagcgtattttggcgtatgattcggtaaatacgtttggtttgatcgtaggtatattattaagttttgtttgtttgcgaagtagcgttttattcgacgataattatacgttggtagtttttcgataatatggtgtataggagaagtatattcgtattattagtgtgacgattgcggcggttatttattagttatcggttcgtttgagaatgacgtgtaattgcgtacgcgatattcgagataacggttgattaagtttattttttattttcgggtaataagggcggtgcgttatttatttttttgttcgtttatatttaacggtttttttgagggtttatttgggtagtgtatgttagaatattcgtt

SEQ ID NO: 10002 - DNA, 731 bp, Artificial Sequence
  chemically treated genomic DNA (Homo sapiens) CpG-island No: 10002
aacgaatattctaacatacactacccaaataaaccctcaaaaaaaccgttaaatataaacgaacaaaaaaataaataacgcaccgcccttattacccgaaaataaaaaataaacttaatcaaccgttatctcgaatatcgcgtacgcaattacacgtcattctcaaacgaaccgataactaataaataaccgccgcaatcgtcacactaataatacgaatatacttctcctatacaccatattatcgaaaaactaccaacgtataattatcgtcgaataaaacgctacttcgcaaacaaacaaaacttaataatatacctacgatcaaaccaaacgtatttaccgaatcatacgccaaaatacgctattacttaaacaaaacctactataccgccatcgaaacgaacacatacaaacaaaataacctaaaaaaaaacaatcaacgataatactctaacgaattcgaattctactaaataacgaaaaaaaactacgtatcacgttcgcgctaaactactataatctaaaacactacactaaacgatcactaccgacgacttcaacaataaaacatacaaaacgtcatactaaaaacgataaaacgccgcttcgacaacgatctccgtcgtctccaataaaataactaacgaataataattcatactaccgaataataaaacacgccaattcgcccgaatattaaaacttaaaccgaaaaaccgacgatacga

SEQ ID NO: 10003 - DNA, 731 bp, Artificial Sequence
  chemically treated genomic DNA (Homo sapiens) CpG-island No: 10003
agcgagtattttagtatgtattgtttaaatgaatttttaaagaagtcgttgaatatggacgggtaaaaaagtggatagcgtatcgtttttattgttcggggatggggagtaagtttagttagtcgttgtttcgggtgtcgcgtgcgtagttgtacgttatttttagacgaatcgatgattgatggatggtcgtcgtagtcgttatattgatgatacggatgtgttttttttatatattatgttatcggagagttgttaacgtatggttatcgtcgggtagggcgttgtttcgtagataggtagaatttgatggtatgtttgcgattaagttaaacgtgtttatcggattatgcgttagaatgcgttgttgtttgagtaaaatttgttgtatcgttatcgaaacgggtatatataggtagagtggtttgaaagaaagtaattagcgatggtgttttgacgggttcgagttttgttggataacggagagagattgcgtgttacgttcgcgttggattgttgtgatttgaggtattgtattgggcggttattatcggcggttttaatagtgaaatatataggacgttatgttgggagcggtggaacgtcgtttcggtaacgattttcgtcgtttttagtggagtggttgacggataatggtttatgttatcgggtaatgaaatacgttagttcgttcggatgttgggatttgaatcgaagaatcggcggtgcgg

SEQ ID NO: 10004 - DNA, 731 bp, Artificial Sequence
  chemically treated genomic DNA (Homo sapiens) CpG-island No: 10004
ccgcaccgccgattcttcgattcaaatcccaacatccgaacgaactaacgtatttcattacccgataacataaaccattatccgtcaaccactccactaaaaacgacgaaaatcgttaccgaaacgacgttccaccgctcccaacataacgtcctatatatttcactattaaaaccgccgataataaccgcccaatacaatacctcaaatcacaacaatccaacgcgaacgtaacacgcaatctctctccgttatccaacaaaactcgaacccgtcaaaacaccatcgctaattactttctttcaaaccactctacctatatatacccgtttcgataacgatacaacaaattttactcaaacaacaacgcattctaacgcataatccgataaacacgtttaacttaatcgcaaacataccatcaaattctacctatctacgaaacaacgccctacccgacgataaccatacgttaacaactctccgataacataatatataaaaaaaacacatccgtatcatcaatataacgactacgacgaccatccatcaatcatcgattcgtctaaaaataacgtacaactacgcacgcgacacccgaaacaacgactaactaaacttactccccatccccgaacaataaaaacgatacgctatccacttttttacccgtccatattcaacgacttctttaaaaattcatttaaacaatacatactaaaatactcgct

SEQ ID NO: 10005 - DNA, 749 bp, Artificial Sequence
  chemically treated genomic DNA (Homo sapiens) CpG-island No: 10005
gagggagcgtttcggcggaggagttaaggaagagggggaggagaaacgcgttagaatttcggttcgggcgttttcgtcggtcgcggaggattgtagtttttaataggttcgtagaacgcgcgttcgttttttgtggttggtcgttttttttcgcgggagcggttggcggagagatttcggttataggttcgcgttcgagagttttttagaggcggtttttttcggttttttttttttttggagtttttagtcgtcggcggttttttcggggcgaggtagagggcgttcgggtttttcgttttagtattatttcggggatagttttcgcgtcgtacgggtttttatcgggttagtattgtagcggcggatagcggcggtcgggcggttttttcgtatttttcgttttggtttcgcgcggttgttaaggatcgttttcgttttcgcgggtcgtttttaacgttagtatcgcggcggcggatagttttttcggcggtatcgcgaatcgcgaataaagtcgcgggtttggggttttagcgcgtttaggggtggcgtgaggtcgtatcgatcgggggattttagtttttttagaaaggtgttatcggcgagttaggcgggggtttagtatagttcgcgttttcggtttgggttcgtcgttcgtcgaggtttggtcgtgtaatgcggggtttagttaagagtgggtaagagggtagaggggaaataggtatagagggtttcggtttcgttaggcg

SEQ ID NO: 10006 - DNA, 749 bp, Artificial Sequence
  chemically treated genomic DNA (Homo sapiens) CpG-island No: 10006
cgcctaacgaaaccgaaaccctctatacctatttcccctctaccctcttacccactcttaactaaaccccgcattacacgaccaaacctcgacgaacgacgaacccaaaccgaaaacgcgaactatactaaacccccgcctaactcgccgataacacctttctaaaaaaactaaaatcccccgatcgatacgacctcacgccacccctaaacgcgctaaaaccccaaacccgcgactttattcgcgattcgcgataccgccgaaaaaactatccgccgccgcgatactaacgttaaaaacgacccgcgaaaacgaaaacgatccttaacaaccgcgcgaaaccaaaacgaaaaatacgaaaaaaccgcccgaccgccgctatccgccgctacaatactaacccgataaaaacccgtacgacgcgaaaactatccccgaaataatactaaaacgaaaaacccgaacgccctctacctcgccccgaaaaaaccgccgacgactaaaaactccaaaaaaaaaaaaaaccgaaaaaaaccgcctctaaaaaactctcgaacgcgaacctataaccgaaatctctccgccaaccgctcccgcgaaaaaaaacgaccaaccacaaaaaacgaacgcgcgttctacgaacctattaaaaactacaatcctccgcgaccgacgaaaacgcccgaaccgaaattctaacgcgtttctcctccccctcttccttaactcctccgccgaaacgctccctc

SEQ ID NO: 10007 - DNA, 749 bp, Artificial Sequence
  chemically treated genomic DNA (Homo sapiens) CpG-island No: 10007
cgtttagcggagtcgggattttttgtgtttgttttttttttatttttttgtttatttttagttgggtttcgtattgtacggttaggtttcggcgggcggcggatttaagtcggagacgcgggttgtgttaggttttcgtttagttcgtcggtgatatttttttgggagagttgaaatttttcgatcgatgcggttttacgttatttttaggcgcgttggggttttagattcgcggttttgttcgcggttcgcggtgtcgtcggagaggttgttcgtcgtcgcggtgttagcgttgggagcggttcgcgggggcgaggacggtttttagtagtcgcgcggaattagggcggagggtgcggaggagtcgttcggtcgtcgttgttcgtcgttgtagtgttgattcgatagggattcgtgcggcgcgggagttgttttcgagatggtgttggagcgagaagttcgagcgttttttgtttcgtttcggaagagtcgtcggcggttgagagttttaggagggggagaggtcggaggaagtcgtttttaggaagttttcgagcgcgggtttgtggtcggggttttttcgttaatcgttttcgcggaggagggcggttagttatagggagcgagcgcgcgttttacgaatttgttggaggttgtagtttttcgcggtcgacgagggcgttcgggtcgaggttttggcgcgtttttttttttttttttttttgattttttcgtcgaggcgttttttt

SEQ ID NO: 10008 - DNA, 749 bp, Artificial Sequence
  chemically treated genomic DNA (Homo sapiens) CpG-island No: 10008
aaaaaaacgcctcgacgaaaaaatcaaaaaaaaaaaaaaaaaaaaacgcgccaaaacctcgacccgaacgccctcgtcgaccgcgaaaaactacaacctccaacaaattcgtaaaacgcgcgctcgctccctataactaaccgccctcctccgcgaaaacgattaacgaaaaaaccccgaccacaaacccgcgctcgaaaacttcctaaaaacgacttcctccgacctctccccctcctaaaactctcaaccgccgacgactcttccgaaacgaaacaaaaaacgctcgaacttctcgctccaacaccatctcgaaaacaactcccgcgccgcacgaatccctatcgaatcaacactacaacgacgaacaacgacgaccgaacgactcctccgcaccctccgccctaattccgcgcgactactaaaaaccgtcctcgcccccgcgaaccgctcccaacgctaacaccgcgacgacgaacaacctctccgacgacaccgcgaaccgcgaacaaaaccgcgaatctaaaaccccaacgcgcctaaaaataacgtaaaaccgcatcgatcgaaaaatttcaactctcccaaaaaaatatcaccgacgaactaaacgaaaacctaacacaacccgcgtctccgacttaaatccgccgcccgccgaaacctaaccgtacaatacgaaacccaactaaaaataaacaaaaaaataaaaaaaaaacaaacacaaaaaatcccgactccgctaaacg

SEQ ID NO: 10009 - DNA, 692 bp, Artificial Sequence
  chemically treated genomic DNA (Homo sapiens) CpG-island No: 10009
cgcgttatattagagtagtagttttgatatagcgtatcgaaatcggagtgataaattcgttcgttgtaataattttgtcgttggttttgtcgtgggtagcgttttacgttagttattggcgataatggtgttaaaagaggtttttttgcgttttgttggcgtataaattattttagtttagcggttatttcggttcgtttattttcgtttgaataaagcggcgaatatgttttgtatcgcgttagtaattttataggcgaggcggattttttttattttttttggcgtttgatttgtcgtagtatattcggcgtggcgttaattagtttcgtattgagttagattgttagcggtgcgcggttttttaatttatttgttggtttttaaatcgagcgtttgtaattgtttatcggtaatgatttgattgacgatagtggaagcgtgttcgtcgcgttaagtaaatgtagttggtagttttgcgtacggtttttattttaacgtaatagcgcgaatttattagaatgtgcgtatttttcggttaattattatataatttgattcggtggagatttttagatgcggtttttgttttgtcgtgaggagagaagtattgtatttagttgttgcgttttagttagtcgcgtagcgaagcgagtaatgttatttggatttttttttttacggttatcgat

SEQ ID NO: 10010 - DNA, 692 bp, Artificial Sequence
  chemically treated genomic DNA (Homo sapiens) CpG-island No: 10010
atcgataaccgtaaaaaaaaaaatccaaataacattactcgcttcgctacgcgactaactaaaacgcaacaactaaatacaatacttctctcctcacgacaaaacaaaaaccgcatctaaaaatctccaccgaatcaaattatataataattaaccgaaaaatacgcacattctaataaattcgcgctattacgttaaaataaaaaccgtacgcaaaactaccaactacatttacttaacgcgacgaacacgcttccactatcgtcaatcaaatcattaccgataaacaattacaaacgctcgatttaaaaaccaacaaataaattaaaaaaccgcgcaccgctaacaatctaactcaatacgaaactaattaacgccacgccgaatatactacgacaaatcaaacgccaaaaaaaataaaaaaaatccgcctcgcctataaaattactaacgcgatacaaaacatattcgccgctttattcaaacgaaaataaacgaaccgaaataaccgctaaactaaaataatttatacgccaacaaaacgcaaaaaaacctcttttaacaccattatcgccaataactaacgtaaaacgctacccacgacaaaaccaacgacaaaattattacaacgaacgaatttatcactccgatttcgatacgctatatcaaaactactactctaatataacgcg

SEQ ID NO: 10011 - DNA, 692 bp, Artificial Sequence
  chemically treated genomic DNA (Homo sapiens) CpG-island No: 10011
atcgatagtcgtaagaaggaaaatttagatgatattattcgtttcgttgcgcgattggttaaggcgtaataattggatgtagtgtttttttttttacggtagaataaaagtcgtatttggggatttttatcggattaggttatgtggtgattagtcggaaagtgcgtatattttggtggattcgcgttattacgttgaggtggaagtcgtgcgtaaggttattagttgtatttgtttgacgcgacgaatacgtttttattatcgttaattaaattattgtcgatgaatagttgtaaacgttcggtttgagggttagtaggtgagttgggaaatcgcgtatcgttggtagtttgatttaatgcgaaattggttagcgttacgtcggatgtgttgcggtaaattaaacgttagaggaggtggagaaaattcgtttcgtttgtgggattgttgacgcggtgtagagtatattcgtcgttttatttaggcggggatgagcgagtcgagatagtcgttgaattggagtggtttatgcgttagtagggcgtagaaaagttttttttgatattattgtcgttagtggttggcgtggggcgttgtttacggtaaagttagcgataagattgttgtagcgggcgagtttgttatttcgatttcggtgcgttgtattagggttattgttttgatatgacgcg

SEQ ID NO: 10012 - DNA, 692 bp, Artificial Sequence
  chemically treated genomic DNA (Homo sapiens) CpG-island No: 10012
cgcgtcatatcaaaacaataaccctaatacaacgcaccgaaatcgaaataacaaactcgcccgctacaacaatcttatcgctaactttaccgtaaacaacgccccacgccaaccactaacgacaataatatcaaaaaaaacttttctacgccctactaacgcataaaccactccaattcaacgactatctcgactcgctcatccccgcctaaataaaacgacgaatatactctacaccgcgtcaacaatcccacaaacgaaacgaattttctccacctcctctaacgtttaatttaccgcaacacatccgacgtaacgctaaccaatttcgcattaaatcaaactaccaacgatacgcgatttcccaactcacctactaaccctcaaaccgaacgtttacaactattcatcgacaataatttaattaacgataataaaaacgtattcgtcgcgtcaaacaaatacaactaataaccttacgcacgacttccacctcaacgtaataacgcgaatccaccaaaatatacgcactttccgactaatcaccacataacctaatccgataaaaatccccaaatacgacttttattctaccgtaaaaaaaaaaacactacatccaattattacgccttaaccaatcgcgcaacgaaacgaataatatcatctaaattttccttcttacgactatcgat

SEQ ID NO: 10013 - DNA, 634 bp, Artificial Sequence
  chemically treated genomic DNA (Homo sapiens) CpG-island No: 10013
attttttttcggttggtgcgtgcgtggttatggcgcgttataagtcgtatttgtcgttgagtttatgttgatgacgtcgcgatagcgttaggtattgattttgttgaaattcgtttattaacgtcgttcgcgaaggagatgttaattcgtttacgggtaaacgtattatagcgtagggttgtcggagtgttttgaaaaaggtcggaaaatttttgatgggaaaaacgtcgtgtagaatgttagaattagtaaggtaatttgcgttcggcgttggcgtcgtttgttttagttatatttttaatatttggtttgtcgcgtagaaatagtaggcgcgcgttttttgatgaattaggatggaattataacgtgtaaagcggcgcgacggaaatcggttagggtgtcgatatcgtttttcgtaaatggtggtagaaatcgtgggggtttcggttagcgacgttcgtttattttaatttaagatatcgacgttacgtcgttcgatttcggcgtattgttttacgttagagttatgttgtcgcgtttgcgttgcgtagtgcggtatattattaaaagagaaaattatcgtttacgtcgtagttatgttatattagtagcgatgaatttgattttgataaaa

SEQ ID NO: 10014 - DNA, 634 bp, Artificial Sequence
  chemically treated genomic DNA (Homo sapiens) CpG-island No: 10014
ttttatcaaaatcaaattcatcgctactaatataacataactacgacgtaaacgataattttctcttttaataatataccgcactacgcaacgcaaacgcgacaacataactctaacgtaaaacaatacgccgaaatcgaacgacgtaacgtcgatatcttaaattaaaataaacgaacgtcgctaaccgaaacccccacgatttctaccaccatttacgaaaaacgatatcgacaccctaaccgatttccgtcgcgccgctttacacgttataattccatcctaattcatcaaaaaacgcgcgcctactatttctacgcgacaaaccaaatattaaaaatataactaaaacaaacgacgccaacgccgaacgcaaattaccttactaattctaacattctacacgacgtttttcccatcaaaaattttccgacctttttcaaaacactccgacaaccctacgctataatacgtttacccgtaaacgaattaacatctccttcgcgaacgacgttaataaacgaatttcaacaaaatcaatacctaacgctatcgcgacgtcatcaacataaactcaacgacaaatacgacttataacgcgccataaccacgcacgcaccaaccgaaaaaaaat

SEQ ID NO: 10015 - DNA, 634 bp, Artificial Sequence
  chemically treated genomic DNA (Homo sapiens) CpG-island No: 10015
ttttattagggttagatttatcgttgttgatgtagtatgattgcggcgtgagcgatgatttttttttttaataatgtgtcgtattgcgtagcgtaggcgcggtaatatagttttggcgtgaggtaatgcgtcgggatcgaacggcgtaacgtcggtattttgagttgaaataagcgaacgtcgttgatcggaatttttacggtttttgttattatttgcgagagacggtgtcggtattttgatcgattttcgtcgcgtcgttttgtacgttatggttttattttgatttattagaaggcgcgcgtttgttatttttacgcgataggttaggtgttagaggtgtagttaaaataggcgacgttaacgtcgggcgtaaattgttttgttggttttggtattttgtacggcgttttttttattaaagatttttcggttttttttaagatatttcggtaattttgcgttgtaatacgtttgttcgtgagcggattagtatttttttcgcgggcggcgttggtaaacgaattttaataggattaatatttaacgttgtcgcggcgttattagtatagatttaacggtaaatacgatttgtggcgcgttataattacgtacgtattagtcgaggggaggt

SEQ ID NO: 10016 - DNA, 634 bp, Artificial Sequence
  chemically treated genomic DNA (Homo sapiens) CpG-island No: 10016
acctcccctcgactaatacgtacgtaattataacgcgccacaaatcgtatttaccgttaaatctatactaataacgccgcgacaacgttaaatattaatcctattaaaattcgtttaccaacgccgcccgcgaaaaaaatactaatccgctcacgaacaaacgtattacaacgcaaaattaccgaaatatcttaaaaaaaaccgaaaaatctttaataaaaaaaacgccgtacaaaataccaaaaccaacaaaacaatttacgcccgacgttaacgtcgcctattttaactacacctctaacacctaacctatcgcgtaaaaataacaaacgcgcgccttctaataaatcaaaataaaaccataacgtacaaaacgacgcgacgaaaatcgatcaaaataccgacaccgtctctcgcaaataataacaaaaaccgtaaaaattccgatcaacgacgttcgcttatttcaactcaaaataccgacgttacgccgttcgatcccgacgcattacctcacgccaaaactatattaccgcgcctacgctacgcaatacgacacattattaaaaaaaaaaatcatcgctcacgccgcaatcatactacatcaacaacgataaatctaaccctaataaaa

SEQ ID NO: 10017 - DNA, 518 bp, Artificial Sequence
  chemically treated genomic DNA (Homo sapiens) CpG-island No: 10017
  misc_feature (203)..(203): n is either a, c, g or t
atacgtttgtaattatataattttgtcgattataattaaattcgtcggatggtcggtttgttatttatattatcggtcgttattatgatcgttttattgcgattttcgatttcgtattcgggaattgagggcgatttggcgttgaggcgttatcggtcgcgtcgcgacgttttattgtgttcgacgaaacggtgaatttgttngttaaatataggttgtacgtacgaggttcggcgagttttgaatagagggtgcggttgtagtattaatgaagggttataatcgcgtggcgtaattgattttataaggcgaggtaagaaacggcgggatcgtacgggatagttaaaagaaaagaatattgatatatggcgttgcgagacgttattgtagatcgttaagtgggtagaattttggcgacgattgtcgtaagttaataattatacgtagtgttattgggtataaattatagtttttgcgttacgcgcgaatatttttataacgggcgtcgtttatatata

SEQ ID NO: 10018 - DNA, 518 bp, Artificial Sequence
  chemically treated genomic DNA (Homo sapiens) CpG-island No: 10018
  misc_feature (316)..(316): n is either a, c, g or t
tatatataaacgacgcccgttataaaaatattcgcgcgtaacgcaaaaactataatttatacccaataacactacgtataattattaacttacgacaatcgtcgccaaaattctacccacttaacgatctacaataacgtctcgcaacgccatatatcaatattcttttcttttaactatcccgtacgatcccgccgtttcttacctcgccttataaaatcaattacgccacgcgattataacccttcattaatactacaaccgcaccctctattcaaaactcgccgaacctcgtacgtacaacctatatttaacnaacaaattcaccgtttcgtcgaacacaataaaacgtcgcgacgcgaccgataacgcctcaacgccaaatcgccctcaattcccgaatacgaaatcgaaaatcgcaataaaacgatcataataacgaccgataatataaataacaaaccgaccatccgacgaatttaattataatcgacaaaattatataattacaaacgtat

SEQ ID NO: 10019 - DNA, 518 bp, Artificial Sequence
  chemically treated genomic DNA (Homo sapiens) CpG-island No: 10019
  misc_feature (316)..(316): n is either a, c, g or t
tatatataagcggcgttcgttgtaggaatgttcgcgcgtagcgtaggggttataatttatatttagtggtattacgtgtagttattggtttgcggtaatcgtcgttagggttttgtttatttagcggtttgtagtggcgtttcgtagcgttatgtattaatattttttttttttggttgtttcgtgcggtttcgtcgttttttatttcgttttataggattagttgcgttacgcggttatggttttttattagtgttatagtcgtattttttgtttagggttcgtcgggtttcgtgcgtgtagtttgtgtttggtnggtaaatttatcgtttcgtcgggtataataaggcgtcgcggcgcggtcggtaacgttttagcgttaggtcgtttttaattttcgggtgcggagtcgggggtcgtaataaagcggttatggtagcggtcggtaatgtaaataataggtcggttattcggcgggtttggttgtggtcggtaaagttgtgtagttatagacgtgt

SEQ ID NO: 10020 - DNA, 518 bp, Artificial Sequence
  chemically treated genomic DNA (Homo sapiens) CpG-island No: 10020
  misc_feature (203)..(203): n is either a, c, g or t
acacgtctataactacacaactttaccgaccacaaccaaacccgccgaataaccgacctattatttacattaccgaccgctaccataaccgctttattacgacccccgactccgcacccgaaaattaaaaacgacctaacgctaaaacgttaccgaccgcgccgcgacgccttattatacccgacgaaacgataaatttaccnaccaaacacaaactacacgcacgaaacccgacgaaccctaaacaaaaaatacgactataacactaataaaaaaccataaccgcgtaacgcaactaatcctataaaacgaaataaaaaacgacgaaaccgcacgaaacaaccaaaaaaaaaaaatattaatacataacgctacgaaacgccactacaaaccgctaaataaacaaaaccctaacgacgattaccgcaaaccaataactacacgtaataccactaaatataaattataacccctacgctacgcgcgaacattcctacaacgaacgccgcttatatata

SEQ ID NO: 10021 - DNA, 529 bp, Artificial Sequence
  chemically treated genomic DNA (Homo sapiens) CpG-island No: 10021
  misc_feature (406)..(407): n is either a, c, g or t
  misc_feature (474)..(475): n is either a, c, g or t
  misc_feature (487)..(487): n is either a, c, g or t
  misc_feature (491)..(491): n is either a, c, g or t
cgaagtttatgcgcgtttttatattgttattttgatggtcgcggtataatgtggggggtacggttagtttgcggtatattaatgacgcgttacgagtgatgtatgggtgggtcgttatttatttttaaatagtgtgtgcgggggttacgcgttcggatacggggaatgcgcgtagtcggttgttattgatatttagcgtagatgcgtggagacgtcgcgattattcgcgggcggagcgggtcgttaattcgtaacgggacgtatttgtatttgttagtcggaaaggtttggttgtgcgtttacgtaggtgaagggtagaatagtttgtcgtttggcgggcgttgtatagcgattgtattaaggattatcggttgttttttaattgttttgaagttcgtttttttanntgggaattattttgttagcggcggtaatcgcggtattttaattggtatttgttcgttggtattgggnngtgtttattggngtgncgggcgtttggtataatattttgtgtttggaaataaat

SEQ ID NO: 10022 - DNA, 529 bp, Artificial Sequence
  chemically treated genomic DNA (Homo sapiens) CpG-island No: 10022
  misc_feature (39)..(39): n is either a, c, g or t
  misc_feature (43)..(43): n is either a, c, g or t
  misc_feature (55)..(56): n is either a, c, g or t
  misc_feature (123)..(124): n is either a, c, g or t
atttatttccaaacacaaaatattataccaaacgcccgncacnccaataaacacnncccaataccaacgaacaaataccaattaaaataccgcgattaccgccgctaacaaaataattcccanntaaaaaaacgaacttcaaaacaattaaaaaacaaccgataatccttaatacaatcgctatacaacgcccgccaaacgacaaactattctacccttcacctacgtaaacgcacaaccaaacctttccgactaacaaatacaaatacgtcccgttacgaattaacgacccgctccgcccgcgaataatcgcgacgtctccacgcatctacgctaaatatcaataacaaccgactacgcgcattccccgtatccgaacgcgtaacccccgcacacactatttaaaaataaataacgacccacccatacatcactcgtaacgcgtcattaatataccgcaaactaaccgtaccccccacattataccgcgaccatcaaaataacaatataaaaacgcgcataaacttcg

SEQ ID NO: 10023 - DNA, 529 bp, Artificial Sequence
  chemically treated genomic DNA (Homo sapiens) CpG-island No: 10023
  misc_feature (39)..(39): n is either a, c, g or t
  misc_feature (43)..(43): n is either a, c, g or t
  misc_feature (55)..(56): n is either a, c, g or t
  misc_feature (123)..(124): n is either a, c, g or t
atttgtttttagatatagagtattatattaggcgttcgntatnttagtgggtatnntttagtgttagcgagtaggtgttagttaaggtgtcgcggttatcgtcgttagtaaaatggtttttanntaaagggacggattttagggtagttaaggggtagtcggtagtttttggtgtagtcgttatatagcgttcgttaggcggtaggttattttgttttttatttacgtaggcgtatagttaaattttttcggttagtagatataagtacgtttcgttacgggttggcggttcgtttcgttcgcgggtggtcgcggcgtttttacgtatttgcgttaggtattaatagtagtcggttacgcgtatttttcgtgttcgggcgcgtggttttcgtatatattatttaggggtgggtggcggtttatttatatattattcgtagcgcgttattaatatatcgtaggttaatcgtgttttttatattatgtcgcggttattagaatagtaatataagggcgcgtatgggtttcg

SEQ ID NO: 10024 - DNA, 529 bp, Artificial Sequence
  chemically treated genomic DNA (Homo sapiens) CpG-island No: 10024
  misc_feature (406)..(407): n is either a, c, g or t
  misc_feature (474)..(475): n is either a, c, g or t
  misc_feature (487)..(487): n is either a, c, g or t
  misc_feature (491)..(491): n is either a, c, g or t
cgaaacccatacgcgcccttatattactattctaataaccgcgacataatataaaaaacacgattaacctacgatatattaataacgcgctacgaataatatataaataaaccgccacccacccctaaataatatatacgaaaaccacgcgcccgaacacgaaaaatacgcgtaaccgactactattaatacctaacgcaaatacgtaaaaacgccgcgaccacccgcgaacgaaacgaaccgccaacccgtaacgaaacgtacttatatctactaaccgaaaaaatttaactatacgcctacgtaaataaaaaacaaaataacctaccgcctaacgaacgctatataacgactacaccaaaaactaccgactaccccttaactaccctaaaatccgtccctttanntaaaaaccattttactaacgacgataaccgcgacaccttaactaacacctactcgctaacactaaannatacccactaanatancgaacgcctaatataatactctatatctaaaaacaaat

SEQ ID NO: 10025 - DNA, 887 bp, Artificial Sequence
  chemically treated genomic DNA (Homo sapiens) CpG-island No: 10025
acgtatttttttcgtattgttagttcggtattagagatatcggatttagttatttgcgtagttttagtatcggcgtaaacgtttgttttatcggtatggtaaaatcgtgagcggtaattattattgatttttcgtggtcgtaatcgtatatttaggtcgtatcgcgggaacgcgatggtaaacgatcgtttttgtaaatcgttataatgatgaatggtagtagcgggtaggtaattagtagtaacgtgattatcggttgagaaacggtggtgttagtaggttttagcggtagaggtatagtagtagagagtatcggtagtagttacggcgtagtaatatcgttaattacgtagtaaatcgttagtgttattacgtttacgtttattaggagcggcgtataggtggcgttttcggtttttttggtgcgcggcgcgtcgaggaacgtgacgttatagattttcgttatatatattatcgttagcgtatcggtaattgttagttttatagcgagtagcggttttagtagacgggtaataaacgcgttattattgtttagtttgaaaaatgattgatagataatttatttttcggtaaaattatttagcggcggtagcgtagttattgttattagttcgattaatatggcgatggagataatcggtatttttttgttaatattatcgagtttttcgatatcgcgatgatcggtacggaattagacgtttttcgtttcgaggaatagtacgtttttgaataggttatggttaagtagatggtatagattatcgaattaggttaagagtaattagcgtcggttgttttcgagcgcgatattcgttacgttagcgtttagttttagtaggatgatgtcgatattttttaggtgt

SEQ ID NO: 10026 - DNA, 887 bp, Artificial Sequence
  chemically treated genomic DNA (Homo sapiens) CpG-island No: 10026
acacctaaaaaatatcgacatcatcctactaaaactaaacgctaacgtaacgaatatcgcgctcgaaaacaaccgacgctaattactcttaacctaattcgataatctataccatctacttaaccataacctattcaaaaacgtactattcctcgaaacgaaaaacgtctaattccgtaccgatcatcgcgatatcgaaaaactcgataatattaacaaaaaaataccgattatctccatcgccatattaatcgaactaataacaataactacgctaccgccgctaaataattttaccgaaaaataaattatctatcaatcatttttcaaactaaacaataataacgcgtttattacccgtctactaaaaccgctactcgctataaaactaacaattaccgatacgctaacgataatatatataacgaaaatctataacgtcacgttcctcgacgcgccgcgcaccaaaaaaaccgaaaacgccacctatacgccgctcctaataaacgtaaacgtaataacactaacgatttactacgtaattaacgatattactacgccgtaactactaccgatactctctactactatacctctaccgctaaaacctactaacaccaccgtttctcaaccgataatcacgttactactaattacctacccgctactaccattcatcattataacgatttacaaaaacgatcgtttaccatcgcgttcccgcgatacgacctaaatatacgattacgaccacgaaaaatcaataataattaccgctcacgattttaccataccgataaaacaaacgtttacgccgatactaaaactacgcaaataactaaatccgatatctctaataccgaactaacaatacgaaaaaaatacgt

SEQ ID NO: 10027 - DNA, 887 bp, Artificial Sequence
  chemically treated genomic DNA (Homo sapiens) CpG-island No: 10027
atatttggaaaatatcggtattattttgttggggttgggcgttggcgtaacgggtatcgcgttcgaaaataatcggcgttgattgtttttggtttggttcggtggtttgtattatttgtttaattatagtttgtttaaaagcgtattgtttttcggggcggggagcgtttggtttcgtatcggttatcgcgatatcgaaaaattcggtggtattggtaagaaaatgtcggttatttttatcgttatgttagtcgggttgatggtaatggttgcgttgtcgtcgttgaatggttttgtcggggaatgggttatttattaattattttttaaattgagtaatagtggcgcgtttgttgttcgtttgttggggtcgttgttcgttgtggggttggtaattatcggtgcgttggcggtgatgtgtatggcgaaagtttatggcgttacgtttttcggcgcgtcgcgtattagagaagtcgaaaacgttatttgtgcgtcgtttttgatgagcgtaagcgtagtggtattggcgatttgttgcgtaattggcggtgttgttgcgtcgtggttattgtcgatgttttttgttgttgtatttttgtcgttggagtttgttaatattatcgttttttaatcgatgattacgttgttgttgattgtttgttcgttgttgttatttattattatggcgatttgtaaaggcgatcgtttgttatcgcgttttcgcggtgcggtttgggtgtgcggttacgattacgaaaaattaatggtgattatcgtttacggttttgttatgtcggtgaaataggcgtttgcgtcggtgttgaaattacgtaaatggttgaattcggtgtttttggtgtcgggttggtagtgcgaggggagtgcgt

SEQ ID NO: 10028 - DNA, 887 bp, Artificial Sequence
  chemically treated genomic DNA (Homo sapiens) CpG-island No: 10028
acgcactcccctcgcactaccaacccgacaccaaaaacaccgaattcaaccatttacgtaatttcaacaccgacgcaaacgcctatttcaccgacataacaaaaccgtaaacgataatcaccattaatttttcgtaatcgtaaccgcacacccaaaccgcaccgcgaaaacgcgataacaaacgatcgcctttacaaatcgccataataataaataacaacaacgaacaaacaatcaacaacaacgtaatcatcgattaaaaaacgataatattaacaaactccaacgacaaaaatacaacaacaaaaaacatcgacaataaccacgacgcaacaacaccgccaattacgcaacaaatcgccaataccactacgcttacgctcatcaaaaacgacgcacaaataacgttttcgacttctctaatacgcgacgcgccgaaaaacgtaacgccataaactttcgccatacacatcaccgccaacgcaccgataattaccaaccccacaacgaacaacgaccccaacaaacgaacaacaaacgcgccactattactcaatttaaaaaataattaataaataacccattccccgacaaaaccattcaacgacgacaacgcaaccattaccatcaacccgactaacataacgataaaaataaccgacattttcttaccaataccaccgaatttttcgatatcgcgataaccgatacgaaaccaaacgctccccgccccgaaaaacaatacgcttttaaacaaactataattaaacaaataatacaaaccaccgaaccaaaccaaaaacaatcaacgccgattattttcgaacgcgatacccgttacgccaacgcccaaccccaacaaaataataccgatattttccaaatat

SEQ ID NO: 10029 - DNA, 502 bp, Artificial Sequence
  chemically treated genomic DNA (Homo sapiens) CpG-island No: 10029
gttcggaatttgtttattggtgtagtttggtttcgtttggtatattttgaggatagttttttttgttgatgtgttttcgggcgtgtataataagtattcggtgcgttatcgcgcgtatattttgcgttagttgtgttaggagatggtacgatttgtatgttagtttcgacgtttaagatttattataagcgatgtttcgttagtagagtttttcgttagtggtgatgaatttttaggatgcgtatagcgtttatattcgcggtgacgtggagttggtgcggattcgtgatgtcgaagggcgaattgcggtagaaggggcgttgttttatttatttggcgtgttttgcgtggtattcggggaagtttgggttggggcggtttaacgttatttttttgtattggaagaaggggtgaatttgttgtcgggattttcgtcggagttgtaaggtgtttatagcgaaatcgatgcggatggcgtgaaacggttgtacggttatgtgtt

SEQ ID NO: 10030 - DNA, 502 bp, Artificial Sequence
  chemically treated genomic DNA (Homo sapiens) CpG-island No: 10030
aacacataaccgtacaaccgtttcacgccatccgcatcgatttcgctataaacaccttacaactccgacgaaaatcccgacaacaaattcaccccttcttccaatacaaaaaaataacgttaaaccgccccaacccaaacttccccgaataccacgcaaaacacgccaaataaataaaacaacgccccttctaccgcaattcgcccttcgacatcacgaatccgcaccaactccacgtcaccgcgaatataaacgctatacgcatcctaaaaattcatcaccactaacgaaaaactctactaacgaaacatcgcttataataaatcttaaacgtcgaaactaacatacaaatcgtaccatctcctaacacaactaacgcaaaatatacgcgcgataacgcaccgaatacttattatacacgcccgaaaacacatcaacaaaaaaaactatcctcaaaatataccaaacgaaaccaaactacaccaataaacaaattccgaac

SEQ ID NO: 10031 - DNA, 502 bp, Artificial Sequence
  chemically treated genomic DNA (Homo sapiens) CpG-island No: 10031
aatatataatcgtataatcgttttacgttattcgtatcggtttcgttataaatattttgtagtttcggcgaaaatttcggtaataaatttatttttttttttagtgtaaggaaataacgttgaatcgttttagtttagattttttcgggtattacgtaaagtacgttaggtggataaggtaacgttttttttgtcgtaattcgtttttcggtattacgaattcgtattaattttacgttatcgcgaatataagcgttatgcgtattttgggggtttattattattgacgggaaattttgttggcggaatatcgtttatagtaggttttagacgtcgaaattgatatatagatcgtgttattttttgatataattggcgtagggtgtacgcgcgatagcgtatcggatatttgttatatacgttcggaaatatattaataggggggattatttttaaaatgtgttaaacggggttagattgtattagtgggtagatttcgggt

SEQ ID NO: 10032 - DNA, 502 bp, Artificial Sequence
  chemically treated genomic DNA (Homo sapiens) CpG-island No: 10032
acccgaaatctacccactaatacaatctaaccccgtttaacacattttaaaaataatcccccctattaatatatttccgaacgtatataacaaatatccgatacgctatcgcgcgtacaccctacgccaattatatcaaaaaataacacgatctatatatcaatttcgacgtctaaaacctactataaacgatattccgccaacaaaatttcccgtcaataataataaacccccaaaatacgcataacgcttatattcgcgataacgtaaaattaatacgaattcgtaataccgaaaaacgaattacgacaaaaaaaacgttaccttatccacctaacgtactttacgtaatacccgaaaaaatctaaactaaaacgattcaacgttatttccttacactaaaaaaaaaaataaatttattaccgaaattttcgccgaaactacaaaatatttataacgaaaccgatacgaataacgtaaaacgattatacgattatatatt

SEQ ID NO: 10033 - DNA, 580 bp, Artificial Sequence
  chemically treated genomic DNA (Homo sapiens) CpG-island No: 10033
agtcgcgttgtggggttttgtttaataggcgttggcgacgttttgcgagaattcggaaaatttttattagtttgtagtgcgaaaagtgttgggggataatttgttaatggcgatgggggttatgttggaagaagcgtaattaatggtgacggcggaaagtattagttattagagttatcgtcgattgttttttcgcgttcgtgaatatgtgttggaaaatatgttcgaatcggtgacggtgttggatttgtgtaattaattgtatgttagtcgtcgtacgttataaaacgcgttttacgttattttaggtattggttcgaacgcgtggttgaaacgtattcgtttgaacgtcgtacgtcgcgaattgataagttcgtggtcgtaaagtatgacggtaaaagacgtcgttatgtagtggggattttggtatttggggtaatttgttacggattattagtagttgtttttcgagaagtcgttattgacgttgtattagcggatgcgggagtgggggtgagggagttatatttaatttttgattttaataaatttatttaacgtcgtttttgggttgttattt

SEQ ID NO: 10034 - DNA, 580 bp, Artificial Sequence
  chemically treated genomic DNA (Homo sapiens) CpG-island No: 10034
aaataacaacccaaaaacgacgttaaataaatttattaaaatcaaaaattaaatataactccctcacccccactcccgcatccgctaatacaacgtcaataacgacttctcgaaaaacaactactaataatccgtaacaaattaccccaaataccaaaatccccactacataacgacgtcttttaccgtcatactttacgaccacgaacttatcaattcgcgacgtacgacgttcaaacgaatacgtttcaaccacgcgttcgaaccaatacctaaaataacgtaaaacgcgttttataacgtacgacgactaacatacaattaattacacaaatccaacaccgtcaccgattcgaacatattttccaacacatattcacgaacgcgaaaaaacaatcgacgataactctaataactaatactttccgccgtcaccattaattacgcttcttccaacataacccccatcgccattaacaaattatcccccaacacttttcgcactacaaactaataaaaattttccgaattctcgcaaaacgtcgccaacgcctattaaacaaaaccccacaacgcgact

SEQ ID NO: 10035 - DNA, 580 bp, Artificial Sequence
  chemically treated genomic DNA (Homo sapiens) CpG-island No: 10035
agatggtagtttagaagcggcgttaagtgagtttattaaggttagggattgggtgtaatttttttatttttattttcgtattcgttgatgtagcgttagtgacggtttttcggaaaatagttgttggtaattcgtggtaaattgttttagatgttagaatttttattgtatggcggcgttttttatcgttatattttgcgattacggatttattagttcgcggcgtacggcgtttaggcgaatgcgttttagttacgcgttcgggttaatgtttaaaatagcgtgaaacgcgttttgtagcgtgcggcggttgatatgtagttgattatataaatttagtatcgttatcggttcggatatgttttttagtatatatttacgggcgcgggaaagtaatcgacggtaattttgatgattgatgtttttcgtcgttattattggttgcgttttttttagtatggtttttatcgttattagtaaattattttttagtatttttcgtattgtaggttgatggagatttttcggattttcgtaaaacgtcgttagcgtttgttggataaagttttatagcgcggtt

SEQ ID NO: 10036 - DNA, 580 bp, Artificial Sequence
  chemically treated genomic DNA (Homo sapiens) CpG-island No: 10036
aaccgcgctataaaactttatccaacaaacgctaacgacgttttacgaaaatccgaaaaatctccatcaacctacaatacgaaaaatactaaaaaataatttactaataacgataaaaaccatactaaaaaaaacgcaaccaataataacgacgaaaaacatcaatcatcaaaattaccgtcgattactttcccgcgcccgtaaatatatactaaaaaacatatccgaaccgataacgatactaaatttatataatcaactacatatcaaccgccgcacgctacaaaacgcgtttcacgctattttaaacattaacccgaacgcgtaactaaaacgcattcgcctaaacgccgtacgccgcgaactaataaatccgtaatcgcaaaatataacgataaaaaacgccgccatacaataaaaattctaacatctaaaacaatttaccacgaattaccaacaactattttccgaaaaaccgtcactaacgctacatcaacgaatacgaaaataaaaataaaaaaattacacccaatccctaaccttaataaactcacttaacgccgcttctaaactaccatct

SEQ ID NO: 10037 - DNA, 552 bp, Artificial Sequence
  chemically treated genomic DNA (Homo sapiens) CpG-island No: 10037
ttagagacgtatcgttagtacggtttgtaattaatgtcgcgtttgagagtgatgttgaatgaaaaagaatttgcgtcgtagttttgttattattgtgaagatgtattttgcgcggtggtttgttcggttaacgttattattcgcgtcgatggggtcgtgtagttgaatgaaagtttgtgcgtaagttgtaagttgtgcggtatcgtttgttcgtttggcgtaattgaatttttcggtagtcgttcgttggatatttcggtaaacgttaatatttcgaaagcgttatcggtatcgtttgtttcggcgcgtgttagtatattgtttgattgggtgttaggtattcgcgcgatcgtcgttaaatgtgatttttgtagttttgatgaataaggttcggtttgcgtgcggatgtgttcgattaaagttttgtatttggtggataatatcgatatcgttcgcgttagtaaacgtaagcgtgagttggattttaatacggattttggcgattttattttgttttagtaggtttaaagtggagaggttaaatgagcgtaa

SEQ ID NO: 10038 - DNA, 552 bp, Artificial Sequence
  chemically treated genomic DNA (Homo sapiens) CpG-island No: 10038
ttacgctcatttaacctctccactttaaacctactaaaacaaaataaaatcgccaaaatccgtattaaaatccaactcacgcttacgtttactaacgcgaacgatatcgatattatccaccaaatacaaaactttaatcgaacacatccgcacgcaaaccgaaccttattcatcaaaactacaaaaatcacatttaacgacgatcgcgcgaatacctaacacccaatcaaacaatatactaacacgcgccgaaacaaacgataccgataacgctttcgaaatattaacgtttaccgaaatatccaacgaacgactaccgaaaaattcaattacgccaaacgaacaaacgataccgcacaacttacaacttacgcacaaactttcattcaactacacgaccccatcgacgcgaataataacgttaaccgaacaaaccaccgcgcaaaatacatcttcacaataataacaaaactacgacgcaaattctttttcattcaacatcactctcaaacgcgacattaattacaaaccgtactaacgatacgtctctaa

SEQ ID NO: 10039 - DNA, 552 bp, Artificial Sequence
  chemically treated genomic DNA (Homo sapiens) CpG-island No: 10039
ttgcgtttatttagtttttttattttgagtttgttgaaataaggtgagatcgttaaagttcgtgttaaagtttagtttacgtttacgtttgttgacgcgggcgatatcggtgttatttattagatgtagggttttagtcgggtatattcgtacgtaggtcggattttgtttattaaagttataaaggttatatttgacggcgatcgcgcgaatatttggtatttagttaagtaatgtgttgatacgcgtcggagtaggcggtgtcggtggcgttttcggggtattggcgtttgtcggaatatttagcggacggttgtcggaaaatttaattgcgttaaacgggtaggcgatgtcgtatagtttgtagtttacgtataggtttttatttaattgtacggttttatcgacgcgggtgatggcgttaatcgggtagattatcgcgtagggtgtatttttatagtggtgatagagttgcggcgtagatttttttttatttagtattatttttaggcgcggtattgattgtaggtcgtgttggcgatgcgtttttga

SEQ ID NO: 10040 - DNA, 552 bp, Artificial Sequence
  chemically treated genomic DNA (Homo sapiens) CpG-island No: 10040
tcaaaaacgcatcgccaacacgacctacaatcaataccgcgcctaaaaataatactaaataaaaaaaaatctacgccgcaactctatcaccactataaaaatacaccctacgcgataatctacccgattaacgccatcacccgcgtcgataaaaccgtacaattaaataaaaacctatacgtaaactacaaactatacgacatcgcctacccgtttaacgcaattaaattttccgacaaccgtccgctaaatattccgacaaacgccaataccccgaaaacgccaccgacaccgcctactccgacgcgtatcaacacattacttaactaaataccaaatattcgcgcgatcgccgtcaaatataacctttataactttaataaacaaaatccgacctacgtacgaatatacccgactaaaaccctacatctaataaataacaccgatatcgcccgcgtcaacaaacgtaaacgtaaactaaactttaacacgaactttaacgatctcaccttatttcaacaaactcaaaataaaaaaactaaataaacgcaa

SEQ ID NO: 10041 - DNA, 502 bp, Artificial Sequence
  chemically treated genomic DNA (Homo sapiens) CpG-island No: 10041
ttggacgtcgggttttttatcggattttaaacgcgttatgttaattttatgtagagttcgttttagagatttttttgtattgtttatacggttgcgtagcggtgagttaggacgataaattaggttaatagtgcggcgtggtttcggtttaatgtacggtagataaataattttatcgcgtttgcgtttcggcggtatagttagcgttggtagtaaagtgatttcgttatttgtcgttattatgttgcgtagagtttttaggttggtcgcgcggaagtgtgtatttttattcgtttcggttttaaaatagaaatttattgtttgatcgcgtaaatagtgattattttttagtattagtagttttttttttgttagatcggttatcggtacgtattcgcggttcgtttacgggtgatttttatagatagttagtaatattggtttattaaataacggtattttaatgaatgtttcgtttttttttattagcgcgaggattacg

SEQ ID NO: 10042 - DNA, 502 bp, Artificial Sequence
  chemically treated genomic DNA (Homo sapiens) CpG-island No: 10042
cgtaatcctcgcgctaataaaaaaaaacgaaacattcattaaaataccgttatttaataaaccaatattactaactatctataaaaatcacccgtaaacgaaccgcgaatacgtaccgataaccgatctaacaaaaaaaaaactactaatactaaaaaataatcactatttacgcgatcaaacaataaatttctattttaaaaccgaaacgaataaaaatacacacttccgcgcgaccaacctaaaaactctacgcaacataataacgacaaataacgaaatcactttactaccaacgctaactataccgccgaaacgcaaacgcgataaaattatttatctaccgtacattaaaccgaaaccacgccgcactattaacctaatttatcgtcctaactcaccgctacgcaaccgtataaacaatacaaaaaaatctctaaaacgaactctacataaaattaacataacgcgtttaaaatccgataaaaaacccgacgtccaa

SEQ ID NO: 10043 - DNA, 502 bp, Artificial Sequence
  chemically treated genomic DNA (Homo sapiens) CpG-island No: 10043
cgtgattttcgcgttggtgaaagagagcgaagtatttattgaagtgtcgttgtttgatgagttaatgttgttggttatttatgaagattattcgtgggcgaatcgcgaatgcgtatcgatggtcgatttggtaggggaaaaattgttgatgttggaagatggttattgtttgcgcgattaggtaatgggtttttgttttgaagtcggggcggatgaagatatatattttcgcgcgattagtttggaaattttgcgtaatatggtggcggtaggtagcgggattattttattgttagcgttggttgtgtcgtcggagcgtaaacgcgatggggttgtttatttgtcgtgtattaagtcggaattacgtcgtattattggtttggtttatcgttttggtttatcgttgcgtagtcgtatgagtagtgtaaagggatttttgaagcgagttttgtatgaagttggtatggcgcgtttaaagttcgatgggaaattcggcgtttag

SEQ ID NO: 10044 - DNA, 502 bp, Artificial Sequence
  chemically treated genomic DNA (Homo sapiens) CpG-island No: 10044
ctaaacgccgaatttcccatcgaactttaaacgcgccataccaacttcatacaaaactcgcttcaaaaatccctttacactactcatacgactacgcaacgataaaccaaaacgataaaccaaaccaataatacgacgtaattccgacttaatacacgacaaataaacaaccccatcgcgtttacgctccgacgacacaaccaacgctaacaataaaataatcccgctacctaccgccaccatattacgcaaaatttccaaactaatcgcgcgaaaatatatatcttcatccgccccgacttcaaaacaaaaacccattacctaatcgcgcaaacaataaccatcttccaacatcaacaatttttcccctaccaaatcgaccatcgatacgcattcgcgattcgcccacgaataatcttcataaataaccaacaacattaactcatcaaacaacgacacttcaataaatacttcgctctctttcaccaacgcgaaaatcacg

SEQ ID NO: 10045 - DNA, 588 bp, Artificial Sequence
  chemically treated genomic DNA (Homo sapiens) CpG-island No: 10045
gaaagtcgttagtcgggagtgcgtgcgtttatagaattttttgtcggtggtgaagtgaaaacgtcggagtaattgatattagaataacgttagttttttgaataaatgtaggttgatatgcgttagtagttaacgtagttggttgaagtttcgtggaatgaatagacgtcggaatagcgttagtaaacgttatagcgttaacgttaggcgtagtaattagcggaatagtaacgtttggtttagtagtcgcgtacgattgaataaagttggtagtagtagacgcgtacgtcgtaagtcgtatcggtataggcgtaatcgcgttagtttaaatcggtttttttttagtagtcgtattaggatttgttggaaatttttgcgtatacgattgcgtagtcgaaggtcggagtaagttgcgttaggtgttcgtggcggtgaagcgttaaaaacgaagggggagatataagataacgcggtggatggtgcgcggcggtcgataaagggcggataggtaaaagggagtggttattgggtttaaggttgatcgaaatatttttatgtgggaatgttgtttgttcgaaatagaaagag

SEQ ID NO: 10046 - DNA, 588 bp, Artificial Sequence
  chemically treated genomic DNA (Homo sapiens) CpG-island No: 10046
ctctttctatttcgaacaaacaacattcccacataaaaatatttcgatcaaccttaaacccaataaccactcccttttacctatccgccctttatcgaccgccgcgcaccatccaccgcgttatcttatatctcccccttcgtttttaacgcttcaccgccacgaacacctaacgcaacttactccgaccttcgactacgcaatcgtatacgcaaaaatttccaacaaatcctaatacgactactaaaaaaaaaccgatttaaactaacgcgattacgcctataccgatacgacttacgacgtacgcgtctactactaccaactttattcaatcgtacgcgactactaaaccaaacgttactattccgctaattactacgcctaacgttaacgctataacgtttactaacgctattccgacgtctattcattccacgaaacttcaaccaactacgttaactactaacgcatatcaacctacatttattcaaaaaactaacgttattctaatatcaattactccgacgttttcacttcaccaccgacaaaaaattctataaacgcacgcactcccgactaacgactttc

SEQ ID NO: 10047 - DNA, 588 bp, Artificial Sequence
  chemically treated genomic DNA (Homo sapiens) CpG-island No: 10047
ttttttttatttcgggtaaataatatttttatatgggggtatttcgattaattttgaatttagtggttatttttttttgtttgttcgttttttgtcgatcgtcgcgtattatttatcgcgttgttttgtgttttttttttcgtttttggcgttttatcgttacgagtatttggcgtagtttgtttcggttttcgattgcgtagtcgtgtgcgtaggagtttttagtagattttggtacggttgttgagaagaagtcggtttagattggcgcggttgcgtttgtatcggtgcggtttgcgacgtacgcgtttgttgttgttagttttgtttagtcgtacgcgattgttgagttaggcgttgttgtttcgttaattgttgcgtttgacgttggcgttgtagcgtttgttgacgttgtttcggcgtttgtttattttacggaattttaattagttgcgttggttgttggcgtatattagtttgtatttgtttaagaagttgacgttgttttggtgttagttgtttcggcgtttttattttattatcggtagaaggttttgtgggcgtacgtattttcggttggcgattttt

SEQ ID NO: 10048 - DNA, 588 bp, Artificial Sequence
  chemically treated genomic DNA (Homo sapiens) CpG-island No: 10048
aaaaatcgccaaccgaaaatacgtacgcccacaaaaccttctaccgataataaaataaaaacgccgaaacaactaacaccaaaacaacgtcaacttcttaaacaaatacaaactaatatacgccaacaaccaacgcaactaattaaaattccgtaaaataaacaaacgccgaaacaacgtcaacaaacgctacaacgccaacgtcaaacgcaacaattaacgaaacaacaacgcctaactcaacaatcgcgtacgactaaacaaaactaacaacaacaaacgcgtacgtcgcaaaccgcaccgatacaaacgcaaccgcgccaatctaaaccgacttcttctcaacaaccgtaccaaaatctactaaaaactcctacgcacacgactacgcaatcgaaaaccgaaacaaactacgccaaatactcgtaacgataaaacgccaaaaacgaaaaaaaaaacacaaaacaacgcgataaataatacgcgacgatcgacaaaaaacgaacaaacaaaaaaaaataaccactaaattcaaaattaatcgaaatacccccatataaaaatattatttacccgaaataaaaaaaa

SEQ ID NO: 10049 - DNA, 748 bp, Artificial Sequence
  chemically treated genomic DNA (Homo sapiens) CpG-island No: 10049
ggtcgtcgttggacgtttagtttcgatttttttatcggtttgcgtttcggcgtaatgagtatcgttaataataatgtcggcggcgtagcgttagggaaaagttatcgtagttacggataattggaagtcgagtatcgtatcggacgtaatatgttgttggaaggcgatttgtttttagtttatagtcgcgtttttgtcgatatcggagaaaacggggtgatgatgtcggtgaaaaattcgatgttcggtatcggtttgcgttggaagtcgttgcgcgattagattttttttatcgtcgtcgaatagtagttgtcgttgaacggttaaaatggcgtattcgatattatgttgcgcgttagcgttttattttttaatggcggtaaatatagcgacgaatggtattcgaacggtttaggttggtttgtttaaaatttgtatttcgatgcggcgtaatatattcgttaggatatttaggcgtggacggtagattatcgcgttagttggtattagaaggtagttaacggatagattattgagttttacgtttacgtttaggataacggttatcgtgataaaggtatttagggcgcgtagtttggcggagtcggggttcgttggaatatttggatcggcgagacgtattacgacgtttggtcgtataaagttagtttcggcgtcgagtattaatatatttttaaggcgattaattaacgtaacggagagcgtaataacgcgttttttattattg

SEQ ID NO: 10050 - DNA, 748 bp, Artificial Sequence
  chemically treated genomic DNA (Homo sapiens) CpG-island No: 10050
caataataaaaaacgcgttattacgctctccgttacgttaattaatcgccttaaaaatatattaatactcgacgccgaaactaactttatacgaccaaacgtcgtaatacgtctcgccgatccaaatattccaacgaaccccgactccgccaaactacgcgccctaaatacctttatcacgataaccgttatcctaaacgtaaacgtaaaactcaataatctatccgttaactaccttctaataccaactaacgcgataatctaccgtccacgcctaaatatcctaacgaatatattacgccgcatcgaaatacaaattttaaacaaaccaacctaaaccgttcgaataccattcgtcgctatatttaccgccattaaaaaataaaacgctaacgcgcaacataatatcgaatacgccattttaaccgttcaacgacaactactattcgacgacgataaaaaaaatctaatcgcgcaacgacttccaacgcaaaccgataccgaacatcgaatttttcaccgacatcatcaccccgttttctccgatatcgacaaaaacgcgactataaactaaaaacaaatcgccttccaacaacatattacgtccgatacgatactcgacttccaattatccgtaactacgataacttttccctaacgctacgccgccgacattattattaacgatactcattacgccgaaacgcaaaccgataaaaaaatcgaaactaaacgtccaacgacgacc

SEQ ID NO: 10051 - DNA, 748 bp, Artificial Sequence
  chemically treated genomic DNA (Homo sapiens) CpG-island No: 10051
taatggtgagaaacgcgttgttgcgtttttcgttacgttgattaatcgttttaaaggtatgttgatattcgacgtcgagattgattttgtgcggttaggcgtcgtagtgcgtttcgtcggtttagatattttagcggatttcgatttcgttaagttgcgcgttttgagtgtttttattacgatagtcgttgttttgaacgtgagcgtaaggtttaatagtttgttcgttagttattttttgatgttagttgacgcgataatttgtcgtttacgtttgaatattttggcggatatattgcgtcgtatcgaggtataggttttgggtaaattagtttgaatcgttcgggtgttattcgtcgttgtatttgtcgttattaaagaatgaggcgttggcgcgtagtatggtatcggatgcgttattttggtcgtttagcggtaattgttgttcgacggcgatgaaaaagatttgatcgcgtagcggtttttagcgtagatcggtgtcggatatcggattttttatcggtattattatttcgtttttttcggtatcggtaaagacgcggttataaattgagagtaggtcgttttttagtagtatattgcgttcgatgcggtattcggtttttagttgttcgtagttacgatagtttttttttggcgttgcgtcgtcgatattattgttagcggtatttattgcgtcggaacgtaagtcgatggaagaatcgaaattgaacgtttagcggcgatt

SEQ ID NO: 10052 - DNA, 748 bp, Artificial Sequence
  chemically treated genomic DNA (Homo sapiens) CpG-island No: 10052
aatcgccgctaaacgttcaatttcgattcttccatcgacttacgttccgacgcaataaataccgctaacaataatatcgacgacgcaacgccaaaaaaaaactatcgtaactacgaacaactaaaaaccgaataccgcatcgaacgcaatatactactaaaaaacgacctactctcaatttataaccgcgtctttaccgataccgaaaaaaacgaaataataataccgataaaaaatccgatatccgacaccgatctacgctaaaaaccgctacgcgatcaaatctttttcatcgccgtcgaacaacaattaccgctaaacgaccaaaataacgcatccgataccatactacgcgccaacgcctcattctttaataacgacaaatacaacgacgaataacacccgaacgattcaaactaatttacccaaaacctatacctcgatacgacgcaatatatccgccaaaatattcaaacgtaaacgacaaattatcgcgtcaactaacatcaaaaaataactaacgaacaaactattaaaccttacgctcacgttcaaaacaacgactatcgtaataaaaacactcaaaacgcgcaacttaacgaaatcgaaatccgctaaaatatctaaaccgacgaaacgcactacgacgcctaaccgcacaaaatcaatctcgacgtcgaatatcaacatacctttaaaacgattaatcaacgtaacgaaaaacgcaacaacgcgtttctcaccatta

SEQ ID NO: 10053 - DNA, 1222 bp, Artificial Sequence
  chemically treated genomic DNA (Homo sapiens) CpG-island No: 10053
cggtgtggtagtttagcgcgattgggcgtcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggtaaaagttgttcgttcgatcgattcgtttcgtcgtcgtcgagatagtaggttattgaatagatatcgtcgtagtcgtagagtacggtgaagtgcggatgggtatttttgacggtatggattatgttgcgtaggtgggcgacggagtcgatggtgtttttgatgtcgataatattgttgcgcgagtcggtcgagggtttttattagcgtcggagattagattttgttcggttagcgtcgggaagttatagagtattatcggtagcgtgacgttgtcggttatttgttcgaaatagcggattaggttcgttttcgatattttttagtagtaggggttgattattacgatgtcgttcgcgttcgatttgttgcgcgtgttggttgagttcgatggtttttcgggacgttggtgtcgtcggtgtcgattagtatcggtacgcgacgatcgatatgatcgatagtaaagcgggtaatggttttacgtttttcggcgatcgagttgggagaattcgttatcgttgtttaggaagaataggtcgttaacgtttgttttgattacgatcgtcgattagacgcggcggtgatcggtttatcgagttggacgatcggcggtaataatggtggagataggggaatgattttcgtgaataacgtagattgcggtatgagatttttttgttgaattatatagttta

SEQ ID NO: 10054 - DNA, 1222 bp, Artificial Sequence
  chemically treated genomic DNA (Homo sapiens) CpG-island No: 10054
taaactatataattcaacaaaaaaatctcataccgcaatctacgttattcacgaaaatcattcccctatctccaccattattaccgccgatcgtccaactcgataaaccgatcaccgccgcgtctaatcgacgatcgtaatcaaaacaaacgttaacgacctattcttcctaaacaacgataacgaattctcccaactcgatcgccgaaaaacgtaaaaccattacccgctttactatcgatcatatcgatcgtcgcgtaccgatactaatcgacaccgacgacaccaacgtcccgaaaaaccatcgaactcaaccaacacgcgcaacaaatcgaacgcgaacgacatcgtaataatcaacccctactactaaaaaatatcgaaaacgaacctaatccgctatttcgaacaaataaccgacaacgtcacgctaccgataatactctataacttcccgacgctaaccgaacaaaatctaatctccgacgctaataaaaaccctcgaccgactcgcgcaacaatattatcgacatcaaaaacaccatcgactccgtcgcccacctacgcaacataatccataccgtcaaaaatacccatccgcacttcaccgtactctacgactacgacgatatctattcaataacctactatctcgacgacgacgaaacgaatcgatcgaacgaacaacttttaccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgacgcccaatcgcgctaaactaccacaccg

SEQ ID NO: 10055 - DNA, 1222 bp, Artificial Sequence
  chemically treated genomic DNA (Homo sapiens) CpG-island No: 10055
tagattatatgatttagtaaggagattttatgtcgtagtttgcgttgtttacgggaattatttttttgtttttattattgttatcgtcgatcgtttagttcgataagtcggttatcgtcgcgtttgatcgacgatcgtgattaaagtaggcgttgacggtttgttttttttgggtagcggtggcgagtttttttagttcggtcgtcgaagagcgtaaagttattgttcgttttgttatcgattatgtcgatcgtcgcgtgtcggtgttgatcggtatcggcggtattaacgtttcgggaaattatcgaatttagttagtacgcgtagtaggtcgggcgcggacggtatcgtggtgattaatttttattattggaaagtgtcggaagcgaatttgattcgttatttcgagtaggtggtcgatagcgttacgttgtcggtgatgttttataatttttcggcgttgatcgggtaggatttgattttcggcgttggtgaaaattttcggtcgattcgcgtagtaatattatcggtattaaagatattatcgatttcgtcgtttatttgcgtagtatgatttatatcgttaaaggtgtttattcgtattttatcgtgttttgcggttacgacgatatttgtttaatagtttgttgtttcggcggcgacggggcgaatcggtcgagcgggtaatttttgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacgacgtttaatcgcgttgggttattatatcg

SEQ ID NO: 10056 - DNA, 1222 bp, Artificial Sequence
  chemically treated genomic DNA (Homo sapiens) CpG-island No: 10056
cgatataataacccaacgcgattaaacgtcgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaacaaaaattacccgctcgaccgattcgccccgtcgccgccgaaacaacaaactattaaacaaatatcgtcgtaaccgcaaaacacgataaaatacgaataaacacctttaacgatataaatcatactacgcaaataaacgacgaaatcgataatatctttaataccgataatattactacgcgaatcgaccgaaaattttcaccaacgccgaaaatcaaatcctacccgatcaacgccgaaaaattataaaacatcaccgacaacgtaacgctatcgaccacctactcgaaataacgaatcaaattcgcttccgacactttccaataataaaaattaatcaccacgataccgtccgcgcccgacctactacgcgtactaactaaattcgataatttcccgaaacgttaataccgccgataccgatcaacaccgacacgcgacgatcgacataatcgataacaaaacgaacaataactttacgctcttcgacgaccgaactaaaaaaactcgccaccgctacccaaaaaaaacaaaccgtcaacgcctactttaatcacgatcgtcgatcaaacgcgacgataaccgacttatcgaactaaacgatcgacgataacaataataaaaacaaaaaaataattcccgtaaacaacgcaaactacgacataaaatctccttactaaatcatataatcta

SEQ ID NO: 10057 - DNA, 627 bp, Artificial Sequence
  chemically treated genomic DNA (Homo sapiens) CpG-island No: 10057
tcgttagtaggttttgtaataggcgttagtcgaagaagaaaaagcgtaattttaattggcggcgtttagtttggtataatcggtacgaaattttcgtttatattgggaacgtatcgtagaatatagcgcggcgttggcgtatattcgttagtagattgaagaagtaaatattcgtttatagagtataatggcgtttcgcgcgagtattcgttattacgcggcgaagtagttagtagaattatagtagtagtaataaagtttgaatatttggttataggaatacgatcgttttcgttagtggaataacgaatcggcgggttggcgtgcgtagtttttttaataaattagcgatcgcgagtatttgcggtaatggtagtaatagttaatttatgttgagtaaaaatttaatgcgtttgcggcgattacgttgacgttaatcgtcgatgaggttgttatcgatttggcgtaatatgttgagtaacgtttattgcgttagtatttggtcgcgttgtatggatagattgttttttaataaaacgtttggcgtagttataggtcgttatttagaatgttacgtaagaatagacgtaacgtaacgtcgtatttaacgaaatgcgttagcgttat

SEQ ID NO: 10058 - DNA, 627 bp, Artificial Sequence
  chemically treated genomic DNA (Homo sapiens) CpG-island No: 10058
ataacgctaacgcatttcgttaaatacgacgttacgttacgtctattcttacgtaacattctaaataacgacctataactacgccaaacgttttattaaaaaacaatctatccatacaacgcgaccaaatactaacgcaataaacgttactcaacatattacgccaaatcgataacaacctcatcgacgattaacgtcaacgtaatcgccgcaaacgcattaaatttttactcaacataaattaactattactaccattaccgcaaatactcgcgatcgctaatttattaaaaaaactacgcacgccaacccgccgattcgttattccactaacgaaaacgatcgtattcctataaccaaatattcaaactttattactactactataattctactaactacttcgccgcgtaataacgaatactcgcgcgaaacgccattatactctataaacgaatatttacttcttcaatctactaacgaatatacgccaacgccgcgctatattctacgatacgttcccaatataaacgaaaatttcgtaccgattataccaaactaaacgccgccaattaaaattacgctttttcttcttcgactaacgcctattacaaaacctactaacga

SEQ ID NO: 10059 - DNA, 627 bp, Artificial Sequence
  chemically treated genomic DNA (Homo sapiens) CpG-island No: 10059
ataacgttggcgtatttcgttaagtgcggcgttacgttgcgtttgtttttgcgtgatattttggatagcgatttgtaattgcgttagacgttttgttggggaataatttgtttatgtagcgcgattaggtgttgacgtagtgggcgttgtttagtatgttgcgttaggtcggtagtaattttatcggcggttaacgttaacgtgatcgtcgtaagcgtattaagtttttgtttagtatgggttaattgttgttgttattgtcgtagatgttcgcgatcgttggtttgttgggagaattgcgtacgttaattcgtcggttcgttgttttattgacggaagcggtcgtgtttttgtaattaggtatttaggttttgttgttgttgttgtaattttgttgattgtttcgtcgcgtggtggcgaatgttcgcgcgaagcgttattgtgttttgtaagcgagtatttatttttttaatttgttggcgaatatgcgttagcgtcgcgttgtgttttgcgatgcgtttttagtgtggacgaagatttcgtgtcggttgtgttagattaagcgtcgttagttgaggttgcgttttttttttttcggttaacgtttgttgtaaggtttgttgacgg

SEQ ID NO: 10060 - DNA, 627 bp, Artificial Sequence
  chemically treated genomic DNA (Homo sapiens) CpG-island No: 10060
ccgtcaacaaaccttacaacaaacgttaaccgaaaaaaaaaaaacgcaacctcaactaacgacgcttaatctaacacaaccgacacgaaatcttcgtccacactaaaaacgcatcgcaaaacacaacgcgacgctaacgcatattcgccaacaaattaaaaaaataaatactcgcttacaaaacacaataacgcttcgcgcgaacattcgccaccacgcgacgaaacaatcaacaaaattacaacaacaacaacaaaacctaaatacctaattacaaaaacacgaccgcttccgtcaataaaacaacgaaccgacgaattaacgtacgcaattctcccaacaaaccaacgatcgcgaacatctacgacaataacaacaacaattaacccatactaaacaaaaacttaatacgcttacgacgatcacgttaacgttaaccgccgataaaattactaccgacctaacgcaacatactaaacaacgcccactacgtcaacacctaatcgcgctacataaacaaattattccccaacaaaacgtctaacgcaattacaaatcgctatccaaaatatcacgcaaaaacaaacgcaacgtaacgccgcacttaacgaaatacgccaacgttat

SEQ ID NO: 10061 - DNA, 681 bp, Artificial Sequence
  chemically treated genomic DNA (Homo sapiens) CpG-island No: 10061
gcgtaaagttgcgtaattcgatgttaattacggcgacgttttttagtaatgacggtgtgtgttgttgtgcggtaggcgagagcggatgaattaacgttgtcgttagtaaggtggttttcggtagcgaatttacgatcgtaattttcgtattttttagcgtggcgatttgttgcgagcggtattgcgggttacgtttagtgtttgttatcgtggtaatggtatatagtggttgattatttaaacgcgcggtataggttttttgttaggcgtttattagcgtaggcggtaggatcggcggtcgtatcgaagttaattacgatattaagtagtaatacgcgtatttgcggtttagcgtcgagatcggtaattaattggttgcgtaaggttgggtcgattatcggatggggacgttcgacggtgtagaaattatcgtcgaggttaataatttggtggttatcggcgtttagtattatgttatgttgatgggtatcgtcggtttttacgttaaggtgttcggtaagtaatttcgtcgtttcggtagttagcgtatcgtcggtatataaatcgtaaataaattcgttgttgataggcgttattgcgttacgtcgcgtcgtgacgcgtgaaagtaggtaagttaggcgtgcggttttatttagcgaggaggtaaattagatattttcg

SEQ ID NO: 10062 - DNA, 681 bp, Artificial Sequence
  chemically treated genomic DNA (Homo sapiens) CpG-island No: 10062
cgaaaatatctaatttacctcctcgctaaataaaaccgcacgcctaacttacctactttcacgcgtcacgacgcgacgtaacgcaataacgcctatcaacaacgaatttatttacgatttatataccgacgatacgctaactaccgaaacgacgaaattacttaccgaacaccttaacgtaaaaaccgacgatacccatcaacataacataatactaaacgccgataaccaccaaattattaacctcgacgataatttctacaccgtcgaacgtccccatccgataatcgacccaaccttacgcaaccaattaattaccgatctcgacgctaaaccgcaaatacgcgtattactacttaatatcgtaattaacttcgatacgaccgccgatcctaccgcctacgctaataaacgcctaacaaaaaacctataccgcgcgtttaaataatcaaccactatataccattaccacgataacaaacactaaacgtaacccgcaataccgctcgcaacaaatcgccacgctaaaaaatacgaaaattacgatcgtaaattcgctaccgaaaaccaccttactaacgacaacgttaattcatccgctctcgcctaccgcacaacaacacacaccgtcattactaaaaaacgtcgccgtaattaacatcgaattacgcaactttacgc

SEQ ID NO: 10063 - DNA, 681 bp, Artificial Sequence
  chemically treated genomic DNA (Homo sapiens) CpG-island No: 10063
cgagaatgtttggtttgttttttcgttggatgaggtcgtacgtttggtttgtttgtttttacgcgttacggcgcgacgtaacgtaatagcgtttgttagtagcggatttatttgcggtttgtatatcggcggtacgttggttgtcgaagcggcgggattatttgtcggatattttggcgtggaagtcgacgatatttattaatatggtatgatgttggacgtcgatagttattagattattgatttcggcgatgatttttatatcgtcgggcgtttttattcgatgatcgatttaattttacgtaattagttaattgtcgatttcggcgttaaatcgtaagtgcgcgtgttgttgtttgatgtcgtgattggtttcggtgcgatcgtcgattttgtcgtttacgttggtgagcgtttggtaaaaagtttgtgtcgcgcgtttagataattaattattgtatgttattgttacggtgataggtattgaacgtgattcgtaatgtcgttcgtagtaaatcgttacgttggaagatgcggggattgcggtcgtgagttcgttatcggaagttattttgttggcggtagcgttaatttattcgttttcgtttgtcgtatagtaatatatatcgttattattggaaaacgtcgtcgtgattaatatcggattacgtagttttgcgt

SEQ ID NO: 10064 - DNA, 681 bp, Artificial Sequence
  chemically treated genomic DNA (Homo sapiens) CpG-island No: 10064
acgcaaaactacgtaatccgatattaatcacgacgacgttttccaataataacgatatatattactatacgacaaacgaaaacgaataaattaacgctaccgccaacaaaataacttccgataacgaactcacgaccgcaatccccgcatcttccaacgtaacgatttactacgaacgacattacgaatcacgttcaatacctatcaccgtaacaataacatacaataattaattatctaaacgcgcgacacaaactttttaccaaacgctcaccaacgtaaacgacaaaatcgacgatcgcaccgaaaccaatcacgacatcaaacaacaacacgcgcacttacgatttaacgccgaaatcgacaattaactaattacgtaaaattaaatcgatcatcgaataaaaacgcccgacgatataaaaatcatcgccgaaatcaataatctaataactatcgacgtccaacatcataccatattaataaatatcgtcgacttccacgccaaaatatccgacaaataatcccgccgcttcgacaaccaacgtaccgccgatatacaaaccgcaaataaatccgctactaacaaacgctattacgttacgtcgcgccgtaacgcgtaaaaacaaacaaaccaaacgtacgacctcatccaacgaaaaaacaaaccaaacattctcg

SEQ ID NO: 10065 - DNA, 673 bp, Artificial Sequence
  chemically treated genomic DNA (Homo sapiens) CpG-island No: 10065
cgtgttgcgcgtgcgtaaaggggaagaaattttaattttaagttatatgttgtcgaagttgtatgaagaagcgatggcgttgtcgtttgaagaagagttcgttgaacgtaagcgttcggaataatttgcgttggtaatttttgttatgtcggatgtgtcgtttgcgttaacgttagttgaatttgtcgcgtttgttgtagttttagtatcgaaagttgtatcggtaatattagtagtttttgtataatttgggttgttgagtcgttttttcggcgtattgaaagcgttgtttagcggtggtgaagaaattaaatcgatcgagtaattagtatcgaaagtagaagcgaaatcggaacgttaataggatcgtcgtaagtttcgttagaataatcgtcgtgatcgtaatgagcgcgcgatattcgtagtgaacgtattgaaggtagcgataatcgcgaagaaaatcgtcgtaattcgtcgttaggtatagtagtagattgtcgagacgcgtagagtcgttagtaggttgaggtacggaaaaagcgcgtatcgtcgacgagtagtaagcgtcgcgtcgtgaacgtagtcgtcgtcgtaatgatataaacgttaggcgtaataagaagcgaaggcgttgaatgttgaagagtaatttgtttaggaaatcgaataggaa

SEQ ID NO: 10066 - DNA, 673 bp, Artificial Sequence
  chemically treated genomic DNA (Homo sapiens) CpG-island No: 10066
ttcctattcgatttcctaaacaaattactcttcaacattcaacgccttcgcttcttattacgcctaacgtttatatcattacgacgacgactacgttcacgacgcgacgcttactactcgtcgacgatacgcgctttttccgtacctcaacctactaacgactctacgcgtctcgacaatctactactatacctaacgacgaattacgacgattttcttcgcgattatcgctaccttcaatacgttcactacgaatatcgcgcgctcattacgatcacgacgattattctaacgaaacttacgacgatcctattaacgttccgatttcgcttctactttcgatactaattactcgatcgatttaatttcttcaccaccgctaaacaacgctttcaatacgccgaaaaaacgactcaacaacccaaattatacaaaaactactaatattaccgatacaactttcgatactaaaactacaacaaacgcgacaaattcaactaacgttaacgcaaacgacacatccgacataacaaaaattaccaacgcaaattattccgaacgcttacgttcaacgaactcttcttcaaacgacaacgccatcgcttcttcatacaacttcgacaacatataacttaaaattaaaatttcttcccctttacgcacgcgcaacacg

SEQ ID NO: 10067 - DNA, 673 bp, Artificial Sequence
  chemically treated genomic DNA (Homo sapiens) CpG-island No: 10067
tttttgttcggttttttgaatagattgttttttaatatttagcgttttcgttttttgttgcgtttgacgtttatattattacggcggcggttacgtttacgacgcggcgtttgttgttcgtcggcggtacgcgtttttttcgtattttagtttgttgacggttttacgcgtttcggtagtttgttgttgtgtttggcgacgagttacgacggtttttttcgcgattatcgttgtttttagtacgtttattacgggtgtcgcgcgtttattacggttacggcggttgttttgacgaggtttgcgacgattttgttgacgtttcggtttcgtttttgttttcggtgttggttgttcggtcggtttggtttttttattatcgttgaatagcgtttttagtgcgtcgaagaagcggtttaatagtttaggttgtgtaggagttgttggtgttgtcggtgtagttttcggtgttggagttataataggcgcggtaggtttagttggcgttggcgtaggcggtatattcggtatggtaaaggttgttagcgtaggttgtttcggacgtttacgtttagcgaatttttttttagacggtagcgttatcgtttttttatgtagtttcggtagtatgtagtttaaggttggggtttttttttttttacgtacgcgtagtacg

SEQ ID NO: 10068 - DNA, 673 bp, Artificial Sequence
  chemically treated genomic DNA (Homo sapiens) CpG-island No: 10068
cgtactacgcgtacgtaaaaaaaaaaaaaccccaaccttaaactacatactaccgaaactacataaaaaaacgataacgctaccgtctaaaaaaaaattcgctaaacgtaaacgtccgaaacaacctacgctaacaacctttaccataccgaatataccgcctacgccaacgccaactaaacctaccgcgcctattataactccaacaccgaaaactacaccgacaacaccaacaactcctacacaacctaaactattaaaccgcttcttcgacgcactaaaaacgctattcaacgataataaaaaaaccaaaccgaccgaacaaccaacaccgaaaacaaaaacgaaaccgaaacgtcaacaaaatcgtcgcaaacctcgtcaaaacaaccgccgtaaccgtaataaacgcgcgacacccgtaataaacgtactaaaaacaacgataatcgcgaaaaaaaccgtcgtaactcgtcgccaaacacaacaacaaactaccgaaacgcgtaaaaccgtcaacaaactaaaatacgaaaaaaacgcgtaccgccgacgaacaacaaacgccgcgtcgtaaacgtaaccgccgccgtaataatataaacgtcaaacgcaacaaaaaacgaaaacgctaaatattaaaaaacaatctattcaaaaaaccgaacaaaaa

SEQ ID NO: 10069 - DNA, 933 bp, Artificial Sequence
  chemically treated genomic DNA (Homo sapiens) CpG-island No: 10069
atcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttattattcgttgggtcgtagggtggtaaaacgggtgtggcggcgtgaacgggatttgacgggttggatgtcgttgttacggaaatcgtaagtgatttgggtacggttgggacggcgatcggttgattacgatatagaacgataggagtcgtatttagacgatttattagtcggggagttttacgttatttattagggtcggaattgtaacggtgagcggcgaaaacgcgcgtcgagtttggtggagttttttatagttcggggcgaaacggggcgcgtgtgtatcgcgggttgtgtaatgtcgatcgttgaacggaatttgtgacggtgatagaagcgtaggtggattgcgcgatcgggtatttaataggtcggaaagggaaaatcggtcgtaacgttcggattaagaggaaggcgtaaaaggatttaaagacgaaattcggaaagggttaaaagg

SEQ ID NO: 10070 - DNA, 933 bp, Artificial Sequence
  chemically treated genomic DNA (Homo sapiens) CpG-island No: 10070
ccttttaaccctttccgaatttcgtctttaaatccttttacgccttcctcttaatccgaacgttacgaccgattttccctttccgacctattaaatacccgatcgcgcaatccacctacgcttctatcaccgtcacaaattccgttcaacgatcgacattacacaacccgcgatacacacgcgccccgtttcgccccgaactataaaaaactccaccaaactcgacgcgcgttttcgccgctcaccgttacaattccgaccctaataaataacgtaaaactccccgactaataaatcgtctaaatacgactcctatcgttctatatcgtaatcaaccgatcgccgtcccaaccgtacccaaatcacttacgatttccgtaacaacgacatccaacccgtcaaatcccgttcacgccgccacacccgttttaccaccctacgacccaacgaataataaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgat

SEQ ID NO: 10071 - DNA, 933 bp, Artificial Sequence
  chemically treated genomic DNA (Homo sapiens) CpG-island No: 10071
ttttttggtttttttcgggtttcgtttttaggtttttttgcgttttttttttggttcgggcgttacggtcggtttttttttttcggtttgttaggtgttcggtcgcgtaatttatttgcgtttttattatcgttataggtttcgtttagcggtcgatattgtatagttcgcggtatatacgcgtttcgtttcgtttcggattgtgaagggttttattaggttcggcgcgcgttttcgtcgtttatcgttgtagtttcgattttgatgagtggcgtgaagtttttcggttgataaatcgtttggatgcggtttttgtcgttttgtatcgtggttagtcggtcgtcgttttagtcgtatttaggttatttgcggttttcgtgatagcgatatttagttcgttaggtttcgtttacgtcgttatattcgttttgttattttgcggtttagcgggtggtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggt

SEQ ID NO: 10072 - DNA, 933 bp, Artificial Sequence
  chemically treated genomic DNA (Homo sapiens) CpG-island No: 10072
accgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttaccacccgctaaaccgcaaaataacaaaacgaatataacgacgtaaacgaaacctaacgaactaaatatcgctatcacgaaaaccgcaaataacctaaatacgactaaaacgacgaccgactaaccacgatacaaaacgacaaaaaccgcatccaaacgatttatcaaccgaaaaacttcacgccactcatcaaaatcgaaactacaacgataaacgacgaaaacgcgcgccgaacctaataaaacccttcacaatccgaaacgaaacgaaacgcgtatataccgcgaactatacaatatcgaccgctaaacgaaacctataacgataataaaaacgcaaataaattacgcgaccgaacacctaacaaaccgaaaaaaaaaaaccgaccgtaacgcccgaaccaaaaaaaaaacgcaaaaaaacctaaaaacgaaacccgaaaaaaaccaaaaaa

SEQ ID NO: 10073 - DNA, 758 bp, Artificial Sequence
  chemically treated genomic DNA (Homo sapiens) CpG-island No: 10073
tgcggttttaacggcggcgaaatgacgttgtcgttggcggatcgttggattttggcggagtttaattagattattaaagcgtatcgcgaagcgttggatagttttcgtttcgatatcgtcgtaggtattttgtatgagtttatttggaattagttttgtgattggtatttcgagttgattaagtcggtaatgaacggtggtatcgaagtagaattgcgcggtattcgttatacgttggtgattgtattggaaggtttgttgcgtttcgcgtattcgattatttcgtttattatcgaaattatttggtagcgtgtgaaagtattttgcggtattattgtcgatattattatgttgtagtcgttttcgtagtacgatgtattttaggttgatgaagtcgtattggtcgatatcgaatggttgaaataggcgatcgttgcggtacgtaatattcgtgtaggaaatgaatatcgcgtcgggtaatcgttggagttgttgttgcgtggttgtagcgcggatgtagaacgtcgcgtaaatgaaaatcgtggttttttgtaaattttggcgcgtttggaaagtattatcgtgttgtttgtcgatgataaaggttcggttttcgttacgaagattatcgacggtgtagagttgttgatttcgatggttggttttattaataaagaagatgagttggcgcgtttggcgaaagaagtggcgaagattgaaggtgaaattagtcgtatcgagaataaattggcgaacga

SEQ ID NO: 10074 - DNA, 758 bp, Artificial Sequence
  chemically treated genomic DNA (Homo sapiens) CpG-island No: 10074
tcgttcgccaatttattctcgatacgactaatttcaccttcaatcttcgccacttctttcgccaaacgcgccaactcatcttctttattaataaaaccaaccatcgaaatcaacaactctacaccgtcgataatcttcgtaacgaaaaccgaacctttatcatcgacaaacaacacgataatactttccaaacgcgccaaaatttacaaaaaaccacgattttcatttacgcgacgttctacatccgcgctacaaccacgcaacaacaactccaacgattacccgacgcgatattcatttcctacacgaatattacgtaccgcaacgatcgcctatttcaaccattcgatatcgaccaatacgacttcatcaacctaaaatacatcgtactacgaaaacgactacaacataataatatcgacaataataccgcaaaatactttcacacgctaccaaataatttcgataataaacgaaataatcgaatacgcgaaacgcaacaaaccttccaatacaatcaccaacgtataacgaataccgcgcaattctacttcgataccaccgttcattaccgacttaatcaactcgaaataccaatcacaaaactaattccaaataaactcatacaaaatacctacgacgatatcgaaacgaaaactatccaacgcttcgcgatacgctttaataatctaattaaactccgccaaaatccaacgatccgccaacgacaacgtcatttcgccgccgttaaaaccgca

SEQ ID NO: 10075 - DNA, 758 bp, Artificial Sequence
  chemically treated genomic DNA (Homo sapiens) CpG-island No: 10075
tcgttcgttagtttgttttcgatacggttgattttatttttaattttcgttatttttttcgttagacgcgttagtttattttttttgttgatgaggttagttatcgggattagtagttttgtatcgtcgatgattttcgtaacggaaatcggatttttgttatcggtaggtagtacggtgatattttttagacgcgttagggtttgtaggaagttacggtttttatttacgcgacgttttgtattcgcgttgtaattacgtagtagtagttttagcggttgttcggcgcgatgtttattttttgtacggatgttacgtatcgtaacgatcgtttgttttagttattcggtgtcggttagtgcggttttattaatttgagatgtatcgtattgcgggaacggttgtagtatgatggtgtcggtagtgatatcgtaaagtatttttatacgttgttagatggtttcggtgatgaacggaatgatcggatgcgcgaggcgtagtagattttttagtatagttattagcgtatggcgagtatcgcgtagttttgtttcggtgttatcgtttattatcggtttggttagttcgagatattagttatagaattggttttaggtgaatttatatagaatgtttgcggcgatatcgaagcggaagttgtttagcgtttcgcggtacgttttgatggtttggttgaatttcgttagaatttagcggttcgttagcgatagcgttatttcgtcgtcgttgaagtcgta

SEQ ID NO: 10076 - DNA, 758 bp, Artificial Sequence
  chemically treated genomic DNA (Homo sapiens) CpG-island No: 10076
tacgacttcaacgacgacgaaataacgctatcgctaacgaaccgctaaattctaacgaaattcaaccaaaccatcaaaacgtaccgcgaaacgctaaacaacttccgcttcgatatcgccgcaaacattctatataaattcacctaaaaccaattctataactaatatctcgaactaaccaaaccgataataaacgataacaccgaaacaaaactacgcgatactcgccatacgctaataactatactaaaaaatctactacgcctcgcgcatccgatcattccgttcatcaccgaaaccatctaacaacgtataaaaatactttacgatatcactaccgacaccatcatactacaaccgttcccgcaatacgatacatctcaaattaataaaaccgcactaaccgacaccgaataactaaaacaaacgatcgttacgatacgtaacatccgtacaaaaaataaacatcgcgccgaacaaccgctaaaactactactacgtaattacaacgcgaatacaaaacgtcgcgtaaataaaaaccgtaacttcctacaaaccctaacgcgtctaaaaaatatcaccgtactacctaccgataacaaaaatccgatttccgttacgaaaatcatcgacgatacaaaactactaatcccgataactaacctcatcaacaaaaaaaataaactaacgcgtctaacgaaaaaaataacgaaaattaaaaataaaatcaaccgtatcgaaaacaaactaacgaacga

SEQ ID NO: 10077 - DNA, 795 bp, Artificial Sequence
  chemically treated genomic DNA (Homo sapiens) CpG-island No: 10077
tttagtcggttggttgtgcgttagtacggatatttagtgttggcgggtcgcggtatttgcgtgtatttagtgttttatagtgaatttaattatgtcggcgcgcgttaggttgacggagtatttcgtcgggttgtttttatcgttacggtggttaagggtgcgtacgtatagtagcggcgatatattcgggattttaagacgttggtattttttggtttgggcgcggcgggcgttgattcgcgtttggttgcggcgtagcgtaatttcggtttgttcgcgtagaaaatcgtgtagcgagtcgttgtcgaagcgttgtagcgtcggttagagggtgaggttcgcgaagtagtggtcgattaaatagagcgcgacgtcgttgatacgacgtagggtgcgtaggtggatgacgttttttttttcggtaatttttagtgcgttagcgacgtggtcggacgcggggcgtaatatcgaaagtagtttttcgttggtgggatggttgttttgatttagtagattttggttaaaacgcgtttgggcgttgagcgggtaatcgaacgggcgtattagtattagtacgtcgacgttttgacggcgttgtatttagtttttttttattagttggtcgatggcgcggcgtagggtgtggcgatttattttaaagcgcgttgttagttgttgttcggcgggaagatagtcgtcgtagcggtagtgttgacgaagtttttgtttaagttttgcggttattttttgatagcgtgtagggtagttggtcggatgtgtagataagtgtataga

SEQ ID NO: 10078 - DNA, 795 bp, Artificial Sequence
  chemically treated genomic DNA (Homo sapiens) CpG-island No: 10078
tctatacacttatctacacatccgaccaactaccctacacgctatcaaaaaataaccgcaaaacttaaacaaaaacttcgtcaacactaccgctacgacgactatcttcccgccgaacaacaactaacaacgcgctttaaaataaatcgccacaccctacgccgcgccatcgaccaactaataaaaaaaaactaaatacaacgccgtcaaaacgtcgacgtactaatactaatacgcccgttcgattacccgctcaacgcccaaacgcgttttaaccaaaatctactaaatcaaaacaaccatcccaccaacgaaaaactactttcgatattacgccccgcgtccgaccacgtcgctaacgcactaaaaattaccgaaaaaaaaaacgtcatccacctacgcaccctacgtcgtatcaacgacgtcgcgctctatttaatcgaccactacttcgcgaacctcaccctctaaccgacgctacaacgcttcgacaacgactcgctacacgattttctacgcgaacaaaccgaaattacgctacgccgcaaccaaacgcgaatcaacgcccgccgcgcccaaaccaaaaaataccaacgtcttaaaatcccgaatatatcgccgctactatacgtacgcacccttaaccaccgtaacgataaaaacaacccgacgaaatactccgtcaacctaacgcgcgccgacataattaaattcactataaaacactaaatacacgcaaataccgcgacccgccaacactaaatatccgtactaacgcacaaccaaccgactaaa

SEQ ID NO: 10079 - DNA, 795 bp, Artificial Sequence
  chemically treated genomic DNA (Homo sapiens) CpG-island No: 10079
tttatgtatttgtttatatattcgattagttattttatacgttattaagagatagtcgtaaaatttgagtaggagtttcgttaatattatcgttgcggcgattattttttcgtcgagtagtaattggtagcgcgttttgaggtgaatcgttatattttgcgtcgcgttatcgattaattggtggaaaaaggttgggtatagcgtcgttagggcgtcggcgtgttggtgttgatgcgttcgttcgattattcgtttaacgtttaggcgcgttttagttagaatttgttggattagggtagttattttattagcgaaaaattgttttcggtattgcgtttcgcgttcggttacgtcgttgacgtattggggattatcgagggggagaacgttatttatttgcgtattttgcgtcgtgttaacggcgtcgcgttttgtttaatcgattattatttcgcggattttattttttggtcgacgttgtaacgtttcgatagcggttcgttgtacgattttttgcgcgagtaaatcggaattgcgttgcgtcgtagttagacgcggattagcgttcgtcgcgtttaggttaaagagtgttagcgttttgaaatttcgaatatgtcgtcgttgttgtgcgtgcgtatttttaattatcgtgacggtgaaagtagttcggcggagtatttcgttagtttgacgcgcgtcgatatgattgaatttattatggagtattgaatgtacgtagatatcgcgattcgttagtattggatgttcgtgttggcgtatagttaatcggttgaa

SEQ ID NO: 10080 - DNA, 795 bp, Artificial Sequence
  chemically treated genomic DNA (Homo sapiens) CpG-island No: 10080
ttcaaccgattaactatacgccaacacgaacatccaatactaacgaatcgcgatatctacgtacattcaatactccataataaattcaatcatatcgacgcgcgtcaaactaacgaaatactccgccgaactactttcaccgtcacgataattaaaaatacgcacgcacaacaacgacgacatattcgaaatttcaaaacgctaacactctttaacctaaacgcgacgaacgctaatccgcgtctaactacgacgcaacgcaattccgatttactcgcgcaaaaaatcgtacaacgaaccgctatcgaaacgttacaacgtcgaccaaaaaataaaatccgcgaaataataatcgattaaacaaaacgcgacgccgttaacacgacgcaaaatacgcaaataaataacgttctccccctcgataatccccaatacgtcaacgacgtaaccgaacgcgaaacgcaataccgaaaacaatttttcgctaataaaataactaccctaatccaacaaattctaactaaaacgcgcctaaacgttaaacgaataatcgaacgaacgcatcaacaccaacacgccgacgccctaacgacgctatacccaacctttttccaccaattaatcgataacgcgacgcaaaatataacgattcacctcaaaacgcgctaccaattactactcgacgaaaaaataatcgccgcaacgataatattaacgaaactcctactcaaattttacgactatctcttaataacgtataaaataactaatcgaatatataaacaaatacataaa

SEQ ID NO: 10081 - DNA, 576 bp, Artificial Sequence
  chemically treated genomic DNA (Homo sapiens) CpG-island No: 10081
ttagatgtttgatgcgacgtttgcgcgttttattaggtttataaattttcgtatttttcgtaggtcggataaggcgtttacgtcgtattcggcgatattagtttacgtcgttaatagattagttatcgtgcgtatattaagtttcgtagcgttcgtagattattgtttaatcggcgttttacggtaagtcgtcgagtagtcgatatgtagttagttttgttgatagtttttaataaagtgcgataggaagttcgtcgtcgtgttcgcgtttgtcggatacgtcgcgttttcggtattgtttagttcggtaaagttagacggtagttggttgcggtggaatttcgttagcggtagacgttagaacggttcgtttttttgcgcggtattcgttagtaagcgatcggttagcgtatcgttaaaattgaatagcgcgtgataattattatttagcgtagttttcgtcgtttcggtgagggtcgtcgtattaatgattattttcggtttttgcgtattggtattaattagattatcggtaagtattagacgtttttcggtattagtgtttattattttaat

SEQ ID NO: 10082 - DNA, 576 bp, Artificial Sequence
  chemically treated genomic DNA (Homo sapiens) CpG-island No: 10082
attaaaataataaacactaataccgaaaaacgtctaatacttaccgataatctaattaataccaatacgcaaaaaccgaaaataatcattaatacgacgaccctcaccgaaacgacgaaaactacgctaaataataattatcacgcgctattcaattttaacgatacgctaaccgatcgcttactaacgaataccgcgcaaaaaaacgaaccgttctaacgtctaccgctaacgaaattccaccgcaaccaactaccgtctaactttaccgaactaaacaataccgaaaacgcgacgtatccgacaaacgcgaacacgacgacgaacttcctatcgcactttattaaaaactatcaacaaaactaactacatatcgactactcgacgacttaccgtaaaacgccgattaaacaataatctacgaacgctacgaaacttaatatacgcacgataactaatctattaacgacgtaaactaatatcgccgaatacgacgtaaacgccttatccgacctacgaaaaatacgaaaatttataaacctaataaaacgcgcaaacgtcgcatcaaacatctaa

SEQ ID NO: 10083 - DNA, 576 bp, Artificial Sequence
  chemically treated genomic DNA (Homo sapiens) CpG-island No: 10083
gttgaagtgatgaatattgatgtcgaagggcgtttggtgtttgtcgatggtttgattgatgttagtgcgtagaaatcggaaatgattattgatgcggcgatttttatcggggcggcgaaaattgcgttgggtaatgattattacgcgttgtttagttttgacgatgcgttggtcggtcgtttgttggcgagtgtcgcgtaggagaacgaatcgttttggcgtttgtcgttggcggagttttatcgtagttagttgtcgtttaattttgtcgaattgaataatatcggaagcgcggcgtattcggtaggcgcgagtacggcggcgggttttttgtcgtattttgttgagaattattagtaaggttggttgtatatcgattgttcggcgatttatcgtaaagcgtcggttgaatagtggtttgcgggcgttacgggatttggtgtgcgtacgatagttaatttgttaacggcgtaaattaatatcgtcggatgcggcgtaaacgttttattcggtttacggagggtgcgggaatttgtaggtttgataagacgcgtaagcgtcgtattaggtatttgg

SEQ ID NO: 10084 - DNA, 576 bp, Artificial Sequence
  chemically treated genomic DNA (Homo sapiens) CpG-island No: 10084
ccaaatacctaatacgacgcttacgcgtcttatcaaacctacaaattcccgcaccctccgtaaaccgaataaaacgtttacgccgcatccgacgatattaatttacgccgttaacaaattaactatcgtacgcacaccaaatcccgtaacgcccgcaaaccactattcaaccgacgctttacgataaatcgccgaacaatcgatatacaaccaaccttactaataattctcaacaaaatacgacaaaaaacccgccgccgtactcgcgcctaccgaatacgccgcgcttccgatattattcaattcgacaaaattaaacgacaactaactacgataaaactccgccaacgacaaacgccaaaacgattcgttctcctacgcgacactcgccaacaaacgaccgaccaacgcatcgtcaaaactaaacaacgcgtaataatcattacccaacgcaattttcgccgccccgataaaaatcgccgcatcaataatcatttccgatttctacgcactaacatcaatcaaaccatcgacaaacaccaaacgcccttcgacatcaatattcatcacttcaac

SEQ ID NO: 10085 - DNA, 646 bp, Artificial Sequence
  chemically treated genomic DNA (Homo sapiens) CpG-island No: 10085
gggagagcgcgtattgtcgggtgtggagcgggttgaggtgattaagatagggggaaaggtatcggtttcgtacggtcggttacggaatttttttcgcgggaagatcgtttatatgttacgttatttcgtgtcggaattaatttgcgagggaaagtcggttatcggacgttttggaggtaggattttcgtcggaagggcgggcgttttttgtagttcgagttaattttcggttggtgcggtgttcggtttgttaggttggcgcggttgacgggatttcgtggagatggtttgcgcggtcgcgcggttttcggtcgattaggataggtgggttttcgggaaggttggtcgtggtattattgggttcggggttttttttatcggaatttcggtatttcgtagttttcgagtttcgatcgtatttcggtcgcggggcggcgcggcgcgggttggtgcggtgagaatcggattcgattcgatcggattttagcgaatagttacgtcgcgagaagcgcgttttatattcgtgttgcgattagagaggttcgttcggtgttttttgagtttttttttttcgtgtaagagcgcgttttaggttcggggacgttggataagttgttgtgttaaaataatagttgtattattgttt

SEQ ID NO: 10086 - DNA, 646 bp, Artificial Sequence
  chemically treated genomic DNA (Homo sapiens) CpG-island No: 10086
aaacaataatacaactattattttaacacaacaacttatccaacgtccccgaacctaaaacgcgctcttacacgaaaaaaaaaaactcaaaaaacaccgaacgaacctctctaatcgcaacacgaatataaaacgcgcttctcgcgacgtaactattcgctaaaatccgatcgaatcgaatccgattctcaccgcaccaacccgcgccgcgccgccccgcgaccgaaatacgatcgaaactcgaaaactacgaaataccgaaattccgataaaaaaaaccccgaacccaataataccacgaccaaccttcccgaaaacccacctatcctaatcgaccgaaaaccgcgcgaccgcgcaaaccatctccacgaaatcccgtcaaccgcgccaacctaacaaaccgaacaccgcaccaaccgaaaattaactcgaactacaaaaaacgcccgcccttccgacgaaaatcctacctccaaaacgtccgataaccgactttccctcgcaaattaattccgacacgaaataacgtaacatataaacgatcttcccgcgaaaaaaattccgtaaccgaccgtacgaaaccgatacctttccccctatcttaatcacctcaacccgctccacacccgacaatacgcgctctccc

SEQ ID NO: 10087 - DNA, 646 bp, Artificial Sequence
  chemically treated genomic DNA (Homo sapiens) CpG-island No: 10087
aaataatgatgtaattgttattttgatataatagtttgtttagcgttttcgagtttggagcgcgtttttatacggaaaggagaaatttagaggatatcgggcgagtttttttgatcgtaatacgaatgtagaacgcgtttttcgcggcgtgattgttcgttaaggttcggtcgggtcgggttcggtttttatcgtattaattcgcgtcgcgtcgtttcgcgatcggggtgcgatcggggttcggaagttgcggaatgtcggggtttcggtgggaagagtttcgagtttaatgatgttacggttagttttttcgaggatttatttgttttggtcggtcggggatcgcgcggtcgcgtaagttatttttacggagtttcgttagtcgcgttagtttagtaggtcggatatcgtattagtcggaagttgattcggattatagagagcgttcgttttttcggcggaagttttatttttaaagcgttcggtagtcggttttttttcgtaggttggtttcggtacggagtgacgtggtatgtagacggttttttcgcgagaagagtttcgtggtcggtcgtgcggggtcggtatttttttttttgttttagttattttagttcgttttatattcggtagtgcgcgttttttt

SEQ ID NO: 10088 - DNA, 646 bp, Artificial Sequence
  chemically treated genomic DNA (Homo sapiens) CpG-island No: 10088
aaaaaaacgcgcactaccgaatataaaacgaactaaaataactaaaacaaaaaaaaaaataccgaccccgcacgaccgaccacgaaactcttctcgcgaaaaaaccgtctacataccacgtcactccgtaccgaaaccaacctacgaaaaaaaaccgactaccgaacgctttaaaaataaaacttccgccgaaaaaacgaacgctctctataatccgaatcaacttccgactaatacgatatccgacctactaaactaacgcgactaacgaaactccgtaaaaataacttacgcgaccgcgcgatccccgaccgaccaaaacaaataaatcctcgaaaaaactaaccgtaacatcattaaactcgaaactcttcccaccgaaaccccgacattccgcaacttccgaaccccgatcgcaccccgatcgcgaaacgacgcgacgcgaattaatacgataaaaaccgaacccgacccgaccgaaccttaacgaacaatcacgccgcgaaaaacgcgttctacattcgtattacgatcaaaaaaactcgcccgatatcctctaaatttctcctttccgtataaaaacgcgctccaaactcgaaaacgctaaacaaactattatatcaaaataacaattacatcattattt

SEQ ID NO: 10089 - DNA, 752 bp, Artificial Sequence
  chemically treated genomic DNA (Homo sapiens) CpG-island No: 10089
agcggcggcggcgtagcgggggtttagtttagggcgtttttacggcggtttatatttcgtagtcgcgtttgtagcgtttttcgttcggtttgtagttttcggcgcgtttgggtcgcggcgcgtttttttttttgtagcgtttttcgttttcgttttagggcgcgttcgttttgttttacggtcgtttcgcgtcgttttagttttcgttttcgtcggttgtcgcgtacggttagcgcgtttatttgttttagtaggcgcgtttagtcgttttcgggggtcgtagcggggtcgggcggcggcgggtagggcgcggtaggtggggagttttcggcgtcgttgttttttagttttcgtcggtgcgcgttttttaggtgtttttataacgtcgaggttttcgcgtggaagttcgggtcgcggtttatttgtttttcgtatagacggtaggtggtttagtggttcgacggatgttcggggcgtttcggcgttaggtggaagtagttttaggtttcggagtatggcgtttttaggcggtcgggaggcgtcggcgtcggcgtcggttttagtttcggatattgatcgtttcgcgtcgtcgcgtcgtttagttcgcgggtttggtttatggtgtaggtcggttcgttattttttattttgcggcgttcgtacgttggggagtaggggaagaataataatgagtgttaggattacgtatatagtttttagattatagttagtttaagaaattatgtcgtttt

SEQ ID NO: 10090 - DNA, 752 bp, Artificial Sequence
  chemically treated genomic DNA (Homo sapiens) CpG-island No: 10090
aaaacgacataatttcttaaactaactataatctaaaaactatatacgtaatcctaacactcattattattcttcccctactccccaacgtacgaacgccgcaaaataaaaaataacgaaccgacctacaccataaaccaaacccgcgaactaaacgacgcgacgacgcgaaacgatcaatatccgaaactaaaaccgacgccgacgccgacgcctcccgaccgcctaaaaacgccatactccgaaacctaaaactacttccacctaacgccgaaacgccccgaacatccgtcgaaccactaaaccacctaccgtctatacgaaaaacaaataaaccgcgacccgaacttccacgcgaaaacctcgacgttataaaaacacctaaaaaacgcgcaccgacgaaaactaaaaaacaacgacgccgaaaactccccacctaccgcgccctacccgccgccgcccgaccccgctacgacccccgaaaacgactaaacgcgcctactaaaacaaataaacgcgctaaccgtacgcgacaaccgacgaaaacgaaaactaaaacgacgcgaaacgaccgtaaaacaaaacgaacgcgccctaaaacgaaaacgaaaaacgctacaaaaaaaaaaacgcgccgcgacccaaacgcgccgaaaactacaaaccgaacgaaaaacgctacaaacgcgactacgaaatataaaccgccgtaaaaacgccctaaactaaacccccgctacgccgccgccgct

SEQ ID NO: 10091 - DNA, 752 bp, Artificial Sequence
  chemically treated genomic DNA (Homo sapiens) CpG-island No: 10091
agggcggtatggttttttaggttaattgtagtttaggagttgtgtgcgtgattttaatatttattattattttttttttgttttttagcgtgcgggcgtcgtagaatgaggagtggcgagtcggtttgtattatggattaggttcgcgggttggacgacgcggcggcgcggggcggttagtgttcgggattggggtcggcgtcgacgtcgacgtttttcggtcgtttgggggcgttatatttcgaggtttggggttatttttatttggcgtcggggcgtttcgggtattcgtcgggttattgggttatttgtcgtttgtgcggggagtaggtgggtcgcggttcgggtttttacgcggggatttcggcgttgtggaggtatttgaggagcgcgtatcggcgggagttggagagtagcggcgtcgggagttttttatttgtcgcgttttgttcgtcgtcgttcggtttcgttgcggttttcgagggcgattgggcgcgtttgttggaatagatgggcgcgttggtcgtgcgcggtagtcggcgggagcgggagttggagcggcgcgaggcggtcgtggagtagggcgagcgcgttttggagcggaggcggagggcgttgtaggaggaagagcgcgtcgcggtttaggcgcgtcgggaattgtaggtcgagcgggaggcgttgtaggcgcggttgcgggatgtgagtcgtcgtgagggcgttttgggttgggttttcgttgcgtcgtcgtcgtt

SEQ ID NO: 10092 - DNA, 752 bp, Artificial Sequence
  chemically treated genomic DNA (Homo sapiens) CpG-island No: 10092
aacgacgacgacgcaacgaaaacccaacccaaaacgccctcacgacgactcacatcccgcaaccgcgcctacaacgcctcccgctcgacctacaattcccgacgcgcctaaaccgcgacgcgctcttcctcctacaacgccctccgcctccgctccaaaacgcgctcgccctactccacgaccgcctcgcgccgctccaactcccgctcccgccgactaccgcgcacgaccaacgcgcccatctattccaacaaacgcgcccaatcgccctcgaaaaccgcaacgaaaccgaacgacgacgaacaaaacgcgacaaataaaaaactcccgacgccgctactctccaactcccgccgatacgcgctcctcaaatacctccacaacgccgaaatccccgcgtaaaaacccgaaccgcgacccacctactccccgcacaaacgacaaataacccaataacccgacgaatacccgaaacgccccgacgccaaataaaaataaccccaaacctcgaaatataacgcccccaaacgaccgaaaaacgtcgacgtcgacgccgaccccaatcccgaacactaaccgccccgcgccgccgcgtcgtccaacccgcgaacctaatccataatacaaaccgactcgccactcctcattctacgacgcccgcacgctaaaaaacaaaaaaaaaataataataaatattaaaatcacgcacacaactcctaaactacaattaacctaaaaaaccataccgccct

SEQ ID NO: 10093 - DNA, 544 bp, Artificial Sequence
  chemically treated genomic DNA (Homo sapiens) CpG-island No: 10093
gtaggtcgcgtatatcgggtaggggttattttcggtttttttgttcgttgttcgtagtttcgttcggttataagtgagttttagggcgttatggttaggggttatcgcggttagtcgggtgtgaggttgtttttcgttgttcgcgcgttttagtggtttttgggttcgtcggcgttcgtttcggtttgaacgtagttttttcgcggcgacgagtagtttcgcgtcggagtttatggtttcggaggcgtcgttttcgtcgcggtcgtcgtcgtcgtttatttttttcgagtttgagttggtttagttaaggcggaaggtggagaagttggaacgtgaattgcggagttgtaagcggtaggtgcgggagatcgagaagttgttgtattatatagaacggttgtattagaacgtagaaagtaataattaggagtttcgtacgtaggtgcgcggttttttttagtttcgcgttttatttagtttaggcgaggttttcgaagttcgtgatagtttcggaaggggtttttgataggggtttagaattatt

SEQ ID NO: 10094 - DNA, 544 bp, Artificial Sequence
  chemically treated genomic DNA (Homo sapiens) CpG-island No: 10094
aataattctaaacccctatcaaaaaccccttccgaaactatcacgaacttcgaaaacctcgcctaaactaaataaaacgcgaaactaaaaaaaaccgcgcacctacgtacgaaactcctaattattactttctacgttctaatacaaccgttctatataatacaacaacttctcgatctcccgcacctaccgcttacaactccgcaattcacgttccaacttctccaccttccgccttaactaaaccaactcaaactcgaaaaaaataaacgacgacgacgaccgcgacgaaaacgacgcctccgaaaccataaactccgacgcgaaactactcgtcgccgcgaaaaaactacgttcaaaccgaaacgaacgccgacgaacccaaaaaccactaaaacgcgcgaacaacgaaaaacaacctcacacccgactaaccgcgataacccctaaccataacgccctaaaactcacttataaccgaacgaaactacgaacaacgaacaaaaaaaccgaaaataacccctacccgatatacgcgacctac

SEQ ID NO: 10095 - DNA, 544 bp, Artificial Sequence
  chemically treated genomic DNA (Homo sapiens) CpG-island No: 10095
agtagttttgagtttttgttagggatttttttcgaggttattacgggtttcgaaggtttcgtttgggttggatggggcgcggggttgaggaggatcgcgtatttgcgtgcggagtttttggttgttgttttttgcgttttggtatagtcgttttgtgtgatgtagtagtttttcgatttttcgtatttgtcgtttgtagtttcgtagtttacgttttaatttttttatttttcgttttagttgggttagtttaggttcgggggaggtgggcggcggcggcgatcgcggcggggacggcgttttcgaggttatgagtttcggcgcgagattgttcgtcgtcgcggaggggttgcgtttaggtcgaaacggacgtcggcggatttagagattattggagcgcgcgggtagcgaaaggtagttttatattcggttggtcgcggtggtttttggttatgacgttttgaaatttatttgtagtcgaacggggttgcgagtaacgagtaaggggatcgaggatggtttttgttcgatgtgcgcggtttgt

SEQ ID NO: 10096 - DNA, 544 bp, Artificial Sequence
  chemically treated genomic DNA (Homo sapiens) CpG-island No: 10096
acaaaccgcgcacatcgaacaaaaaccatcctcgatccccttactcgttactcgcaaccccgttcgactacaaataaatttcaaaacgtcataaccaaaaaccaccgcgaccaaccgaatataaaactacctttcgctacccgcgcgctccaataatctctaaatccgccgacgtccgtttcgacctaaacgcaacccctccgcgacgacgaacaatctcgcgccgaaactcataacctcgaaaacgccgtccccgccgcgatcgccgccgccgcccacctcccccgaacctaaactaacccaactaaaacgaaaaataaaaaaattaaaacgtaaactacgaaactacaaacgacaaatacgaaaaatcgaaaaactactacatcacacaaaacgactataccaaaacgcaaaaaacaacaaccaaaaactccgcacgcaaatacgcgatcctcctcaaccccgcgccccatccaacccaaacgaaaccttcgaaacccgtaataacctcgaaaaaaatccctaacaaaaactcaaaactact

SEQ ID NO: 10097 - DNA, 1124 bp, Artificial Sequence
  chemically treated genomic DNA (Homo sapiens) CpG-island No: 10097
ttggcgcgagtttgtgttgacgagtggatcgcgcgtacgttagagaaatcgcgttacgttgtcggtgttttcggttcgattaatcgtacggcgtttattttttcggacgttaacgattcggtatttcgtaatattatttttgacgggttggtggcggtttatcgagagtttattaaagcgttggtggaaggtggcgcggatttgattttgattgaaatcgttttcgatatttttaacgttaaagcggcggtatttgcggtgaaaacggagtttgaagcgttgggcgttgagttgtcgattatgattttcggtattattatcgacgttttcgggcgtacgtttttcgggtagattatcgaagtattttataatttattgcgttacgtcgaagttttgatttttggtttgaattgtgcgttggggttcgatgaattgcgttagtacgtgtaggagttgttacggattgcggaatgttacgttatcgcgtattcgaacgtcgggttatttaacgtttttggtgagtacgatttcgacgtcgatacgatggtaaaatagatacgtgaatgggcgtaagcgggtttttttaatatcgttcgcggttgttgtggtattacgttataatatattgcggagatgagttttggtcgtaaaaggttaacgcgcgtagaatcgagttcggtattttcgacgttgtcgggtaaagtttggttggaatatgtattgtcgttaattgttgaatagttgtaggtcgtcgtttagcggtgtttattttttttcgttggcgtaacgtagatttgggatgattatatagcgaaaacggttgcggttttcgtttcgttgggtgtttttgttatcggtatttatagcgttgtcgatttcgttgtcgcgattgaaaatgttgagatcgtgattgtcggcggggggaatattttttagttggttgaaatagtggtcgcgaagcgcgggttggtggtattaattattggacgtgggtaaacgtggggttttgtattttggttggaggcggtaggggttaaatttggttggttaaatattcgtattaataacgatatgtcgattgtcgattcgtaagggtttcgatggcgttaaatttgttttcgttg

SEQ ID NO: 10098 - DNA, 1124 bp, Artificial Sequence
  chemically treated genomic DNA (Homo sapiens) CpG-island No: 10098
caacgaaaacaaatttaacgccatcgaaacccttacgaatcgacaatcgacatatcgttattaatacgaatatttaaccaaccaaatttaacccctaccgcctccaaccaaaatacaaaaccccacgtttacccacgtccaataattaataccaccaacccgcgcttcgcgaccactatttcaaccaactaaaaaatattccccccgccgacaatcacgatctcaacattttcaatcgcgacaacgaaatcgacaacgctataaataccgataacaaaaacacccaacgaaacgaaaaccgcaaccgttttcgctatataatcatcccaaatctacgttacgccaacgaaaaaaaataaacaccgctaaacgacgacctacaactattcaacaattaacgacaatacatattccaaccaaactttacccgacaacgtcgaaaataccgaactcgattctacgcgcgttaaccttttacgaccaaaactcatctccgcaatatattataacgtaataccacaacaaccgcgaacgatattaaaaaaacccgcttacgcccattcacgtatctattttaccatcgtatcgacgtcgaaatcgtactcaccaaaaacgttaaataacccgacgttcgaatacgcgataacgtaacattccgcaatccgtaacaactcctacacgtactaacgcaattcatcgaaccccaacgcacaattcaaaccaaaaatcaaaacttcgacgtaacgcaataaattataaaatacttcgataatctacccgaaaaacgtacgcccgaaaacgtcgataataataccgaaaatcataatcgacaactcaacgcccaacgcttcaaactccgttttcaccgcaaataccgccgctttaacgttaaaaatatcgaaaacgatttcaatcaaaatcaaatccgcgccaccttccaccaacgctttaataaactctcgataaaccgccaccaacccgtcaaaaataatattacgaaataccgaatcgttaacgtccgaaaaaataaacgccgtacgattaatcgaaccgaaaacaccgacaacgtaacgcgatttctctaacgtacgcgcgatccactcgtcaacacaaactcgcgccaa

SEQ ID NO: 10099 - DNA, 1124 bp, Artificial Sequence
  chemically treated genomic DNA (Homo sapiens) CpG-island No: 10099
tagcgggaatagatttagcgttatcgaaatttttgcggatcgataatcggtatatcgttgttggtacgaatatttggttaattaagtttagtttttgtcgtttttagttaaaatatagagttttacgtttatttacgtttagtaattggtgttattagttcgcgtttcgcggttattgttttagttaattggaaagtatttttttcgtcgataattacgattttagtatttttaatcgcggtaacgggatcgataacgttatgaatatcggtgatagaaatatttagcggagcgagaatcgtagtcgttttcgttgtgtaattattttaggtttgcgttacgttagcgaaagggaataaatatcgttgagcggcgatttgtaattgtttagtaattagcggtagtgtatgttttagttaggttttattcggtagcgtcgagggtatcgagttcgattttgcgcgcgttaattttttacggttaggatttattttcgtaatatgttgtggcgtggtgttatagtagtcgcggacgatattgagaaaattcgtttgcgtttatttacgtatttgttttgttatcgtgtcggcgtcgagatcgtatttattaaaggcgttgggtagttcggcgttcgggtgcgcggtgacgtagtatttcgtaattcgtgatagtttttgtacgtattggcgtagtttatcgggttttagcgtatagtttaggttaaaggttagagtttcggcgtggcgtaatgagttgtaaaatgtttcggtggtttgttcggagagcgtgcgttcggaggcgtcggtgatggtgtcggagattataatcggtagtttaacgtttagcgttttaaatttcgtttttatcgtaaatatcgtcgttttggcgttaagggtgtcgaaaacggttttaattaggattagattcgcgttattttttattagcgttttggtggattttcgataagtcgttattagttcgttaaaagtgatattacgaaatgtcggatcgttgacgttcggagaaatagacgtcgtgcggttggtcgggtcgagaatatcggtaacgtagcgcggtttttttggcgtgcgcgcggtttattcgttagtataagttcgcgttag

SEQ ID NO: 10100 - DNA, 1124 bp, Artificial Sequence
  chemically treated genomic DNA (Homo sapiens) CpG-island No: 10100
ctaacgcgaacttatactaacgaataaaccgcgcgcacgccaaaaaaaccgcgctacgttaccgatattctcgacccgaccaaccgcacgacgtctatttctccgaacgtcaacgatccgacatttcgtaatatcacttttaacgaactaataacgacttatcgaaaatccaccaaaacgctaataaaaaataacgcgaatctaatcctaattaaaaccgttttcgacacccttaacgccaaaacgacgatatttacgataaaaacgaaatttaaaacgctaaacgttaaactaccgattataatctccgacaccatcaccgacgcctccgaacgcacgctctccgaacaaaccaccgaaacattttacaactcattacgccacgccgaaactctaacctttaacctaaactatacgctaaaacccgataaactacgccaatacgtacaaaaactatcacgaattacgaaatactacgtcaccgcgcacccgaacgccgaactacccaacgcctttaataaatacgatctcgacgccgacacgataacaaaacaaatacgtaaataaacgcaaacgaattttctcaatatcgtccgcgactactataacaccacgccacaacatattacgaaaataaatcctaaccgtaaaaaattaacgcgcgcaaaatcgaactcgataccctcgacgctaccgaataaaacctaactaaaacatacactaccgctaattactaaacaattacaaatcgccgctcaacgatatttattccctttcgctaacgtaacgcaaacctaaaataattacacaacgaaaacgactacgattctcgctccgctaaatatttctatcaccgatattcataacgttatcgatcccgttaccgcgattaaaaatactaaaatcgtaattatcgacgaaaaaaatactttccaattaactaaaacaataaccgcgaaacgcgaactaataacaccaattactaaacgtaaataaacgtaaaactctatattttaactaaaaacgacaaaaactaaacttaattaaccaaatattcgtaccaacaacgatataccgattatcgatccgcaaaaatttcgataacgctaaatctattcccgcta

SEQ ID NO: 10101 - DNA, 597 bp, Artificial Sequence
  chemically treated genomic DNA (Homo sapiens) CpG-island No: 10101
cgtttgcgcgttcgtttcgagcgcggtaaaggtttcggtcgtcgtcgcgtagtcggggtagacggttatgtcgtagtttatcgtacggcggattattttattatggatattgggcgtaacgatgagttgatagtttattttggcgagcgtatcgatttgtttaggttttagtatcgtatttgcgttaattaacgttttgtcgtcgtacgtattaacgatggcgggaatgttttgtttttattgtggggaatttagcgggattttaatcgcgtcgaattcggcgttaattatcgcgttaatatgcgttagcgtttcgtcgggcgtaatatcgcgtaaaatggcgattagcgggagtttagtttgttattgtatgagcgatgttttttatattagtttgaaatgtcgtgtcgttcggtaacggcgttacgtcgtaatttatcgtttgaaaggtttgttggtagcgcgcggttagcgatgtttcggcgtatacggtgatggcgtgttcgttttcgtgaaagtgtcggattcgaaattttttttttagattaaagataaattggttttttttgaggtgaaatcggcggttgaatagtagat

SEQ ID NO: 10102 - DNA, 597 bp, Artificial Sequence
  chemically treated genomic DNA (Homo sapiens) CpG-island No: 10102
atctactattcaaccgccgatttcacctcaaaaaaaaccaatttatctttaatctaaaaaaaaaatttcgaatccgacactttcacgaaaacgaacacgccatcaccgtatacgccgaaacatcgctaaccgcgcgctaccaacaaacctttcaaacgataaattacgacgtaacgccgttaccgaacgacacgacatttcaaactaatataaaaaacatcgctcatacaataacaaactaaactcccgctaatcgccattttacgcgatattacgcccgacgaaacgctaacgcatattaacgcgataattaacgccgaattcgacgcgattaaaatcccgctaaattccccacaataaaaacaaaacattcccgccatcgttaatacgtacgacgacaaaacgttaattaacgcaaatacgatactaaaacctaaacaaatcgatacgctcgccaaaataaactatcaactcatcgttacgcccaatatccataataaaataatccgccgtacgataaactacgacataaccgtctaccccgactacgcgacgacgaccgaaacctttaccgcgctcgaaacgaacgcgcaaacg

SEQ ID NO: 10103 - DNA, 597 bp, Artificial Sequence
  chemically treated genomic DNA (Homo sapiens) CpG-island No: 10103
atttgttgtttaatcgtcgattttattttagaagaaattagtttgtttttggtttgggaggagaatttcgggttcggtatttttacggaaacgaatacgttattatcgtgtgcgtcggaatatcgttgatcgcgcgttattagtaagttttttaggcgatgggttgcgacgtgacgtcgttgtcgggcgatacggtattttaggttggtataaggagtatcgtttatgtagtggtaaattaaattttcgttgatcgttattttgcgcggtattacgttcgacgaggcgttggcgtatgttggcgcggtgattgacgtcgggttcgacgcggttgaaatttcgttgaattttttataatgggagtaaagtattttcgttatcgttgatgcgtacggcgataaggcgttgattggcgtaggtacggtattgaaatttgaataggtcgatgcgttcgttaggatgggttgttagtttatcgttacgtttaatatttatagtgaagtgattcgtcgtgcggtgggttacggtatgatcgtttgtttcggttgcgcgacggcgatcgaagtttttatcgcgttcgaagcgggcgcgtaggcg

SEQ ID NO: 10104 - DNA, 597 bp, Artificial Sequence
  chemically treated genomic DNA (Homo sapiens) CpG-island No: 10104
cgcctacgcgcccgcttcgaacgcgataaaaacttcgatcgccgtcgcgcaaccgaaacaaacgatcataccgtaacccaccgcacgacgaatcacttcactataaatattaaacgtaacgataaactaacaacccatcctaacgaacgcatcgacctattcaaatttcaataccgtacctacgccaatcaacgccttatcgccgtacgcatcaacgataacgaaaatactttactcccattataaaaaattcaacgaaatttcaaccgcgtcgaacccgacgtcaatcaccgcgccaacatacgccaacgcctcgtcgaacgtaataccgcgcaaaataacgatcaacgaaaatttaatttaccactacataaacgatactccttataccaacctaaaataccgtatcgcccgacaacgacgtcacgtcgcaacccatcgcctaaaaaacttactaataacgcgcgatcaacgatattccgacgcacacgataataacgtattcgtttccgtaaaaataccgaacccgaaattctcctcccaaaccaaaaacaaactaatttcttctaaaataaaatcgacgattaaacaacaaat

SEQ ID NO: 10105 - DNA, 697 bp, Artificial Sequence
  chemically treated genomic DNA (Homo sapiens) CpG-island No: 10105
gacgtatttgtaagttatttaaaggttaaatcgttggcggagttattaatttcgtcggaagtattgatagcggtttttgaggcgttttcggtagcgatcgtcgatgacgatgatagttagtagttgttgttgagcggtatgagttgcgttagttgtgttattcgcgtataaaatgcgttgtaaagcgtatcgggcgttatttaggtacgggtaaatttggcggagcgtattgcgttggtgatgggtagtgtttttttataagatttagtgtaggcggtggaaaaagcgggttacggcgcggaagcgattgaagatgacgttaaacgtcgcgagcgttagtaagaaatcgtcgtcgttacgatgaagcgttttcgttggtaggtaattgtcgtattggcggtgggtatttcggtgatggtttgggggatgatcggcgataatatgatggttatcgttgataatcgtagtttgtggttggttatcggtttgataattttggtagtgatggttttcgtcggcgggtatttttatcgtagtgtatggaaaaggttgttgaacggtgcggcgacgatggatacgttggtggcgttgggtattggcgtggcgtgggtttattcgatgagcgttaattgtggtcgcggtggtttcgatggaagcgcgatattttaatgtaattataattgatataaaattttaa

SEQ ID NO: 10106 - DNA, 697 bp, Artificial Sequence
  chemically treated genomic DNA (Homo sapiens) CpG-island No: 10106
ttaaaattttatatcaattataattacattaaaatatcgcgcttccatcgaaaccaccgcgaccacaattaacgctcatcgaataaacccacgccacgccaatacccaacgccaccaacgtatccatcgtcgccgcaccgttcaacaaccttttccatacactacgataaaaatacccgccgacgaaaaccatcactaccaaaattatcaaaccgataaccaaccacaaactacgattatcaacgataaccatcatattatcgccgatcatcccccaaaccatcaccgaaatacccaccgccaatacgacaattacctaccaacgaaaacgcttcatcgtaacgacgacgatttcttactaacgctcgcgacgtttaacgtcatcttcaatcgcttccgcgccgtaacccgctttttccaccgcctacactaaatcttataaaaaaacactacccatcaccaacgcaatacgctccgccaaatttacccgtacctaaataacgcccgatacgctttacaacgcattttatacgcgaataacacaactaacgcaactcataccgctcaacaacaactactaactatcatcgtcatcgacgatcgctaccgaaaacgcctcaaaaaccgctatcaatacttccgacgaaattaataactccgccaacgatttaacctttaaataacttacaaatacgtc

SEQ ID NO: 10107 - DNA, 697 bp, Artificial Sequence
  chemically treated genomic DNA (Homo sapiens) CpG-island No: 10107
ttgaagttttgtgttagttataattgtattaagatgtcgcgtttttatcgggattatcgcggttatagttgacgtttatcgaatagatttacgttacgttagtatttagcgttattagcgtatttatcgtcgtcgtatcgtttagtagttttttttatgtattgcggtaaaaatgttcgtcggcgaaaattattattgttagggttattaggtcgataattaattataggttgcggttgttagcggtgattattatgttatcgtcgattattttttagattattatcgggatatttatcgttagtgcgataattgtttgttagcggaagcgttttatcgtagcgacggcggttttttgttggcgttcgcggcgtttagcgttatttttaatcgttttcgcgtcgtagttcgttttttttatcgtttgtattaaattttgtggggaggtattgtttattattagcgtagtacgtttcgttaggtttattcgtgtttgagtgacgttcggtacgttttgtagcgtattttgtacgcgggtgatatagttggcgtagtttatgtcgtttagtagtaattgttggttgttatcgttatcggcggtcgttgtcggaagcgttttagaaatcgttgttagtgttttcgacgggattgatgatttcgttagcggtttagtttttgggtggtttatagatgcgtt

SEQ ID NO: 10108 - DNA, 697 bp, Artificial Sequence
  chemically treated genomic DNA (Homo sapiens) CpG-island No: 10108
aacgcatctataaaccacccaaaaactaaaccgctaacgaaatcatcaatcccgtcgaaaacactaacaacgatttctaaaacgcttccgacaacgaccgccgataacgataacaaccaacaattactactaaacgacataaactacgccaactatatcacccgcgtacaaaatacgctacaaaacgtaccgaacgtcactcaaacacgaataaacctaacgaaacgtactacgctaataataaacaatacctccccacaaaatttaatacaaacgataaaaaaaacgaactacgacgcgaaaacgattaaaaataacgctaaacgccgcgaacgccaacaaaaaaccgccgtcgctacgataaaacgcttccgctaacaaacaattatcgcactaacgataaatatcccgataataatctaaaaaataatcgacgataacataataatcaccgctaacaaccgcaacctataattaattatcgacctaataaccctaacaataataattttcgccgacgaacatttttaccgcaatacataaaaaaaactactaaacgatacgacgacgataaatacgctaataacgctaaatactaacgtaacgtaaatctattcgataaacgtcaactataaccgcgataatcccgataaaaacgcgacatcttaatacaattataactaacacaaaacttcaa

SEQ ID NO: 10109 - DNA, 514 bp, Artificial Sequence
  chemically treated genomic DNA (Homo sapiens) CpG-island No: 10109
cgtttttttattagttaggttttattttcgggcgaggtttgttatcgattagtagtcgtttcgttcgttcggagtttttttaattttcgagtttaagtagatttcgttggttcgcgtttgtatttttcgtcgggtttacgttttttcggtcgtttagtaggagttagttttcgttatcggagtcggtcgggagagggtataaaattatcgttattaaggcggttgttattagagaggagcgaattttagattcgtttgtggagagatttggggtcgttaaggaaacggcggggaggggagcgaggaggagaacgttgaggatttggcgtcggcgtcgtcgtcgtcgtcgtcgaaataaaggtaggaatttatttgggcgaatcggcgtttgaatttaaggggaggtcgagtcgttgtggcgagagattataattcgggtcgggaggggggggtggttaggtttttttttcgtttttttagtgcggggaatatgtagagtagttacggtaggtat

SEQ ID NO: 10110 - DNA, 514 bp, Artificial Sequence
  chemically treated genomic DNA (Homo sapiens) CpG-island No: 10110
atacctaccgtaactactctacatattccccgcactaaaaaaacgaaaaaaaaacctaaccacccccccctcccgacccgaattataatctctcgccacaacgactcgacctccccttaaattcaaacgccgattcgcccaaataaattcctacctttatttcgacgacgacgacgacgacgccgacgccaaatcctcaacgttctcctcctcgctcccctccccgccgtttccttaacgaccccaaatctctccacaaacgaatctaaaattcgctcctctctaataacaaccgccttaataacgataattttataccctctcccgaccgactccgataacgaaaactaactcctactaaacgaccgaaaaaacgtaaacccgacgaaaaatacaaacgcgaaccaacgaaatctacttaaactcgaaaattaaaaaaactccgaacgaacgaaacgactactaatcgataacaaacctcgcccgaaaataaaacctaactaataaaaaaacg

SEQ ID NO: 10111 - DNA, 514 bp, Artificial Sequence
  chemically treated genomic DNA (Homo sapiens) CpG-island No: 10111
atgtttgtcgtagttgttttatatgtttttcgtattgaggagacggaagaggagtttagttatttttttttttcggttcggattatagtttttcgttatagcggttcggtttttttttggatttagacgtcgattcgtttaggtaaatttttgtttttatttcggcggcggcggcggcggcgtcggcgttaggtttttagcgttttttttttcgttttttttttcgtcgtttttttagcggttttaggtttttttataggcgagtttagagttcgtttttttttggtggtagtcgttttggtagcggtggttttgtattttttttcggtcggtttcggtggcggggattggtttttgttgggcggtcggggaggcgtaggttcggcggagagtgtaggcgcgggttagcggaatttatttgagttcggggattaggagagtttcgggcgagcggagcgattgttggtcggtgataggtttcgttcgggagtggagtttagttagtggggaggcg

SEQ ID NO: 10112 - DNA, 514 bp, Artificial Sequence
  chemically treated genomic DNA (Homo sapiens) CpG-island No: 10112
cgcctccccactaactaaactccactcccgaacgaaacctatcaccgaccaacaatcgctccgctcgcccgaaactctcctaatccccgaactcaaataaattccgctaacccgcgcctacactctccgccgaacctacgcctccccgaccgcccaacaaaaaccaatccccgccaccgaaaccgaccgaaaaaaaatacaaaaccaccgctaccaaaacgactaccaccaaaaaaaaacgaactctaaactcgcctataaaaaaacctaaaaccgctaaaaaaacgacgaaaaaaaaaacgaaaaaaaaaacgctaaaaacctaacgccgacgccgccgccgccgccgccgaaataaaaacaaaaatttacctaaacgaatcgacgtctaaatccaaaaaaaaaccgaaccgctataacgaaaaactataatccgaaccgaaaaaaaaaaataactaaactcctcttccgtctcctcaatacgaaaaacatataaaacaactacgacaaacat

SEQ ID NO: 10113 - DNA, 626 bp, Artificial Sequence
  chemically treated genomic DNA (Homo sapiens) CpG-island No: 10113
acgtgcgggcgtgtcggttttaatattacgaacgcggtggatatagttataatcgtgggcgtgacgattatcgtgacgtatatcgttatttttgatgcgattattatttagtttgttaaggatttgtttcggcgtttcgtttagattaatttttagatggtttattagcgttagtttgtcgtttttatttatacgcgcgaataacgatatttcggtatacgtcgggttacgttgtattagcgagtcgtcggagttgttataaatatcgtcgatgatcgatgcgtttatatacgatgatttaattattgagtgcggttcgcgttttagcggtttgagggttttttttagcgattagagcgtggtgttcggataggttagtatttgttcgtttttgttaagaacgtgtagtttgtcgagacgtagggtgttgatgataacgatatcgcgattataatcgttaacgtatggcgtcgattttttcgttaggtttgtattggcggttgtattagaatattttagtcggcggtgacgtaggtttttagaattcgtataatttattagtgagcgggtagtattaaggtaattatcgttatttcggaatttttcgtggttatttcggttattaa

SEQ ID NO: 10114 - DNA, 626 bp, Artificial Sequence
  chemically treated genomic DNA (Homo sapiens) CpG-island No: 10114
ttaataaccgaaataaccacgaaaaattccgaaataacgataattaccttaatactacccgctcactaataaattatacgaattctaaaaacctacgtcaccgccgactaaaatattctaatacaaccgccaatacaaacctaacgaaaaaatcgacgccatacgttaacgattataatcgcgatatcgttatcatcaacaccctacgtctcgacaaactacacgttcttaacaaaaacgaacaaatactaacctatccgaacaccacgctctaatcgctaaaaaaaaccctcaaaccgctaaaacgcgaaccgcactcaataattaaatcatcgtatataaacgcatcgatcatcgacgatatttataacaactccgacgactcgctaatacaacgtaacccgacgtataccgaaatatcgttattcgcgcgtataaataaaaacgacaaactaacgctaataaaccatctaaaaattaatctaaacgaaacgccgaaacaaatccttaacaaactaaataataatcgcatcaaaaataacgatatacgtcacgataatcgtcacgcccacgattataactatatccaccgcgttcgtaatattaaaaccgacacgcccgcacgt

SEQ ID NO: 10115 - DNA, 626 bp, Artificial Sequence
  chemically treated genomic DNA (Homo sapiens) CpG-island No: 10115
ttaatggtcggggtaattacgaagaatttcgaagtggcggtaattattttggtattattcgtttattagtagattgtgcgggttttggaagtttgcgttatcgtcgattgaagtattttgatgtagtcgttaatataggtttgacggaaggatcgacgttatacgttaacgattatgatcgcgatgtcgttattattagtattttgcgtttcgataagttgtacgtttttggtaagggcgaataggtgttggtttattcgggtattacgttttagtcgttggaaaaagtttttaaatcgttgggacgcgaatcgtatttagtgattggattatcgtgtataggcgtatcggttatcggcggtatttgtaataatttcggcggttcgttggtgtaacgtggttcggcgtatatcgaaatgtcgttattcgcgcgtataaatgaagacggtaaattgacgttggtgaattatttggggattgatttgggcgaaacgtcggagtagatttttagtaagttggatgatgatcgtattaaagatgacgatgtgcgttacgatggtcgttacgtttacgattatgattatgtttatcgcgttcgtgatattgaagtcgatacgttcgtacgt

SEQ ID NO: 10116 - DNA, 626 bp, Artificial Sequence
  chemically treated genomic DNA (Homo sapiens) CpG-island No: 10116
acgtacgaacgtatcgacttcaatatcacgaacgcgataaacataatcataatcgtaaacgtaacgaccatcgtaacgcacatcgtcatctttaatacgatcatcatccaacttactaaaaatctactccgacgtttcgcccaaatcaatccccaaataattcaccaacgtcaatttaccgtcttcatttatacgcgcgaataacgacatttcgatatacgccgaaccacgttacaccaacgaaccgccgaaattattacaaataccgccgataaccgatacgcctatacacgataatccaatcactaaatacgattcgcgtcccaacgatttaaaaactttttccaacgactaaaacgtaatacccgaataaaccaacacctattcgcccttaccaaaaacgtacaacttatcgaaacgcaaaatactaataataacgacatcgcgatcataatcgttaacgtataacgtcgatccttccgtcaaacctatattaacgactacatcaaaatacttcaatcgacgataacgcaaacttccaaaacccgcacaatctactaataaacgaataataccaaaataattaccgccacttcgaaattcttcgtaattaccccgaccattaa

SEQ ID NO: 10117 - DNA, 608 bp, Artificial Sequence
  chemically treated genomic DNA (Homo sapiens) CpG-island No: 10117
  misc_feature (279)..(279): n is either a, c, g or t
gcgtagtaattttttttgatatattttcgcgtgaagtttatatcgcgagttgttcgtattgcgcggcggagcgtataatattttcgcgtgtttcgttatcgcgtatttgtcgaaggttgttgttttggcgtagttttattacggtcgattgtcgttcgtacgtcgatcggttttcggttgtagtgttttgtttttatcgttattttttagtttgattcgttttgggttaagtgtttttttgattttgatcggtatggttatgacgatcgcgtggttttnttcgagtgttttgggtttaacgttttggtattcgtagtatcgtcgttgtatatttatagtggggtattttagtcgtgttggcgtcgtggcgtgtgtttatcggttcgtcggcgggatgatgtagtgttgttgtacgttttttcggttattcgtgttttttttatttgtcgtttttttttcggcgggatatcgtattcgggtttggcggggttggtaatttcgttagtcgtcgggtcgattattttcgttacgttgatgttgttgttttattagtattcgaattagatggggtatttggtgattgttttgttgttggtttggggcggtat

SEQ ID NO: 10118 - DNA, 608 bp, Artificial Sequence
  chemically treated genomic DNA (Homo sapiens) CpG-island No: 10118
  misc_feature (330)..(330): n is either a, c, g or t
ataccgccccaaaccaacaacaaaacaatcaccaaataccccatctaattcgaatactaataaaacaacaacatcaacgtaacgaaaataatcgacccgacgactaacgaaattaccaaccccgccaaacccgaatacgatatcccgccgaaaaaaaaacgacaaataaaaaaaacacgaataaccgaaaaaacgtacaacaacactacatcatcccgccgacgaaccgataaacacacgccacgacgccaacacgactaaaataccccactataaatatacaacgacgatactacgaataccaaaacgttaaacccaaaacactcgaanaaaaccacgcgatcgtcataaccataccgatcaaaatcaaaaaaacacttaacccaaaacgaatcaaactaaaaaataacgataaaaacaaaacactacaaccgaaaaccgatcgacgtacgaacgacaatcgaccgtaataaaactacgccaaaacaacaaccttcgacaaatacgcgataacgaaacacgcgaaaatattatacgctccgccgcgcaatacgaacaactcgcgatataaacttcacgcgaaaatatatcaaaaaaaattactacgc

SEQ ID NO: 10119 - DNA, 608 bp, Artificial Sequence
  chemically treated genomic DNA (Homo sapiens) CpG-island No: 10119
  misc_feature (330)..(330): n is either a, c, g or t
gtgtcgttttaggttagtagtagagtaattattagatgttttatttgattcgggtattgatgagataataatattagcgtggcgagaatagtcggttcggcgattaacggaattgttaatttcgttaagttcgggtgcggtgtttcgtcggagaagagacgataggtaaagggggtacgagtgatcggagggacgtgtaataatattatattatttcgtcggcgagtcgatgggtatacgttacggcgttagtacggttggaatgttttattgtaagtgtatagcgacggtattgcggatattaggacgttgagtttagaatattcggangagattacgcggtcgttataattatgtcggttaggattagaagaatatttaatttagggcggattaggttggaaagtagcggtggggataaaatattgtaatcgggggtcgatcggcgtgcggacgatagtcggtcgtggtgaaattacgttaaagtaataattttcgatagatgcgcgatgacgaggtacgcgaggatattatgcgtttcgtcgcgtaatgcggataattcgcggtatgagttttacgcggaggtatgttaggaagaattattacgt

SEQ ID NO: 10120 - DNA, 608 bp, Artificial Sequence
  chemically treated genomic DNA (Homo sapiens) CpG-island No: 10120
  misc_feature (279)..(279): n is either a, c, g or t
acgtaataattcttcctaacatacctccgcgtaaaactcataccgcgaattatccgcattacgcgacgaaacgcataatatcctcgcgtacctcgtcatcgcgcatctatcgaaaattattactttaacgtaatttcaccacgaccgactatcgtccgcacgccgatcgacccccgattacaatattttatccccaccgctactttccaacctaatccgccctaaattaaatattcttctaatcctaaccgacataattataacgaccgcgtaatctcntccgaatattctaaactcaacgtcctaatatccgcaataccgtcgctatacacttacaataaaacattccaaccgtactaacgccgtaacgtatacccatcgactcgccgacgaaataatataatattattacacgtccctccgatcactcgtaccccctttacctatcgtctcttctccgacgaaacaccgcacccgaacttaacgaaattaacaattccgttaatcgccgaaccgactattctcgccacgctaatattattatctcatcaatacccgaatcaaataaaacatctaataattactctactactaacctaaaacgacac

SEQ ID NO: 10121 - DNA, 585 bp, Artificial Sequence
  chemically treated genomic DNA (Homo sapiens) CpG-island No: 10121
ttcggttggcgtaatttagttcgaagcggtagacgtatcggaaattatttcggattcgtttgattcgtcgaagaaacgtaaatcgataatgttggtgatcgatttgacgttgcgttttgattttgagttcgagaagatttttcgtcgtttttttaacgattcgtaggcgtttaacgaagtttttgttcgtgtttggtttaaattgacgtatagggatatggggtcgaaatttcgttatatcgggtcggaagtgtcgaaagaagatttgatttggtaagattcgttgtcgtagtcgatttataattcgatcgagtaggatattatcgatttgaaattcgcgattgcggattttggtttgtttgttagtgagttggtatcggtggtttgggtatttgtttttatttttcgtggtggcgataaacgcggtggtgttaacggtgcgcgtttggtattaatgtcgtagcgcgattgggatgtgaacgtcgtagtcgttcgtgttttgtttgttttggagaaaatttagaaagagtttggtaaagtttcgttggcggatattatagtgttggttggtgtggttggtgttga

SEQ ID NO: 10122 - DNA, 585 bp, Artificial Sequence
  chemically treated genomic DNA (Homo sapiens) CpG-island No: 10122
tcaacaccaaccacaccaaccaacactataatatccgccaacgaaactttaccaaactctttctaaattttctccaaaacaaacaaaacacgaacgactacgacgttcacatcccaatcgcgctacgacattaataccaaacgcgcaccgttaacaccaccgcgtttatcgccaccacgaaaaataaaaacaaatacccaaaccaccgataccaactcactaacaaacaaaccaaaatccgcaatcgcgaatttcaaatcgataatatcctactcgatcgaattataaatcgactacgacaacgaatcttaccaaatcaaatcttctttcgacacttccgacccgatataacgaaatttcgaccccatatccctatacgtcaatttaaaccaaacacgaacaaaaacttcgttaaacgcctacgaatcgttaaaaaaacgacgaaaaatcttctcgaactcaaaatcaaaacgcaacgtcaaatcgatcaccaacattatcgatttacgtttcttcgacgaatcaaacgaatccgaaataatttccgatacgtctaccgcttcgaactaaattacgccaaccgaa

SEQ ID NO: 10123 - DNA, 585 bp, Artificial Sequence
  chemically treated genomic DNA (Homo sapiens) CpG-island No: 10123
ttaatattaattatattagttagtattatgatattcgttagcgaggttttattagattttttttggattttttttagaataggtagagtacgaacggttgcggcgtttatattttagtcgcgttgcggtattaatgttagacgcgtatcgttggtattatcgcgtttgtcgttattacggaaggtagaagtagatgtttaggttatcgatattagtttattaatagatagattagaattcgtaatcgcgaattttagatcgataatgttttgttcggtcgggttgtagatcggttgcggtagcggattttgttagattagattttttttcggtattttcggttcgatgtagcgagatttcggttttatatttttgtgcgttagtttgaattaggtacgggtaaaggtttcgttgaacgtttgcggatcgttgaggaaacgacgagagattttttcgaatttaggattaaaacgtagcgttaggtcggttattagtattgtcggtttacgttttttcgacggattaaacggattcgggataattttcggtgcgtttatcgtttcgaattggattgcgttagtcggg

SEQ ID NO: 10124 - DNA, 585 bp, Artificial Sequence
  chemically treated genomic DNA (Homo sapiens) CpG-island No: 10124
cccgactaacgcaatccaattcgaaacgataaacgcaccgaaaattatcccgaatccgtttaatccgtcgaaaaaacgtaaaccgacaatactaataaccgacctaacgctacgttttaatcctaaattcgaaaaaatctctcgtcgtttcctcaacgatccgcaaacgttcaacgaaacctttacccgtacctaattcaaactaacgcacaaaaatataaaaccgaaatctcgctacatcgaaccgaaaataccgaaaaaaaatctaatctaacaaaatccgctaccgcaaccgatctacaacccgaccgaacaaaacattatcgatctaaaattcgcgattacgaattctaatctatctattaataaactaatatcgataacctaaacatctacttctaccttccgtaataacgacaaacgcgataataccaacgatacgcgtctaacattaataccgcaacgcgactaaaatataaacgccgcaaccgttcgtactctacctattctaaaaaaaatccaaaaaaaatctaataaaacctcgctaacgaatatcataatactaactaatataattaatattaa

SEQ ID NO: 10125 - DNA, 534 bp, Artificial Sequence
  chemically treated genomic DNA (Homo sapiens) CpG-island No: 10125
ttgttattcgttgaagaagtcgatagttttattagcgtttttgttagcgattttgagcgtttggcggcgttgttcgatagcggtattaacgacgtagtgtatgcggaagtggtgggttacggggaagtatggtcggtacgtttgatgtttgcggtatttaattaataagggttgttagcggtttggtttgatgttcgcgagtttttacgcgttgaacgcgtcgtataatcgtaggttgatgaagggtttttttattcgttgttgtaatagttgttggtgtaatattcgggtaaacgtttggtggtgatcggatttattagtcgtaataacgtcggtgaaacggtgttgttggggcgtaacggtttcgattatttcgcgatataaatcggtgcgttggcgggtgtttttcgcgtaattatttggagcgacgtcgtcggggtatatagtgttcgatcgcgtaaagtgttgaatcgcgaaaaagtagatttagttattagcgatttgcggatggatgaaatggacggtatgtagttg

SEQ ID NO: 10126 - DNA, 534 bp, Artificial Sequence
  chemically treated genomic DNA (Homo sapiens) CpG-island No: 10126
caactacataccgtccatttcatccatccgcaaatcgctaataactaaatctactttttcgcgattcaacactttacgcgatcgaacactatataccccgacgacgtcgctccaaataattacgcgaaaaacacccgccaacgcaccgatttatatcgcgaaataatcgaaaccgttacgccccaacaacaccgtttcaccgacgttattacgactaataaatccgatcaccaccaaacgtttacccgaatattacaccaacaactattacaacaacgaataaaaaaacccttcatcaacctacgattatacgacgcgttcaacgcgtaaaaactcgcgaacatcaaaccaaaccgctaacaacccttattaattaaataccgcaaacatcaaacgtaccgaccatacttccccgtaacccaccacttccgcatacactacgtcgttaataccgctatcgaacaacgccgccaaacgctcaaaatcgctaacaaaaacgctaataaaactatcgacttcttcaacgaataacaa

SEQ ID NO: 10127 - DNA, 534 bp, Artificial Sequence
  chemically treated genomic DNA (Homo sapiens) CpG-island No: 10127
tagttgtatatcgtttattttatttattcgtaggtcgttgatgattaaatttattttttcgcgatttagtattttacgcggtcgggtattgtatatttcggcgacgtcgttttagatggttacgcgagaaatattcgttagcgtatcgatttgtgtcgcggaatagtcggaatcgttacgttttagtagtatcgttttatcggcgttgttgcggttgataaattcggttattattagacgtttgttcggatgttgtattagtagttgttgtagtaacgggtaagaaagttttttattaatttgcggttgtgcggcgcgtttagcgcgtaaaaattcgcgggtattaagttaggtcgttggtagtttttgttgattaagtatcgtagatattagacgtgtcgattatattttttcgtggtttattattttcgtatatattgcgtcgttaatatcgttgtcgagtagcgtcgttaggcgtttaaggtcgttgataaaagcgttaatgaggttatcggtttttttagcgggtagtag

SEQ ID NO: 10128 - DNA, 534 bp, Artificial Sequence
  chemically treated genomic DNA (Homo sapiens) CpG-island No: 10128
ctactacccgctaaaaaaaccgataacctcattaacgcttttatcaacgaccttaaacgcctaacgacgctactcgacaacgatattaacgacgcaatatatacgaaaataataaaccacgaaaaaatataatcgacacgtctaatatctacgatacttaatcaacaaaaactaccaacgacctaacttaatacccgcgaatttttacgcgctaaacgcgccgcacaaccgcaaattaataaaaaactttcttacccgttactacaacaactactaatacaacatccgaacaaacgtctaataataaccgaatttatcaaccgcaacaacgccgataaaacgatactactaaaacgtaacgattccgactattccgcgacacaaatcgatacgctaacgaatatttctcgcgtaaccatctaaaacgacgtcgccgaaatatacaatacccgaccgcgtaaaatactaaatcgcgaaaaaataaatttaatcatcaacgacctacgaataaataaaataaacgatatacaacta

SEQ ID NO: 10129 - DNA, 543 bp, Artificial Sequence
  chemically treated genomic DNA (Homo sapiens) CpG-island No: 10129
cgcgatttcgattttgtgttgacggatttgttgatgtcgggtatggatggcgtgtagtttatttagagtttggcgagtttacggtgtaagttcgttttggcgattatgagtgtcgcgtttcggcgtatgttgatggcggttagtttggtggcgaaaaatttcgacgtggaagtgatagggttgattttaaaatcggtggcggtcgaagttttgcgtaatttggtgaattaatttaacgataaggatcgtagtttttcgtcgtcgatgtttttcgtttatttggaaatagatcggtagacgattatttaggcgatgggcgacggttaattttaggtttggttttaatcgaaaaaatttttggttaacggtcgtatcgtcgtcgtcgaagcgttggtgcgttggatgtatttcgagtaaggcgtgatgttgtcggtttcgtttttatcggttattaaagttttcgagttggaagagcgtttgttgtggatcgtgttgaaataggttatttatgtttaggaacgttggcgttagcgcggttacgag

SEQ ID NO: 10130 - DNA, 543 bp, Artificial Sequence
  chemically treated genomic DNA (Homo sapiens) CpG-island No: 10130
ctcgtaaccgcgctaacgccaacgttcctaaacataaataacctatttcaacacgatccacaacaaacgctcttccaactcgaaaactttaataaccgataaaaacgaaaccgacaacatcacgccttactcgaaatacatccaacgcaccaacgcttcgacgacgacgatacgaccgttaaccaaaaattttttcgattaaaaccaaacctaaaattaaccgtcgcccatcgcctaaataatcgtctaccgatctatttccaaataaacgaaaaacatcgacgacgaaaaactacgatccttatcgttaaattaattcaccaaattacgcaaaacttcgaccgccaccgattttaaaatcaaccctatcacttccacgtcgaaatttttcgccaccaaactaaccgccatcaacatacgccgaaacgcgacactcataatcgccaaaacgaacttacaccgtaaactcgccaaactctaaataaactacacgccatccatacccgacatcaacaaatccgtcaacacaaaatcgaaatcgcg

SEQ ID NO: 10131 - DNA, 543 bp, Artificial Sequence
  chemically treated genomic DNA (Homo sapiens) CpG-island No: 10131
ttcgtaatcgcgttggcgttagcgtttttgggtatggatggtttgttttagtacgatttatagtaggcgtttttttagttcgaaagttttgatggtcggtaaaaacgaggtcggtagtattacgttttgttcgggatgtatttagcgtattagcgtttcggcggcgacgatgcggtcgttggttaaggattttttcggttggaattaggtttggaattggtcgtcgtttatcgtttggatgatcgtttgtcggtttatttttaggtgggcggggagtatcggcggcgaagggttgcggtttttgtcgttgagttgatttattaagttgcgtagggtttcggtcgttatcggttttgaaattagttttattatttttacgtcgaggtttttcgttattaggttggtcgttattaatatgcgtcgggacgcggtatttatgatcgttagggcgggtttgtatcgtaggttcgttaggttttggataaattgtacgttatttatgttcggtattagtagattcgttagtataaggtcgaaatcgcg

SEQ ID NO: 10132 - DNA, 543 bp, Artificial Sequence
  chemically treated genomic DNA (Homo sapiens) CpG-island No: 10132
cgcgatttcgaccttatactaacgaatctactaataccgaacataaataacgtacaatttatccaaaacctaacgaacctacgatacaaacccgccctaacgatcataaataccgcgtcccgacgcatattaataacgaccaacctaataacgaaaaacctcgacgtaaaaataataaaactaatttcaaaaccgataacgaccgaaaccctacgcaacttaataaatcaactcaacgacaaaaaccgcaacccttcgccgccgatactccccgcccacctaaaaataaaccgacaaacgatcatccaaacgataaacgacgaccaattccaaacctaattccaaccgaaaaaatccttaaccaacgaccgcatcgtcgccgccgaaacgctaatacgctaaatacatcccgaacaaaacgtaatactaccgacctcgtttttaccgaccatcaaaactttcgaactaaaaaaacgcctactataaatcgtactaaaacaaaccatccatacccaaaaacgctaacgccaacgcgattacgaa

SEQ ID NO: 10133 - DNA, 1080 bp, Artificial Sequence
  chemically treated genomic DNA (Homo sapiens) CpG-island No: 10133
ataggggacgttttttatatagcggatgttttttatgttacggaggttttcgtatatagggacgttttttatttcgcggacgttttttatatagggacgttttttacgtcgcggatatttttttatatagcggatatgtttcgacgtttttttatatggcggacgtttttttatacggcggatttcgatttcgtcgttttttaaacgggaggggaggagtcgtggttatcgtgataattataaaataggatgagtttcgttttttagaacgcggagtcgcggtggaagagggtgacgtcgtcgagagtttacgagcgtgttttaagtcgagtgaggagcgcgcgggggcgtttttgtttttaaggtcgtacgagcgttaaggtttcgcggggagaatagttacggggggagacggggttcgcgttgtttttacgaacgttgttggtggggattttacggttgcgttcgttgaggtggaggggtcgggaggatagagtttcgcgttcgtcgtcgttcgtttttgattttgtcggtttcgggttggggtagagaagggcgggcgcgggcggtcgtgtcgggagcggaggcggacgtcggtcgggttttttcgggttttttcgttgggcgttttgcggtcgtatttttttttttattcggagattaggtttttgtttcgttcgcggttgaggagataaggagaggttgatttgaaaagttgcgaggacgcgtattttaatttttagggacggtttgagtttcgttttgtttttcgaaagtgttgggaacggattttattagtaggcgaaattgtttttaaagtttcgtggtttagtaaaaggtagggcggggacgtttatggttttcgggtcggttttttacgggtttagttttcgagttttcggattggacggcgcgggcgtcgggggtttaggttgtttcggtcgtttcgttgtgagttcgagttgcgttgtagtcgttggttacgtatgggggtttttcgcgtttttttttttaggtcggtagtgggttggggtcgtaagtgttttcgcgtatattggtcgttttttagggataaggata

SEQ ID NO: 10134 - DNA, 1080 bp, Artificial Sequence
  chemically treated genomic DNA (Homo sapiens) CpG-island No: 10134
tatccttatccctaaaaaacgaccaatatacgcgaaaacacttacgaccccaacccactaccgacctaaaaaaaaaaacgcgaaaaacccccatacgtaaccaacgactacaacgcaactcgaactcacaacgaaacgaccgaaacaacctaaacccccgacgcccgcgccgtccaatccgaaaactcgaaaactaaacccgtaaaaaaccgacccgaaaaccataaacgtccccgccctaccttttactaaaccacgaaactttaaaaacaatttcgcctactaataaaatccgttcccaacactttcgaaaaacaaaacgaaactcaaaccgtccctaaaaattaaaatacgcgtcctcgcaacttttcaaatcaacctctccttatctcctcaaccgcgaacgaaacaaaaacctaatctccgaataaaaaaaaaaatacgaccgcaaaacgcccaacgaaaaaacccgaaaaaacccgaccgacgtccgcctccgctcccgacacgaccgcccgcgcccgcccttctctaccccaacccgaaaccgacaaaatcaaaaacgaacgacgacgaacgcgaaactctatcctcccgacccctccacctcaacgaacgcaaccgtaaaatccccaccaacaacgttcgtaaaaacaacgcgaaccccgtctccccccgtaactattctccccgcgaaaccttaacgctcgtacgaccttaaaaacaaaaacgcccccgcgcgctcctcactcgacttaaaacacgctcgtaaactctcgacgacgtcaccctcttccaccgcgactccgcgttctaaaaaacgaaactcatcctattttataattatcacgataaccacgactcctcccctcccgtttaaaaaacgacgaaatcgaaatccgccgtataaaaaaacgtccgccatataaaaaaacgtcgaaacatatccgctatataaaaaaatatccgcgacgtaaaaaacgtccctatataaaaaacgtccgcgaaataaaaaacgtccctatatacgaaaacctccgtaacataaaaaacatccgctatataaaaaacgtcccctat

SEQ ID NO: 10135 - DNA, 1080 bp, Artificial Sequence
  chemically treated genomic DNA (Homo sapiens) CpG-island No: 10135
tgtttttgtttttgggggacggttagtgtacgcggggatatttgcggttttagtttattgtcggtttggaggaaaggacgcgggggatttttatacgtgattagcggttgtagcgtagttcgggtttatagcggggcggtcggagtagtttggattttcgacgttcgcgtcgtttagttcggggattcggaggttgagttcgtagggggtcggttcgggggttatgggcgttttcgttttgttttttgttgggttacggagttttgaggatagtttcgtttgttgataaaattcgtttttagtattttcgaaaggtagggcggggtttaagtcgtttttggaggttaaaatgcgcgttttcgtagttttttaaattagtttttttttatttttttagtcgcgggcggggtaggggtttggttttcggatggaggaggaggtgcggtcgtaggacgtttagcggggagattcggggagattcggtcggcgttcgttttcgttttcggtacggtcgttcgcgttcgtttttttttgttttagttcgggatcggtagggttagaagcgggcggcggcgggcgcggggttttgttttttcggtttttttattttagcgggcgtagtcgtggggtttttattaatagcgttcgtgggggtagcgcgggtttcgttttttttcgtggttatttttttcgcgaggttttggcgttcgtgcggttttgggagtaagagcgttttcgcgcgttttttattcggtttgggatacgttcgtgaattttcggcggcgttatttttttttatcgcgatttcgcgttttgggaggcggggtttattttgttttgtggttgttacggtggttacggttttttttttttcgtttagaaagcggcgaggtcggggttcgtcgtgtgagggggcgttcgttatgtgaaggggcgtcgaggtatgttcgttgtgtgagggggtgttcgcggcgtgaggggcgtttttgtgtgagaggcgttcgcggagtgaggggcgtttttgtgtgcggaggttttcgtggtatgaggggtattcgttgtgtgaggggcgttttttgt

SEQ ID NO: 10136 - DNA, 1080 bp, Artificial Sequence
  chemically treated genomic DNA (Homo sapiens) CpG-island No: 10136
acaaaaaacgcccctcacacaacgaatacccctcataccacgaaaacctccgcacacaaaaacgcccctcactccgcgaacgcctctcacacaaaaacgcccctcacgccgcgaacaccccctcacacaacgaacatacctcgacgccccttcacataacgaacgccccctcacacgacgaaccccgacctcgccgctttctaaacgaaaaaaaaaaaaccgtaaccaccgtaacaaccacaaaacaaaataaaccccgcctcccaaaacgcgaaatcgcgataaaaaaaaataacgccgccgaaaattcacgaacgtatcccaaaccgaataaaaaacgcgcgaaaacgctcttactcccaaaaccgcacgaacgccaaaacctcgcgaaaaaaataaccacgaaaaaaaacgaaacccgcgctacccccacgaacgctattaataaaaaccccacgactacgcccgctaaaataaaaaaaccgaaaaaacaaaaccccgcgcccgccgccgcccgcttctaaccctaccgatcccgaactaaaacaaaaaaaaacgaacgcgaacgaccgtaccgaaaacgaaaacgaacgccgaccgaatctccccgaatctccccgctaaacgtcctacgaccgcacctcctcctccatccgaaaaccaaacccctaccccgcccgcgactaaaaaaataaaaaaaaactaatttaaaaaactacgaaaacgcgcattttaacctccaaaaacgacttaaaccccgccctacctttcgaaaatactaaaaacgaattttatcaacaaacgaaactatcctcaaaactccgtaacccaacaaaaaacaaaacgaaaacgcccataacccccgaaccgaccccctacgaactcaacctccgaatccccgaactaaacgacgcgaacgtcgaaaatccaaactactccgaccgccccgctataaacccgaactacgctacaaccgctaatcacgtataaaaatcccccgcgtcctttcctccaaaccgacaataaactaaaaccgcaaatatccccgcgtacactaaccgtcccccaaaaacaaaaaca

SEQ ID NO: 10137 - DNA, 792 bp, Artificial Sequence
  chemically treated genomic DNA (Homo sapiens) CpG-island No: 10137
ggcggtttacgtttcgtttgttcgcgggcgggtattaggaatagttttgatatcgtttttcgttttcgggcgggtgcgtagcgcgattttagttttcgtttcgtcgtttatttgtttgtttcgcgcgcgtcgtttcgtttttttcgcgtttttgcggtcgttcgcgtacgcggacgttacgaagttgttttttgcggttcgggggcggacgcgcgggaaattcgtatcgaggagggaaagagacgcgtcgtgagtttcgcgggcgttgcgttttcgttgtgtttttatcgtttggagatcgcgtaggggtaggcgtgggggtttcgcgcgtttttggagattcgcggtttcgtttttttatcgttggttttagggtaggacgcgcgcgggtttttagttttgagggtttcgggtcgggtcgtcgtttttcgtttcgtttcgtcggttcgttcgtttattttttcgggtttttttttcgtttgcgggcggcggcggttgcgggtacggcgggacgcggggagaggaaaacgatagtgagaggcggttttacgttcgttcgttcgttttttcgttttatcggttcgcggtttatcgtgtttcgattgtagtttttttatcgtcgtcgttacgtttcgtcgggtttcgcgtttaggtgtagggttgagttttgaagtcggggtcgggagttcgcgggggtcgtatgggtcgggagtaagttagggtgtcggtaggaggtgagggaagatggttttacgtcgcgcgggggtcgggggagttagggggcgttaggta

SEQ ID NO: 10138 - DNA, 792 bp, Artificial Sequence
  chemically treated genomic DNA (Homo sapiens) CpG-island No: 10138
tacctaacgccccctaactcccccgacccccgcgcgacgtaaaaccatcttccctcacctcctaccgacaccctaacttactcccgacccatacgacccccgcgaactcccgaccccgacttcaaaactcaaccctacacctaaacgcgaaacccgacgaaacgtaacgacgacgataaaaaaactacaatcgaaacacgataaaccgcgaaccgataaaacgaaaaaacgaacgaacgaacgtaaaaccgcctctcactatcgttttcctctccccgcgtcccgccgtacccgcaaccgccgccgcccgcaaacgaaaaaaaaacccgaaaaaataaacgaacgaaccgacgaaacgaaacgaaaaacgacgacccgacccgaaaccctcaaaactaaaaacccgcgcgcgtcctaccctaaaaccaacgataaaaaaacgaaaccgcgaatctccaaaaacgcgcgaaacccccacgcctacccctacgcgatctccaaacgataaaaacacaacgaaaacgcaacgcccgcgaaactcacgacgcgtctctttccctcctcgatacgaatttcccgcgcgtccgcccccgaaccgcaaaaaacaacttcgtaacgtccgcgtacgcgaacgaccgcaaaaacgcgaaaaaaacgaaacgacgcgcgcgaaacaaacaaataaacgacgaaacgaaaactaaaatcgcgctacgcacccgcccgaaaacgaaaaacgatatcaaaactattcctaatacccgcccgcgaacaaacgaaacgtaaaccgcc

SEQ ID NO: 10139 - DNA, 792 bp, Artificial Sequence
  chemically treated genomic DNA (Homo sapiens) CpG-island No: 10139
tatttggcgttttttggttttttcggttttcgcgcggcgtggagttatttttttttattttttatcggtattttagtttgttttcggtttatgcggttttcgcgggttttcggtttcggttttagaatttagttttgtatttgagcgcggggttcggcggggcgtggcggcggcgatggggaaattgtagtcgaagtacggtgagtcgcgggtcggtagggcgggagggcgggcgggcgggcgtggggtcgttttttattgtcgttttttttttttcgcgtttcgtcgtgttcgtagtcgtcgtcgttcgtaagcggagagagagttcggaagggtgagcgggcgagtcgacggggcggggcggggggcggcgattcggttcgggatttttagagttaggagttcgcgcgcgttttgttttggagttagcggtggggggacggggtcgcgggtttttaggagcgcgcgggatttttacgtttgtttttgcgcggtttttaggcgatggggatatagcgaaggcgtagcgttcgcggggtttacggcgcgttttttttttttttcggtgcgggtttttcgcgcgttcgttttcggatcgtaggggatagtttcgtggcgttcgcgtacgcgagcggtcgtaaaggcgcggaggaagcggagcggcgcgcgcgggataagtaggtaggcggcggggcggaggttggggtcgcgttgcgtattcgttcgggggcggggagcggtgttagagttgtttttggtgttcgttcgcggataggcgagacgtgggtcgtt

SEQ ID NO: 10140 - DNA, 792 bp, Artificial Sequence
  chemically treated genomic DNA (Homo sapiens) CpG-island No: 10140
aacgacccacgtctcgcctatccgcgaacgaacaccaaaaacaactctaacaccgctccccgcccccgaacgaatacgcaacgcgaccccaacctccgccccgccgcctacctacttatcccgcgcgcgccgctccgcttcctccgcgcctttacgaccgctcgcgtacgcgaacgccacgaaactatcccctacgatccgaaaacgaacgcgcgaaaaacccgcaccgaaaaaaaaaaaaaacgcgccgtaaaccccgcgaacgctacgccttcgctatatccccatcgcctaaaaaccgcgcaaaaacaaacgtaaaaatcccgcgcgctcctaaaaacccgcgaccccgtccccccaccgctaactccaaaacaaaacgcgcgcgaactcctaactctaaaaatcccgaaccgaatcgccgccccccgccccgccccgtcgactcgcccgctcacccttccgaactctctctccgcttacgaacgacgacgactacgaacacgacgaaacgcgaaaaaaaaaaaacgacaataaaaaacgaccccacgcccgcccgcccgccctcccgccctaccgacccgcgactcaccgtacttcgactacaatttccccatcgccgccgccacgccccgccgaaccccgcgctcaaatacaaaactaaattctaaaaccgaaaccgaaaacccgcgaaaaccgcataaaccgaaaacaaactaaaataccgataaaaaataaaaaaaaataactccacgccgcgcgaaaaccgaaaaaaccaaaaaacgccaaata

SEQ ID NO: 10141 - DNA, 551 bp, Artificial Sequence
  chemically treated genomic DNA (Homo sapiens) CpG-island No: 10141
gagagcgttatcgcgagtgttatttagcgaatagtttagatcggggtataaagttacgttagtttagatacgttaacgttagttaggtgggtttacgatagtttagcgtttttgaatatacgtagatttaggttagttttatatagttaattcggttatatcgttttagatagcgtaagtttagattagtttagtgttacgttacgttatacgattaacgcgtagcgttagttgtattaagtttagtttagtttatacgagttaagtcgagttacgtcgagtttagtatggaacgtagaggcgtaacgtcgagtttagtagcgattaaagtcgtacgttagttttagtcggcgggacgagttgaagttcgacggcggattgtatttcgagtagagttgaaaatcgagtggtaagcgtatagcgggaggtcgtcgagacgtcggtggtagttgtcggggaggggtgcgcgtttacggattggtagatagaagggataagatgtttattggtatgtaatacgattgaggatattacgttcgatagttttagtt

SEQ ID NO: 10142 - DNA, 551 bp, Artificial Sequence
  chemically treated genomic DNA (Homo sapiens) CpG-island No: 10142
aactaaaactatcgaacgtaatatcctcaatcgtattacataccaataaacatcttatcccttctatctaccaatccgtaaacgcgcacccctccccgacaactaccaccgacgtctcgacgacctcccgctatacgcttaccactcgattttcaactctactcgaaatacaatccgccgtcgaacttcaactcgtcccgccgactaaaactaacgtacgactttaatcgctactaaactcgacgttacgcctctacgttccatactaaactcgacgtaactcgacttaactcgtataaactaaactaaacttaatacaactaacgctacgcgttaatcgtataacgtaacgtaacactaaactaatctaaacttacgctatctaaaacgatataaccgaattaactatataaaactaacctaaatctacgtatattcaaaaacgctaaactatcgtaaacccacctaactaacgttaacgtatctaaactaacgtaactttataccccgatctaaactattcgctaaataacactcgcgataacgctctc

SEQ ID NO: 10143 - DNA, 551 bp, Artificial Sequence
  chemically treated genomic DNA (Homo sapiens) CpG-island No: 10143
aattgaggttgtcgggcgtgatatttttaatcgtgttgtatgttaatggatattttgttttttttgtttattagttcgtgggcgcgtattttttttcggtaattgttatcggcgtttcgacgatttttcgttgtgcgtttgttattcggtttttaattttgttcgaaatgtagttcgtcgtcgggttttagttcgtttcgtcgattgaaattggcgtacgattttagtcgttgttgaattcgacgttgcgtttttacgttttatgttgaattcgacgtggttcggtttagttcgtgtgaattgagttgagtttagtgtaattggcgttgcgcgttagtcgtgtgacgtgacgtgatattgaattggtttgagtttacgttgtttgaagcgatgtggtcgagttagttatgtggaattgatttgggtttacgtgtgtttaaggacgttggattgtcgtgaatttatttggttgacgttaacgtgtttgaattgacgtggttttgtgtttcgatttgggttgttcgttgaatgatattcgcggtgacgttttt

SEQ ID NO: 10144 - DNA, 551 bp, Artificial Sequence
  chemically treated genomic DNA (Homo sapiens) CpG-island No: 10144
aaaaacgtcaccgcgaatatcattcaacgaacaacccaaatcgaaacacaaaaccacgtcaattcaaacacgttaacgtcaaccaaataaattcacgacaatccaacgtccttaaacacacgtaaacccaaatcaattccacataactaactcgaccacatcgcttcaaacaacgtaaactcaaaccaattcaatatcacgtcacgtcacacgactaacgcgcaacgccaattacactaaactcaactcaattcacacgaactaaaccgaaccacgtcgaattcaacataaaacgtaaaaacgcaacgtcgaattcaacaacgactaaaatcgtacgccaatttcaatcgacgaaacgaactaaaacccgacgacgaactacatttcgaacaaaattaaaaaccgaataacaaacgcacaacgaaaaatcgtcgaaacgccgataacaattaccgaaaaaaaatacgcgcccacgaactaataaacaaaaaaaacaaaatatccattaacatacaacacgattaaaaatatcacgcccgacaacctcaatt

SEQ ID NO: 10145 - DNA, 647 bp, Artificial Sequence
  chemically treated genomic DNA (Homo sapiens) CpG-island No: 10145
  misc_feature (21)..(21): n is either a, c, g or t
  misc_feature (265)..(265): n is either a, c, g or t
tgcgacgttggcgcgttttantttaggttttattaaattttgagtcgtaggtcggattaggcgtttacgttgtattcggtatttcgggagttttttgaattgtcgaatcgatttgcggcggtcgtgttttatttaggttttataaatcgagtcgtaggtcggataaggcgtttacgtcgtattcggtatttcgatattagattttatatgcgtcgttttcgtagttatcgttttggattgacggtattaagatcgttttggtgtnttcgattttgcgatattggcgtcgtaatttgatagtaggcgtacgaagtcggtgaatttttgggcgatggcgatattgcgtagtttgttagtgtcggtgacgcgtgagagtaatatttgatgttggtagcggcgacggaggatttttttaacgcgttcgataacgttcgtcgcgttgttgtgtagttttaatttttgggtaggaaatagggggatcgtttattatcgggcggttgagtagttaggaagaattgatcggatagcggtttattatatttatttcggcgtgtggattgagaatgttgatggtattaagtaagtcgcgtaggatggcgttgtcgttacgattgtcgtaagtgtggttgtttagaataagtaatttt

SEQ ID NO: 10146 - DNA, 647 bp, Artificial Sequence
  chemically treated genomic DNA (Homo sapiens) CpG-island No: 10146
  misc_feature (383)..(383): n is either a, c, g or t
  misc_feature (627)..(627): n is either a, c, g or t
aaaattacttattctaaacaaccacacttacgacaatcgtaacgacaacgccatcctacgcgacttacttaataccatcaacattctcaatccacacgccgaaataaatataataaaccgctatccgatcaattcttcctaactactcaaccgcccgataataaacgatccccctatttcctacccaaaaattaaaactacacaacaacgcgacgaacgttatcgaacgcgttaaaaaaatcctccgtcgccgctaccaacatcaaatattactctcacgcgtcaccgacactaacaaactacgcaatatcgccatcgcccaaaaattcaccgacttcgtacgcctactatcaaattacgacgccaatatcgcaaaatcgaanacaccaaaacgatcttaataccgtcaatccaaaacgataactacgaaaacgacgcatataaaatctaatatcgaaataccgaatacgacgtaaacgccttatccgacctacgactcgatttataaaacctaaataaaacacgaccgccgcaaatcgattcgacaattcaaaaaactcccgaaataccgaatacaacgtaaacgcctaatccgacctacgactcaaaatttaataaaacctaaantaaaacgcgccaacgtcgca

SEQ ID NO: 10147 - DNA, 647 bp, Artificial Sequence
  chemically treated genomic DNA (Homo sapiens) CpG-island No: 10147
  misc_feature (383)..(383): n is either a, c, g or t
  misc_feature (627)..(627): n is either a, c, g or t
gaaattatttattttgggtaattatatttgcggtaatcgtggcgatagcgttattttgcgcggtttatttgatgttattaatatttttaatttatacgtcgaagtggatgtgatgagtcgttattcggttagttttttttggttgtttaatcgttcggtaatgggcgatttttttgttttttgtttaaaaattgaaattatataatagcgcggcgggcgttgtcgggcgcgttaaaaaagtttttcgtcgtcgttattagtattaggtattgtttttacgcgttatcgatattggtaagttgcgtaatatcgttatcgtttagggatttatcgatttcgtgcgtttgttgttaggttacgacgttaatatcgtagggtcgggngtattaagacgattttggtgtcgttaatttaggacgatggttgcgaaagcggcgtatgtaagatttgatatcgagatgtcggatgcggcgtaaacgttttattcggtttacggttcggtttgtaaggtttagataagatacggtcgtcgtaggtcgattcgataatttaaaggattttcggggtgtcggatgtagcgtgaacgtttaattcggtttacggtttaggatttagtaaggtttggantaagacgcgttagcgtcgta

SEQ ID NO: 10148 - DNA, 647 bp, Artificial Sequence
  chemically treated genomic DNA (Homo sapiens) CpG-island No: 10148
  misc_feature (21)..(21): n is either a, c, g or t
  misc_feature (265)..(265): n is either a, c, g or t
tacgacgctaacgcgtcttantccaaaccttactaaatcctaaaccgtaaaccgaattaaacgttcacgctacatccgacaccccgaaaatcctttaaattatcgaatcgacctacgacgaccgtatcttatctaaaccttacaaaccgaaccgtaaaccgaataaaacgtttacgccgcatccgacatctcgatatcaaatcttacatacgccgctttcgcaaccatcgtcctaaattaacgacaccaaaatcgtcttaatacncccgaccctacgatattaacgtcgtaacctaacaacaaacgcacgaaatcgataaatccctaaacgataacgatattacgcaacttaccaatatcgataacgcgtaaaaacaatacctaatactaataacgacgacgaaaaacttttttaacgcgcccgacaacgcccgccgcgctattatataatttcaatttttaaacaaaaaacaaaaaaatcgcccattaccgaacgattaaacaaccaaaaaaaactaaccgaataacgactcatcacatccacttcgacgtataaattaaaaatattaataacatcaaataaaccgcgcaaaataacgctatcgccacgattaccgcaaatataattacccaaaataaataatttc

SEQ ID NO: 10149 - DNA, 815 bp, Artificial Sequence
  chemically treated genomic DNA (Homo sapiens) CpG-island No: 10149
cgcggcgggcgtgatttatttttttttgggtcggtgcgtagaggttgtgtagtagattaatttgacgcgggttgattagcgatttgtcgttaaagtttagttgtttgatgtgggcggttttttgtagaaattcggtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacgattataggttttttcgatacgtaggattttttttttaatatttagaatattttgagcggtatcggttttcggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaagttaaatattacggtattagtcgggtagatgaacgagttgttgattatcgcgggattggatttagtataaaaatatgttgcgggggtgttattatacgttgtgtattaaacggcggggattgataattgagttattatttttttatacgggatggggtatgagtagggttaa

SEQ ID NO: 10150 - DNA, 815 bp, Artificial Sequence
  chemically treated genomic DNA (Homo sapiens) CpG-island No: 10150
ttaaccctactcataccccatcccgtataaaaaaataataactcaattatcaatccccgccgtttaatacacaacgtataataacacccccgcaacatatttttatactaaatccaatcccgcgataatcaacaactcgttcatctacccgactaataccgtaatatttaacttcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccgaaaaccgataccgctcaaaatattctaaatattaaaaaaaaaatcctacgtatcgaaaaaacctataatcgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaaccgaatttctacaaaaaaccgcccacatcaaacaactaaactttaacgacaaatcgctaatcaacccgcgtcaaattaatctactacacaacctctacgcaccgacccaaaaaaaaataaatcacgcccgccgcg

SEQ ID NO: 10151 - DNA, 815 bp, Artificial Sequence
  chemically treated genomic DNA (Homo sapiens) CpG-island No: 10151
ttaattttgtttatgttttatttcgtgtggagggatggtagtttagttgttaattttcgtcgtttggtgtataacgtataatggtattttcgtagtatgtttttgtgttgggtttaatttcgcgatggttagtaattcgtttatttattcggttgatgtcgtgatgtttgatttcggagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgtcgaaaatcgatatcgtttaggatgttttggatattgaaaaagagattttgcgtatcgaaaaagtttgtggtcgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtcggatttttgtaagaagtcgtttatattaaatagttgggttttgacggtaaatcgttgattaattcgcgttagattgatttgttgtataatttttacgtatcgatttagaaagaagtggattacgttcgtcgcg

SEQ ID NO: 10152 - DNA, 815 bp, Artificial Sequence
  chemically treated genomic DNA (Homo sapiens) CpG-island No: 10152
cgcgacgaacgtaatccacttctttctaaatcgatacgtaaaaattatacaacaaatcaatctaacgcgaattaatcaacgatttaccgtcaaaacccaactatttaatataaacgacttcttacaaaaatccgacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacgaccacaaactttttcgatacgcaaaatctctttttcaatatccaaaacatcctaaacgatatcgattttcgacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatctccgaaatcaaacatcacgacatcaaccgaataaataaacgaattactaaccatcgcgaaattaaacccaacacaaaaacatactacgaaaataccattatacgttatacaccaaacgacgaaaattaacaactaaactaccatccctccacacgaaataaaacataaacaaaattaa

SEQ ID NO: 10153 - DNA, 571 bp, Artificial Sequence
  chemically treated genomic DNA (Homo sapiens) CpG-island No: 10153
ttgacggttacggttttagttttattttcggttcgttgatttatgtcggttttattttggggatgatcgttggacgttttatcggcggttggtttatcgatcgttatagtcgcgttgtcgtggttcgggttagtgtattaatgggggcgttgggtattgggttgattatttttgtcgatagcgtttgggtcgttggggtgtttgttgtattttggggattgggtgtttcgttgggtttttcgttgattatttttgtcgttagcgatatcgtttcgagtattaatttttttgatacgattttagttcggtattcggaaggtgatgttagtattggtagtaggttgtttaatcgtgattaagttttcggaaattacgttattgacgatgttgcgcgtggcggaattggttagcgaggttggtatttttgatggcgtttttaatgtcgttatcgggttaggtgttgtatgcggcgcggttttgacgttatatttttatgttgcgaaaattagttttatcggtttaatcgcgacgggaaaaggtattgttagaattgttgttgattatttaacgt

SEQ ID NO: 10154 - DNA, 571 bp, Artificial Sequence
  chemically treated genomic DNA (Homo sapiens) CpG-island No: 10154
acgttaaataatcaacaacaattctaacaataccttttcccgtcgcgattaaaccgataaaactaattttcgcaacataaaaatataacgtcaaaaccgcgccgcatacaacacctaacccgataacgacattaaaaacgccatcaaaaataccaacctcgctaaccaattccgccacgcgcaacatcgtcaataacgtaatttccgaaaacttaatcacgattaaacaacctactaccaatactaacatcaccttccgaataccgaactaaaatcgtatcaaaaaaattaatactcgaaacgatatcgctaacgacaaaaataatcaacgaaaaacccaacgaaacacccaatccccaaaatacaacaaacaccccaacgacccaaacgctatcgacaaaaataatcaacccaatacccaacgcccccattaatacactaacccgaaccacgacaacgcgactataacgatcgataaaccaaccgccgataaaacgtccaacgatcatccccaaaataaaaccgacataaatcaacgaaccgaaaataaaactaaaaccgtaaccgtcaa

SEQ ID NO: 10155 - DNA, 571 bp, Artificial Sequence
  chemically treated genomic DNA (Homo sapiens) CpG-island No: 10155
gcgttaagtgattagtagtagttttggtaatattttttttcgtcgcggttgaatcggtaaaattgattttcgtaatatgaggatgtgacgttagggtcgcgtcgtatatagtatttgattcggtgacgatattaaaaacgttattagggatattagtttcgttggttagtttcgttacgcgtaatatcgttagtggcgtggttttcgaaggtttaattacgattgaatagtttgttgttagtgttggtattatttttcgggtatcgagttaaagtcgtattaaaagggttggtgttcggggcggtatcgttggcggtagaaatggttagcgggaagtttagcgaggtatttagtttttagagtataatagatattttagcgatttaggcgttatcgataaaaataattagtttaatatttaacgtttttattagtgtattggttcgaattacggtaacgcgattgtaacggtcgatgaattaatcgtcggtgaagcgtttaacggttatttttagggtaaaatcggtataaattagcgagtcggaagtagggttaaaatcgtgatcgttaa

SEQ ID NO: 10156 - DNA, 571 bp, Artificial Sequence
  chemically treated genomic DNA (Homo sapiens) CpG-island No: 10156
ttaacgatcacgattttaaccctacttccgactcgctaatttataccgattttaccctaaaaataaccgttaaacgcttcaccgacgattaattcatcgaccgttacaatcgcgttaccgtaattcgaaccaatacactaataaaaacgttaaatattaaactaattatttttatcgataacgcctaaatcgctaaaatatctattatactctaaaaactaaatacctcgctaaacttcccgctaaccatttctaccgccaacgataccgccccgaacaccaacccttttaatacgactttaactcgatacccgaaaaataataccaacactaacaacaaactattcaatcgtaattaaaccttcgaaaaccacgccactaacgatattacgcgtaacgaaactaaccaacgaaactaatatccctaataacgtttttaatatcgtcaccgaatcaaatactatatacgacgcgaccctaacgtcacatcctcatattacgaaaatcaattttaccgattcaaccgcgacgaaaaaaaatattaccaaaactactactaatcacttaacgc

SEQ ID NO: 10157 - DNA, 529 bp, Artificial Sequence
  chemically treated genomic DNA (Homo sapiens) CpG-island No: 10157
cgtttaacgggggaggcgattatcgcgttaattttcgtatcgttgattagaatgggtcgtcgtgtatcgttaggtggaatcggcgttcgcggattaattagtattttgttgtttatattatttagaattgggtacgttagtcgtgcggtggtatattcgggtcgggtttatttttcgaattatcgtgtttaaatgaacgtaggatttgaaagataagcgattattgttgcgcgaagcgttaggttatgttgcgtatattgttcgttagcgtattattatagtgatttgtataaggcgatcgagaacgtcgtttcggtaacgatttttcgtcgtttttagtggagtggttgacggataatggtttatgttatcgggttaatgaaatacgttagttcgttcggatgttgggatttgaatcgaagaatacggcggtgcggagttcggagagtaacggaatagtagagagtttcgtgaaaacgataaagcgtgattatattagtattatgtttaaattagacgggttaacggt

SEQ ID NO: 10158 - DNA, 529 bp, Artificial Sequence
  chemically treated genomic DNA (Homo sapiens) CpG-island No: 10158
accgttaacccgtctaatttaaacataatactaatataatcacgctttatcgttttcacgaaactctctactattccgttactctccgaactccgcaccgccgtattcttcgattcaaatcccaacatccgaacgaactaacgtatttcattaacccgataacataaaccattatccgtcaaccactccactaaaaacgacgaaaaatcgttaccgaaacgacgttctcgatcgccttatacaaatcactataataatacgctaacgaacaatatacgcaacataacctaacgcttcgcgcaacaataatcgcttatctttcaaatcctacgttcatttaaacacgataattcgaaaaataaacccgacccgaatataccaccgcacgactaacgtacccaattctaaataatataaacaacaaaatactaattaatccgcgaacgccgattccacctaacgatacacgacgacccattctaatcaacgatacgaaaattaacgcgataatcgcctcccccgttaaacg

SEQ ID NO: 10159 - DNA, 529 bp, Artificial Sequence
  chemically treated genomic DNA (Homo sapiens) CpG-island No: 10159
gtcgttaattcgtttggtttgggtatgatattgatgtagttacgttttatcgtttttacgaagttttttgttatttcgttatttttcggatttcgtatcgtcgtgtttttcggtttaagttttaatattcgggcgaattggcgtgttttattagttcggtagtatgaattattattcgttagttattttattggagacgacggaagatcgttgtcgaagcggcgttttcggtcgttttatatagattattgtagtgatgcgttggcgagtagtatgcgtagtatggtttggcgtttcgcgtaataatgatcgtttgttttttagattttgcgtttatttgaatacgataattcggaagataaattcggttcgggtatgttatcgtacggttggcgtatttagttttgggtggtataaataataaagtgttggttggttcgcgagcgtcgattttatttgacggtatacggcgatttattttggttaacggtgcggaagttggcgcggtgatcgtttttttcgttgagcg

SEQ ID NO: 10160 - DNA, 529 bp, Artificial Sequence
  chemically treated genomic DNA (Homo sapiens) CpG-island No: 10160
cgctcaacgaaaaaaacgatcaccgcgccaacttccgcaccgttaaccaaaataaatcgccgtataccgtcaaataaaatcgacgctcgcgaaccaaccaacactttattatttataccacccaaaactaaatacgccaaccgtacgataacatacccgaaccgaatttatcttccgaattatcgtattcaaataaacgcaaaatctaaaaaacaaacgatcattattacgcgaaacgccaaaccatactacgcatactactcgccaacgcatcactacaataatctatataaaacgaccgaaaacgccgcttcgacaacgatcttccgtcgtctccaataaaataactaacgaataataattcatactaccgaactaataaaacacgccaattcgcccgaatattaaaacttaaaccgaaaaacacgacgatacgaaatccgaaaaataacgaaataacaaaaaacttcgtaaaaacgataaaacgtaactacatcaatatcatacccaaaccaaacgaattaacgac

SEQ ID NO: 10161 - DNA, 968 bp, Artificial Sequence
  chemically treated genomic DNA (Homo sapiens) CpG-island No: 10161
tttttcgttgacgattttttattttagttcggttttcggaggggatcgagttcgtcgtttacggttcgcgtttcgcgttttcgcggatttattgttcggtcgggtattgtatttcgggtcgcggttgttcgttggtcgtcgttttttcgtcgtttcgcgtcgtggtcgtcgtttttcgcgtcggcgtttcggcgtagttcgcgtttggttacgtttcgggttggggtatagtttttcgatttatgcggtcgttcgcggtcgaaggggtttagtcggtttcgaacgattcggagtttttttcgtcggggtgttaggtagtggtcgtagttttttagtcgtcggggcggttttcgagggttcgtagagcgttttcgcgcgcgttatcgtggttcgttttacggtttttgattttgcgcgaggaggtgcggtcggaggttgaagggttcggacgcggcgtatgcgtatatacgtgtgcgggttgagtcgtcggggtttggagggggaatcgcgcgttgcggttgttgcgtttgtttcgttttcggacgtcgttggtttgttttttttgttagttgtgtggggattggtagagggtgtgagagcgggaaacgatcggacgagcggcggggagcgttttgggtgaggaggaggaagtttggttttaggtgtgaaggatgttgacgcgtttcggcgcgtcgcggtgttattttcggtttttgagcgttgttttacgtcgtagcgggttttttttagttgtgaagcgcggttgcgttttgttcgggttttttttcgtcgggacggttttaacgttcgagtttagcgggtttgggttttcgttgtcgggttaggttagttgtttcggggttgggagttacggtatcggggttggggcggagaagacgaattagtttaattcgattcggttaagtaagcgtagtagtgtgtgtttttggattatagtattttatgta

SEQ ID NO: 10162 - DNA, 968 bp, Artificial Sequence
  chemically treated genomic DNA (Homo sapiens) CpG-island No: 10162
tacataaaatactataatccaaaaacacacactactacgcttacttaaccgaatcgaattaaactaattcgtcttctccgccccaaccccgataccgtaactcccaaccccgaaacaactaacctaacccgacaacgaaaacccaaacccgctaaactcgaacgttaaaaccgtcccgacgaaaaaaaacccgaacaaaacgcaaccgcgcttcacaactaaaaaaaacccgctacgacgtaaaacaacgctcaaaaaccgaaaataacaccgcgacgcgccgaaacgcgtcaacatccttcacacctaaaaccaaacttcctcctcctcacccaaaacgctccccgccgctcgtccgatcgtttcccgctctcacaccctctaccaatccccacacaactaacaaaaaaaacaaaccaacgacgtccgaaaacgaaacaaacgcaacaaccgcaacgcgcgattccccctccaaaccccgacgactcaacccgcacacgtatatacgcatacgccgcgtccgaacccttcaacctccgaccgcacctcctcgcgcaaaatcaaaaaccgtaaaacgaaccacgataacgcgcgcgaaaacgctctacgaaccctcgaaaaccgccccgacgactaaaaaactacgaccactacctaacaccccgacgaaaaaaactccgaatcgttcgaaaccgactaaaccccttcgaccgcgaacgaccgcataaatcgaaaaactataccccaacccgaaacgtaaccaaacgcgaactacgccgaaacgccgacgcgaaaaacgacgaccacgacgcgaaacgacgaaaaaacgacgaccaacgaacaaccgcgacccgaaatacaatacccgaccgaacaataaatccgcgaaaacgcgaaacgcgaaccgtaaacgacgaactcgatcccctccgaaaaccgaactaaaataaaaaatcgtcaacgaaaaa

SEQ ID NO: 10163 - DNA, 968 bp, Artificial Sequence
  chemically treated genomic DNA (Homo sapiens) CpG-island No: 10163
tatatgaaatattatgatttaagaatatatattgttgcgtttgtttaatcgggtcgagttgaattagttcgtttttttcgttttaatttcggtgtcgtaatttttagtttcggagtaattagtttggttcgatagcggaggtttaagttcgttgggttcgggcgttggaatcgtttcggcggggggaagttcgggtaggacgtagtcgcgttttatagttgaggaaaattcgttgcggcgtagggtaacgtttagaagtcgagagtggtatcgcgacgcgtcggaacgcgttagtattttttatatttaagattagatttttttttttttatttaggacgtttttcgtcgttcgttcggtcgtttttcgtttttatattttttgttagtttttatatagttgataagggaagtaagttagcggcgttcggggacggagtaagcgtagtagtcgtagcgcgcggttttttttttaggtttcggcgatttagttcgtatacgtgtatgcgtatgcgtcgcgttcgggttttttagttttcggtcgtattttttcgcgtagggttagaggtcgtggggcgggttacggtgacgcgcgcggaagcgttttgcgggttttcggaaatcgtttcggcggttgagaggttgcggttattgtttggtatttcgacgggaggggtttcggatcgttcggagtcggttgaattttttcggtcgcgagcgatcgtatgagtcgggggattatgttttagttcgaagcgtggttaggcgcgagttgcgtcgagacgtcggcgcgggaggcggcggttacggcgcgggacggcgggaaggcggcggttagcgggtagtcgcggttcgagatgtagtgttcggtcgagtagtgagttcgcgggggcgcggggcgcgggtcgtgggcggcgggttcggtttttttcggaagtcgggttggggtggggagtcgttagcggaggg

SEQ ID NO: 10164 - DNA, 968 bp, Artificial Sequence
  chemically treated genomic DNA (Homo sapiens) CpG-island No: 10164
ccctccgctaacgactccccaccccaacccgacttccgaaaaaaaccgaacccgccgcccacgacccgcgccccgcgcccccgcgaactcactactcgaccgaacactacatctcgaaccgcgactacccgctaaccgccgccttcccgccgtcccgcgccgtaaccgccgcctcccgcgccgacgtctcgacgcaactcgcgcctaaccacgcttcgaactaaaacataatcccccgactcatacgatcgctcgcgaccgaaaaaattcaaccgactccgaacgatccgaaacccctcccgtcgaaataccaaacaataaccgcaacctctcaaccgccgaaacgatttccgaaaacccgcaaaacgcttccgcgcgcgtcaccgtaacccgccccacgacctctaaccctacgcgaaaaaatacgaccgaaaactaaaaaacccgaacgcgacgcatacgcatacacgtatacgaactaaatcgccgaaacctaaaaaaaaaaccgcgcgctacgactactacgcttactccgtccccgaacgccgctaacttacttcccttatcaactatataaaaactaacaaaaaatataaaaacgaaaaacgaccgaacgaacgacgaaaaacgtcctaaataaaaaaaaaaaaatctaatcttaaatataaaaaatactaacgcgttccgacgcgtcgcgataccactctcgacttctaaacgttaccctacgccgcaacgaattttcctcaactataaaacgcgactacgtcctacccgaacttccccccgccgaaacgattccaacgcccgaacccaacgaacttaaacctccgctatcgaaccaaactaattactccgaaactaaaaattacgacaccgaaattaaaacgaaaaaaacgaactaattcaactcgacccgattaaacaaacgcaacaatatatattcttaaatcataatatttcatata

SEQ ID NO: 10165 - DNA, 587 bp, Artificial Sequence
  chemically treated genomic DNA (Homo sapiens) CpG-island No: 10165
  misc_feature (226)..(226): n is either a, c, g or t
ttggtaagtttttttggaaattaagtcgaaacgcggttattaagttttggttaggtttgtcgtggatttgggttattgtttcgcgttggatcggagtaatataatagtgcgtcgtatattgggttgttaattatgtatatagtatgtggcgtttacgggtttcgattggtagtttacgtttatttacgttttaacgtttttagcgttttattttgttttatgaatnacgtgggggtattttttttaagaaggtttgtaatttggcgagaggttatcgtatatacggcgttgaggcgatttgtggtttcggttcggtttgtttacgatagcggttaggttggatttgcggggagaaatattcgtggtttcgattgagtcgataatttgttaatcggcgtattggcgaggttattagtcgtttttcgttttacggtttaggcgttgggtcggtagatttaggtcgaatattaagggtattcgttaattcggagttaagtttttttttacgtaaaattaagttttgacggtcgagacgcgttgaaaaatggggtagaaaattgtgatagattcgttgtaatggtcggggt

SEQ ID NO: 10166 - DNA, 587 bp, Artificial Sequence
  chemically treated genomic DNA (Homo sapiens) CpG-island No: 10166
  misc_feature (362)..(362): n is either a, c, g or t
accccgaccattacaacgaatctatcacaattttctaccccatttttcaacgcgtctcgaccgtcaaaacttaattttacgtaaaaaaaaacttaactccgaattaacgaatacccttaatattcgacctaaatctaccgacccaacgcctaaaccgtaaaacgaaaaacgactaataacctcgccaatacgccgattaacaaattatcgactcaatcgaaaccacgaatatttctccccgcaaatccaacctaaccgctatcgtaaacaaaccgaaccgaaaccacaaatcgcctcaacgccgtatatacgataacctctcgccaaattacaaaccttcttaaaaaaaatacccccacgtnattcataaaacaaaataaaacgctaaaaacgttaaaacgtaaataaacgtaaactaccaatcgaaacccgtaaacgccacatactatatacataattaacaacccaatatacgacgcactattatattactccgatccaacgcgaaacaataacccaaatccacgacaaacctaaccaaaacttaataaccgcgtttcgacttaatttccaaaaaaacttaccaa

SEQ ID NO: 10167 - DNA, 587 bp, Artificial Sequence
  chemically treated genomic DNA (Homo sapiens) CpG-island No: 10167
  misc_feature (362)..(362): n is either a, c, g or t
atttcggttattgtaacgggtttgttataattttttgttttattttttaacgcgtttcggtcgttaaaatttggttttgcgtaaaagggagtttgatttcgggttggcgggtgtttttgatattcggtttaagtttatcggtttaacgtttgggtcgtaaaacggggggcgattggtggtttcgttaatgcgtcgattaataggttgtcggtttaatcgggattacgggtattttttttcgtaggtttagtttgatcgttgtcgtgaatagatcggatcggggttataagtcgttttaacgtcgtgtgtgcgatggtttttcgttaggttgtagatttttttaggagggatgtttttacgtngtttatagagtaggatgaagcgttgggagcgttaaaacgtagataagcgtgggttgttaatcgaggttcgtaggcgttatatgttgtatatatagttagtagtttagtgtgcgacgtattgttgtgttgtttcgatttagcgcgaggtagtagtttaagtttacggtaggtttagttagaatttagtggtcgcgtttcgatttggtttttagaaagatttattag

SEQ ID NO: 10168 - DNA, 587 bp, Artificial Sequence
  chemically treated genomic DNA (Homo sapiens) CpG-island No: 10168
  misc_feature (226)..(226): n is either a, c, g or t
ctaataaatctttctaaaaaccaaatcgaaacgcgaccactaaattctaactaaacctaccgtaaacttaaactactacctcgcgctaaatcgaaacaacacaacaatacgtcgcacactaaactactaactatatatacaacatataacgcctacgaacctcgattaacaacccacgcttatctacgttttaacgctcccaacgcttcatcctactctataaacnacgtaaaaacatccctcctaaaaaaatctacaacctaacgaaaaaccatcgcacacacgacgttaaaacgacttataaccccgatccgatctattcacgacaacgatcaaactaaacctacgaaaaaaaatacccgtaatcccgattaaaccgacaacctattaatcgacgcattaacgaaaccaccaatcgccccccgttttacgacccaaacgttaaaccgataaacttaaaccgaatatcaaaaacacccgccaacccgaaatcaaactcccttttacgcaaaaccaaattttaacgaccgaaacgcgttaaaaaataaaacaaaaaattataacaaacccgttacaataaccgaaat

SEQ ID NO: 10169 - DNA, 916 bp, Artificial Sequence
  chemically treated genomic DNA (Homo sapiens) CpG-island No: 10169
  misc_feature (745)..(745): n is either a, c, g or t
  misc_feature (748)..(748): n is either a, c, g or t
cgacgtaggcgtcgttcgtgacgatgatgacgtcgtagttgttttagtcgagttgttttattttcgttcggtttatgggtaggaagggtgcggggtcgaaacgtttggtttagaaggggcggtaagcggttagggttttcggggcggtaacgggtagtgcggatataagaggtggattgtcgacggtaggtttagaaagtataaagttcgcgtagggcgcgggttcggggtatagggtcggggcgtgaattatagcgcgcggatgttcgcggtttgtaggtttttggggttttgttttatttcgaattcgatttgggcgttttcggttagagtgcggaagtcgtcgttgtttttgatttcgttgtgatgggcgaataggtttttgtcgtcgtcggcgggggtgatgaagtcgaagtttttgtcgtcgttaaattatttgacgatgtcggattgtatggtgtttatgaaaatttttttggtgtcgttgaattaaattcgtttttagttcgagcggttgcggtgaaatataatatataagattagacgggacggcgtcggcggcgataagtcgatcgaagcgtaagattgtaagggtttaggtcgttagtaacgtttgggcggtcgtcgttatgttacgagtacgcggcgaatcgtttgttataaggtttttttcgaagacggcgtaggcgtagtcgcggtaggcgtcgtaggtcgtggtatacggcgtaagtcgtcgttgtagagnttntcgaaattcggggtaagttcggagcgatgtcggcgagcgggcgatggttacggggtcggggagatcgcgggtggtagattattaatagcgtttttatgtcgatttagtatttaataattttttcgttgggtattaagaatttcggttaggatattaaatatggttcgt

SEQ ID NO: 10170 - DNA, 916 bp, Artificial Sequence
  chemically treated genomic DNA (Homo sapiens) CpG-island No: 10170
  misc_feature (169)..(169): n is either a, c, g or t
  misc_feature (172)..(172): n is either a, c, g or t
acgaaccatatttaatatcctaaccgaaattcttaatacccaacgaaaaaattattaaatactaaatcgacataaaaacgctattaataatctaccacccgcgatctccccgaccccgtaaccatcgcccgctcgccgacatcgctccgaacttaccccgaatttcganaanctctacaacgacgacttacgccgtataccacgacctacgacgcctaccgcgactacgcctacgccgtcttcgaaaaaaaccttataacaaacgattcgccgcgtactcgtaacataacgacgaccgcccaaacgttactaacgacctaaacccttacaatcttacgcttcgatcgacttatcgccgccgacgccgtcccgtctaatcttatatattatatttcaccgcaaccgctcgaactaaaaacgaatttaattcaacgacaccaaaaaaattttcataaacaccatacaatccgacatcgtcaaataatttaacgacgacaaaaacttcgacttcatcacccccgccgacgacgacaaaaacctattcgcccatcacaacgaaatcaaaaacaacgacgacttccgcactctaaccgaaaacgcccaaatcgaattcgaaataaaacaaaaccccaaaaacctacaaaccgcgaacatccgcgcgctataattcacgccccgaccctataccccgaacccgcgccctacgcgaactttatactttctaaacctaccgtcgacaatccacctcttatatccgcactacccgttaccgccccgaaaaccctaaccgcttaccgccccttctaaaccaaacgtttcgaccccgcacccttcctacccataaaccgaacgaaaataaaacaactcgactaaaacaactacgacgtcatcatcgtcacgaacgacgcctacgtcg

SEQ ID NO: 10171 - DNA, 916 bp, Artificial Sequence
  chemically treated genomic DNA (Homo sapiens) CpG-island No: 10171
  misc_feature (169)..(169): n is either a, c, g or t
  misc_feature (172)..(172): n is either a, c, g or t
acgaattatatttggtgttttggtcgagatttttaatgtttagcgagaagattgttgggtattgaatcgatataaaggcgttgttggtggtttgttattcgcggttttttcgatttcgtgattatcgttcgttcgtcggtatcgtttcgggtttgtttcgaatttcganggnttttgtagcgacgatttgcgtcgtgtgttacggtttgcggcgtttgtcgcgattgcgtttgcgtcgttttcgaagagagttttgtggtaggcggttcgtcgcgtgttcgtggtatggcggcggtcgtttaggcgttgttggcggtttgagtttttataattttgcgtttcggtcggtttgtcgtcgtcggcgtcgtttcgtttgattttgtgtgttgtgttttatcgtagtcgttcgggttgagggcgaatttgatttaacgatattaaggaaatttttatgagtattatgtaattcggtatcgttaagtggtttgacgacggtaagggtttcggttttattattttcgtcgacggcggtaaggatttgttcgtttattatagcgaaattaagaataacggcggttttcgtattttggtcgaaggcgtttaggtcgagttcgaagtgaagtagggttttaagggtttgtaagtcgcgaatattcgcgcgttgtaatttacgtttcggttttgtgtttcgagttcgcgttttgcgcgggttttgtgttttttgggtttgtcgtcgataatttattttttatgttcgtattgttcgttgtcgtttcgaaggttttgatcgtttatcgttttttttgggttaagcgtttcggtttcgtattttttttgtttatgagtcgggcggagatggagtagttcggttgggatagttgcgacgttattatcgttacgggcgacgtttacgtcg

SEQ ID NO: 10172 - DNA, 916 bp, Artificial Sequence
  chemically treated genomic DNA (Homo sapiens) CpG-island No: 10172
  misc_feature (745)..(745): n is either a, c, g or t
  misc_feature (748)..(748): n is either a, c, g or t
cgacgtaaacgtcgcccgtaacgataataacgtcgcaactatcccaaccgaactactccatctccgcccgactcataaacaaaaaaaatacgaaaccgaaacgcttaacccaaaaaaaacgataaacgatcaaaaccttcgaaacgacaacgaacaatacgaacataaaaaataaattatcgacgacaaacccaaaaaacacaaaacccgcgcaaaacgcgaactcgaaacacaaaaccgaaacgtaaattacaacgcgcgaatattcgcgacttacaaacccttaaaaccctacttcacttcgaactcgacctaaacgccttcgaccaaaatacgaaaaccgccgttattcttaatttcgctataataaacgaacaaatccttaccgccgtcgacgaaaataataaaaccgaaacccttaccgtcgtcaaaccacttaacgataccgaattacataatactcataaaaatttccttaatatcgttaaatcaaattcgccctcaacccgaacgactacgataaaacacaacacacaaaatcaaacgaaacgacgccgacgacgacaaaccgaccgaaacgcaaaattataaaaactcaaaccgccaacaacgcctaaacgaccgccgccataccacgaacacgcgacgaaccgcctaccacaaaactctcttcgaaaacgacgcaaacgcaatcgcgacaaacgccgcaaaccgtaacacacgacgcaaatcgtcgctacaaaanccntcgaaattcgaaacaaacccgaaacgataccgacgaacgaacgataatcacgaaatcgaaaaaaccgcgaataacaaaccaccaacaacgcctttatatcgattcaatacccaacaatcttctcgctaaacattaaaaatctcgaccaaaacaccaaatataattcgt

SEQ ID NO: 10173 - DNA, 603 bp, Artificial Sequence
  chemically treated genomic DNA (Homo sapiens) CpG-island No: 10173
  misc_feature (49)..(49): n is either a, c, g or t
tcgttacgcgcgatggttttttacgtttttttgttttttgggaggcgtngcggttggttttggatattcgtcgtttatttttcgttcgggcgggtttattttaattgggagcgtttagttcgtttttttgtttttttttagaatgttttattgtttatcgatagaattagcgagttattttataaatagtaattcgtagtcgaggtggagttatttattgcgtatcgcgttacgcgttttttgttttatttttttatgtcgatattttcgttaatttcgttatttcgttttattagcgtcgcgggaagttaggtttcgtttttcgtaggatcgaagtttcgtttttttttcgcgggggttatttttggtttcgttttattgagcgtatttttttttgtcgtttttttttttttatttgggaatttgaggatcgttattttggttcggtttcgtaggcgtacgtcggttttcggggtttcgtttttttgagggtaagtcgttttcgtttcgtttttttgtaaatatttatgggtatttggcgaatttgttgatttcgtttattattttagcgttatttgtatttaattatttacgaagtaaatt

SEQ ID NO: 10174 - DNA, 603 bp, Artificial Sequence
  chemically treated genomic DNA (Homo sapiens) CpG-island No: 10174
  misc_feature (555)..(555): n is either a, c, g or t
aatttacttcgtaaataattaaatacaaataacgctaaaataataaacgaaatcaacaaattcgccaaatacccataaatatttacaaaaaaacgaaacgaaaacgacttaccctcaaaaaaacgaaaccccgaaaaccgacgtacgcctacgaaaccgaaccaaaataacgatcctcaaattcccaaataaaaaaaaaaaaacgacaaaaaaaaatacgctcaataaaacgaaaccaaaaataacccccgcgaaaaaaaaacgaaacttcgatcctacgaaaaacgaaacctaacttcccgcgacgctaataaaacgaaataacgaaattaacgaaaatatcgacataaaaaaataaaacaaaaaacgcgtaacgcgatacgcaataaataactccacctcgactacgaattactatttataaaataactcgctaattctatcgataaacaataaaacattctaaaaaaaaacaaaaaaacgaactaaacgctcccaattaaaataaacccgcccgaacgaaaaataaacgacgaatatccaaaaccaaccgcnacgcctcccaaaaaacaaaaaaacgtaaaaaaccatcgcgcgtaacga

SEQ ID NO: 10175 - DNA, 603 bp, Artificial Sequence
  chemically treated genomic DNA (Homo sapiens) CpG-island No: 10175
  misc_feature (555)..(555): n is either a, c, g or t
ggtttatttcgtagatagttgggtataagtgacgttaggatgataggcggagttaataggttcgttagatatttatgagtatttataagggggcggggcgaaagcgatttgtttttaaaggggcggaatttcgagggtcggcgtgcgtttacgggatcgggttagggtgacgatttttaagtttttaagtagaggagaggaagcggtagagggaggtgcgtttagtggggcggagttaagggtggttttcgcgggaggagggcggggtttcggttttgcgaggggcgggatttgatttttcgcggcgttgatggggcgggatgacgaagttgacgagggtgtcggtatgagggggtggagtaaggagcgcgtggcgcggtgcgtagtgggtggttttatttcgattgcgaattattgtttatgaggtgattcgttggttttatcggtggatagtgggatattttgaagggaggtaaggaggcggattgagcgtttttaattggggtgagttcgttcgagcggagagtggacggcgggtgtttaggattagtcgtngcgttttttaaggggtaagaaaacgtggggaattatcgcgcgtgacgg

SEQ ID NO: 10176 - DNA, 603 bp, Artificial Sequence
  chemically treated genomic DNA (Homo sapiens) CpG-island No: 10176
  misc_feature (49)..(49): n is either a, c, g or t
ccgtcacgcgcgataattccccacgttttcttaccccttaaaaaacgcnacgactaatcctaaacacccgccgtccactctccgctcgaacgaactcaccccaattaaaaacgctcaatccgcctccttacctcccttcaaaatatcccactatccaccgataaaaccaacgaatcacctcataaacaataattcgcaatcgaaataaaaccacccactacgcaccgcgccacgcgctccttactccaccccctcataccgacaccctcgtcaacttcgtcatcccgccccatcaacgccgcgaaaaatcaaatcccgcccctcgcaaaaccgaaaccccgccctcctcccgcgaaaaccacccttaactccgccccactaaacgcacctccctctaccgcttcctctcctctacttaaaaacttaaaaatcgtcaccctaacccgatcccgtaaacgcacgccgaccctcgaaattccgcccctttaaaaacaaatcgctttcgccccgcccccttataaatactcataaatatctaacgaacctattaactccgcctatcatcctaacgtcacttatacccaactatctacgaaataaacc

SEQ ID NO: 10177 - DNA, 640 bp, Artificial Sequence
  chemically treated genomic DNA (Homo sapiens) CpG-island No: 10177
aattatttttcggaagttttggttatttatcgattagttttagtttttggtcgagacgagatttttcgaagggttttcgcggggttatataagttttgcgataaatttagtttcgggttattggtatgttggtttcgttttttcgtttgcgtttgcgcgggagagaagtgtgagcgtaagggttttaaacggcgtttgcgtagttttataattacgttaaaatttcgcggagtttagattcgatttcgcgagaataatttttaacgtttttatagttagtatttgtttttataatcgtgttgtattttcgtttaattattttgttttgttttttaacgtttttagtttatttatggaaattcggaaggttcgggttattatttaatttaaattttagagaaaaagtatatcgtcgtattttatttaagtaaattattcggttattgagaaagaggcgcgtaagcgttacggttgcgtttttatagtaacgtcggcgtttcgtgacgtttttacgtattacgtacgttagagttaattagaagaggcgttggttggttgagaagtagtggagacgtgaggttgggttagagcggcgtgttaatttgggaggattaggtttttttcggttagggagtggaaa

SEQ ID NO: 10178 - DNA, 640 bp, Artificial Sequence
  chemically treated genomic DNA (Homo sapiens) CpG-island No: 10178
tttccactccctaaccgaaaaaaacctaatcctcccaaattaacacgccgctctaacccaacctcacgtctccactacttctcaaccaaccaacgcctcttctaattaactctaacgtacgtaatacgtaaaaacgtcacgaaacgccgacgttactataaaaacgcaaccgtaacgcttacgcgcctctttctcaataaccgaataatttacttaaataaaatacgacgatatactttttctctaaaatttaaattaaataataacccgaaccttccgaatttccataaataaactaaaaacgttaaaaaacaaaacaaaataattaaacgaaaatacaacacgattataaaaacaaatactaactataaaaacgttaaaaattattctcgcgaaatcgaatctaaactccgcgaaattttaacgtaattataaaactacgcaaacgccgtttaaaacccttacgctcacacttctctcccgcgcaaacgcaaacgaaaaaacgaaaccaacataccaataacccgaaactaaatttatcgcaaaacttatataaccccgcgaaaacccttcgaaaaatctcgtctcgaccaaaaactaaaactaatcgataaataaccaaaacttccgaaaaataatt

SEQ ID NO: 10179 - DNA, 640 bp, Artificial Sequence
  chemically treated genomic DNA (Homo sapiens) CpG-island No: 10179
tttttattttttggtcggaaaaaatttagtttttttaggttagtacgtcgttttagtttagttttacgtttttattgttttttagttagttaacgttttttttgattggttttgacgtgcgtggtgcgtgaaaacgttacgagacgtcggcgttattataagagcgtagtcgtggcgtttgcgcgttttttttttagtgatcgggtggtttgtttaggtgaggtgcggcggtgtgttttttttttagggtttgggttggatggtggttcgggtttttcgagtttttatgagtaagttaaagacgttaggaaatagagtagggtggttgaacgggagtgtagtacggttgtgggggtagatattgattatgagagcgttggaggttattttcgcgagatcggatttgggtttcgcgaggttttggcgtagttgtgggattgcgtaggcgtcgtttggagtttttacgtttatatttttttttcgcgtaggcgtagacggggaagcggagttaatatgttagtggttcggagttgggtttgtcgtaaaatttatgtgatttcgcggagatttttcgagaaatttcgtttcgattaagagttgaagttgatcggtgagtggttaaggttttcgggaagtggtt

SEQ ID NO: 10180 - DNA, 640 bp, Artificial Sequence
  chemically treated genomic DNA (Homo sapiens) CpG-island No: 10180
aaccacttcccgaaaaccttaaccactcaccgatcaacttcaactcttaatcgaaacgaaatttctcgaaaaatctccgcgaaatcacataaattttacgacaaacccaactccgaaccactaacatattaactccgcttccccgtctacgcctacgcgaaaaaaaaatataaacgtaaaaactccaaacgacgcctacgcaatcccacaactacgccaaaacctcgcgaaacccaaatccgatctcgcgaaaataacctccaacgctctcataatcaatatctacccccacaaccgtactacactcccgttcaaccaccctactctatttcctaacgtctttaacttactcataaaaactcgaaaaacccgaaccaccatccaacccaaaccctaaaaaaaaaacacaccgccgcacctcacctaaacaaaccacccgatcactaaaaaaaaaacgcgcaaacgccacgactacgctcttataataacgccgacgtctcgtaacgttttcacgcaccacgcacgtcaaaaccaatcaaaaaaaacgttaactaactaaaaaacaataaaaacgtaaaactaaactaaaacgacgtactaacctaaaaaaactaaattttttccgaccaaaaaataaaaa

SEQ ID NO: 10181 - DNA, 1205 bp, Artificial Sequence
  chemically treated genomic DNA (Homo sapiens) CpG-island No: 10181
cgtttcgcgtcgttttaaggcggaggttcgggagggggtcgattcggttcgttagttttacgttcggttttagatttcggtatttttttttcgttagttggcgcggtttcgtttttttttcggaagaggaaattttcggggttcgagtaatagggttaggcgcggagaggagcggcgggagagttaggagggtcgtttagggtaggaggcgagttaggtcgggttagaagttggtcgacggcggcgcgcgggggcgtcgggcggggagggtcgttgggtcggatttagcgcgtagtcggggtagggcgcggttcggggttcgagagcgtagggcgggtcgtagttggaaggaatatttgagttgggagaggaggtcgagttggagggcggtttttttcgggtttgcgttcgggaagtcgtcgcggaggaggagacggggatagcggggttgttcgggcgttgtgcgtatgttgggtttgggtcgtcgtcggggtttgttttttgggttgttcggttatcgtcgtttcgggcgttcggtatgtcggtgtattatatttttaatttacgcgttttttggtttttggtgatcggtttgtgtatcgttttggtgtgtttttattatgttttgcggggaagcgggggcgttcgggtcgagttcgtcgacggcgtggatggcggtttttcgttgtttaaggtggtcgttttgtttttttttagttatgtttttttgcgttgtcgttacgttgttcggtagcgttttttgttcgggttttttcgtttggagggttacgtcgtttttttttcgagatattttcgagagtcgggttttagtattttgttggagagttattacgagtatgaggtgcgtttgttttcgtacgtgttgggttatagtaaggcgtacgtgagtcggatcgtgggcgagttggtgcgggttggtcgcgttcgggggtttttcggttttatttttgggggagcgttggttttggtttttcgcggagattttatttaggtgggtagcgtttacgagtaatataaaattcgtcggttcgatagtttcgacgtgttggtgttattgcgtttttcgtcgtttgtggcgttggagttacggagtttgggcgaggagttagcgttggtttcggtttttcgcggttgttttttgtgcgtttttaaggtattatttttattatcgggggtttcggggg

SEQ ID NO: 10182 - DNA, 1205 bp, Artificial Sequence
  chemically treated genomic DNA (Homo sapiens) CpG-island No: 10182
cccccgaaacccccgataataaaaataataccttaaaaacgcacaaaaaacaaccgcgaaaaaccgaaaccaacgctaactcctcgcccaaactccgtaactccaacgccacaaacgacgaaaaacgcaataacaccaacacgtcgaaactatcgaaccgacgaattttatattactcgtaaacgctacccacctaaataaaatctccgcgaaaaaccaaaaccaacgctcccccaaaaataaaaccgaaaaacccccgaacgcgaccaacccgcaccaactcgcccacgatccgactcacgtacgccttactataacccaacacgtacgaaaacaaacgcacctcatactcgtaataactctccaacaaaatactaaaacccgactctcgaaaatatctcgaaaaaaaaacgacgtaaccctccaaacgaaaaaacccgaacaaaaaacgctaccgaacaacgtaacgacaacgcaaaaaaacataactaaaaaaaaacaaaacgaccaccttaaacaacgaaaaaccgccatccacgccgtcgacgaactcgacccgaacgcccccgcttccccgcaaaacataataaaaacacaccaaaacgatacacaaaccgatcaccaaaaaccaaaaaacgcgtaaattaaaaatataatacaccgacataccgaacgcccgaaacgacgataaccgaacaacccaaaaaacaaaccccgacgacgacccaaacccaacatacgcacaacgcccgaacaaccccgctatccccgtctcctcctccgcgacgacttcccgaacgcaaacccgaaaaaaaccgccctccaactcgacctcctctcccaactcaaatattccttccaactacgacccgccctacgctctcgaaccccgaaccgcgccctaccccgactacgcgctaaatccgacccaacgaccctccccgcccgacgcccccgcgcgccgccgtcgaccaacttctaacccgacctaactcgcctcctaccctaaacgaccctcctaactctcccgccgctcctctccgcgcctaaccctattactcgaaccccgaaaatttcctcttccgaaaaaaaaacgaaaccgcgccaactaacgaaaaaaaaataccgaaatctaaaaccgaacgtaaaactaacgaaccgaatcgaccccctcccgaacctccgccttaaaacgacgcgaaacg

SEQ ID NO: 10183 - DNA, 1205 bp, Artificial Sequence
  chemically treated genomic DNA (Homo sapiens) CpG-island No: 10183
ttttcgaggttttcgatggtgagggtggtgttttgagggcgtataagaagtagtcgcggaaggtcggggttagcgttggtttttcgtttaggtttcgtggttttagcgttataagcggcgggaggcgtagtggtattagtacgtcgaagttgtcgggtcggcggattttatgttgttcgtaggcgttgtttatttggatgaagttttcgcggaaggttaaggttagcgtttttttaggaatgagatcgggggattttcgggcgcggttagttcgtattagttcgtttacgattcggtttacgtgcgttttgttgtggtttaatacgtgcggagataggcgtattttatgttcgtagtaattttttagtaggatgttgaggttcggttttcggaagtgtttcgaggagaaggcggcgtgattttttagacggggagattcgggtaggaagcgttgtcggatagcgtggcgatagcgtaggaggatatagttgaggaggagtaggacggttattttaagtaacgggaagtcgttatttacgtcgtcggcgggttcggttcgggcgttttcgttttttcgtaggatatggtagaggtatattagggcggtgtataggtcggttattaggggttagaagacgcgtagattgagggtgtagtgtatcgatatgtcgggcgttcggggcggcggtggtcgagtagtttagggggtaagtttcggcggcgatttaagtttagtatgcgtatagcgttcgggtagtttcgttgttttcgttttttttttcgcggcggtttttcgaacgtaggttcgagggaggtcgttttttagttcggtttttttttttagtttaagtgttttttttagttgcggttcgttttgcgttttcgggtttcgggtcgcgttttgtttcggttgcgcgttgagttcggtttagcggtttttttcgttcggcgttttcgcgcgtcgtcgtcggttagtttttggttcggtttggttcgttttttattttgggcggtttttttggttttttcgtcgttttttttcgcgtttgattttgttattcggatttcgggagttttttttttcgagggggaggcgaggtcgcgttagttagcggggaggaaatgtcggagtttggagtcgagcgtggagttggcgagtcgggtcggttttttttcgggttttcgttttaaagcgacgcggggcg

SEQ ID NO: 10184 - DNA, 1205 bp, Artificial Sequence
  chemically treated genomic DNA (Homo sapiens) CpG-island No: 10184
cgccccgcgtcgctttaaaacgaaaacccgaaaaaaaaccgacccgactcgccaactccacgctcgactccaaactccgacatttcctccccgctaactaacgcgacctcgcctccccctcgaaaaaaaaaactcccgaaatccgaataacaaaatcaaacgcgaaaaaaaacgacgaaaaaaccaaaaaaaccgcccaaaataaaaaacgaaccaaaccgaaccaaaaactaaccgacgacgacgcgcgaaaacgccgaacgaaaaaaaccgctaaaccgaactcaacgcgcaaccgaaacaaaacgcgacccgaaacccgaaaacgcaaaacgaaccgcaactaaaaaaaacacttaaactaaaaaaaaaaaccgaactaaaaaacgacctccctcgaacctacgttcgaaaaaccgccgcgaaaaaaaaaacgaaaacaacgaaactacccgaacgctatacgcatactaaacttaaatcgccgccgaaacttaccccctaaactactcgaccaccgccgccccgaacgcccgacatatcgatacactacaccctcaatctacgcgtcttctaacccctaataaccgacctatacaccgccctaatatacctctaccatatcctacgaaaaaacgaaaacgcccgaaccgaacccgccgacgacgtaaataacgacttcccgttacttaaaataaccgtcctactcctcctcaactatatcctcctacgctatcgccacgctatccgacaacgcttcctacccgaatctccccgtctaaaaaatcacgccgccttctcctcgaaacacttccgaaaaccgaacctcaacatcctactaaaaaattactacgaacataaaatacgcctatctccgcacgtattaaaccacaacaaaacgcacgtaaaccgaatcgtaaacgaactaatacgaactaaccgcgcccgaaaatcccccgatctcattcctaaaaaaacgctaaccttaaccttccgcgaaaacttcatccaaataaacaacgcctacgaacaacataaaatccgccgacccgacaacttcgacgtactaataccactacgcctcccgccgcttataacgctaaaaccacgaaacctaaacgaaaaaccaacgctaaccccgaccttccgcgactacttcttatacgccctcaaaacaccaccctcaccatcgaaaacctcgaaaa

SEQ ID NO: 10185 - DNA, 600 bp, Artificial Sequence
  chemically treated genomic DNA (Homo sapiens) CpG-island No: 10185
gtttcggcgttttcggtttcgtttgcgttggggtcgttgtagttttcgtagttgtttcgggttgtttgtttaggcgtttcggttttattttagtttggggagcgtttcggtggggagtacgggatagcgagggaggtcgaggcgggggtattgggcgttcgatattttcgaatcggggaggcggtttcgatttcgagagtcggaacgtagggaaaggtaaggacggggcggtcggcggaggggcgggcgtcgtttattagttacgttagttacgtttggggttatcggttgtttttttttttttttttttttttgttttttttttttttcgttgttggcgagggtaaagtggtcgtggcggcgttatgttcgggtcggagtgagtgcgcgcgggcgaaaatggcgtatatttaggtagggttgaggttgggggtaaggttcggggtgcgggtagggggtgtcgcgtttttttcggttgggagcgcgcggaagggagggtttacggttaggtttttataaatttgtttcgagaaaaagggtgttcgtgcgcgggtaatttgtgtagtaataggggtgcgtttcgggaggagagattgggga

SEQ ID NO: 10186 - DNA, 600 bp, Artificial Sequence
  chemically treated genomic DNA (Homo sapiens) CpG-island No: 10186
tccccaatctctcctcccgaaacgcacccctattactacacaaattacccgcgcacgaacaccctttttctcgaaacaaatttataaaaacctaaccgtaaaccctcccttccgcgcgctcccaaccgaaaaaaacgcgacaccccctacccgcaccccgaaccttacccccaacctcaaccctacctaaatatacgccattttcgcccgcgcgcactcactccgacccgaacataacgccgccacgaccactttaccctcgccaacaacgaaaaaaaaaaaaaacaaaaaaaaaaaaaaaaaaaaaaacaaccgataaccccaaacgtaactaacgtaactaataaacgacgcccgcccctccgccgaccgccccgtccttacctttccctacgttccgactctcgaaatcgaaaccgcctccccgattcgaaaatatcgaacgcccaatacccccgcctcgacctccctcgctatcccgtactccccaccgaaacgctccccaaactaaaataaaaccgaaacgcctaaacaaacaacccgaaacaactacgaaaactacaacgaccccaacgcaaacgaaaccgaaaacgccgaaac

SEQ ID NO: 10187 - DNA, 600 bp, Artificial Sequence
  chemically treated genomic DNA (Homo sapiens) CpG-island No: 10187
tttttagttttttttttcggggcgtatttttgttgttgtataggttgttcgcgtacgggtattttttttttcgaagtaagtttgtgggagtttagtcgtgggttttttttttcgcgcgtttttagtcggagggggcgcggtattttttattcgtatttcggattttgtttttagttttagttttatttggatgtacgttattttcgttcgcgcgtatttatttcggttcgggtatggcgtcgttacggttattttgttttcgttaatagcggagggggaagaaagtaaagggggaaaggaagaaaaaggtagtcggtggttttagacgtgattggcgtggttgatgagcggcgttcgttttttcgtcggtcgtttcgtttttgtttttttttgcgtttcggttttcggaatcggggtcgttttttcggttcggagatatcgggcgtttagtgttttcgtttcggtttttttcgttgtttcgtgttttttatcgaggcgttttttaggttggaataaggtcggggcgtttgggtaagtagttcggggtagttgcggggattgtagcgattttagcgtaggcggggtcggagacgtcggggt

SEQ ID NO: 10188 - DNA, 600 bp, Artificial Sequence
  chemically treated genomic DNA (Homo sapiens) CpG-island No: 10188
accccgacgtctccgaccccgcctacgctaaaatcgctacaatccccgcaactaccccgaactacttacccaaacgccccgaccttattccaacctaaaaaacgcctcgataaaaaacacgaaacaacgaaaaaaaccgaaacgaaaacactaaacgcccgatatctccgaaccgaaaaaacgaccccgattccgaaaaccgaaacgcaaaaaaaaacaaaaacgaaacgaccgacgaaaaaacgaacgccgctcatcaaccacgccaatcacgtctaaaaccaccgactacctttttcttcctttccccctttactttcttccccctccgctattaacgaaaacaaaataaccgtaacgacgccatacccgaaccgaaataaatacgcgcgaacgaaaataacgtacatccaaataaaactaaaactaaaaacaaaatccgaaatacgaataaaaaataccgcgccccctccgactaaaaacgcgcgaaaaaaaaaacccacgactaaactcccacaaacttacttcgaaaaaaaaaatacccgtacgcgaacaacctatacaacaacaaaaatacgccccgaaaaaaaaaactaaaaa

SEQ ID NO: 10189 - DNA, 710 bp, Artificial Sequence
  chemically treated genomic DNA (Homo sapiens) CpG-island No: 10189
tttgatcgatttggagtttttttatcgcgtttaattaggttgtttttcggtatcgttgatttttgttaatatcgtagtcggagatttttcgtttaggcgcgtgacgtttgtttttgattgtttgttttttaggtagtggtcgttttgataaagttaggcgcgtagattggtcgatttttagttaattgcgatgtagcgagttgttatgtgattttttttaattttcgtgtcgagttggcgattatggtaagcgtcgtttgttttgtcgtatcgtcgttttgatgtcgtatcgtatcgaatagcgttttatgtttttggagcgtttgcggtatgttggttttatcgtttatttaggttcgtttaaaaatcgttcgttgtagcgaattgatcgtaatgttaagttgttgtaatatcgggttatgtatcgattgtagtatcgtttcgtggtagcgaatattcgtttcgttaaacgtttcgcggttttgattgttggtaattatttcgtttagcgtcgatttaatttgcgttagatcgttggaagtcgcgcgttttgttgtttaacgggtaatcgtcggttttattagatttcgtatttcgtttatggtattgataagtcgtgggtcgtagttattttttagtatttattgtagtacgttagtgtcgaggtaattttattggttacgcggtgattagttcggtatttatagtga

SEQ ID NO: 10190 - DNA, 710 bp, Artificial Sequence
  chemically treated genomic DNA (Homo sapiens) CpG-island No: 10190
tcactataaataccgaactaatcaccgcgtaaccaataaaattacctcgacactaacgtactacaataaatactaaaaaataactacgacccacgacttatcaataccataaacgaaatacgaaatctaataaaaccgacgattacccgttaaacaacaaaacgcgcgacttccaacgatctaacgcaaattaaatcgacgctaaacgaaataattaccaacaatcaaaaccgcgaaacgtttaacgaaacgaatattcgctaccacgaaacgatactacaatcgatacataacccgatattacaacaacttaacattacgatcaattcgctacaacgaacgatttttaaacgaacctaaataaacgataaaaccaacataccgcaaacgctccaaaaacataaaacgctattcgatacgatacgacatcaaaacgacgatacgacaaaacaaacgacgcttaccataatcgccaactcgacacgaaaattaaaaaaaatcacataacaactcgctacatcgcaattaactaaaaatcgaccaatctacgcgcctaactttatcaaaacgaccactacctaaaaaacaaacaatcaaaaacaaacgtcacgcgcctaaacgaaaaatctccgactacgatattaacaaaaatcaacgataccgaaaaacaacctaattaaacgcgataaaaaaactccaaatcgatcaaa

SEQ ID NO: 10191 - DNA, 710 bp, Artificial Sequence
  chemically treated genomic DNA (Homo sapiens) CpG-island No: 10191
ttattataggtatcgagttgattatcgcgtaattagtggaattatttcgatattgacgtattgtaatgggtgttggaaaatgattacgatttacggtttattagtgttatgagcgaagtgcgaaatttggtggaatcggcgattgttcgttgggtagtagagcgcgcgatttttagcgatttggcgtagattgaatcggcgttgaacgagatgattgttaataattaggatcgcgaagcgtttaacgaagcggatattcgttattacgaggcggtgttgtagtcggtgtataattcggtgttatagtaatttagtattgcgattagttcgttgtagcgggcggtttttgaacgaatttggatgggcgatgaggttaatatgtcgtaaacgttttaggaatataaggcgttgttcgatgcgatacgatattaggacggcgatgcggtagagtaggcggcgtttattatgatcgttagttcgatacgaaggttaaaggaaattatatgatagttcgttatatcgtaattgattggggatcgattaatttgcgcgtttggttttattagggcgattattgtttggagagtaggtaattagaagtaggcgttacgcgtttgaacggaaaattttcggttgcggtgttagtagaagttagcggtatcgagggatagtttagttgggcgcgataaagagattttaaatcggttaaa

SEQ ID NO: 10192 - DNA, 710 bp, Artificial Sequence
  chemically treated genomic DNA (Homo sapiens) CpG-island No: 10192
tttaaccgatttaaaatctctttatcgcgcccaactaaactatccctcgataccgctaacttctactaacaccgcaaccgaaaattttccgttcaaacgcgtaacgcctacttctaattacctactctccaaacaataatcgccctaataaaaccaaacgcgcaaattaatcgatccccaatcaattacgatataacgaactatcatataatttcctttaaccttcgtatcgaactaacgatcataataaacgccgcctactctaccgcatcgccgtcctaatatcgtatcgcatcgaacaacgccttatattcctaaaacgtttacgacatattaacctcatcgcccatccaaattcgttcaaaaaccgcccgctacaacgaactaatcgcaatactaaattactataacaccgaattatacaccgactacaacaccgcctcgtaataacgaatatccgcttcgttaaacgcttcgcgatcctaattattaacaatcatctcgttcaacgccgattcaatctacgccaaatcgctaaaaatcgcgcgctctactacccaacgaacaatcgccgattccaccaaatttcgcacttcgctcataacactaataaaccgtaaatcgtaatcattttccaacacccattacaatacgtcaatatcgaaataattccactaattacgcgataatcaactcgatacctataataa

SEQ ID NO: 10193 - DNA, 557 bp, Artificial Sequence
  chemically treated genomic DNA (Homo sapiens) CpG-island No: 10193
gttgttcgtgttcgtgaagcggcgcgtcgcgcgcgtgaaatgattcgtcgtaaaggtgcgttcgatttagcgggtttgtcgggtaaattggtagattgttaggaacgcgattcggcgtttttcgaattgtatttggtggaaggggatttcgcgggcggttttgcgaagtaggggcgtaatcgtaagaattaggcgattttgtcgttgaagggtaaaatttttaacgtcgagaaagcgcgtttcgataagatgttttttttttaggaagtggcgacgtttattatcgcgtttggttgtggtatcggtcgtgacgagtataattcggataaattgcgttattatagtattattattatgatcgatgcggacgtcgacggttcgtatattcgtacgttgttgttgatttttttttatcgttagatggtcggaaatcgttgaacgcggttacgtttatttcggttaggcggcgtttttaaagtgtttaaaggtagtcggaatcgttttttaagacgaaaaaagttttttttagtgtttagtttgaggttttttagaagatt

SEQ ID NO: 10194 - DNA, 557 bp, Artificial Sequence
  chemically treated genomic DNA (Homo sapiens) CpG-island No: 10194
aatcttctaaaaaacctcaaactaaacactaaaaaaaacttttttcgtcttaaaaaacgattccgactacctttaaacactttaaaaacgccgcctaaccgaaataaacgtaaccgcgttcaacgatttccgaccatctaacgataaaaaaaaatcaacaacaacgtacgaatatacgaaccgtcgacgtccgcatcgatcataataataatactataataacgcaatttatccgaattatactcgtcacgaccgataccacaaccaaacgcgataataaacgtcgccacttcctaaaaaaaaaacatcttatcgaaacgcgctttctcgacgttaaaaattttacccttcaacgacaaaatcgcctaattcttacgattacgcccctacttcgcaaaaccgcccgcgaaatccccttccaccaaatacaattcgaaaaacgccgaatcgcgttcctaacaatctaccaatttacccgacaaacccgctaaatcgaacgcacctttacgacgaatcatttcacgcgcgcgacgcgccgcttcacgaacacgaacaac

SEQ ID NO: 10195 - DNA, 557 bp, Artificial Sequence
  chemically treated genomic DNA (Homo sapiens) CpG-island No: 10195
aattttttaaaaggttttagattagatattgaggagaatttttttcgttttaagggacggtttcggttgtttttgggtattttgaaagcgtcgtttgatcgaaatagacgtgatcgcgtttaacgattttcggttatttgacgatagaagaaggttaatagtagcgtacgaatgtgcgagtcgtcgacgttcgtatcggttatgatgatgatgttgtgataacgtagtttgttcgggttgtattcgttacgatcgatattatagttaagcgcggtgataagcgtcgttattttttgagaagagagtattttatcgaagcgcgttttttcgacgttgaggattttattttttagcggtagaatcgtttggtttttgcggttacgtttttgtttcgtagagtcgttcgcggagtttttttttattaggtatagttcggaaagcgtcggatcgcgtttttggtagtttgttagtttgttcggtaggttcgttaagtcgagcgtatttttacggcgggttattttacgcgcgcgacgcgtcgttttacgggtacgggtagt

SEQ ID NO: 10196 - DNA, 557 bp, Artificial Sequence
  chemically treated genomic DNA (Homo sapiens) CpG-island No: 10196
actacccgtacccgtaaaacgacgcgtcgcgcgcgtaaaataacccgccgtaaaaatacgctcgacttaacgaacctaccgaacaaactaacaaactaccaaaaacgcgatccgacgctttccgaactatacctaataaaaaaaaactccgcgaacgactctacgaaacaaaaacgtaaccgcaaaaaccaaacgattctaccgctaaaaaataaaatcctcaacgtcgaaaaaacgcgcttcgataaaatactctcttctcaaaaaataacgacgcttatcaccgcgcttaactataatatcgatcgtaacgaatacaacccgaacaaactacgttatcacaacatcatcatcataaccgatacgaacgtcgacgactcgcacattcgtacgctactattaaccttcttctatcgtcaaataaccgaaaatcgttaaacgcgatcacgtctatttcgatcaaacgacgctttcaaaatacccaaaaacaaccgaaaccgtcccttaaaacgaaaaaaattctcctcaatatctaatctaaaaccttttaaaaaatt

SEQ ID NO: 10197 - DNA, 766 bp, Artificial Sequence
  chemically treated genomic DNA (Homo sapiens) CpG-island No: 10197
tacgttgtgttgatttatttttttttttttcgagtgtggtgtatttaattattcgttgttttatatttttaaagtatttttatgagtttattatcggcggaatattaatattattcgcgatcgttagataattgcgtatttcgtgttgcgggcgtttaagcgttaaacgttggtttgtttttatcggtaatcgttagtcggtttagacggtattattatttagtcgcgtttcgtaatcggtattcgttagagtaaattatttattagtttcgaatttaatagttaattgatcgagcgtgatttttagcgcgggggtattggcgttattatttattagtaggttagtaatgcgtaacgcgggtatatttagtgcgtcgtagtggttgatattcgattggcgaaaatcgtgacgatcgttattttgtatagtggtatatatgttcgtacgaataatttttagtatattttttttttttgcggtataaagcgtacgttgtttttcggacgtaataagatgggttcgttacgcgtcggattaaataggttgagtgaggtatgattaattaattgttagttattcggcgttgttagcggataaatattagtttgcggttcgtcgatttcgatagaatttgtcggaacgagtaagcgcggtttagcgcgtcgtggcgtgtgtagttgtttcggtaaattttcgagatacgggaagttcggttgaaaatttaaaaattagattacgtattttacggaggagtgtaatttaata

SEQ ID NO: 10198 - DNA, 766 bp, Artificial Sequence
  chemically treated genomic DNA (Homo sapiens) CpG-island No: 10198
tattaaattacactcctccgtaaaatacgtaatctaatttttaaattttcaaccgaacttcccgtatctcgaaaatttaccgaaacaactacacacgccacgacgcgctaaaccgcgcttactcgttccgacaaattctatcgaaatcgacgaaccgcaaactaatatttatccgctaacaacgccgaataactaacaattaattaatcatacctcactcaacctatttaatccgacgcgtaacgaacccatcttattacgtccgaaaaacaacgtacgctttataccgcaaaaaaaaaaaatatactaaaaattattcgtacgaacatatataccactatacaaaataacgatcgtcacgattttcgccaatcgaatatcaaccactacgacgcactaaatatacccgcgttacgcattactaacctactaataaataataacgccaatacccccgcgctaaaaatcacgctcgatcaattaactattaaattcgaaactaataaataatttactctaacgaataccgattacgaaacgcgactaaataataataccgtctaaaccgactaacgattaccgataaaaacaaaccaacgtttaacgcttaaacgcccgcaacacgaaatacgcaattatctaacgatcgcgaataatattaatattccgccgataataaactcataaaaatactttaaaaatataaaacaacgaataattaaatacaccacactcgaaaaaaaaaaaaataaatcaacacaacgta

SEQ ID NO: 10199 - DNA, 766 bp, Artificial Sequence
  chemically treated genomic DNA (Homo sapiens) CpG-island No: 10199
tgttgaattgtattttttcgtggaatacgtggtttggtttttaggtttttaatcgggtttttcgtatttcgggagtttgtcggaataattatatacgttacggcgcgttgaatcgcgtttattcgtttcggtaggttttgtcgggatcggcgggtcgtagattggtgtttattcgttggtaacgtcgggtggttggtagttgattggttatattttatttagtttgtttgattcggcgcgtgacgaatttattttattacgttcgggagatagcgtgcgttttgtatcgtagaaggagggagtatgttgaagattattcgtgcgggtatgtatattattgtgtaggatggcggtcgttacggttttcgttagtcgggtattagttattgcggcgtattggatatgttcgcgttacgtattgttaatttattggtgggtaatgacgttaatgttttcgcgttggagattacgttcggttagttaattgttgagttcgaaattgatgggtggtttgttttgacgggtgtcggttgcgaagcgcggttggatgataatgtcgtttggatcggttggcgattgtcgatgaaagtaggttagcgtttaacgtttaaacgttcgtagtacgggatgcgtagttatttggcggtcgcgggtggtattgatgtttcgtcggtaatgggtttataggagtgttttaaagatgtgagatagcgggtggttaggtgtattatattcggggaaaagaagggtgggttaatataacgtg

SEQ ID NO: 10200 - DNA, 766 bp, Artificial Sequence
  chemically treated genomic DNA (Homo sapiens) CpG-island No: 10200
cacgttatattaacccacccttcttttccccgaatataatacacctaaccacccgctatctcacatctttaaaacactcctataaacccattaccgacgaaacatcaataccacccgcgaccgccaaataactacgcatcccgtactacgaacgtttaaacgttaaacgctaacctactttcatcgacaatcgccaaccgatccaaacgacattatcatccaaccgcgcttcgcaaccgacacccgtcaaaacaaaccacccatcaatttcgaactcaacaattaactaaccgaacgtaatctccaacgcgaaaacattaacgtcattacccaccaataaattaacaatacgtaacgcgaacatatccaatacgccgcaataactaatacccgactaacgaaaaccgtaacgaccgccatcctacacaataatatacatacccgcacgaataatcttcaacatactccctccttctacgatacaaaacgcacgctatctcccgaacgtaataaaataaattcgtcacgcgccgaatcaaacaaactaaataaaatataaccaatcaactaccaaccacccgacgttaccaacgaataaacaccaatctacgacccgccgatcccgacaaaacctaccgaaacgaataaacgcgattcaacgcgccgtaacgtatataattattccgacaaactcccgaaatacgaaaaacccgattaaaaacctaaaaaccaaaccacgtattccacgaaaaaatacaattcaaca

SEQ ID NO: 10201 - DNA, 565 bp, Artificial Sequence
  chemically treated genomic DNA (Homo sapiens) CpG-island No: 10201
tcgtacggttagggtcgcggcgaaacggagtttattttaagtgcgtcgcgtttggtcgcgttttgtagttcgacgaggttgaggatggagaggggagacgtagggagaagagggacgcgggatttggatttaagaggtcgtttcgttgtcggtttggcggcggcgtcgattcgggttcgcgcgttttatataagttttttgtttgtttttgtatatttggtggataaatcgggcgtttaggttatatcgtttttttttttcgcgggggcgcgggggatgttttttttcggttgttagggtgtgttttttgggtgaagagaaagtttttcggtaggcggagggaaatatttttcgcgcgttagcgaagggggaagacggtgtggtttggacgcgcggtttgtttattaggtgtgtagaggtagataggatatttgtgtggaacgcgcgaattcgagtcggcgtcgtagttagatcggtaacggagcggttttttgggtttaagtttcgcgttttttttttttttgcgttttttttttttatttttagtttcgtcgggttataggat

SEQ ID NO: 10202 - DNA, 565 bp, Artificial Sequence
  chemically treated genomic DNA (Homo sapiens) CpG-island No: 10202
atcctataacccgacgaaactaaaaataaaaaaaaaaaacgcaaaaaaaaaaaaaacgcgaaacttaaacccaaaaaaccgctccgttaccgatctaactacgacgccgactcgaattcgcgcgttccacacaaatatcctatctacctctacacacctaataaacaaaccgcgcgtccaaaccacaccgtcttcccccttcgctaacgcgcgaaaaatatttccctccgcctaccgaaaaactttctcttcacccaaaaaacacaccctaacaaccgaaaaaaaacatcccccgcgcccccgcgaaaaaaaaaaacgatataacctaaacgcccgatttatccaccaaatatacaaaaacaaacaaaaaacttatataaaacgcgcgaacccgaatcgacgccgccgccaaaccgacaacgaaacgacctcttaaatccaaatcccgcgtccctcttctccctacgtctcccctctccatcctcaacctcgtcgaactacaaaacgcgaccaaacgcgacgcacttaaaataaactccgtttcgccgcgaccctaaccgtacga

SEQ ID NO: 10203 - DNA, 565 bp, Artificial Sequence
  chemically treated genomic DNA (Homo sapiens) CpG-island No: 10203
gttttgtagttcgacgaggttgaggatggagaggggagacgtagggagaagagggacgcgggatttggatttaagaggtcgtttcgttgtcggtttggttgcggcgtcgattcgggttcgcgcgttttatataagtgttttgtttgtttttgtatatttggtggataaatcgcgcgtttaggttatatcgtttttttttttcgttggcgcgcggaggatgttttttttcgtttgtcgaggggttttttttttatttagaaagtatattttggtagtcggagggaaatatttttcgcgttttcgcgaagggggaagacggtgtggtttggacgttcggtttgtttattaggtgtgtagaggtagataggaaatttgtgtggaacgcgcgaattcgagtcggcgtcgtcgttagatcggtaacggagcggttttttgggtttaagtttcgcgttttttttttttttgcgttttttttttttatttttagtttcgtcgggttataggacgcggttaggcgcggcgtatttgagatgggtttcgtttcgtcgcggttttggtcgtgcgg

SEQ ID NO: 10204 - DNA, 565 bp, Artificial Sequence
  chemically treated genomic DNA (Homo sapiens) CpG-island No: 10204
ccgcacgaccaaaaccgcgacgaaacgaaacccatctcaaatacgccgcgcctaaccgcgtcctataacccgacgaaactaaaaataaaaaaaaaaaacgcaaaaaaaaaaaaaacgcgaaacttaaacccaaaaaaccgctccgttaccgatctaacgacgacgccgactcgaattcgcgcgttccacacaaatttcctatctacctctacacacctaataaacaaaccgaacgtccaaaccacaccgtcttcccccttcgcgaaaacgcgaaaaatatttccctccgactaccaaaatatactttctaaataaaaaaaaaacccctcgacaaacgaaaaaaaacatcctccgcgcgccaacgaaaaaaaaaaacgatataacctaaacgcgcgatttatccaccaaatatacaaaaacaaacaaaacacttatataaaacgcgcgaacccgaatcgacgccgcaaccaaaccgacaacgaaacgacctcttaaatccaaatcccgcgtccctcttctccctacgtctcccctctccatcctcaacctcgtcgaactacaaaac

SEQ ID NO: 10205 - DNA, 719 bp, Artificial Sequence
  chemically treated genomic DNA (Homo sapiens) CpG-island No: 10205
ttcgagaattcgcggcgtcgattgcgtttgtttttttcgagttggcgattttttcgcgggatttgttttcgtttaaagtttgtataattgaaagagttcgtagagttcggtcgtttttcgtttttttaagggcggcgaggtcggttattggtagacgatcggttattatttagtaggggtttacgggaattcgtatttggagtcgggggtgttacgttacgtcggtttagtggttcgcggagagcgttcgggtgtatttttgttaaagatgttttttggaggtttcggtcgcgcgggattcgggggagaggtcgtttttttttcgttgttattagcgtttaggtcgtcggtttttttttcgttgtttaaatagtagaaaagtaggcgttaagttgtttttgttaaaaaggggatatatttcggtcgcgaaattgtaaattcggtgttagatagttgtaaattcgtgtcgataggttgttagatagttgcgggggttggtcgggaaggagtttacggttttcgggtttatatttcgtcgtttcgacgcgcgcgtttatcgcgagagtagttggtcgggtcggtacggggtattacgtgttcgcgggaggggcgggagcggtcggcgagggcgggcgggaggtagggagggggcgggaggggagttaggggcggggtttgcgtttaaggggatgttaattaaagtattaattttaaattgt

SEQ ID NO: 10206 - DNA, 719 bp, Artificial Sequence
  chemically treated genomic DNA (Homo sapiens) CpG-island No: 10206
acaatttaaaattaatactttaattaacatccccttaaacgcaaaccccgcccctaactcccctcccgccccctccctacctcccgcccgccctcgccgaccgctcccgcccctcccgcgaacacgtaataccccgtaccgacccgaccaactactctcgcgataaacgcgcgcgtcgaaacgacgaaatataaacccgaaaaccgtaaactccttcccgaccaacccccgcaactatctaacaacctatcgacacgaatttacaactatctaacaccgaatttacaatttcgcgaccgaaatatatcccctttttaacaaaaacaacttaacgcctacttttctactatttaaacaacgaaaaaaaaaccgacgacctaaacgctaataacaacgaaaaaaaaacgacctctcccccgaatcccgcgcgaccgaaacctccaaaaaacatctttaacaaaaatacacccgaacgctctccgcgaaccactaaaccgacgtaacgtaacacccccgactccaaatacgaattcccgtaaacccctactaaataataaccgatcgtctaccaataaccgacctcgccgcccttaaaaaaacgaaaaacgaccgaactctacgaactctttcaattatacaaactttaaacgaaaacaaatcccgcgaaaaaatcgccaactcgaaaaaaacaaacgcaatcgacgccgcgaattctcgaa

SEQ ID NO: 10207 - DNA, 719 bp, Artificial Sequence
  chemically treated genomic DNA (Homo sapiens) CpG-island No: 10207
ataatttgaagttgatgttttgattggtatttttttgagcgtaggtttcgtttttggtttttttttcgttttttttttgtttttcgttcgttttcgtcggtcgttttcgtttttttcgcgagtacgtggtgtttcgtgtcggttcggttagttattttcgcggtgggcgcgcgcgtcggggcggcggggtgtgggttcggaggtcgtgggttttttttcgattagttttcgtagttgtttgataatttgtcgatacgggtttatagttgtttgatatcgggtttgtagtttcgcggtcgaggtgtgttttttttttaataaaaataatttggcgtttgtttttttattgtttgggtagcggggaaggggtcggcggtttggacgttggtgatagcgaggggggagcggtttttttttcgagtttcgcgcggtcggggtttttaggggatatttttggtagaagtgtattcggacgtttttcgcgagttattgaatcggcgtggcgtgatattttcgattttagatgcgggttttcgtgggtttttattgggtagtaatcgatcgtttgttaatgatcggtttcgtcgtttttggggaagcggggagcggtcgagttttgcgggtttttttaattgtgtaaattttgagcgagggtaaatttcgcggagaagtcgttagttcgggggaagtaggcgtagtcggcgtcgcgggttttcgga

SEQ ID NO: 10208 - DNA, 719 bp, Artificial Sequence
  chemically treated genomic DNA (Homo sapiens) CpG-island No: 10208
tccgaaaacccgcgacgccgactacgcctacttcccccgaactaacgacttctccgcgaaatttaccctcgctcaaaatttacacaattaaaaaaacccgcaaaactcgaccgctccccgcttccccaaaaacgacgaaaccgatcattaacaaacgatcgattactacccaataaaaacccacgaaaacccgcatctaaaatcgaaaatatcacgccacgccgattcaataactcgcgaaaaacgtccgaatacacttctaccaaaaatatcccctaaaaaccccgaccgcgcgaaactcgaaaaaaaaaccgctcccccctcgctatcaccaacgtccaaaccgccgaccccttccccgctacccaaacaataaaaaaacaaacgccaaattatttttattaaaaaaaaaacacacctcgaccgcgaaactacaaacccgatatcaaacaactataaacccgtatcgacaaattatcaaacaactacgaaaactaatcgaaaaaaaacccacgacctccgaacccacaccccgccgccccgacgcgcgcgcccaccgcgaaaataactaaccgaaccgacacgaaacaccacgtactcgcgaaaaaaacgaaaacgaccgacgaaaacgaacgaaaaacaaaaaaaaaacgaaaaaaaaaccaaaaacgaaacctacgctcaaaaaaataccaatcaaaacatcaacttcaaattat

SEQ ID NO: 10209 - DNA, 1042 bp, Artificial Sequence
  chemically treated genomic DNA (Homo sapiens) CpG-island No: 10209
tcgagcggagggcggtcgtcgtagtcggcgcgcgattgcggattcgggcgtagtcgggagtcgggcgtttgcgagtatcgggtagaggagtcgcgatcggtttttatttttcggttcgtttcgagcgcgttcggtcggtcgttcgtttttttttagatttttcgcggcgttttttgtaatttttttcggtcggttttcgttttttttttcgcgtttttaatattcgttcgttgcggcggtcgtcgagttcgcggatatgtttttttcgtagttgggttattcgtagtatttgagcgtcgcggggtcgggcgtttacggcggcgagcgttcgggggtgttggtcgcggtcgttgcggcggttgtcgtcgtttcgtcgggtcgatcgggggtcgcggagttgggcggcggggtaggcgcggttgtagttatttcggtgttgggtatgtacgcggcggcggggtcgtacgcgggcgcgtttaattatagcgtttttttgttttacgtcgcggattttagttttttttcgtagatggtgagtgcgttcggtttttttcgttttttttttgttttattcgcgttagggtaagggtggcgggtcgttcgggagggagagattacgggtggatttggttcggaagaggaattagaaaggttcgggggtaggttttcggtggtcgaggtcgcggttttcggggacgtaagagggttgggaggtcgggcgggtgacggttgggttatttcggtttgggaaagcggaaggttcgggttagggagcgggtagcgagtgaatttagagaggtcgtagaagtaggttcgtggagcggtgttcgcgttggaggtcgggggtaaattcgtttggttcggttaggggcgttcgggtaggtttacggggtttttgtaggtcggttcggcgtagcgtagtaggatttttttttttggtcgcgggttttattcgcgcggtttttttagttttcgaatcgagtttggaaaatttggttttttttttttttagtagtttcgagatagttgtattcgagtttgt

SEQ ID NO: 10210 - DNA, 1042 bp, Artificial Sequence
  chemically treated genomic DNA (Homo sapiens) CpG-island No: 10210
acaaactcgaatacaactatctcgaaactactaaaaaaaaaaaaaaccaaattttccaaactcgattcgaaaactaaaaaaaccgcgcgaataaaacccgcgaccaaaaaaaaaaatcctactacgctacgccgaaccgacctacaaaaaccccgtaaacctacccgaacgcccctaaccgaaccaaacgaatttacccccgacctccaacgcgaacaccgctccacgaacctacttctacgacctctctaaattcactcgctacccgctccctaacccgaaccttccgctttcccaaaccgaaataacccaaccgtcacccgcccgacctcccaaccctcttacgtccccgaaaaccgcgacctcgaccaccgaaaacctacccccgaacctttctaattcctcttccgaaccaaatccacccgtaatctctccctcccgaacgacccgccacccttaccctaacgcgaataaaacaaaaaaaaaacgaaaaaaaccgaacgcactcaccatctacgaaaaaaaactaaaatccgcgacgtaaaacaaaaaaacgctataattaaacgcgcccgcgtacgaccccgccgccgcgtacatacccaacaccgaaataactacaaccgcgcctaccccgccgcccaactccgcgacccccgatcgacccgacgaaacgacgacaaccgccgcaacgaccgcgaccaacacccccgaacgctcgccgccgtaaacgcccgaccccgcgacgctcaaatactacgaataacccaactacgaaaaaaacatatccgcgaactcgacgaccgccgcaacgaacgaatattaaaaacgcgaaaaaaaaaacgaaaaccgaccgaaaaaaattacaaaaaacgccgcgaaaaatctaaaaaaaaacgaacgaccgaccgaacgcgctcgaaacgaaccgaaaaataaaaaccgatcgcgactcctctacccgatactcgcaaacgcccgactcccgactacgcccgaatccgcaatcgcgcgccgactacgacgaccgccctccgctcga

SEQ ID NO: 10211 - DNA, 1042 bp, Artificial Sequence
  chemically treated genomic DNA (Homo sapiens) CpG-island No: 10211
gtaaattcggatataattatttcggagttgttaaagagggagaaaattaagttttttagattcggttcgaaaattaaagaggtcgcgcgagtggaattcgcggttaggaagggaagttttgttacgttacgtcgggtcgatttgtaggaatttcgtgggtttgttcgggcgtttttggtcgagttaggcgagtttgttttcgatttttagcgcgggtatcgttttacgggtttgtttttgcggtttttttgaatttattcgttattcgttttttggttcgggtttttcgtttttttaggtcgagatggtttagtcgttattcgttcggttttttagtttttttgcgttttcgggggtcgcggtttcggttatcgggaatttgttttcggatttttttagtttttttttcggattaggtttattcgtagtttttttttttcgggcgattcgttatttttgttttggcgcgggtgagatagaggagaagcgggggaggtcgggcgtatttattatttgcgagaagaggttgagattcgcggcgtagggtaggaaggcgttgtagttgggcgcgttcgcgtacggtttcgtcgtcgcgtatatgtttagtatcgaggtgattgtagtcgcgtttgtttcgtcgtttagtttcgcggttttcggtcggttcgacgaggcggcggtagtcgtcgtagcggtcgcggttagtattttcgggcgttcgtcgtcgtaggcgttcggtttcgcggcgtttaggtattgcgggtagtttagttgcgggaaggatatgttcgcggattcggcgatcgtcgtagcgggcgagtattaaaggcgcggggagggaggcggaggtcggtcggagggggttgtagggggcgtcgcgaggggtttagggaggagcgggcggtcggtcgggcgcgttcggggcgggtcgggagatggaggtcggtcgcggtttttttgttcggtgttcgtaggcgttcggttttcggttgcgttcggattcgtaatcgcgcgtcgattgcggcggtcgtttttcgttcgg

SEQ ID NO: 10212 - DNA, 1042 bp, Artificial Sequence
  chemically treated genomic DNA (Homo sapiens) CpG-island No: 10212
ccgaacgaaaaacgaccgccgcaatcgacgcgcgattacgaatccgaacgcaaccgaaaaccgaacgcctacgaacaccgaacaaaaaaaccgcgaccgacctccatctcccgacccgccccgaacgcgcccgaccgaccgcccgctcctccctaaacccctcgcgacgccccctacaaccccctccgaccgacctccgcctccctccccgcgcctttaatactcgcccgctacgacgatcgccgaatccgcgaacatatccttcccgcaactaaactacccgcaatacctaaacgccgcgaaaccgaacgcctacgacgacgaacgcccgaaaatactaaccgcgaccgctacgacgactaccgccgcctcgtcgaaccgaccgaaaaccgcgaaactaaacgacgaaacaaacgcgactacaatcacctcgatactaaacatatacgcgacgacgaaaccgtacgcgaacgcgcccaactacaacgccttcctaccctacgccgcgaatctcaacctcttctcgcaaataataaatacgcccgacctcccccgcttctcctctatctcacccgcgccaaaacaaaaataacgaatcgcccgaaaaaaaaaaactacgaataaacctaatccgaaaaaaaaactaaaaaaatccgaaaacaaattcccgataaccgaaaccgcgacccccgaaaacgcaaaaaaactaaaaaaccgaacgaataacgactaaaccatctcgacctaaaaaaacgaaaaacccgaaccaaaaaacgaataacgaataaattcaaaaaaaccgcaaaaacaaacccgtaaaacgatacccgcgctaaaaatcgaaaacaaactcgcctaactcgaccaaaaacgcccgaacaaacccacgaaattcctacaaatcgacccgacgtaacgtaacaaaacttcccttcctaaccgcgaattccactcgcgcgacctctttaattttcgaaccgaatctaaaaaacttaattttctccctctttaacaactccgaaataattatatccgaatttac

SEQ ID NO: 10213 - DNA, 668 bp, Artificial Sequence
  chemically treated genomic DNA (Homo sapiens) CpG-island No: 10213
gttttaacgcgagttttttttttttttggaatttttgaaaagatattagcgtttcgattttttttttcgtttcggttatgtacggagtttttacgcgtagtattggcgttagtgggtttcgagtaagtcgggaagggcgggttataggttgggggtgcgagcggaggacggtcgttttgatttcgggattcggttttgatttcgggattcggttttgtttttattagatcgtttttttcggtagtttatattttcgttggtagttttggaaatgtttgttggtttagtttttacgtatttaacgttgagtcgtttgcgttttgaaggtttcgcgtcgggttcgtaaagttttttgaaggtgtttgttgcggcgcgtggcgcgcgtttcgtttcgaatttattgatgttgatgtttcggattcgtagcgatgtttaggtttttaggtttttttttattcgcgcgcgttcgaggttagtttcgttgcgagtgttttttaatatcgttgtttttagttgttttttcgttgttcggtcgcggttatttaagggtaatttgttttggattttcgcggtgcgcgcgtttgagggtaaaggacgtagttcgtggagtttaagtgtaaaggggtttttttgggagattaaagttattttttttttttcgtttttta

SEQ ID NO: 10214 - DNA, 668 bp, Artificial Sequence
  chemically treated genomic DNA (Homo sapiens) CpG-island No: 10214
taaaaaacgaaaaaaaaaaaataactttaatctcccaaaaaaacccctttacacttaaactccacgaactacgtcctttaccctcaaacgcgcgcaccgcgaaaatccaaaacaaattacccttaaataaccgcgaccgaacaacgaaaaaacaactaaaaacaacgatattaaaaaacactcgcaacgaaactaacctcgaacgcgcgcgaataaaaaaaaacctaaaaacctaaacatcgctacgaatccgaaacatcaacatcaataaattcgaaacgaaacgcgcgccacgcgccgcaacaaacaccttcaaaaaactttacgaacccgacgcgaaaccttcaaaacgcaaacgactcaacgttaaatacgtaaaaactaaaccaacaaacatttccaaaactaccaacgaaaatataaactaccgaaaaaaacgatctaataaaaacaaaaccgaatcccgaaatcaaaaccgaatcccgaaatcaaaacgaccgtcctccgctcgcacccccaacctataacccgcccttcccgacttactcgaaacccactaacgccaatactacgcgtaaaaactccgtacataaccgaaacgaaaaaaaaaatcgaaacgctaatatcttttcaaaaattccaaaaaaaaaaaaaactcgcgttaaaac

SEQ ID NO: 10215 - DNA, 668 bp, Artificial Sequence
  chemically treated genomic DNA (Homo sapiens) CpG-island No: 10215
tgggaagcgagaaagaggaggtggttttggttttttagggaagtttttttatatttgggttttacggattgcgttttttgtttttaggcgcgcgtatcgcgggagtttagagtaaattgtttttagatggtcgcggtcgggtagcggggaggtagttgggagtagcgatgttgggaaatattcgtagcggggttggtttcgggcgcgcgcgagtggggaaaggtttaggagtttggatatcgttgcggattcgggatattagtattagtgggttcggagcgggacgcgcgttacgcgtcgtagtaggtatttttaggaggttttgcggattcggcgcggggtttttagggcgtaggcgatttagcgttgaatgcgtgaaaattgagttagtaaatatttttaaaattgttagcgaggatgtgggttgtcgggaaaaacggtttagtggggatagggtcgagtttcgaagttagagtcgagtttcgaggttagagcggtcgtttttcgttcgtatttttagtttgtgattcgtttttttcggtttgttcgagatttattggcgttagtgttgcgcgtggggatttcgtgtatggtcgaagcgagggggaaagtcggggcgttggtgtttttttagaggttttaggaaagagggaggttcgcgttaggat

SEQ ID NO: 10216 - DNA, 668 bp, Artificial Sequence
  chemically treated genomic DNA (Homo sapiens) CpG-island No: 10216
atcctaacgcgaacctccctctttcctaaaacctctaaaaaaacaccaacgccccgactttccccctcgcttcgaccatacacgaaatccccacgcgcaacactaacgccaataaatctcgaacaaaccgaaaaaaacgaatcacaaactaaaaatacgaacgaaaaacgaccgctctaacctcgaaactcgactctaacttcgaaactcgaccctatccccactaaaccgtttttcccgacaacccacatcctcgctaacaattttaaaaatatttactaactcaattttcacgcattcaacgctaaatcgcctacgccctaaaaaccccgcgccgaatccgcaaaacctcctaaaaatacctactacgacgcgtaacgcgcgtcccgctccgaacccactaatactaatatcccgaatccgcaacgatatccaaactcctaaacctttccccactcgcgcgcgcccgaaaccaaccccgctacgaatatttcccaacatcgctactcccaactacctccccgctacccgaccgcgaccatctaaaaacaatttactctaaactcccgcgatacgcgcgcctaaaaacaaaaaacgcaatccgtaaaacccaaatataaaaaaacttccctaaaaaaccaaaaccacctcctctttctcgcttccca

SEQ ID NO: 10217 - DNA, 1343 bp, Artificial Sequence
  chemically treated genomic DNA (Homo sapiens) CpG-island No: 10217
ggatcggagcgatatagggataggtagcgagaacgacggatgagttttgagaagcgattaggaggagagatggggaggatcgggaatagtagcgtttcggtggggttgcgtagaggtcgggagaggggatgagaggaggatggaggaaaggggagggcgaggttgttaggatcggagcgggtagagatggggaagaggtgtatcgggaagagggacggcggtaggggtaggggttagggatgcgagttgaagggtcgggcgggcgggaggatagggaaggaaagatagaaagggatgggggaagggagacgatggagaaggaggtgaggaggttggagaggaggtgagatagcggcggaggtagggacgtagggtcggggaagaagagatggagacgggatcgcggcgtttgtcgtagcgcgggtttcgcggatattcgtcgtcgtcgtttcggagtagtttggtggaaagcgcgtttcgtcggggttttttcggtatttatttgggggttttagtttcggattttgtgtttcgcgtcggattttttttttcgttttgtttttgcgattttagcgttttcgaatttcgttagtttttgtaggtttcgttagtagtatttttatttcgtgggacgttcggggttacgttttttttagtttttgattggttattgtttacgttagttatattattattggttgaggggtcgtcggatatgtaaattaggatgggttcgtcgtcgtatcgattggttggcgttcgtaaagcgtagttttcgatttgggttttgattggtttcgcggttttgacggcgatagtgacgcgaggcgggtttttggattgagtgtgcggcgcggtgcgtcgtttttcgaggtttttttcgcgggtggtagcggacggggcgcgtttttcggttagttttcggtttttaggtttgtggtttcgttgagtatcggtcgtcgggtttttgggttcgtcgagtggagattttttgaaaagcgtgggtttcgtggttttcggcgcggtcgcggcgggtcggttttttaggtaacgcggttcgcggcgggcggaattatgtgggtcggcgtcgcgggggaggttggacgcggtttcgaggtatagggggttttagtgttggttagagtttcggggttcgggggtagggtggtttacgtcgtttttgcgtgggggttcggtgtttggggtgcggcggtggcgcgcggcgggggttgttttcgcgttagtcgtaggcgttttttttcgtcgggatatttggggtcggggtcgttgggtgtcgtttggttacgtgggtttttttttgtttttgttttttgttttttgtt

SEQ ID NO: 10218 - DNA, 1343 bp, Artificial Sequence
  chemically treated genomic DNA (Homo sapiens) CpG-island No: 10218
aacaaaaaacaaaaaacaaaaacaaaaaaaaacccacgtaaccaaacgacacccaacgaccccgaccccaaatatcccgacgaaaaaaaacgcctacgactaacgcgaaaacaacccccgccgcgcgccaccgccgcaccccaaacaccgaacccccacgcaaaaacgacgtaaaccaccctacccccgaaccccgaaactctaaccaacactaaaaccccctatacctcgaaaccgcgtccaacctcccccgcgacgccgacccacataattccgcccgccgcgaaccgcgttacctaaaaaaccgacccgccgcgaccgcgccgaaaaccacgaaacccacgcttttcaaaaaatctccactcgacgaacccaaaaacccgacgaccgatactcaacgaaaccacaaacctaaaaaccgaaaactaaccgaaaaacgcgccccgtccgctaccacccgcgaaaaaaacctcgaaaaacgacgcaccgcgccgcacactcaatccaaaaacccgcctcgcgtcactatcgccgtcaaaaccgcgaaaccaatcaaaacccaaatcgaaaactacgctttacgaacgccaaccaatcgatacgacgacgaacccatcctaatttacatatccgacgacccctcaaccaataataatataactaacgtaaacaataaccaatcaaaaactaaaaaaaacgtaaccccgaacgtcccacgaaataaaaatactactaacgaaacctacaaaaactaacgaaattcgaaaacgctaaaatcgcaaaaacaaaacgaaaaaaaaaatccgacgcgaaacacaaaatccgaaactaaaacccccaaataaataccgaaaaaaccccgacgaaacgcgctttccaccaaactactccgaaacgacgacgacgaatatccgcgaaacccgcgctacgacaaacgccgcgatcccgtctccatctcttcttccccgaccctacgtccctacctccgccgctatctcacctcctctccaacctcctcacctccttctccatcgtctcccttcccccatccctttctatctttccttccctatcctcccgcccgcccgacccttcaactcgcatccctaacccctacccctaccgccgtccctcttcccgatacacctcttccccatctctacccgctccgatcctaacaacctcgccctcccctttcctccatcctcctctcatcccctctcccgacctctacgcaaccccaccgaaacgctactattcccgatcctccccatctctcctcctaatcgcttctcaaaactcatccgtcgttctcgctacctatccctatatcgctccgatcc

SEQ ID NO: 10219 - DNA, 1343 bp, Artificial Sequence
  chemically treated genomic DNA (Homo sapiens) CpG-island No: 10219
ggtagggggtaaagggtaagggtagaaaggaatttacgtagttaaacggtatttagcggtttcgattttaagtgtttcgacgaggggggacgtttgcgattaacgcggggatagttttcgtcgcgcgttatcgtcgtattttaggtatcgggtttttacgtagggacggcgtggattattttattttcgaatttcgaggttttggttaatattgaggttttttgtgtttcgaggtcgcgtttaatttttttcgcggcgtcggtttatatggtttcgttcgtcgcgggtcgcgttatttaggagatcgattcgtcgcggtcgcgtcggaggttacggagtttacgttttttagagagtttttattcgacggatttagaggttcggcggtcggtgtttaacggagttataagtttgaggatcgaggattggtcgaggggcgcgtttcgttcgttgttattcgcgggaggagtttcggaaggcggcgtatcgcgtcgtatatttagtttaagaattcgtttcgcgttattgtcgtcgttagggtcgcggagttaattagagtttaagtcgagggttgcgttttgcgagcgttagttaatcggtgcggcggcgggtttattttgatttgtatgttcgacgattttttaattaatggtaatgtgattggcgtgaataatagttaattagaagttggaagaggcgtggtttcgggcgttttacgaggtgaagatgttgttggcggaatttgtaggagttagcgggattcgggggcgttaaagtcgtaggggtagggcgggaaggaagattcggcgcggggtataggattcggagttggagtttttaggtgagtatcggggagatttcggcggggcgcgttttttattaagttgtttcgggacggcggcggcgggtattcgcgaggttcgcgttgcggtaggcgtcgcggtttcgtttttattttttttttttcggttttgcgtttttgttttcgtcgttgttttattttttttttagtttttttatttttttttttatcgtttttttttttttatttttttttgtttttttttttttgttttttcgttcgttcgattttttagttcgtatttttgatttttgtttttgtcgtcgttttttttttcggtgtattttttttttatttttgttcgtttcggttttagtagtttcgttttttttttttttttattttttttttattttttttttcggtttttgcgtagttttatcggggcgttgttgttttcggttttttttatttttttttttgatcgttttttaaggtttattcgtcgttttcgttgtttgtttttgtgtcgtttcggttt

SEQ ID NO: 10220 - DNA, 1343 bp, Artificial Sequence
  chemically treated genomic DNA (Homo sapiens) CpG-island No: 10220
aaaccgaaacgacacaaaaacaaacaacgaaaacgacgaataaaccttaaaaaacgatcaaaaaaaaaaataaaaaaaaccgaaaacaacaacgccccgataaaactacgcaaaaaccgaaaaaaaaaataaaaaaaaaataaaaaaaaaaaaaaaacgaaactactaaaaccgaaacgaacaaaaataaaaaaaaaatacaccgaaaaaaaaaacgacgacaaaaacaaaaatcaaaaatacgaactaaaaaatcgaacgaacgaaaaaacaaaaaaaaaaaaacaaaaaaaaataaaaaaaaaaaaacgataaaaaaaaaaataaaaaaactaaaaaaaaaataaaacaacgacgaaaacaaaaacgcaaaaccgaaaaaaaaaaaataaaaacgaaaccgcgacgcctaccgcaacgcgaacctcgcgaatacccgccgccgccgtcccgaaacaacttaataaaaaacgcgccccgccgaaatctccccgatactcacctaaaaactccaactccgaatcctataccccgcgccgaatcttccttcccgccctacccctacgactttaacgcccccgaatcccgctaactcctacaaattccgccaacaacatcttcacctcgtaaaacgcccgaaaccacgcctcttccaacttctaattaactattattcacgccaatcacattaccattaattaaaaaatcgtcgaacatacaaatcaaaataaacccgccgccgcaccgattaactaacgctcgcaaaacgcaaccctcgacttaaactctaattaactccgcgaccctaacgacgacaataacgcgaaacgaattcttaaactaaatatacgacgcgatacgccgccttccgaaactcctcccgcgaataacaacgaacgaaacgcgcccctcgaccaatcctcgatcctcaaacttataactccgttaaacaccgaccgccgaacctctaaatccgtcgaataaaaactctctaaaaaacgtaaactccgtaacctccgacgcgaccgcgacgaatcgatctcctaaataacgcgacccgcgacgaacgaaaccatataaaccgacgccgcgaaaaaaattaaacgcgacctcgaaacacaaaaaacctcaatattaaccaaaacctcgaaattcgaaaataaaataatccacgccgtccctacgtaaaaacccgatacctaaaatacgacgataacgcgcgacgaaaactatccccgcgttaatcgcaaacgtcccccctcgtcgaaacacttaaaatcgaaaccgctaaataccgtttaactacgtaaattcctttctacccttaccctttaccccctacc

SEQ ID NO: 10221 - DNA, 516 bp, Artificial Sequence
  chemically treated genomic DNA (Homo sapiens) CpG-island No: 10221
gtagttttatcgggtgacggtagtcgcgtttcgcgtggggtagcggcgagcggaaagggaagtcgggcggggttagggggttaaatacgggcgatagtttcgtttagtttcggatttgtagcgcgtataagttcgggcgtttttcgagcgtcgcgtttaagtttcgtttttttcgtttttcgggtttcgattggtcgagttatcgcgggggcgtgttcggcggagttggtcgggattcgggcggagcgggcggggattcgggttattgcggtgtggattcgagggttgggcgcggggtcggcgtagaaggtgagtttttttatcgtttttcggtcgggttgcgggtcgcggggtaggcgtatgaggcgagttttttattattattttcggataagcgagttttttttcgtcgcgcggttttggcggtttttgggtcggcggggcgtagtgtcgttgattttagtttaagaagaggtttgggaagggcgtttttgggcggtttgcggggtgaatttg

SEQ ID NO: 10222 - DNA, 516 bp, Artificial Sequence
  chemically treated genomic DNA (Homo sapiens) CpG-island No: 10222
caaattcaccccgcaaaccgcccaaaaacgcccttcccaaacctcttcttaaactaaaatcaacgacactacgccccgccgacccaaaaaccgccaaaaccgcgcgacgaaaaaaaactcgcttatccgaaaataataataaaaaactcgcctcatacgcctaccccgcgacccgcaacccgaccgaaaaacgataaaaaaactcaccttctacgccgaccccgcgcccaaccctcgaatccacaccgcaataacccgaatccccgcccgctccgcccgaatcccgaccaactccgccgaacacgcccccgcgataactcgaccaatcgaaacccgaaaaacgaaaaaaacgaaacttaaacgcgacgctcgaaaaacgcccgaacttatacgcgctacaaatccgaaactaaacgaaactatcgcccgtatttaaccccctaaccccgcccgacttccctttccgctcgccgctaccccacgcgaaacgcgactaccgtcacccgataaaactac

SEQ ID NO: 10223 - DNA, 516 bp, Artificial Sequence
  chemically treated genomic DNA (Homo sapiens) CpG-island No: 10223
taggtttatttcgtaagtcgtttaggagcgttttttttaggtttttttttgggttggagttagcggtattgcgtttcgtcggtttaggagtcgttaagatcgcgcggcgggagagagttcgtttgttcgggggtggtgatgggagattcgttttatgcgtttgtttcgcgattcgtagttcggtcgggggacggtggggggatttattttttgcgtcggtttcgcgtttagttttcgagtttatatcgtagtagttcgggttttcgttcgtttcgttcgggtttcggttagtttcgtcggatacgttttcgcggtggttcggttaatcggagttcgggaagcgggaggggcggggtttgggcgcggcgttcggagggcgttcgagtttgtgcgcgttgtaggttcggggttgggcgggattgtcgttcgtgtttgattttttggtttcgttcggttttttttttcgttcgtcgttgttttacgcggagcgcgattgtcgttattcggtgggattgt

SEQ ID NO: 10224 - DNA, 516 bp, Artificial Sequence
  chemically treated genomic DNA (Homo sapiens) CpG-island No: 10224
acaatcccaccgaataacgacaatcgcgctccgcgtaaaacaacgacgaacgaaaaaaaaaaccgaacgaaaccaaaaaatcaaacacgaacgacaatcccgcccaaccccgaacctacaacgcgcacaaactcgaacgccctccgaacgccgcgcccaaaccccgcccctcccgcttcccgaactccgattaaccgaaccaccgcgaaaacgtatccgacgaaactaaccgaaacccgaacgaaacgaacgaaaacccgaactactacgatataaactcgaaaactaaacgcgaaaccgacgcaaaaaataaatccccccaccgtcccccgaccgaactacgaatcgcgaaacaaacgcataaaacgaatctcccatcaccacccccgaacaaacgaactctctcccgccgcgcgatcttaacgactcctaaaccgacgaaacgcaataccgctaactccaacccaaaaaaaaacctaaaaaaaacgctcctaaacgacttacgaaataaaccta

SEQ ID NO: 10225 - DNA, 767 bp, Artificial Sequence
  chemically treated genomic DNA (Homo sapiens) CpG-island No: 10225
gcgggcgcgggagtatttagcgaagagagtagaggatacgaatataacgatacggaggagagatttggcgaagcgaagtagcgcgaatagagtagaaagaaggattaacggtacgagagagagtagggagcgagcgagggaagtagcggaaggagaagtaggaggtttcgtatcgtcgaggaagacgaagacgaaaggagatgagaagaagaaagggatatagggagagacgcggacggataacgaagattatcgaacgttaaggcgtaggagagcggaggcgaggggataagaggagacgggagtaggttagggagtaagggcgaagaaagtattacggatgcggaacgggggaatagaggaaggcgggagggacgcgcggggtaaggcgggcgaatagaagagagagagaaagagagggaggagatttagacgataaagcgaaggttataaggcgcggtataaggaagaagagtagggcgggagtaaatagtatagataaaacgaacggaatagtagtcggagcgggagagcggaaagggaacgcgacggggcgtacgacgagaacgagagataatattttagaggaggtcggtaggttacgtaggaggtaaaaagttagacgacgaatcgcgtacggtacgagcgagagagagaaaagcggaggtagaggagcgggaatagaaagagaaaggaagagggatacgggggtataaaagagtagagcgaaagcgaggaggaggagagagcgaaagtaagagaagacg

SEQ ID NO: 10226 - DNA, 767 bp, Artificial Sequence
  chemically treated genomic DNA (Homo sapiens) CpG-island No: 10226
cgtcttctcttactttcgctctctcctcctcctcgctttcgctctactcttttatacccccgtatccctcttcctttctctttctattcccgctcctctacctccgcttttctctctctcgctcgtaccgtacgcgattcgtcgtctaactttttacctcctacgtaacctaccgacctcctctaaaatattatctctcgttctcgtcgtacgccccgtcgcgttccctttccgctctcccgctccgactactattccgttcgttttatctatactatttactcccgccctactcttcttccttataccgcgccttataaccttcgctttatcgtctaaatctcctccctctctttctctctctcttctattcgcccgccttaccccgcgcgtccctcccgccttcctctattcccccgttccgcatccgtaatactttcttcgcccttactccctaacctactcccgtctcctcttatcccctcgcctccgctctcctacgccttaacgttcgataatcttcgttatccgtccgcgtctctccctatatccctttcttcttctcatctcctttcgtcttcgtcttcctcgacgatacgaaacctcctacttctccttccgctacttccctcgctcgctccctactctctctcgtaccgttaatccttctttctactctattcgcgctacttcgcttcgccaaatctctcctccgtatcgttatattcgtatcctctactctcttcgctaaatactcccgcgcccgc

SEQ ID NO: 10227 - DNA, 767 bp, Artificial Sequence
  chemically treated genomic DNA (Homo sapiens) CpG-island No: 10227
cgtttttttttgttttcgtttttttttttttttcgttttcgttttgtttttttgtgttttcgtgtttttttttttttttttttttgttttcgtttttttgttttcgtttttttttttttcgttcgtgtcgtgcgcggttcgtcgtttggttttttgttttttgcgtggtttgtcggttttttttggggtgttgtttttcgttttcgtcgtgcgtttcgtcgcgtttttttttcgttttttcgtttcggttgttgtttcgttcgttttgtttgtgttgtttgttttcgttttattttttttttttgtgtcgcgttttgtggttttcgttttatcgtttgggtttttttttttttttttttttttttttttgttcgttcgttttgtttcgcgcgtttttttcgtttttttttgttttttcgtttcgtattcgtggtgtttttttcgtttttgttttttggtttgttttcgtttttttttgttttttcgttttcgtttttttgcgttttggcgttcggtgattttcgttgttcgttcgcgtttttttttgtgttttttttttttttttattttttttcgttttcgtttttttcggcggtgcggggttttttgttttttttttcgttatttttttcgttcgttttttgttttttttcgtgtcgttggtttttttttttgttttgttcgcgttgtttcgtttcgttaggtttttttttcgtgtcgttgtgttcgtgttttttgtttttttcgttgggtgttttcgcgttcgt

SEQ ID NO: 10228 - DNA, 767 bp, Artificial Sequence
  chemically treated genomic DNA (Homo sapiens) CpG-island No: 10228
acgaacgcgaaaacacccaacgaaaaaaacaaaaaacacgaacacaacgacacgaaaaaaaaacctaacgaaacgaaacaacgcgaacaaaacaaaaaaaaaaaccaacgacacgaaaaaaaacaaaaaacgaacgaaaaaaataacgaaaaaaaaaacaaaaaaccccgcaccgccgaaaaaaacgaaaacgaaaaaaaataaaaaaaaaaaaaaaacacaaaaaaaaacgcgaacgaacaacgaaaatcaccgaacgccaaaacgcaaaaaaacgaaaacgaaaaaacaaaaaaaaacgaaaacaaaccaaaaaacaaaaacgaaaaaaacaccacgaatacgaaacgaaaaaacaaaaaaaaacgaaaaaaacgcgcgaaacaaaacgaacgaacaaaaaaaaaaaaaaaaaaaaaaaaaaaaacccaaacgataaaacgaaaaccacaaaacgcgacacaaaaaaaaaaaataaaacgaaaacaaacaacacaaacaaaacgaacgaaacaacaaccgaaacgaaaaaacgaaaaaaaaacgcgacgaaacgcacgacgaaaacgaaaaacaacaccccaaaaaaaaccgacaaaccacgcaaaaaacaaaaaaccaaacgacgaaccgcgcacgacacgaacgaaaaaaaaaaaaacgaaaacaaaaaaacgaaaacaaaaaaaaaaaaaaaaaaaaacacgaaaacacaaaaaaacaaaacgaaaacgaaaaaaaaaaaaaaacgaaaacaaaaaaaaacg

SEQ ID NO: 10229 - DNA, 516 bp, Artificial Sequence
  chemically treated genomic DNA (Homo sapiens) CpG-island No: 10229
ttcgttttcgtagtaataagttcgttttttggtttttttagtaataagttttttttttttttttcgaagaggggcgtcggaataaggcggattttattttttcgggtttttaagtcgtcgttgtttttatagataaagtcgttcgtatttgattttgttgggcgtcgttattttaatcggaaatacgtacggttttattcggaagtgttaggcgtatttatttaatttcgtgtcgtggttgcggttgaagttgtttgttcgatttttattttttttttatttggcgggatattgtattcggtttcgttttttttattcgggtttcgtttttaagttgggacgttttttcgtgcgggcgtcgtttttttacgtttaagtagttggttaaagttttgtttttggtttagttttcgtattttagcgagtttcgttttcgatatttttgtaagttttattttttttttaacgtgtgtttacgattataggaacgaagtagaaagaaaaaagaaaataaga

SEQ ID NO: 10230 - DNA, 516 bp, Artificial Sequence
  chemically treated genomic DNA (Homo sapiens) CpG-island No: 10230
tcttattttcttttttctttctacttcgttcctataatcgtaaacacacgttaaaaaaaaaataaaacttacaaaaatatcgaaaacgaaactcgctaaaatacgaaaactaaaccaaaaacaaaactttaaccaactacttaaacgtaaaaaaacgacgcccgcacgaaaaaacgtcccaacttaaaaacgaaacccgaataaaaaaaacgaaaccgaatacaatatcccgccaaataaaaaaaaaataaaaatcgaacaaacaacttcaaccgcaaccacgacacgaaattaaataaatacgcctaacacttccgaataaaaccgtacgtatttccgattaaaataacgacgcccaacaaaatcaaatacgaacgactttatctataaaaacaacgacgacttaaaaacccgaaaaaataaaatccgccttattccgacgcccctcttcgaaaaaaaaaaaaaaaacttattactaaaaaaaccaaaaaacgaacttattactacgaaaacgaa

SEQ ID NO: 10231 - DNA, 516 bp, Artificial Sequence
  chemically treated genomic DNA (Homo sapiens) CpG-island No: 10231
ttttgtttttttttttttttttgtttcgtttttgtggtcgtgggtatacgttagaagaggggtggagtttgtaaaagtatcgggggcgggattcgttgaggtgcgaaaattgggttaggggtagggttttgattagttatttgagcgtgaaggggcggcgttcgtacgaaggggcgttttagtttggaggcggggttcggatgggaggggcggggtcgagtgtagtatttcgttaggtgagaaggggataagagtcgggtaagtagttttagtcgtaattacggtacgaagttgggtgggtacgtttggtattttcgggtgaaatcgtgcgtattttcggttaagatggcggcgtttagtagagttaggtgcggacgattttgtttgtaggagtagcggcggtttgaggattcggggaggtgagattcgttttatttcggcgttttttttcggagaggagggagaagatttgttgttaaggagattaaagggcgggtttgttgttacggaggcgga

SEQ ID NO: 10232 - DNA, 516 bp, Artificial Sequence
  chemically treated genomic DNA (Homo sapiens) CpG-island No: 10232
tccgcctccgtaacaacaaacccgccctttaatctccttaacaacaaatcttctccctcctctccgaaaaaaaacgccgaaataaaacgaatctcacctccccgaatcctcaaaccgccgctactcctacaaacaaaatcgtccgcacctaactctactaaacgccgccatcttaaccgaaaatacgcacgatttcacccgaaaataccaaacgtacccacccaacttcgtaccgtaattacgactaaaactacttacccgactcttatccccttctcacctaacgaaatactacactcgaccccgcccctcccatccgaaccccgcctccaaactaaaacgccccttcgtacgaacgccgccccttcacgctcaaataactaatcaaaaccctacccctaacccaattttcgcacctcaacgaatcccgcccccgatacttttacaaactccacccctcttctaacgtatacccacgaccacaaaaacgaaacaaaaaaaaaaaaaaaaacaaaa

SEQ ID NO: 10233 - DNA, 1063 bp, Artificial Sequence
  chemically treated genomic DNA (Homo sapiens) CpG-island No: 10233
tttcggttcgttttcggattttagggtcgttcgtcgcgtatttagtttcgtagtttttcgggttttaggcgcggatatttcggggggcggaaattaggagtcgcggggaggtcgcggttcggttcgcgacgtcggggttcggagaagggaggcgagaggtttttcggagttcgacggagggaggggagggaacgaggaggtcgcgggtcggagcggggagtagtttcgagcggcgttcggttcggtttttattttgaggttcggtttcgcgtatttttggtaagggttacggtggagttttcggtgtcgatggtgtagaggatgttttcgtagcggattttcgttttggagatgaggttgattttgttgtcgatgtaaggggtgttttcgtttatggcgtcgtcgtcgtcgtttttagttgttcgtagagaggtagattttacgttattgtcgttcgtttcgtacgttcgttcgtttcgtcggcgtttatagtagtcgttttagatttaatatggcggcggcgtcggtttcgttatttttttttagtttttcgtttttaagtcgcggcgcggcggcggcggcggcggcggtagcggcggcggcgcggggtatgttgggagggcgaggtcgcgttttcgcgagatttggtcggttattggtggttttcggtttattcgtggtttcgggagtttcggtagcgtttgttggtttggattacggtggtggttttggggtcgcgtgagaggaatttcggggatcggttgagtgtttcgtggtattcgtttgttgcgggttggagaggaggcgcgcggttttttttttgatttaggtcgtggtcgttttgtcgtgggttttgtgtttttgtcgacgcggggttttcggtttggagcgttgtttattcgttttcgagttgtggcgagtcgttgtttatttttttaagacgttgaatttgtatttcgtggagtttttacggttttattatcgtagttatcgttcggggagtttttttcgaggttgtttttggagttggggtttttataaggatttaagtgttttagttttt

SEQ ID NO: 10234 - DNA, 1063 bp, Artificial Sequence
  chemically treated genomic DNA (Homo sapiens) CpG-island No: 10234
aaaaactaaaacacttaaatccttataaaaaccccaactccaaaaacaacctcgaaaaaaactccccgaacgataactacgataataaaaccgtaaaaactccacgaaatacaaattcaacgtcttaaaaaaataaacaacgactcgccacaactcgaaaacgaataaacaacgctccaaaccgaaaaccccgcgtcgacaaaaacacaaaacccacgacaaaacgaccacgacctaaatcaaaaaaaaaaccgcgcgcctcctctccaacccgcaacaaacgaataccacgaaacactcaaccgatccccgaaattcctctcacgcgaccccaaaaccaccaccgtaatccaaaccaacaaacgctaccgaaactcccgaaaccacgaataaaccgaaaaccaccaataaccgaccaaatctcgcgaaaacgcgacctcgccctcccaacataccccgcgccgccgccgctaccgccgccgccgccgccgccgcgccgcgacttaaaaacgaaaaactaaaaaaaaataacgaaaccgacgccgccgccatattaaatctaaaacgactactataaacgccgacgaaacgaacgaacgtacgaaacgaacgacaataacgtaaaatctacctctctacgaacaactaaaaacgacgacgacgacgccataaacgaaaacaccccttacatcgacaacaaaatcaacctcatctccaaaacgaaaatccgctacgaaaacatcctctacaccatcgacaccgaaaactccaccgtaacccttaccaaaaatacgcgaaaccgaacctcaaaataaaaaccgaaccgaacgccgctcgaaactactccccgctccgacccgcgacctcctcgttccctcccctccctccgtcgaactccgaaaaacctctcgcctcccttctccgaaccccgacgtcgcgaaccgaaccgcgacctccccgcgactcctaatttccgccccccgaaatatccgcgcctaaaacccgaaaaactacgaaactaaatacgcgacgaacgaccctaaaatccgaaaacgaaccgaaa

SEQ ID NO: 10235 - DNA, 1063 bp, Artificial Sequence
  chemically treated genomic DNA (Homo sapiens) CpG-island No: 10235
aggggttgaaatatttgagtttttgtgagagttttagttttaggggtagtttcgggggaagtttttcgggcgatgattgcggtaatggagtcgtaggagttttacgaggtgtaggtttagcgttttagaaggatgagtagcggttcgttatagttcggaggcgggtgggtagcgttttaggtcgagggtttcgcgtcggtaaagatataggatttacgataaggcggttacggtttgagttaaaaggaaggtcgcgcgttttttttttagttcgtagtaagcgggtgttacgaggtatttagtcggttttcgaagttttttttacgcggttttaagattattatcgtagtttaggttaataagcgttgtcgggattttcgaggttacgaatgagtcgggagttattagtagtcggttaagtttcgcgagagcgcggtttcgtttttttagtatgtttcgcgtcgtcgtcgttgtcgtcgtcgtcgtcgtcgtcgcgtcgcggtttgagggcgggaggttgggggagggtagcggagtcggcgtcgtcgttatgttgggtttgaagcggttgttgtaggcgtcgacggagcgagcgggcgtgcggagcgggcgatagtggcgtgggatttgtttttttgcgagtagttgggagcggcggcggcggcgttatgagcgggggtattttttatatcggtagtaagattagttttatttttaaggcggagattcgttacgagggtattttttatattatcgatatcgaaaattttatcgtagtttttgttaaaggtacgcgggatcgggttttagggtgggggtcgagtcgggcgtcgttcggggttgtttttcgtttcggttcgcggttttttcgttttttttttttttttcgtcgagtttcgggaggtttttcgtttttttttttcgggtttcggcgtcgcgggtcggatcgcggttttttcgcggtttttggttttcgtttttcggaatgttcgcgtttgaagttcggggaattacgggattgagtgcgcggcgggcggttttgaagttcgagaacgggtcggag

SEQ ID NO: 10236 - DNA, 1063 bp, Artificial Sequence
  chemically treated genomic DNA (Homo sapiens) CpG-island No: 10236
ctccgacccgttctcgaacttcaaaaccgcccgccgcgcactcaatcccgtaattccccgaacttcaaacgcgaacattccgaaaaacgaaaaccaaaaaccgcgaaaaaaccgcgatccgacccgcgacgccgaaacccgaaaaaaaaaaacgaaaaacctcccgaaactcgacgaaaaaaaaaaaaaaaacgaaaaaaccgcgaaccgaaacgaaaaacaaccccgaacgacgcccgactcgacccccaccctaaaacccgatcccgcgtacctttaacaaaaactacgataaaattttcgatatcgataatataaaaaataccctcgtaacgaatctccgccttaaaaataaaactaatcttactaccgatataaaaaatacccccgctcataacgccgccgccgccgctcccaactactcgcaaaaaaacaaatcccacgccactatcgcccgctccgcacgcccgctcgctccgtcgacgcctacaacaaccgcttcaaacccaacataacgacgacgccgactccgctaccctcccccaacctcccgccctcaaaccgcgacgcgacgacgacgacgacgacgacaacgacgacgacgcgaaacatactaaaaaaacgaaaccgcgctctcgcgaaacttaaccgactactaataactcccgactcattcgtaacctcgaaaatcccgacaacgcttattaacctaaactacgataataatcttaaaaccgcgtaaaaaaaacttcgaaaaccgactaaatacctcgtaacacccgcttactacgaactaaaaaaaaaacgcgcgaccttccttttaactcaaaccgtaaccgccttatcgtaaatcctatatctttaccgacgcgaaaccctcgacctaaaacgctacccacccgcctccgaactataacgaaccgctactcatccttctaaaacgctaaacctacacctcgtaaaactcctacgactccattaccgcaatcatcgcccgaaaaacttcccccgaaactacccctaaaactaaaactctcacaaaaactcaaatatttcaacccct

SEQ ID NO: 10237 - DNA, 727 bp, Artificial Sequence
  chemically treated genomic DNA (Homo sapiens) CpG-island No: 10237
cggattatatgtttttgaagatcgttcggggtcgggttttttggtaaggtttgtagtgacgttatttcgggttttggatttcggagagcgtttggagacggggtttggattttacgttcggcgcgttttttttttgtaaggcgcgcggtcgggcggggtttttatgatttttttaaggcgcggttagagttttttcgtagaaaaacgatttaaaggagacgcgtggcgcgatggcggcggttttacgcgcgggtcggcggcgcgggtagtcgtttttggcgttgttgtttttgttgttggcgttattgtcgtcgggggtttcgtcgggcgtcgacgtttattttttcgaggagcgttggagttcggagtcgtttttgtaggcgtcgcgcgtgtttatcgcgttgttggcgcgaaacgcggtttacgcgttgtttattacgttgggcgtattcgagcggttgcggtattcgcgggagcgtacggcgttatggtgagtcgagttcgttgtttttattaggcgggttacgcgagtttttgtttgttgtttttataggggtgggtttacgcgagtttttgttcgttgtttttttttgggcgggttcgcgcgtgttttttgttcgttatttttatcgggacggttttacgtatgtttttgttcgttgtttttatcgggacgggtttacgcgtgttttttgtttgttgtttttttatggggttagatatagtt

SEQ ID NO: 10238 - DNA, 727 bp, Artificial Sequence
  chemically treated genomic DNA (Homo sapiens) CpG-island No: 10238
aactatatctaaccccataaaaaaacaacaaacaaaaaacacgcgtaaacccgtcccgataaaaacaacgaacaaaaacatacgtaaaaccgtcccgataaaaataacgaacaaaaaacacgcgcgaacccgcccaaaaaaaaacaacgaacaaaaactcgcgtaaacccacccctataaaaacaacaaacaaaaactcgcgtaacccgcctaataaaaacaacgaactcgactcaccataacgccgtacgctcccgcgaataccgcaaccgctcgaatacgcccaacgtaataaacaacgcgtaaaccgcgtttcgcgccaacaacgcgataaacacgcgcgacgcctacaaaaacgactccgaactccaacgctcctcgaaaaaataaacgtcgacgcccgacgaaacccccgacgacaataacgccaacaacaaaaacaacaacgccaaaaacgactacccgcgccgccgacccgcgcgtaaaaccgccgccatcgcgccacgcgtctcctttaaatcgtttttctacgaaaaaactctaaccgcgccttaaaaaaatcataaaaaccccgcccgaccgcgcgccttacaaaaaaaaaacgcgccgaacgtaaaatccaaaccccgtctccaaacgctctccgaaatccaaaacccgaaataacgtcactacaaaccttaccaaaaaacccgaccccgaacgatcttcaaaaacatataatccg

SEQ ID NO: 10239 - DNA, 727 bp, Artificial Sequence
  chemically treated genomic DNA (Homo sapiens) CpG-island No: 10239
ggttgtgtttggttttatgggaggatagtaggtagggggtacgcgtggattcgtttcgatgggggtagcgggtaggggtatgcgtagaatcgtttcgatgggggtagcgagtaggaagtacgcgcggattcgtttagaagaggatagcgggtaggggttcgcgtggatttatttttatggggatagtaagtaggggttcgcgtgattcgtttgatggggatagcgggttcgatttattatagcgtcgtgcgttttcgcgggtgtcgtagtcgttcgagtgcgtttagcgtggtgggtaacgcgtgggtcgcgtttcgcgttaatagcgcgatgagtacgcgcggcgtttgtaggggcgatttcgggttttagcgtttttcggggaagtaggcgtcggcgttcggcggggttttcggcggtagtggcgttagtagtagaagtagtagcgttaggagcggttgttcgcgtcgtcggttcgcgcgtggggtcgtcgttatcgcgttacgcgttttttttaagtcgtttttttgcgggaggattttggtcgcgttttaaaggggttataggggtttcgttcggtcgcgcgttttataggggaggagcgcgtcgggcgtgaagtttaggtttcgtttttagacgtttttcgaagtttaaggttcggagtgacgttattgtaggttttattaggaggttcggtttcggacgatttttaggggtatatggttcg

SEQ ID NO: 10240 - DNA, 727 bp, Artificial Sequence
  chemically treated genomic DNA (Homo sapiens) CpG-island No: 10240
cgaaccatatacccctaaaaatcgtccgaaaccgaacctcctaataaaacctacaataacgtcactccgaaccttaaacttcgaaaaacgtctaaaaacgaaacctaaacttcacgcccgacgcgctcctcccctataaaacgcgcgaccgaacgaaacccctataacccctttaaaacgcgaccaaaatcctcccgcaaaaaaacgacttaaaaaaaacgcgtaacgcgataacgacgaccccacgcgcgaaccgacgacgcgaacaaccgctcctaacgctactacttctactactaacgccactaccgccgaaaaccccgccgaacgccgacgcctacttccccgaaaaacgctaaaacccgaaatcgcccctacaaacgccgcgcgtactcatcgcgctattaacgcgaaacgcgacccacgcgttacccaccacgctaaacgcactcgaacgactacgacacccgcgaaaacgcacgacgctataataaatcgaacccgctatccccatcaaacgaatcacgcgaacccctacttactatccccataaaaataaatccacgcgaacccctacccgctatcctcttctaaacgaatccgcgcgtacttcctactcgctacccccatcgaaacgattctacgcatacccctacccgctacccccatcgaaacgaatccacgcgtaccccctacctactatcctcccataaaaccaaacacaacc

SEQ ID NO: 10241 - DNA, 618 bp, Artificial Sequence
  chemically treated genomic DNA (Homo sapiens) CpG-island No: 10241
cgattgttcgattttcgcggtgttttatttgttttattgcgtatgtgttaaagataattatttaaagtattcgaaattaagcggtagggtcggtttttgcgtaggcgtattagcgacggtcgtagggagcgttttttttttttcgtcgtcgttttcgttatggtcgcgtcggtttcgggttttatttcggtgttttcgagtttttaggagttgggtgcggcgttagcgtagttggtggtttagcgcgtagtatgttgtttggtaggggttcgcgttcgtttcgcgttcggtttgtcgggcgggagtttcgtttcgatgttagttcgcgagttattcgtcgtcgtcgtttttgtcgggttagttagtttagcgcgttggacgttgggtttttgcgacgagcgtttcgtgtttttcgattacgtcgagagtacgtacggtttttatcgggtgagagttacgggggtcgtcggggattacgtcgagagggttatagttatcgtttatatttcggttacggaggtcgtcgggggttatgtcgaaagggtcgcgtttattgtttgtatttcggttacgggggttattgggtattatgttaagagggtcgtgtttattgtttgt

SEQ ID NO: 10242 - DNA, 618 bp, Artificial Sequence
  chemically treated genomic DNA (Homo sapiens) CpG-island No: 10242
acaaacaataaacacgaccctcttaacataatacccaataacccccgtaaccgaaatacaaacaataaacgcgaccctttcgacataacccccgacgacctccgtaaccgaaatataaacgataactataaccctctcgacgtaatccccgacgacccccgtaactctcacccgataaaaaccgtacgtactctcgacgtaatcgaaaaacacgaaacgctcgtcgcaaaaacccaacgtccaacgcgctaaactaactaacccgacaaaaacgacgacgacgaataactcgcgaactaacatcgaaacgaaactcccgcccgacaaaccgaacgcgaaacgaacgcgaacccctaccaaacaacatactacgcgctaaaccaccaactacgctaacgccgcacccaactcctaaaaactcgaaaacaccgaaataaaacccgaaaccgacgcgaccataacgaaaacgacgacgaaaaaaaaaaaacgctccctacgaccgtcgctaatacgcctacgcaaaaaccgaccctaccgcttaatttcgaatactttaaataattatctttaacacatacgcaataaaacaaataaaacaccgcgaaaatcgaacaatcg

SEQ ID NO: 10243 - DNA, 618 bp, Artificial Sequence
  chemically treated genomic DNA (Homo sapiens) CpG-island No: 10243
gtaggtagtgggtacggtttttttggtatgatatttagtggttttcgtagtcgaggtgtagatagtgggcgcggttttttcggtatggttttcggcggttttcgtagtcggggtgtaggcggtggttgtggttttttcggcgtgattttcggcggttttcgtagtttttattcggtagaggtcgtacgtgttttcggcgtgatcgaagggtacgaggcgttcgtcgtagaagtttagcgtttagcgcgttaagttagttggttcggtaggggcgacggcggcgggtagttcgcgggttagtatcgagacgaggttttcgttcgataggtcgagcgcgaaacgggcgcgggtttttgttaggtagtatgttgcgcgttgggttattagttgcgttagcgtcgtatttagtttttgggaattcgagaatatcgagatgaggttcggggtcggcgcggttatggcgagggcggcggcggggaggaggaagcgttttttacggtcgtcgttagtacgtttgcgtaagggtcggttttgtcgtttggtttcgagtattttgggtgattgtttttggtatatgcgtagtgaggtaagtgaagtatcgcgaaggtcgggtagtcg

SEQ ID NO: 10244 - DNA, 618 bp, Artificial Sequence
  chemically treated genomic DNA (Homo sapiens) CpG-island No: 10244
cgactacccgaccttcgcgatacttcacttacctcactacgcatataccaaaaacaatcacccaaaatactcgaaaccaaacgacaaaaccgacccttacgcaaacgtactaacgacgaccgtaaaaaacgcttcctcctccccgccgccgccctcgccataaccgcgccgaccccgaacctcatctcgatattctcgaattcccaaaaactaaatacgacgctaacgcaactaataacccaacgcgcaacatactacctaacaaaaacccgcgcccgtttcgcgctcgacctatcgaacgaaaacctcgtctcgatactaacccgcgaactacccgccgccgtcgcccctaccgaaccaactaacttaacgcgctaaacgctaaacttctacgacgaacgcctcgtacccttcgatcacgccgaaaacacgtacgacctctaccgaataaaaactacgaaaaccgccgaaaatcacgccgaaaaaaccacaaccaccgcctacaccccgactacgaaaaccgccgaaaaccataccgaaaaaaccgcgcccactatctacacctcgactacgaaaaccactaaatatcataccaaaaaaaccgtacccactacctac

SEQ ID NO: 10245 - DNA, 557 bp, Artificial Sequence
  chemically treated genomic DNA (Homo sapiens) CpG-island No: 10245
ttttagggtgtattcgatagtttttgttagcgtagtgtggacgttggataaagacgtagttagtaggtcgttggtggtcgcgggttggattcgttgatttggttattaaatttttttttcggggagtgaagcggtacggaaggagcggagttaagggcggggttggggattggattcgttttcgggttcggggattggattcgttttcgggtttcggaggagtttttgcgtttgcgtgtcgggcgtggatttgtggttggattttttcgttttgggttggttttcgcgttttttttcggttttttttattttcgtttatttgacgcgatgacgtattttaggtttgcggacgtggcggcggcgtacggatcggaaggcggagacgttggcggtagaggcggaggcggacggggttagtttaaagtagaggttcggttatgaatttattcgggatagcggcggcggcggattttttggttattttttcgtagagtgttttttgttaacggggataggtaaagatggtggtaggaggtgagggtagttcggtttaggag

SEQ ID NO: 10246 - DNA, 557 bp, Artificial Sequence
  chemically treated genomic DNA (Homo sapiens) CpG-island No: 10246
ctcctaaaccgaactaccctcacctcctaccaccatctttacctatccccgttaacaaaaaacactctacgaaaaaataaccaaaaaatccgccgccgccgctatcccgaataaattcataaccgaacctctactttaaactaaccccgtccgcctccgcctctaccgccaacgtctccgccttccgatccgtacgccgccgccacgtccgcaaacctaaaatacgtcatcgcgtcaaataaacgaaaataaaaaaaaccgaaaaaaaacgcgaaaaccaacccaaaacgaaaaaatccaaccacaaatccacgcccgacacgcaaacgcaaaaactcctccgaaacccgaaaacgaatccaatccccgaacccgaaaacgaatccaatccccaaccccgcccttaactccgctccttccgtaccgcttcactccccgaaaaaaaaatttaataaccaaatcaacgaatccaacccgcgaccaccaacgacctactaactacgtctttatccaacgtccacactacgctaacaaaaactatcgaatacaccctaaaa

SEQ ID NO: 10247 - DNA, 557 bp, Artificial Sequence
  chemically treated genomic DNA (Homo sapiens) CpG-island No: 10247
tttttggatcgggttatttttattttttgttattatttttatttgttttcgttagtagggagtattttgcgagaagatggttaaaaggttcgtcgtcgtcgttgtttcgggtaagtttatggtcgagtttttgttttgggttgatttcgttcgttttcgtttttgtcgttaacgttttcgtttttcggttcgtacgtcgtcgttacgttcgtaaatttgagatgcgttatcgcgttaagtgggcggaggtgggaagggtcgggggaggacgcggaggttagtttaaaacgggggagtttaattataggtttacgttcggtacgtaggcgtagggattttttcggggttcgggggcgggtttaattttcgggttcgggggcgggtttaatttttagtttcgtttttgatttcgtttttttcgtgtcgttttatttttcgaggaaaagatttggtggttaagttagcggatttaattcgcgattattagcgatttattggttgcgtttttgtttagcgtttatattgcgttggtagagattgtcgggtgtattttgagg

SEQ ID NO: 10248 - DNA, 557 bp, Artificial Sequence
  chemically treated genomic DNA (Homo sapiens) CpG-island No: 10248
cctcaaaatacacccgacaatctctaccaacgcaatataaacgctaaacaaaaacgcaaccaataaatcgctaataatcgcgaattaaatccgctaacttaaccaccaaatcttttcctcgaaaaataaaacgacacgaaaaaaacgaaatcaaaaacgaaactaaaaattaaacccgcccccgaacccgaaaattaaacccgcccccgaaccccgaaaaaatccctacgcctacgtaccgaacgtaaacctataattaaactcccccgttttaaactaacctccgcgtcctcccccgacccttcccacctccgcccacttaacgcgataacgcatctcaaatttacgaacgtaacgacgacgtacgaaccgaaaaacgaaaacgttaacgacaaaaacgaaaacgaacgaaatcaacccaaaacaaaaactcgaccataaacttacccgaaacaacgacgacgacgaaccttttaaccatcttctcgcaaaatactccctactaacgaaaacaaataaaaataataacaaaaaataaaaataacccgatccaaaaa

SEQ ID NO: 10249 - DNA, 556 bp, Artificial Sequence
  chemically treated genomic DNA (Homo sapiens) CpG-island No: 10249
tcgttcgcgtattttattttcgtgtattttttatttggtttgcgggttcgggtgcgggtagataatagcgggtcgtatagattgaagtaggcggttattagtagtagtcgtcgcggttttattgtttcgggttttgcgcggcgttgtttcgggaggttgtttcgtttcgggttgtttcgttttatttttttttttgatttttgcgggtcggggagtcggttttcgcggtaggtagagcgtagggtgtttacggtgtaagattagggtttaagcgattttcggcgagcgttgtgtttggggcggttagcggggcggggcgggattggggcgcgcggtcgcgcgggcgcgagcgaggaagggcgtttttcggcgtgtagtgagagtttttgcgttggagtcgttcggcgtttttttttcgcggttttttagtcgtcgttcgtaagtttttttggttttgtgcgtttcgtttcgtttcgatttgttttattggggggtttggtcgtcggttattgtcgggtttagaagtttatttagttcggtattagtttagattttt

SEQ ID NO: 10250 - DNA, 556 bp, Artificial Sequence
  chemically treated genomic DNA (Homo sapiens) CpG-island No: 10250
aaaaatctaaactaataccgaactaaataaacttctaaacccgacaataaccgacgaccaaaccccccaataaaacaaatcgaaacgaaacgaaacgcacaaaaccaaaaaaacttacgaacgacgactaaaaaaccgcgaaaaaaaaacgccgaacgactccaacgcaaaaactctcactacacgccgaaaaacgcccttcctcgctcgcgcccgcgcgaccgcgcgccccaatcccgccccgccccgctaaccgccccaaacacaacgctcgccgaaaatcgcttaaaccctaatcttacaccgtaaacaccctacgctctacctaccgcgaaaaccgactccccgacccgcaaaaatcaaaaaaaaaaataaaacgaaacaacccgaaacgaaacaacctcccgaaacaacgccgcgcaaaacccgaaacaataaaaccgcgacgactactactaataaccgcctacttcaatctatacgacccgctattatctacccgcacccgaacccgcaaaccaaataaaaaatacacgaaaataaaatacgcgaacga

SEQ ID NO: 10251 - DNA, 556 bp, Artificial Sequence
  chemically treated genomic DNA (Homo sapiens) CpG-island No: 10251
aagggtttgagttggtatcgaattgagtggatttttaggttcggtagtggtcggcggttaggttttttagtagggtaggtcggggcggggcggggcgtatagagttagaggggtttgcgagcggcggttgagggatcgcggggagggggcgtcgagcggttttagcgtagagatttttattgtacgtcggagggcgttttttttcgttcgcgttcgcgcgatcgcgcgttttagtttcgtttcgtttcgttaatcgttttagatatagcgttcgtcgagggtcgtttggattttgattttatatcgtgggtattttgcgttttgtttgtcgcgaagatcggtttttcgattcgtagaagttaggagagagggtgaagcggagtagttcgaggcggggtagtttttcggagtagcgtcgcgtagagttcgggataatggggtcgcggcggttgttgttggtggtcgtttgttttagtttgtgcggttcgttgttgtttgttcgtattcgggttcgtaggttaggtgagagatgtacgggaatggggtgcgcgggcgg

SEQ ID NO: 10252 - DNA, 556 bp, Artificial Sequence
  chemically treated genomic DNA (Homo sapiens) CpG-island No: 10252
ccgcccgcgcaccccattcccgtacatctctcacctaacctacgaacccgaatacgaacaaacaacaacgaaccgcacaaactaaaacaaacgaccaccaacaacaaccgccgcgaccccattatcccgaactctacgcgacgctactccgaaaaactaccccgcctcgaactactccgcttcaccctctctcctaacttctacgaatcgaaaaaccgatcttcgcgacaaacaaaacgcaaaatacccacgatataaaatcaaaatccaaacgaccctcgacgaacgctatatctaaaacgattaacgaaacgaaacgaaactaaaacgcgcgatcgcgcgaacgcgaacgaaaaaaaacgccctccgacgtacaataaaaatctctacgctaaaaccgctcgacgccccctccccgcgatccctcaaccgccgctcgcaaacccctctaactctatacgccccgccccgccccgacctaccctactaaaaaacctaaccgccgaccactaccgaacctaaaaatccactcaattcgataccaactcaaaccctt

SEQ ID NO: 10253 - DNA, 646 bp, Artificial Sequence
  chemically treated genomic DNA (Homo sapiens) CpG-island No: 10253
gtagtttttgtcgtttcgtttatttgtatatggtaggtttcgtttttagcgtttagtttcgttatatcgtttattattagtacgcggtagttcggtattttagttagtatttggattgttgtagttattgaatcgatattggcgttgtaggagtcgtcgagtagtaattggttttttgttagttggatggggaatagacggtttggaatagtttttagatttgttagtttcgttttgatagtattaagcgttgcgtttacggatatggagagcgtagcggttgttagcgtattcgtaatattgtgacgtttcggtaacggtagtagaatatcgacgttatcggttggggtttgtagggtaaatttcgtatcgtgcgaggttatatggatattggtggcggtgaaatcgttgttggcggtattgggtgagaaacgttatattttgcgtgagttaattacgttttgttagtttagttagtcgttgttgtcggcgtttataatggcgatatcgtttttcggtaggtcgttaaagattttattttcgttttcgcgatatcgtaagcgagttaaaattttcgattgcgtcgtgtcggttgtgattagcgtagttttcggcgaattcgattttaggttaggttatttcgttt

SEQ ID NO: 10254 - DNA, 646 bp, Artificial Sequence
  chemically treated genomic DNA (Homo sapiens) CpG-island No: 10254
aaacgaaataacctaacctaaaatcgaattcgccgaaaactacgctaatcacaaccgacacgacgcaatcgaaaattttaactcgcttacgatatcgcgaaaacgaaaataaaatctttaacgacctaccgaaaaacgatatcgccattataaacgccgacaacaacgactaactaaactaacaaaacgtaattaactcacgcaaaatataacgtttctcacccaataccgccaacaacgatttcaccgccaccaatatccatataacctcgcacgatacgaaatttaccctacaaaccccaaccgataacgtcgatattctactaccgttaccgaaacgtcacaatattacgaatacgctaacaaccgctacgctctccatatccgtaaacgcaacgcttaatactatcaaaacgaaactaacaaatctaaaaactattccaaaccgtctattccccatccaactaacaaaaaaccaattactactcgacgactcctacaacgccaatatcgattcaataactacaacaatccaaatactaactaaaataccgaactaccgcgtactaataataaacgatataacgaaactaaacgctaaaaacgaaacctaccatatacaaataaacgaaacgacaaaaactac

SEQ ID NO: 10255 - DNA, 646 bp, Artificial Sequence
  chemically treated genomic DNA (Homo sapiens) CpG-island No: 10255
aggcgaaatagtttggtttgggatcggattcgtcgggaattgcgttggttataatcggtacggcgtaatcggaagttttggttcgtttgcggtgtcgcgaaagcgaaagtgaaatttttagcggtttgtcggaaaacggtatcgttattatgaacgtcgataataacgattggttgaattggtagagcgtaattggtttacgtaaagtgtggcgttttttatttaatgtcgttaatagcgattttatcgttattaatatttatgtgatttcgtacggtacggaatttattttataaattttaatcggtagcgtcgatgttttgttgtcgttgtcggggcgttataatattgcgaatgcgttggtagtcgttgcgttttttatgttcgtgggcgtaacgtttgatgttattaaagcggggttggtaaatttgaaagttgttttaggtcgtttgttttttatttaattggtagaaaattagttgttgttcgacgatttttataacgttaatgtcggtttaatgattgtagtagtttaggtattggttgaaatgtcgggttatcgcgtgttggtggtgggcgatatggcggaattgggcgttgaaagcgaagtttgttatgtataggtgggcgaggcggtaaaagttgt

SEQ ID NO: 10256 - DNA, 646 bp, Artificial Sequence
  chemically treated genomic DNA (Homo sapiens) CpG-island No: 10256
acaacttttaccgcctcgcccacctatacataacaaacttcgctttcaacgcccaattccgccatatcgcccaccaccaacacgcgataacccgacatttcaaccaatacctaaactactacaatcattaaaccgacattaacgttataaaaatcgtcgaacaacaactaattttctaccaattaaataaaaaacaaacgacctaaaacaactttcaaatttaccaaccccgctttaataacatcaaacgttacgcccacgaacataaaaaacgcaacgactaccaacgcattcgcaatattataacgccccgacaacgacaacaaaacatcgacgctaccgattaaaatttataaaataaattccgtaccgtacgaaatcacataaatattaataacgataaaatcgctattaacgacattaaataaaaaacgccacactttacgtaaaccaattacgctctaccaattcaaccaatcgttattatcgacgttcataataacgataccgttttccgacaaaccgctaaaaatttcactttcgctttcgcgacaccgcaaacgaaccaaaacttccgattacgccgtaccgattataaccaacgcaattcccgacgaatccgatcccaaaccaaactatttcgcct

SEQ ID NO: 10257 - DNA, 542 bp, Artificial Sequence
  chemically treated genomic DNA (Homo sapiens) CpG-island No: 10257
gttgtagtaggttattaggcggacgggcgtcgatatatttcgtaggcgatagcgtaaggtgtggttgttattattgtagaggcgaaagatgaggcgatcgatggtgaaattcgtgaaatgtacggcgtatcggttatttattttagttagtttaacgagcgtttatttgtattggcgggtcgtttttattatgaattttttgataatttacgtttcgtgggcgtaacgggtattaacggtaaaattacgattatttagttgttggcgtagtggagttaattgtttggcgaaattagcgcggtaatgggtatcgttggtaacggtttgttggggaaagtgatttcgatagaaaatataatcggttcggtagtcgatgtttagtatgagttggcggggttggtggattagggcgcgacgttttgcgtaatggaagtttttttttacgggttggtatagtatcgtgtggcggtattgaaatttgcggcgtcggtttttattaatttaagtcgcgattattttgattattatggtgatatggaata

SEQ ID NO: 10258 - DNA, 542 bp, Artificial Sequence
  chemically treated genomic DNA (Homo sapiens) CpG-island No: 10258
tattccatatcaccataataatcaaaataatcgcgacttaaattaataaaaaccgacgccgcaaatttcaataccgccacacgatactataccaacccgtaaaaaaaaacttccattacgcaaaacgtcgcgccctaatccaccaaccccgccaactcatactaaacatcgactaccgaaccgattatattttctatcgaaatcactttccccaacaaaccgttaccaacgatacccattaccgcgctaatttcgccaaacaattaactccactacgccaacaactaaataatcgtaattttaccgttaatacccgttacgcccacgaaacgtaaattatcaaaaaattcataataaaaacgacccgccaatacaaataaacgctcgttaaactaactaaaataaataaccgatacgccgtacatttcacgaatttcaccatcgatcgcctcatctttcgcctctacaataataacaaccacaccttacgctatcgcctacgaaatatatcgacgcccgtccgcctaataacctactacaac

SEQ ID NO: 10259 - DNA, 542 bp, Artificial Sequence
  chemically treated genomic DNA (Homo sapiens) CpG-island No: 10259
tgttttatattattatgataattaaggtgatcgcggtttaagttggtaaagatcgacgtcgtaaattttaatgtcgttatacggtgttgtattagttcgtgggaggaaatttttattgcgtaaaacgtcgcgttttgatttattagtttcgttagtttatgttgaatatcgattgtcgaatcggttgtattttttgtcgggattattttttttagtaggtcgttattaacggtgtttattatcgcgttgatttcgttaagtagttggttttattgcgttaatagttgggtagtcgtggttttgtcgttggtgttcgttacgtttacgagacgtaaattgttagagggtttatggtaaaagcggttcgttagtgtagataaacgttcgttgagttggttgagatagatgatcggtacgtcgtgtattttacggattttattatcggtcgttttatttttcgtttttgtaataatggtagttatattttgcgttatcgtttgcgggatatatcgacgttcgttcgtttgatgatttattatagt

SEQ ID NO: 10260 - DNA, 542 bp, Artificial Sequence
  chemically treated genomic DNA (Homo sapiens) CpG-island No: 10260
actataataaatcatcaaacgaacgaacgtcgatatatcccgcaaacgataacgcaaaatataactaccattattacaaaaacgaaaaataaaacgaccgataataaaatccgtaaaatacacgacgtaccgatcatctatctcaaccaactcaacgaacgtttatctacactaacgaaccgcttttaccataaaccctctaacaatttacgtctcgtaaacgtaacgaacaccaacgacaaaaccacgactacccaactattaacgcaataaaaccaactacttaacgaaatcaacgcgataataaacaccgttaataacgacctactaaaaaaaataatcccgacaaaaaatacaaccgattcgacaatcgatattcaacataaactaacgaaactaataaatcaaaacgcgacgttttacgcaataaaaatttcctcccacgaactaatacaacaccgtataacgacattaaaatttacgacgtcgatctttaccaacttaaaccgcgatcaccttaattatcataataatataaaaca

SEQ ID NO: 10261 - DNA, 531 bp, Artificial Sequence
  chemically treated genomic DNA (Homo sapiens) CpG-island No: 10261
gtcgggtaaatagggcgcggatattgtttttggtttaggcgtaacgtttcgtgcgtgtcgataggttacggtggtttatacgcggtattttttgcggcgaaagatgaatataaacgtttaatgtttgggtcgtattatcggtgtatcgaaagatgtagttggtaagtatcgcgttgcgtatggcgatgtagattcgcgagtaatatattcgtcgtgagaaagcgaattttaaatatttgtattttttaggtattgttgtgttaaatatcgttagtttgtatgtcgtttattacggttcggttggtttgaaacgtatcgttatcgtatttatcgtttgatcgatattttggcggcgggtttgtaataaaaaggtttgaaattgcgttatgcgtattatttcgatattttgtgtgtggaagtggtcgataaagcgggcgtattgacgcgtgtttgaagcggttgaaattaattttgcgtagcgatttttgaacgcggttgggattatttttgatgaaataattacgcgtgata

SEQ ID NO: 10262 - DNA, 531 bp, Artificial Sequence
  chemically treated genomic DNA (Homo sapiens) CpG-island No: 10262
tatcacgcgtaattatttcatcaaaaataatcccaaccgcgttcaaaaatcgctacgcaaaattaatttcaaccgcttcaaacacgcgtcaatacgcccgctttatcgaccacttccacacacaaaatatcgaaataatacgcataacgcaatttcaaacctttttattacaaacccgccgccaaaatatcgatcaaacgataaatacgataacgatacgtttcaaaccaaccgaaccgtaataaacgacatacaaactaacgatatttaacacaacaatacctaaaaaatacaaatatttaaaattcgctttctcacgacgaatatattactcgcgaatctacatcgccatacgcaacgcgatacttaccaactacatctttcgatacaccgataatacgacccaaacattaaacgtttatattcatctttcgccgcaaaaaataccgcgtataaaccaccgtaacctatcgacacgcacgaaacgttacgcctaaaccaaaaacaatatccgcgccctatttacccgac

SEQ ID NO: 10263 - DNA, 531 bp, Artificial Sequence
  chemically treated genomic DNA (Homo sapiens) CpG-island No: 10263
tgttacgcgtggttgttttattaagagtgattttaatcgcgtttagaaatcgttacgtaaggttgattttagtcgttttaggtacgcgttagtacgttcgttttgtcggttatttttatatataaggtgtcgaaatagtgcgtatggcgtagttttagatttttttgttgtaggttcgtcgttaggatatcggttagacggtgaatgcggtagcgatacgttttaggttaatcgggtcgtgataaacggtatataggttggcgatgtttagtatagtagtatttgggaagtataaatgtttggagttcgtttttttacggcggatatgttgttcgcgagtttgtatcgttatgcgtagcgcggtatttgttagttgtatttttcgatatatcgataatacggtttaggtattgagcgtttgtatttatttttcgtcgtaaagaatgtcgcgtgtgggttatcgtagtttatcggtacgtacgaagcgttgcgtttgaattaaaaataatattcgcgttttgtttattcggt

SEQ ID NO: 10264 - DNA, 531 bp, Artificial Sequence
  chemically treated genomic DNA (Homo sapiens) CpG-island No: 10264
accgaataaacaaaacgcgaatattatttttaattcaaacgcaacgcttcgtacgtaccgataaactacgataacccacacgcgacattctttacgacgaaaaataaatacaaacgctcaatacctaaaccgtattatcgatatatcgaaaaatacaactaacaaataccgcgctacgcataacgatacaaactcgcgaacaacatatccgccgtaaaaaaacgaactccaaacatttatacttcccaaatactactatactaaacatcgccaacctatataccgtttatcacgacccgattaacctaaaacgtatcgctaccgcattcaccgtctaaccgatatcctaacgacgaacctacaacaaaaaaatctaaaactacgccatacgcactatttcgacaccttatatataaaaataaccgacaaaacgaacgtactaacgcgtacctaaaacgactaaaatcaaccttacgtaacgatttctaaacgcgattaaaatcactcttaataaaacaaccacgcgtaaca

SEQ ID NO: 10265 - DNA, 713 bp, Artificial Sequence
  chemically treated genomic DNA (Homo sapiens) CpG-island No: 10265
cgtttatcgtgacggtttcgttatcgttggcggcggcggtatggtagtggttgaagagttggaatacgcgttggcgcgtggtgtttatatttatgttgaaatcgttggttacggcgtaatttttgatggtgtagatatggttgtttcgtttggcgaaggcgtagtacgttgtatgaagatggcgatgtatggcgttgatattttaatcgattatttgaatttttacggtatttcgatttcggttggcgacgtgaaagagttggtagttattcgtgaagtgttcggcgataagagttcggcgatttttgtaattaaagttatgatcggttattttttgggcgttgttggcgtataggaagttatttattttttgttgatgttggaatacggttttatcgtttcgagtattaatattgaagagttggacgagtaggttgcgggtttgaatatcgtgatcgaaacgatcgatcgcgaaattgattatcgttatgtttaatagtttcggtttcggcggtattaacgttacgttggtaatgcgtaagttgaaagattaattcgtagtaggtcggagtagacgcgttagcgtcgtatacgacgttacggcgttaatgcgggtttcggtattaacggtaaaagggaatttgttggttttttttttatattattgtaaaatgtcggtcgatttagcggaaatttcgcgttgtggtattttt

SEQ ID NO: 10266 - DNA, 713 bp, Artificial Sequence
  chemically treated genomic DNA (Homo sapiens) CpG-island No: 10266
aaaaataccacaacgcgaaatttccgctaaatcgaccgacattttacaataatataaaaaaaaaaccaacaaattcccttttaccgttaataccgaaacccgcattaacgccgtaacgtcgtatacgacgctaacgcgtctactccgacctactacgaattaatctttcaacttacgcattaccaacgtaacgttaataccgccgaaaccgaaactattaaacataacgataatcaatttcgcgatcgatcgtttcgatcacgatattcaaacccgcaacctactcgtccaactcttcaatattaatactcgaaacgataaaaccgtattccaacatcaacaaaaaataaataacttcctatacgccaacaacgcccaaaaaataaccgatcataactttaattacaaaaatcgccgaactcttatcgccgaacacttcacgaataactaccaactctttcacgtcgccaaccgaaatcgaaataccgtaaaaattcaaataatcgattaaaatatcaacgccatacatcgccatcttcatacaacgtactacgccttcgccaaacgaaacaaccatatctacaccatcaaaaattacgccgtaaccaacgatttcaacataaatataaacaccacgcgccaacgcgtattccaactcttcaaccactaccataccgccgccgccaacgataacgaaaccgtcacgataaacg

SEQ ID NO: 10267 - DNA, 713 bp, Artificial Sequence
  chemically treated genomic DNA (Homo sapiens) CpG-island No: 10267
agaaatgttataacgcggaattttcgttgaatcggtcggtattttataatgatgtgaaaagggaattagtaggtttttttttgtcgttagtgtcggagttcgtattggcgtcgtaacgtcgtatgcgacgttggcgcgtttatttcgatttattgcgaattaattttttagtttgcgtattattagcgtggcgttggtgtcgtcgaagtcgaagttgttagatataacggtggttagtttcgcgatcggtcgtttcggttacgatgtttagattcgtagtttgttcgtttagttttttaatgttgatgttcggggcgataaagtcgtgttttagtattagtagagagtagatagttttttgtacgttagtagcgtttagagagtgatcggttatggttttggttgtagaaatcgtcgggtttttatcgtcgaatattttacggatagttgttagtttttttacgtcgttaatcggagtcgaagtatcgtgggagtttaggtaatcgattggggtattaacgttatgtatcgttatttttatgtagcgtattgcgttttcgttagacggagtaattatgtttgtattattagaggttgcgtcgtagttaacgattttagtatagatgtgagtattacgcgttagcgcgtgttttagttttttaattattattatatcgtcgtcgttagcgataacgaaatcgttacggtgagcg

SEQ ID NO: 10268 - DNA, 713 bp, Artificial Sequence
  chemically treated genomic DNA (Homo sapiens) CpG-island No: 10268
cgctcaccgtaacgatttcgttatcgctaacgacgacgatataataataattaaaaaactaaaacacgcgctaacgcgtaatactcacatctatactaaaatcgttaactacgacgcaacctctaataatacaaacataattactccgtctaacgaaaacgcaatacgctacataaaaataacgatacataacgttaataccccaatcgattacctaaactcccacgatacttcgactccgattaacgacgtaaaaaaactaacaactatccgtaaaatattcgacgataaaaacccgacgatttctacaaccaaaaccataaccgatcactctctaaacgctactaacgtacaaaaaactatctactctctactaatactaaaacacgactttatcgccccgaacatcaacattaaaaaactaaacgaacaaactacgaatctaaacatcgtaaccgaaacgaccgatcgcgaaactaaccaccgttatatctaacaacttcgacttcgacgacaccaacgccacgctaataatacgcaaactaaaaaattaattcgcaataaatcgaaataaacgcgccaacgtcgcatacgacgttacgacgccaatacgaactccgacactaacgacaaaaaaaaacctactaattcccttttcacatcattataaaataccgaccgattcaacgaaaattccgcgttataacatttct

SEQ ID NO: 10269 - DNA, 707 bp, Artificial Sequence
  chemically treated genomic DNA (Homo sapiens) CpG-island No: 10269
attttaagcgtaatcgtttttgtatgacgtaggttatcgcgtttaagtttaacgatcgttttttggatttcgttttttatttataagatttgatcgaggttgtgaattatcgggattattaattgggcgttgtcgaaattggcggcgcgtaaaatggttcgtagttgagtgcggaataggttagtaaatttcgggtaaatacgtatcgcgcgatagtcgaggaacgggttttttttttggggaatatttagataaggaatgtttttatcgtcgtcgatgtttatcgtgcggaagataatcggtttgtcgttcgtcgttagtagtatttgttggtaggttttaaattgtttttgttcgttcggcgcgttgtcgcgatttatatagagtatttcggtacggaatagttcgatatttttcgcgtcgttggtaaacgcgtttggcgtttttagagcggtgtcgatattcgtcgtaatattaatacgtttgttattacgggaataggttagttgcgcggtagtttgcgtttgttgtttttggcgtttattcgttagcgtttgcgcgaattgataataatcgttttacgcgttatttcgggttaatggtagtacgtcgaattgaggttaaatattttgtaggttgttcgtattataggtaacgtatttagggaagttattatacggatattaagaagggttaataggtttaag

SEQ ID NO: 10270 - DNA, 707 bp, Artificial Sequence
  chemically treated genomic DNA (Homo sapiens) CpG-island No: 10270
cttaaacctattaacccttcttaatatccgtataataacttccctaaatacgttacctataatacgaacaacctacaaaatatttaacctcaattcgacgtactaccattaacccgaaataacgcgtaaaacgattattatcaattcgcgcaaacgctaacgaataaacgccaaaaacaacaaacgcaaactaccgcgcaactaacctattcccgtaataacaaacgtattaatattacgacgaatatcgacaccgctctaaaaacgccaaacgcgtttaccaacgacgcgaaaaatatcgaactattccgtaccgaaatactctatataaatcgcgacaacgcgccgaacgaacaaaaacaatttaaaacctaccaacaaatactactaacgacgaacgacaaaccgattatcttccgcacgataaacatcgacgacgataaaaacattccttatctaaatattccccaaaaaaaaaacccgttcctcgactatcgcgcgatacgtatttacccgaaatttactaacctattccgcactcaactacgaaccattttacgcgccgccaatttcgacaacgcccaattaataatcccgataattcacaacctcgatcaaatcttataaataaaaaacgaaatccaaaaaacgatcgttaaacttaaacgcgataacctacgtcatacaaaaacgattacgcttaaaat

SEQ ID NO: 10271 - DNA, 707 bp, Artificial Sequence
  chemically treated genomic DNA (Homo sapiens) CpG-island No: 10271
tttaaatttgttggttttttttggtattcgtatgatggtttttttgaatgcgttgtttgtaatgcgggtaatttgtaaggtgtttaattttagttcggcgtgttgttattaattcggaatgacgcgtgaagcggttattattagttcgcgtagacgttggcggataaacgttaaaaataataggcgtaggttgtcgcgtagttggtttattttcgtgataataagcgtattgatattgcggcgaatatcggtatcgttttggaagcgttaggcgcgtttgttaacggcgcggaaggtgtcgggttgtttcgtatcgaaatgttttatatggatcgcgatagcgcgtcggacgagtaggagtaatttgaagtttattagtaggtgttattggcggcgggcgataagtcgattatttttcgtacgatggatatcggcggcgataaaagtattttttatttgaatattttttaggaagagaattcgtttttcggttatcgcgcggtacgtatttattcggaatttgttggtttgtttcgtatttaattgcgggttattttgcgcgtcgttagtttcggtaacgtttagttgatgatttcgatggtttatagtttcgattagattttatgggtgaaaggcgagatttaaaaagcgatcgttgagtttaagcgcgatggtttgcgttatgtagagacgattacgtttgggat

SEQ ID NO: 10272 - DNA, 707 bp, Artificial Sequence
  chemically treated genomic DNA (Homo sapiens) CpG-island No: 10272
atcccaaacgtaatcgtctctacataacgcaaaccatcgcgcttaaactcaacgatcgctttttaaatctcgcctttcacccataaaatctaatcgaaactataaaccatcgaaatcatcaactaaacgttaccgaaactaacgacgcgcaaaataacccgcaattaaatacgaaacaaaccaacaaattccgaataaatacgtaccgcgcgataaccgaaaaacgaattctcttcctaaaaaatattcaaataaaaaatacttttatcgccgccgatatccatcgtacgaaaaataatcgacttatcgcccgccgccaataacacctactaataaacttcaaattactcctactcgtccgacgcgctatcgcgatccatataaaacatttcgatacgaaacaacccgacaccttccgcgccgttaacaaacgcgcctaacgcttccaaaacgataccgatattcgccgcaatatcaatacgcttattatcacgaaaataaaccaactacgcgacaacctacgcctattatttttaacgtttatccgccaacgtctacgcgaactaataataaccgcttcacgcgtcattccgaattaataacaacacgccgaactaaaattaaacaccttacaaattacccgcattacaaacaacgcattcaaaaaaaccatcatacgaataccaaaaaaaaccaacaaatttaaa

SEQ ID NO: 10273 - DNA, 507 bp, Artificial Sequence
  chemically treated genomic DNA (Homo sapiens) CpG-island No: 10273
acgatgagatagtattcgatacggagatgtagatagtattttaggcgaaggatagagtgtagttaacgaggaaattaaacgagaagatagtgggtatatagacgacgtacgagtacgagcgtaagcgagatacgaacgagggagtagtagtcgataatacgataggagtttaataataggagataatacgtggatatagagtcgttatggtaacgaatgatatcgatagaattaatagagatacgtgagagatatattatagaggtagtcgatataggtatatatagaggatacgagcgtaatttacgcgtgatatatttatgaattatcgatatatgaatatagtataggtgattatcgcggtatagttgaggtagatatcgaaggatagatattagttagacggaagtaggtacggggtatataggtacgcgacgtgtagtcgaagtaacgagtcgtacgtataatggtttagaataagagtaaagagttataaagatgaagagt

SEQ ID NO: 10274 - DNA, 507 bp, Artificial Sequence
  chemically treated genomic DNA (Homo sapiens) CpG-island No: 10274
actcttcatctttataactctttactcttattctaaaccattatacgtacgactcgttacttcgactacacgtcgcgtacctatataccccgtacctacttccgtctaactaatatctatccttcgatatctacctcaactataccgcgataatcacctatactatattcatatatcgataattcataaatatatcacgcgtaaattacgctcgtatcctctatatatacctatatcgactacctctataatatatctctcacgtatctctattaattctatcgatatcattcgttaccataacgactctatatccacgtattatctcctattattaaactcctatcgtattatcgactactactccctcgttcgtatctcgcttacgctcgtactcgtacgtcgtctatatacccactatcttctcgtttaatttcctcgttaactacactctatccttcgcctaaaatactatctacatctccgtatcgaatactatctcatcgt

SEQ ID NO: 10275 - DNA, 507 bp, Artificial Sequence
  chemically treated genomic DNA (Homo sapiens) CpG-island No: 10275
attttttatttttataattttttgtttttgttttgagttattgtacgtacggttcgttgtttcgattgtacgtcgcgtgtttgtgtatttcgtatttattttcgtttggttagtgtttatttttcgatgtttattttagttgtgtcgcggtgattatttgtattgtgtttatgtgtcggtggtttatgagtgtgttacgcgtgagttgcgttcgtgttttttgtgtgtgtttgtgtcgattatttttgtagtgtgttttttacgtgtttttgttggttttatcggtgttattcgttgttatggcggttttatgtttacgtgttgttttttgttgttaggtttttgtcgtgttgtcggttattgttttttcgttcgtgtttcgtttgcgttcgtgttcgtgcgtcgtttgtgtgtttattattttttcgtttggttttttcgttagttgtattttgtttttcgtttagggtgttgtttatattttcgtgtcgggtgttgttttatcgt

SEQ ID NO: 10276 - DNA, 507 bp, Artificial Sequence
  chemically treated genomic DNA (Homo sapiens) CpG-island No: 10276
acgataaaacaacacccgacacgaaaatataaacaacaccctaaacgaaaaacaaaatacaactaacgaaaaaaccaaacgaaaaaataataaacacacaaacgacgcacgaacacgaacgcaaacgaaacacgaacgaaaaaacaataaccgacaacacgacaaaaacctaacaacaaaaaacaacacgtaaacataaaaccgccataacaacgaataacaccgataaaaccaacaaaaacacgtaaaaaacacactacaaaaataatcgacacaaacacacacaaaaaacacgaacgcaactcacgcgtaacacactcataaaccaccgacacataaacacaatacaaataatcaccgcgacacaactaaaataaacatcgaaaaataaacactaaccaaacgaaaataaatacgaaatacacaaacacgcgacgtacaatcgaaacaacgaaccgtacgtacaataactcaaaacaaaaacaaaaaattataaaaataaaaaat

SEQ ID NO: 10277 - DNA, 709 bp, Artificial Sequence
  chemically treated genomic DNA (Homo sapiens) CpG-island No: 10277
tacgtagacgttatagatcgtatacgtcgtacgcgatattagataagcgagtttacgagtaagtaagatattataatatagataggttgacggagataagcgttagacgagatacgtcgaagtttaggtaatacgtatatatatcggaagaaggaagacgataaaagagatagtaacggtattatgcgtacgagtaagagagagacgatcgaatattagtagtaagtatacgtcgacgagtagatacgacgaatagtaagaatatatcgtagaatagtacgatatatagtagtatatatatatagaataagagtagtagtaagatagacgatagagaaagataacgagtagagcgatacgtaattatcgatataaaagatatcgagcgcgatcgtaatagtatatatattacggcgaatagagacgattattaatatagtataagtacgatatacgagcgcgcgtgagagaaattatacgcgatagtattaggcgatacgtcgagagataataataaacgtatatattaatatattatattattacgtagagtatatataattacgtagttagtaatagacgataagtatcgagcgattaataatagatagtagtataataataaataataataattatatattacgaatagttagagacgaacgacgtatgatatagtataagtattcgagtagagtattaattataa

SEQ ID NO: 10278 - DNA, 709 bp, Artificial Sequence
  chemically treated genomic DNA (Homo sapiens) CpG-island No: 10278
ttataattaatactctactcgaatacttatactatatcatacgtcgttcgtctctaactattcgtaatatataattattattatttattattatactactatctattattaatcgctcgatacttatcgtctattactaactacgtaattatatatactctacgtaataatataatatattaatatatacgtttattattatctctcgacgtatcgcctaatactatcgcgtataatttctctcacgcgcgctcgtatatcgtacttatactatattaataatcgtctctattcgccgtaatatatatactattacgatcgcgctcgatatcttttatatcgataattacgtatcgctctactcgttatctttctctatcgtctatcttactactactcttattctatatatatatactactatatatcgtactattctacgatatattcttactattcgtcgtatctactcgtcgacgtatacttactactaatattcgatcgtctctctcttactcgtacgcataataccgttactatctcttttatcgtcttccttcttccgatatatatacgtattacctaaacttcgacgtatctcgtctaacgcttatctccgtcaacctatctatattataatatcttacttactcgtaaactcgcttatctaatatcgcgtacgacgtatacgatctataacgtctacgta

SEQ ID NO: 10279 - DNA, 709 bp, Artificial Sequence
  chemically treated genomic DNA (Homo sapiens) CpG-island No: 10279
ttgtggttgatgttttgttcgggtgtttgtgttgtgttatgcgtcgttcgtttttgattgttcgtggtgtgtggttgttgttgtttattgttgtgttgttgtttgttgttggtcgttcggtgtttgtcgtttgttgttggttgcgtgattgtgtgtgttttgcgtggtagtgtggtgtgttggtgtgtgcgtttgttgttgtttttcggcgtgtcgtttggtgttgtcgcgtgtggttttttttacgcgcgttcgtgtgtcgtgtttgtattatgttagtggtcgtttttgttcgtcgtggtgtgtgtgttgttgcggtcgcgttcggtgttttttgtgtcggtggttgcgtgtcgttttgttcgttatttttttttgtcgtttgttttgttgttatttttgttttgtgtgtgtgtgttgttgtgtgtcgtgttgttttgcggtgtgtttttgttgttcgtcgtgtttgttcgtcggcgtatgtttgttgttagtgttcggtcgttttttttttgttcgtacgtatggtatcgttgttgttttttttatcgttttttttttttcggtgtgtgtgcgtgttgtttgagtttcggcgtgtttcgtttggcgtttgttttcgttagtttgtttgtgttgtgatattttgtttgttcgtgggttcgtttgtttagtgtcgcgtgcggcgtgtacggtttgtggcgtttgcgtg

SEQ ID NO: 10280 - DNA, 709 bp, Artificial Sequence
  chemically treated genomic DNA (Homo sapiens) CpG-island No: 10280
cacgcaaacgccacaaaccgtacacgccgcacgcgacactaaacaaacgaacccacgaacaaacaaaatatcacaacacaaacaaactaacgaaaacaaacgccaaacgaaacacgccgaaactcaaacaacacgcacacacaccgaaaaaaaaaaaacgataaaaaaaacaacaacgataccatacgtacgaacaaaaaaaaaacgaccgaacactaacaacaaacatacgccgacgaacaaacacgacgaacaacaaaaacacaccgcaaaacaacacgacacacaacaacacacacacacaaaacaaaaataacaacaaaacaaacgacaaaaaaaaataacgaacaaaacgacacgcaaccaccgacacaaaaaacaccgaacgcgaccgcaacaacacacacaccacgacgaacaaaaacgaccactaacataatacaaacacgacacacgaacgcgcgtaaaaaaaaccacacgcgacaacaccaaacgacacgccgaaaaacaacaacaaacgcacacaccaacacaccacactaccacgcaaaacacacacaatcacgcaaccaacaacaaacgacaaacaccgaacgaccaacaacaaacaacaacacaacaataaacaacaacaaccacacaccacgaacaatcaaaaacgaacgacgcataacacaacacaaacacccgaacaaaacatcaaccacaa

SEQ ID NO: 10281 - DNA, 507 bp, Artificial Sequence
  chemically treated genomic DNA (Homo sapiens) CpG-island No: 10281
taaaatcgtagacgcgtaacggttcgggggaatttataaggaggtatttagaagcgcgatagcgaaggtttatattattagagatcgacggggcgtggatagtatggaaggtgaattagcgaggaggtggacgaaacggagaaaagtgaaggtatacgattatagggcgggacgagtcgggtcgtttcgaacgcggagcggcggtacggcgggaatagtcgggtaatttagatcgggtaaaagtcgtagagtggtataataggatagggtagcggagcgggattcgagggcgagggggagcgcggaagtcgcgttcgggaagacgtagtaataaagagggggtttaatcgttggtggggttcgtcgggaaggtaattttggcgagaagtttcgcgcgataaagggagggcggagtgtgttcggggagagaatggattaagtaaaaaaatcgacgtataagtcgcgaaaggagttagtcggaggcgaatagtgtcgatcgtgtgtttt

SEQ ID NO: 10282 - DNA, 507 bp, Artificial Sequence
  chemically treated genomic DNA (Homo sapiens) CpG-island No: 10282
aaaacacacgatcgacactattcgcctccgactaactcctttcgcgacttatacgtcgatttttttacttaatccattctctccccgaacacactccgccctccctttatcgcgcgaaacttctcgccaaaattaccttcccgacgaaccccaccaacgattaaaccccctctttattactacgtcttcccgaacgcgacttccgcgctccccctcgccctcgaatcccgctccgctaccctatcctattataccactctacgacttttacccgatctaaattacccgactattcccgccgtaccgccgctccgcgttcgaaacgacccgactcgtcccgccctataatcgtataccttcacttttctccgtttcgtccacctcctcgctaattcaccttccatactatccacgccccgtcgatctctaataatataaaccttcgctatcgcgcttctaaatacctccttataaattcccccgaaccgttacgcgtctacgatttta

SEQ ID NO: 10283 - DNA, 507 bp, Artificial Sequence
  chemically treated genomic DNA (Homo sapiens) CpG-island No: 10283
aagatatacggtcgatattattcgttttcgattgatttttttcgcgatttatacgtcgatttttttgtttaatttatttttttttcggatatatttcgttttttttttgtcgcgcggagtttttcgttaaaattattttttcggcgggttttattagcggttgggttttttttttgttgttgcgttttttcgagcgcggttttcgcgttttttttcgttttcgggtttcgtttcgttgttttgttttattgtgttattttgcggtttttgttcggtttgggttgttcgattgttttcgtcgtgtcgtcgtttcgcgttcggggcggttcggttcgtttcgttttgtggtcgtgtgtttttattttttttcgtttcgtttattttttcgttagtttattttttatgttgtttacgtttcgtcggtttttggtggtgtggattttcgttgtcgcgtttttgggtgtttttttgtgggttttttcgggtcgttgcgcgtttgcggttttg

SEQ ID NO: 10284 - DNA, 507 bp, Artificial Sequence
  chemically treated genomic DNA (Homo sapiens) CpG-island No: 10284
caaaaccgcaaacgcgcaacgacccgaaaaaacccacaaaaaaacacccaaaaacgcgacaacgaaaatccacaccaccaaaaaccgacgaaacgtaaacaacataaaaaataaactaacgaaaaaataaacgaaacgaaaaaaaataaaaacacacgaccacaaaacgaaacgaaccgaaccgccccgaacgcgaaacgacgacacgacgaaaacaatcgaacaacccaaaccgaacaaaaaccgcaaaataacacaataaaacaaaacaacgaaacgaaacccgaaaacgaaaaaaaacgcgaaaaccgcgctcgaaaaaacgcaacaacaaaaaaaaaacccaaccgctaataaaacccgccgaaaaaataattttaacgaaaaactccgcgcgacaaaaaaaaaacgaaatatatccgaaaaaaaaataaattaaacaaaaaaatcgacgtataaatcgcgaaaaaaatcaatcgaaaacgaataatatcgaccgtatatctt

SEQ ID NO: 10285 - DNA, 525 bp, Artificial Sequence
  chemically treated genomic DNA (Homo sapiens) CpG-island No: 10285
attatcggtattgattaacgttttttgcgtcgtaatcgtatgcgttagatcgataatcggatttttatcgttatgaattaggtgaattgtcgtggttgtagacgtagttttcggtaggttcgtatagcgttcgttaaaagtaatgacgcgtgaagtaaggttcggttcggttttaatgttttttagtattataatcgcgttttgagagaaatcgatgagcgtcgtggcgttagtttttatttcgttttgtttttgttagtagcgtatcgttttaataaacgtcggtatgatcgtatttatacgcgtttggcgattatttttcgtaatattttgtatcgaaaattattgacgtttcgtcggattatcgttcggtttcgcgttatcgatatttattattagcgtattaggaaatagcggtgtaaattagttgtttattttttttattgttatcgggttattttcgatatcgtggaaaagtagtaataattgttgcgtaggtttattcgggttttgaataataaaatg

SEQ ID NO: 10286 - DNA, 525 bp, Artificial Sequence
  chemically treated genomic DNA (Homo sapiens) CpG-island No: 10286
cattttattattcaaaacccgaataaacctacgcaacaattattactacttttccacgatatcgaaaataacccgataacaataaaaaaaataaacaactaatttacaccgctatttcctaatacgctaataataaatatcgataacgcgaaaccgaacgataatccgacgaaacgtcaataattttcgatacaaaatattacgaaaaataatcgccaaacgcgtataaatacgatcataccgacgtttattaaaacgatacgctactaacaaaaacaaaacgaaataaaaactaacgccacgacgctcatcgatttctctcaaaacgcgattataatactaaaaaacattaaaaccgaaccgaaccttacttcacgcgtcattacttttaacgaacgctatacgaacctaccgaaaactacgtctacaaccacgacaattcacctaattcataacgataaaaatccgattatcgatctaacgcatacgattacgacgcaaaaaacgttaatcaataccgataat

SEQ ID NO: 10287 - DNA, 525 bp, Artificial Sequence
  chemically treated genomic DNA (Homo sapiens) CpG-island No: 10287
tattttgttgtttaaagttcggataaatttgcgtaatagttgttattgtttttttacggtgtcggggataattcggtggtaatgggggaaataggtaattggtttgtatcgttgttttttgatgcgttggtggtgagtgtcggtggcgcggagtcgagcggtaattcggcggggcgttagtggttttcggtgtagggtattacggaagataatcgttaggcgcgtgtggatgcgattatgtcgacgtttattgaaacggtgcgttattggtagaaatagagcggagtaggggttaacgttacggcgtttatcggttttttttaaggcgcgattatggtgttggagagtattaaagtcgaatcgggttttgttttacgcgttattgtttttaacggacgttatgcgagtttgtcggaaattgcgtttatagttacgataatttatttgatttatggcggtgaagattcggttatcgatttggcgtatgcggttgcggcgtaggaagcgttaattagtgtcggtggt

SEQ ID NO: 10288 - DNA, 525 bp, Artificial Sequence
  chemically treated genomic DNA (Homo sapiens) CpG-island No: 10288
accaccgacactaattaacgcttcctacgccgcaaccgcatacgccaaatcgataaccgaatcttcaccgccataaatcaaataaattatcgtaactataaacgcaatttccgacaaactcgcataacgtccgttaaaaacaataacgcgtaaaacaaaacccgattcgactttaatactctccaacaccataatcgcgccttaaaaaaaaccgataaacgccgtaacgttaacccctactccgctctatttctaccaataacgcaccgtttcaataaacgtcgacataatcgcatccacacgcgcctaacgattatcttccgtaataccctacaccgaaaaccactaacgccccgccgaattaccgctcgactccgcgccaccgacactcaccaccaacgcatcaaaaaacaacgatacaaaccaattacctatttcccccattaccaccgaattatccccgacaccgtaaaaaaacaataacaactattacgcaaatttatccgaactttaaacaacaaaata

SEQ ID NO: 10289 - DNA, 652 bp, Artificial Sequence
  chemically treated genomic DNA (Homo sapiens) CpG-island No: 10289
tgcgtcgaaaaatggttaggtcgttggtattaatattattggttttttcgaggtttgtatgttcggcgggatggcgatgaaatggcgttggcgtaagcgtatggaagttgtaggtaaattaacggataaattaaatttggtgtgcggttcggtataaatttgttggtataaattcgttcgttattgggatgtggagttgcgtgagatttttatgcgtttcggttagttgtttatggattcgaaacgtatgattgaagtttgtgacgaaatatatcggcgtggtgtcgattttcggcgtgatttatattggtaattatgagtttttataatcgttgtacgatgcgttggataaattttaggtcgatatcggtatcgatatcgatatgtatatcgacgttgttagcggtggttttttggtatcgttcgtcgtttcggatatcgtttgggattttcgtttgtcgcgtgtgaaatcgattagtgttttaggttattaattcggtttggtttcgttgggttgcggttgggttatttggcgtgacgaagaagcgttgtcgtaggaattggtgtttaacgttgattatttgggtggttaaattggtatttttgttattaatttttttcgttcggcgggttaggtaattgtatagtatta

SEQ ID NO: 10290 - DNA, 652 bp, Artificial Sequence
  chemically treated genomic DNA (Homo sapiens) CpG-island No: 10290
taatactatacaattacctaacccgccgaacgaaaaaaattaataacaaaaataccaatttaaccacccaaataatcaacgttaaacaccaattcctacgacaacgcttcttcgtcacgccaaataacccaaccgcaacccaacgaaaccaaaccgaattaataacctaaaacactaatcgatttcacacgcgacaaacgaaaatcccaaacgatatccgaaacgacgaacgataccaaaaaaccaccgctaacaacgtcgatatacatatcgatatcgataccgatatcgacctaaaatttatccaacgcatcgtacaacgattataaaaactcataattaccaatataaatcacgccgaaaatcgacaccacgccgatatatttcgtcacaaacttcaatcatacgtttcgaatccataaacaactaaccgaaacgcataaaaatctcacgcaactccacatcccaataacgaacgaatttataccaacaaatttataccgaaccgcacaccaaatttaatttatccgttaatttacctacaacttccatacgcttacgccaacgccatttcatcgccatcccgccgaacatacaaacctcgaaaaaaccaataatattaataccaacgacctaaccatttttcgacgca

SEQ ID NO: 10291 - DNA, 652 bp, Artificial Sequence
  chemically treated genomic DNA (Homo sapiens) CpG-island No: 10291
tagtattgtgtaattatttgattcgtcgggcgggagaagttgatggtaaaagtattaatttgattatttaggtagttaacgttgaatattagtttttgcggtagcgttttttcgttacgttagataatttagtcgtagtttagcggagttagatcgaattgatggtttgaagtattgatcgattttatacgcggtaggcggaagttttagacgatattcggggcgacgaacggtgttaggaagttatcgttggtagcgtcgatgtgtatgtcgatgtcgatatcggtatcggtttggaatttatttagcgtatcgtgtagcggttgtgggaatttatagttattagtgtaggttacgtcgaaagtcggtattacgtcgatgtgtttcgttataggttttaattatgcgtttcgggtttataaataattgatcggggcgtatagggattttacgtagttttatattttagtagcgggcgaatttatgttagtagatttgtatcggatcgtatattaggtttggtttattcgttggtttgtttgtagtttttatacgtttgcgttaacgttattttatcgttatttcgtcgagtatataggtttcggaagaattaatggtgttggtgttaacggtttgattatttttcggcgta

SEQ ID NO: 10292 - DNA, 652 bp, Artificial Sequence
  chemically treated genomic DNA (Homo sapiens) CpG-island No: 10292
tacgccgaaaaataatcaaaccgttaacaccaacaccattaattcttccgaaacctatatactcgacgaaataacgataaaataacgttaacgcaaacgtataaaaactacaaacaaaccaacgaataaaccaaacctaatatacgatccgatacaaatctactaacataaattcgcccgctactaaaatataaaactacgtaaaatccctatacgccccgatcaattatttataaacccgaaacgcataattaaaacctataacgaaacacatcgacgtaataccgactttcgacgtaacctacactaataactataaattcccacaaccgctacacgatacgctaaataaattccaaaccgataccgatatcgacatcgacatacacatcgacgctaccaacgataacttcctaacaccgttcgtcgccccgaatatcgtctaaaacttccgcctaccgcgtataaaatcgatcaatacttcaaaccatcaattcgatctaactccgctaaactacgactaaattatctaacgtaacgaaaaaacgctaccgcaaaaactaatattcaacgttaactacctaaataatcaaattaatacttttaccatcaacttctcccgcccgacgaatcaaataattacacaatacta

SEQ ID NO: 10293 - DNA, 860 bp, Artificial Sequence
  chemically treated genomic DNA (Homo sapiens) CpG-island No: 10293
  misc_feature (708)..(708): n is either a, c, g or t
  misc_feature (796)..(796): n is either a, c, g or t
tacgatgttagttagcggcggttttttttatttattcggttagttaggattttattttttagtcggtcgagtatttgtattagtatcggcgggaatattatattgttatcgttttcgtcgtcggattgttgaagcgtattcgttaggttgcggcgttgcgttttcgttagtttatcggtggcggttttaattttgatgagtggcgtgaagtttttcggttgataaatcgtttggatgcgggttttgtcgttttgtattgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggttatatgttgagggtgttgttcgtgtgtagtttcgggtcgggtcggcggttatttgtcgggtttgttgtttcgggatgcgatatttagatcgcggcggggtgtgaacgtcggtanttgcggtggtgtgtacgtattcgggttgcgcggtcgtgtcggtgatcgcgagacgtcgggtattcggttattcgttgtcggcggttgnagcgtaggtcgggggataagcgggagcgttcgcgcgcgggtattcggttgttttcgttatcgga

SEQ ID NO: 10294 - DNA, 860 bp, Artificial Sequence
  chemically treated genomic DNA (Homo sapiens) CpG-island No: 10294
  misc_feature (65)..(65): n is either a, c, g or t
  misc_feature (153)..(153): n is either a, c, g or t
tccgataacgaaaacaaccgaatacccgcgcgcgaacgctcccgcttatcccccgacctacgctncaaccgccgacaacgaataaccgaatacccgacgtctcgcgatcaccgacacgaccgcgcaacccgaatacgtacacaccaccgcaantaccgacgttcacaccccgccgcgatctaaatatcgcatcccgaaacaacaaacccgacaaataaccgccgacccgacccgaaactacacacgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacaatacaaaacgacaaaacccgcatccaaacgatttatcaaccgaaaaacttcacgccactcatcaaaattaaaaccgccaccgataaactaacgaaaacgcaacgccgcaacctaacgaatacgcttcaacaatccgacgacgaaaacgataacaatataatattcccgccgatactaatacaaatactcgaccgactaaaaaataaaatcctaactaaccgaataaataaaaaaaaccgccgctaactaacatcgta

SEQ ID NO: 10295 - DNA, 860 bp, Artificial Sequence
  chemically treated genomic DNA (Homo sapiens) CpG-island No: 10295
  misc_feature (65)..(65): n is either a, c, g or t
  misc_feature (153)..(153): n is either a, c, g or t
ttcggtggcgaaagtaatcgggtattcgcgcgcggacgttttcgtttatttttcgatttgcgttntagtcgtcgatagcgggtggtcgggtattcgacgtttcgcgattatcgatacgatcgcgtaattcgggtacgtatatattatcgtagntgtcggcgtttatatttcgtcgcgatttggatatcgtatttcgaagtagtagattcggtaggtaatcgtcggttcgattcggagttgtatacggatagtatttttagtatgtggtcggataatcgtatcgttcgtgacgcgtattatttttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattataatatagaacgatagaattcgtatttagacgatttattagtcggggagttttacgttatttattagagttgaaatcgttatcggtgagttggcgaaaacgtagcgtcgtagtttggcggatgcgttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtg

SEQ ID NO: 10296 - DNA, 860 bp, Artificial Sequence
  chemically treated genomic DNA (Homo sapiens) CpG-island No: 10296
  misc_feature (708)..(708): n is either a, c, g or t
  misc_feature (796)..(796): n is either a, c, g or t
cacgataccaaccaacgacgactttcctcactcacccgatcaaccaaaatttcactttccaaccgatcgaacatctacaccaacaccgacgaaaacaccacactaccaccgtcttcgccgccgaactactaaaacgcatccgccaaactacgacgctacgttttcgccaactcaccgataacgatttcaactctaataaataacgtaaaactccccgactaataaatcgtctaaatacgaattctatcgttctatattataatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaaataatacgcgtcacgaacgatacgattatccgaccacatactaaaaatactatccgtatacaactccgaatcgaaccgacgattacctaccgaatctactacttcgaaatacgatatccaaatcgcgacgaaatataaacgccgacanctacgataatatatacgtacccgaattacgcgatcgtatcgataatcgcgaaacgtcgaatacccgaccacccgctatcgacgactanaacgcaaatcgaaaaataaacgaaaacgtccgcgcgcgaatacccgattactttcgccaccgaa

SEQ ID NO: 10297 - DNA, 566 bp, Artificial Sequence
  chemically treated genomic DNA (Homo sapiens) CpG-island No: 10297
cgttcgcgtaggtatttcggtaggtgattcgaatcgattattcggttttcgttttttagtatttataggcgtaaattttgacgggcgtcggtttttagtatttcggtagttagtaggtttttaaaattcgtttggttaagttgtggttgtaacgtgcgattaaacgtcgaatcgcgatgacgcgttaatttttttagattaatatcgttcggttgttgttgtattaatagcgttttatcgttgtcggtataatcgttaattagtattatcggtttttgtgttagtttaatagtcgtttgaatcgcggtttggcgtaggtgttttataatcgatttttattagcgggataattaattttcgttgtatgtaattagttttgtataatatgtgagcgttgaacggtaagggcgtagtagaaaatatttggcggatttggaggtacgttgtcgttagcgtttatgttcggtgacgaatttttcggtattagtgtaggttaacgtagagagatacgagtcgggggtaattaggtgtacgcgggtcgaaaacgtattatacgggaaaaaacg

SEQ ID NO: 10298 - DNA, 566 bp, Artificial Sequence
  chemically treated genomic DNA (Homo sapiens) CpG-island No: 10298
cgttttttcccgtataatacgttttcgacccgcgtacacctaattacccccgactcgtatctctctacgttaacctacactaataccgaaaaattcgtcaccgaacataaacgctaacgacaacgtacctccaaatccgccaaatattttctactacgcccttaccgttcaacgctcacatattatacaaaactaattacatacaacgaaaattaattatcccgctaataaaaatcgattataaaacacctacgccaaaccgcgattcaaacgactattaaactaacacaaaaaccgataatactaattaacgattataccgacaacgataaaacgctattaatacaacaacaaccgaacgatattaatctaaaaaaattaacgcgtcatcgcgattcgacgtttaatcgcacgttacaaccacaacttaaccaaacgaattttaaaaacctactaactaccgaaatactaaaaaccgacgcccgtcaaaatttacgcctataaatactaaaaaacgaaaaccgaataatcgattcgaatcacctaccgaaatacctacgcgaacg

SEQ ID NO: 10299 - DNA, 566 bp, Artificial Sequence
  chemically treated genomic DNA (Homo sapiens) CpG-island No: 10299
cgttttttttcgtatgatgcgttttcggttcgcgtgtatttgattattttcggttcgtgtttttttgcgttggtttatattggtgtcggggaattcgttatcgggtatggacgttggcggtaacgtgtttttaaattcgttaggtattttttgttgcgtttttgtcgtttagcgtttatatattgtgtaaagttggttgtatgtagcggggattgattatttcgttggtggaagtcggttataaggtatttgcgttagatcgcgatttaggcgattattgaattggtataaaaatcgatagtgttgattggcggttgtatcggtagcggtaaaacgttgttagtgtagtaatagtcgaacggtgttgatttggaagggttggcgcgttatcgcggttcggcgtttggtcgtacgttataattataatttagttaggcgagttttgaaaatttgttggttgtcgaaatgttaaaaatcgacgttcgttagaatttgcgtttgtgggtgttggaagacgaaagtcggatgatcggttcgaattatttgtcggaatgtttgcgcgagcg

SEQ ID NO: 10300 - DNA, 566 bp, Artificial Sequence
  chemically treated genomic DNA (Homo sapiens) CpG-island No: 10300
cgctcgcgcaaacattccgacaaataattcgaaccgatcatccgactttcgtcttccaacacccacaaacgcaaattctaacgaacgtcgatttttaacatttcgacaaccaacaaattttcaaaactcgcctaactaaattataattataacgtacgaccaaacgccgaaccgcgataacgcgccaacccttccaaatcaacaccgttcgactattactacactaacaacgttttaccgctaccgatacaaccgccaatcaacactatcgatttttataccaattcaataatcgcctaaatcgcgatctaacgcaaataccttataaccgacttccaccaacgaaataatcaatccccgctacatacaaccaactttacacaatatataaacgctaaacgacaaaaacgcaacaaaaaatacctaacgaatttaaaaacacgttaccgccaacgtccatacccgataacgaattccccgacaccaatataaaccaacgcaaaaaaacacgaaccgaaaataatcaaatacacgcgaaccgaaaacgcatcatacgaaaaaaaacg

SEQ ID NO: 10301 - DNA, 748 bp, Artificial Sequence
  chemically treated genomic DNA (Homo sapiens) CpG-island No: 10301
cgtagtcgagcgttacggtttcgtagagtagtttcggtcgttggcgcgttatgaggaaggcgttacgtagttcgcgacggagtcggttcgtcgaggacgttgtggttagggtcgggttcgagttgaggtagtttgagttcgcggggtcgtcgtcgttttttttttcgttttcggcgttttcgttgttgttgttgtcgtcgtcgcggttttcgtatttcgatattatatgtttttagtcgtcggttttatatcgtcgtcgtcgtttcgggttcgaaggttcggttcggttcgttgttttttaatttcgtagttcgtcgtattcgttaattcggacgttttacgttagtcgcgtcgtcgtcgcggggttcgttttattttatattttagagtacgtagtttcgtttatcgtttacggagttcgggcgggtatcgatatcgtttaaattttcgtttttaacgggttacgttttgtattttacgtaaatgtacggaagtttttttcgttcgtagtttagttttggtttttatcggttacgatttcgtttacggagtttgcgtaggcgtcgtcgcggggcgtggagaagttgtttttttgggataaggttcgcggggaatatttggaattttgatatcgttgtagtttgttttcgtcgcgttgggttttaggagtcgtaacgataataatcgtgtttattatttttattataggtttcgaagtacgtaggtgtcgttttttattttaatttaa

SEQ ID NO: 10302 - DNA, 748 bp, Artificial Sequence
  chemically treated genomic DNA (Homo sapiens) CpG-island No: 10302
ttaaattaaaataaaaaacgacacctacgtacttcgaaacctataataaaaataataaacacgattattatcgttacgactcctaaaacccaacgcgacgaaaacaaactacaacgatatcaaaattccaaatattccccgcgaaccttatcccaaaaaaacaacttctccacgccccgcgacgacgcctacgcaaactccgtaaacgaaatcgtaaccgataaaaaccaaaactaaactacgaacgaaaaaaacttccgtacatttacgtaaaatacaaaacgtaacccgttaaaaacgaaaatttaaacgatatcgatacccgcccgaactccgtaaacgataaacgaaactacgtactctaaaatataaaataaaacgaaccccgcgacgacgacgcgactaacgtaaaacgtccgaattaacgaatacgacgaactacgaaattaaaaaacaacgaaccgaaccgaaccttcgaacccgaaacgacgacgacgatataaaaccgacgactaaaaacatataatatcgaaatacgaaaaccgcgacgacgacaacaacaacaacgaaaacgccgaaaacgaaaaaaaaaacgacgacgaccccgcgaactcaaactacctcaactcgaacccgaccctaaccacaacgtcctcgacgaaccgactccgtcgcgaactacgtaacgccttcctcataacgcgccaacgaccgaaactactctacgaaaccgtaacgctcgactacg

SEQ ID NO: 10303 - DNA, 748 bp, Artificial Sequence
  chemically treated genomic DNA (Homo sapiens) CpG-island No: 10303
ttaagttgggataaaaaacggtatttacgtgtttcggggtttgtagtgagaatggtggatacgattattgtcgttacggtttttaaaatttagcgcggcgagagtagattatagcggtgttaaggttttaagtatttttcgcgggttttattttaagggagtagtttttttacgtttcgcgacggcgtttgcgtagatttcgtgagcggggtcgtgatcggtgggggttaagattgggttgcgggcggggaaggttttcgtgtatttacgtagggtgtagggcgtggttcgttgggggcggggatttgggcggtgtcggtgttcgttcggatttcgtgagcggtgggcggagttgcgtgttttggggtgtgaggtggggcggatttcgcggcggcggcgcggttgacgtggagcgttcgggttagcgggtgcggcgagttgcgggattggggagtaacgggtcgggtcgggttttcgggttcgaggcggcggcggcggtataaagtcggcgattgggagtatgtaatgtcggaatgcggaggtcgcggcggcggtagtagtagtagcgaggacgtcgaggacgagggagggggcggcggcggtttcgcgggtttagattgttttagttcgagttcgattttggttatagcgttttcggcgggtcggtttcgtcgcgggttgcgtggcgttttttttatggcgcgttagcggtcggagttgttttgcggggtcgtggcgttcggttgcg

SEQ ID NO: 10304 - DNA, 748 bp, Artificial Sequence
  chemically treated genomic DNA (Homo sapiens) CpG-island No: 10304
cgcaaccgaacgccacgaccccgcaaaacaactccgaccgctaacgcgccataaaaaaaacgccacgcaacccgcgacgaaaccgacccgccgaaaacgctataaccaaaatcgaactcgaactaaaacaatctaaacccgcgaaaccgccgccgccccctccctcgtcctcgacgtcctcgctactactactaccgccgccgcgacctccgcattccgacattacatactcccaatcgccgactttataccgccgccgccgcctcgaacccgaaaacccgacccgacccgttactccccaatcccgcaactcgccgcacccgctaacccgaacgctccacgtcaaccgcgccgccgccgcgaaatccgccccacctcacaccccaaaacacgcaactccgcccaccgctcacgaaatccgaacgaacaccgacaccgcccaaatccccgcccccaacgaaccacgccctacaccctacgtaaatacacgaaaaccttccccgcccgcaacccaatcttaacccccaccgatcacgaccccgctcacgaaatctacgcaaacgccgtcgcgaaacgtaaaaaaactactcccttaaaataaaacccgcgaaaaatacttaaaaccttaacaccgctataatctactctcgccgcgctaaattttaaaaaccgtaacgacaataatcgtatccaccattctcactacaaaccccgaaacacgtaaataccgttttttatcccaacttaa

SEQ ID NO: 10305 - DNA, 641 bp, Artificial Sequence
  chemically treated genomic DNA (Homo sapiens) CpG-island No: 10305
tttcgcgaggaaatcgcgagaatgtagtatatttaggttgtgtaaagtgagtagagtttgattgcgacgaagcgttagagcgcggaatagcggcggatttttagttttattgtatattagcgtattatttgcgcgtgggtttttgttggagtcgataaagatcgggatatcgttgcgtattgcgggtagtaacgttgtcggatgtagtatttttgtattaaaagttgttatttttgtcgtttcggtaaacgcgattttattaatgcgttttgttgcggaaattacgcgtggatcggtggtgtagatgttcgggacgtcggtttagatattaatacgagatgcgtgtaaagttttcgttagtaaggttgtcgtataatcgttgtttttacggttaagcgtcgttgtacgatttttattttcgttatcgataaatttttgggtgattattaagtttttattgagacgtgggagtagttgtagcgcggttagtttcgttagcgcggttatatttggttttgtacgattaaatcggtcgttggtacgtattattttacgtatattaaattattgtgtttgaatatcgcgttcgcgtaggattttaataaatagtagggtcgatattagttcgtcgtggttgatta

SEQ ID NO: 10306 - DNA, 641 bp, Artificial Sequence
  chemically treated genomic DNA (Homo sapiens) CpG-island No: 10306
taatcaaccacgacgaactaatatcgaccctactatttattaaaatcctacgcgaacgcgatattcaaacacaataatttaatatacgtaaaataatacgtaccaacgaccgatttaatcgtacaaaaccaaatataaccgcgctaacgaaactaaccgcgctacaactactcccacgtctcaataaaaacttaataatcacccaaaaatttatcgataacgaaaataaaaatcgtacaacgacgcttaaccgtaaaaacaacgattatacgacaaccttactaacgaaaactttacacgcatctcgtattaatatctaaaccgacgtcccgaacatctacaccaccgatccacgcgtaatttccgcaacaaaacgcattaataaaatcgcgtttaccgaaacgacaaaaataacaacttttaatacaaaaatactacatccgacaacgttactacccgcaatacgcaacgatatcccgatctttatcgactccaacaaaaacccacgcgcaaataatacgctaatatacaataaaactaaaaatccgccgctattccgcgctctaacgcttcgtcgcaatcaaactctactcactttacacaacctaaatatactacattctcgcgatttcctcgcgaaa

SEQ ID NO: 10307 - DNA, 641 bp, Artificial Sequence
  chemically treated genomic DNA (Homo sapiens) CpG-island No: 10307
tggttagttacggcgagttgatgtcgattttgttgtttgttgagattttgcgcgaacgcgatgtttaggtatagtggtttgatgtacgtaaagtgatgcgtattaacgatcgatttggtcgtgtagagttagatatagtcgcgttggcggaattggtcgcgttgtagttgtttttacgttttaatgaaggtttagtgattatttagggatttatcggtagcgaaaataaaggtcgtataacgacgtttggtcgtggaggtagcgattatacggtagttttgttggcggaggttttatacgtatttcgtgttgatatttggatcgacgtttcgggtatttatattatcgatttacgcgtagttttcgtagtaaaacgtattgatgaaatcgcgtttgtcgaagcggtagagatggtaatttttggtgtaaaagtattgtattcggtaacgttgttattcgtagtacgtagcgatatttcggtttttgtcggttttagtaaagatttacgcgtaggtggtacgttggtgtgtaataaaattgaaaattcgtcgttgtttcgcgttttggcgtttcgtcgtaattagattttgtttattttgtatagtttgaatatgttgtattttcgcggttttttcgcggaa

SEQ ID NO: 10308 - DNA, 641 bp, Artificial Sequence
  chemically treated genomic DNA (Homo sapiens) CpG-island No: 10308
ttccgcgaaaaaaccgcgaaaatacaacatattcaaactatacaaaataaacaaaatctaattacgacgaaacgccaaaacgcgaaacaacgacgaattttcaattttattacacaccaacgtaccacctacgcgtaaatctttactaaaaccgacaaaaaccgaaatatcgctacgtactacgaataacaacgttaccgaatacaatacttttacaccaaaaattaccatctctaccgcttcgacaaacgcgatttcatcaatacgttttactacgaaaactacgcgtaaatcgataatataaatacccgaaacgtcgatccaaatatcaacacgaaatacgtataaaacctccgccaacaaaactaccgtataatcgctacctccacgaccaaacgtcgttatacgacctttattttcgctaccgataaatccctaaataatcactaaaccttcattaaaacgtaaaaacaactacaacgcgaccaattccgccaacgcgactatatctaactctacacgaccaaatcgatcgttaatacgcatcactttacgtacatcaaaccactatacctaaacatcgcgttcgcgcaaaatctcaacaaacaacaaaatcgacatcaactcgccgtaactaacca

SEQ ID NO: 10309 - DNA, 926 bp, Artificial Sequence
  chemically treated genomic DNA (Homo sapiens) CpG-island No: 10309
gtaacgggtatcgcgttcgaataatcggcgttgattgtttttggtttggtcggtggtttgtattatttgtttaattatagtttgtttaaaagcgtattgtttttcggggcggggagcgtttggtttcgtatcggttatcgcgatatcgaaaaattcggtggtattggtaagaaaatgtcggttatttttatcgttatgttagtcgggttgatggtaatggttgcgttgtcgtcgttgaatggttttgtcggggaatgggttatttattaattattttttaaattgagtaatagtggcgcgtttgttgttcgtttgttggggtcgttgttcgttgtggggttggtaattatcggtgcgttggcggtgatgtgtatggcgaaagtttatggcgttacgtttttcggcgcgtcgcgtattaaagaagtcgaaaacgttatttgtgcgtcgtttttgatgagcgtaagcgtagtggtattggcgatttgttgcgtaattggcggtgttgttgcgtcgtggcgtattgtcgatgttttttgttgttgtatttttgtcgttggagtttgttaatattatcgttttttaatcgatgattacgttgttgttgattgtttgttcgttgttgttatttattattatggcgatttgtaaaggcgatcgtttgttatcgcgttttcgcggtgcggtttgggtgtgcggttacgattacgaaaaattaatggtgattatcgtttacggttttgttatgtcggtgaaataggcgtttgcgtcggtgttgaaattacgtaaatggttgaattcggtgtttttggtgtcgggttggtagtgcgaagggagtgcgttgttgtttcgtcggatgtgcgtttgttgaattggcggtattggtggtgattattgttttacgaggaatttgaaatgagtgtttatat

SEQ ID NO: 10310 - DNA, 926 bp, Artificial Sequence
  chemically treated genomic DNA (Homo sapiens) CpG-island No: 10310
atataaacactcatttcaaattcctcgtaaaacaataatcaccaccaataccgccaattcaacaaacgcacatccgacgaaacaacaacgcactcccttcgcactaccaacccgacaccaaaaacaccgaattcaaccatttacgtaatttcaacaccgacgcaaacgcctatttcaccgacataacaaaaccgtaaacgataatcaccattaatttttcgtaatcgtaaccgcacacccaaaccgcaccgcgaaaacgcgataacaaacgatcgcctttacaaatcgccataataataaataacaacaacgaacaaacaatcaacaacaacgtaatcatcgattaaaaaacgataatattaacaaactccaacgacaaaaatacaacaacaaaaaacatcgacaatacgccacgacgcaacaacaccgccaattacgcaacaaatcgccaataccactacgcttacgctcatcaaaaacgacgcacaaataacgttttcgacttctttaatacgcgacgcgccgaaaaacgtaacgccataaactttcgccatacacatcaccgccaacgcaccgataattaccaaccccacaacgaacaacgaccccaacaaacgaacaacaaacgcgccactattactcaatttaaaaaataattaataaataacccattccccgacaaaaccattcaacgacgacaacgcaaccattaccatcaacccgactaacataacgataaaaataaccgacattttcttaccaataccaccgaatttttcgatatcgcgataaccgatacgaaaccaaacgctccccgccccgaaaaacaatacgcttttaaacaaactataattaaacaaataatacaaaccaccgaccaaaccaaaaacaatcaacgccgattattcgaacgcgatacccgttac

SEQ ID NO: 10311 - DNA, 926 bp, Artificial Sequence
  chemically treated genomic DNA (Homo sapiens) CpG-island No: 10311
atataaatatttattttaggtttttcgtgaaataataattattattagtatcgttagtttaataggcgtatattcggcggaatagtaacgtatttttttcgtattgttagttcggtattagagatatcggatttagttatttgcgtagttttagtatcggcgtaaacgtttgttttatcggtatggtaaaatcgtgagcggtaattattattgatttttcgtggtcgtaatcgtatatttaggtcgtatcgcgggaacgcgatggtaaacgatcgtttttgtaaatcgttataatgatgaatggtagtagcgggtaggtaattagtagtaacgtgattatcggttgagaaacggtggtgttagtaggttttagcggtagaggtatagtagtagagagtatcggtagtacgttacggcgtagtaatatcgttaattacgtagtaaatcgttagtgttattacgtttacgtttattaggagcggcgtataggtggcgttttcggtttttttggtgcgcggcgcgtcgaggaacgtgacgttatagattttcgttatatatattatcgttagcgtatcggtaattgttagttttatagcgagtagcggttttagtagacgggtaataaacgcgttattattgtttagtttgaaaaatgattgatagataatttatttttcggtaaaattatttagcggcggtagcgtagttattgttattagttcgattaatatggcgatggagataatcggtatttttttgttaatattatcgagtttttcgatatcgcgatgatcggtacggaattagacgtttttcgtttcgaggaatagtacgtttttgaataggttatggttaagtagatggtatagattatcgattaggttaagagtaattagcgtcggttgttcgagcgcgatattcgttat

SEQ ID NO: 10312 - DNA, 926 bp, Artificial Sequence
  chemically treated genomic DNA (Homo sapiens) CpG-island No: 10312
ataacgaatatcgcgctcgaacaaccgacgctaattactcttaacctaatcgataatctataccatctacttaaccataacctattcaaaaacgtactattcctcgaaacgaaaaacgtctaattccgtaccgatcatcgcgatatcgaaaaactcgataatattaacaaaaaaataccgattatctccatcgccatattaatcgaactaataacaataactacgctaccgccgctaaataattttaccgaaaaataaattatctatcaatcatttttcaaactaaacaataataacgcgtttattacccgtctactaaaaccgctactcgctataaaactaacaattaccgatacgctaacgataatatatataacgaaaatctataacgtcacgttcctcgacgcgccgcgcaccaaaaaaaccgaaaacgccacctatacgccgctcctaataaacgtaaacgtaataacactaacgatttactacgtaattaacgatattactacgccgtaacgtactaccgatactctctactactatacctctaccgctaaaacctactaacaccaccgtttctcaaccgataatcacgttactactaattacctacccgctactaccattcatcattataacgatttacaaaaacgatcgtttaccatcgcgttcccgcgatacgacctaaatatacgattacgaccacgaaaaatcaataataattaccgctcacgattttaccataccgataaaacaaacgtttacgccgatactaaaactacgcaaataactaaatccgatatctctaataccgaactaacaatacgaaaaaaatacgttactattccgccgaatatacgcctattaaactaacgatactaataataattattatttcacgaaaaacctaaaataaatatttatat

SEQ ID NO: 10313 - DNA, 564 bp, Artificial Sequence
  chemically treated genomic DNA (Homo sapiens) CpG-island No: 10313
ttgcgttcgttgggttagttgttttagatagttattggcggtaggcgataatagcgttattatgtcgtcgcgggtgagttgcgaggtatttagcgttcgttttacgttagtagtcgttttgtcgttgatacgtaggcggatgtcgttttagtttagttgtcgttagcgatcgttgaaggtttttatgtcgatgtttttagaaattcggttagcgggttggtggtatgagtaaaataattgcggttgttcggttcggattgacgtgttagtaggtttgtttttatcgttagacgaaatgttttcgttatgttgacgggatcgttcgcgacggtaatcgtcgtatttattaatatcgcgtcggtttttatttttagcgtttgcgcggtatggttgggaacgtcgatgttagtatcgataattatcggtattgtggtttgttggataataatttttagtatggcgcgggtttttagtttttgattcgagttaatcggcgcgtcgagcggtattatcgttgtatagtcgattttttttagacgtttatataatatcggatcggtttcg

SEQ ID NO: 10314 - DNA, 564 bp, Artificial Sequence
  chemically treated genomic DNA (Homo sapiens) CpG-island No: 10314
cgaaaccgatccgatattatataaacgtctaaaaaaaatcgactatacaacgataataccgctcgacgcgccgattaactcgaatcaaaaactaaaaacccgcgccatactaaaaattattatccaacaaaccacaataccgataattatcgatactaacatcgacgttcccaaccataccgcgcaaacgctaaaaataaaaaccgacgcgatattaataaatacgacgattaccgtcgcgaacgatcccgtcaacataacgaaaacatttcgtctaacgataaaaacaaacctactaacacgtcaatccgaaccgaacaaccgcaattattttactcataccaccaacccgctaaccgaatttctaaaaacatcgacataaaaaccttcaacgatcgctaacgacaactaaactaaaacgacatccgcctacgtatcaacgacaaaacgactactaacgtaaaacgaacgctaaatacctcgcaactcacccgcgacgacataataacgctattatcgcctaccgccaataactatctaaaacaactaacccaacgaacgcaa

SEQ ID NO: 10315 - DNA, 564 bp, Artificial Sequence
  chemically treated genomic DNA (Homo sapiens) CpG-island No: 10315
cggggtcgattcggtattgtgtaaacgtttggaagaagtcggttgtgtagcggtgatgtcgttcggcgcgtcgattggttcgaattagggattggaaattcgcgttatgttggagattattatttagtaggttatagtgtcggtggttgtcgatgttggtatcggcgtttttagttatgtcgcgtaggcgttggaaatgggggtcgacgcggtgttagtgaatacggcgattgtcgtcgcggacgatttcgttaatatggcgaaggtatttcgtttggcggtagaagtaggtttattggtacgttagttcggatcgggtagtcgtagttattttgtttatgttattagttcgttgatcggatttttggaggtatcggtatgaaaatttttagcgatcgttggcgataattggattgggacgatattcgtttgcgtattaacggtaaaacggttgttgacgtagagcgggcgttaaatgtttcgtaatttattcgcgacgatatgatggcgttgttatcgtttgtcgttagtggttatttggaataattggtttaacgggcgtag

SEQ ID NO: 10316 - DNA, 564 bp, Artificial Sequence
  chemically treated genomic DNA (Homo sapiens) CpG-island No: 10316
ctacgcccgttaaaccaattattccaaataaccactaacgacaaacgataacaacgccatcatatcgtcgcgaataaattacgaaacatttaacgcccgctctacgtcaacaaccgttttaccgttaatacgcaaacgaatatcgtcccaatccaattatcgccaacgatcgctaaaaattttcataccgatacctccaaaaatccgatcaacgaactaataacataaacaaaataactacgactacccgatccgaactaacgtaccaataaacctacttctaccgccaaacgaaataccttcgccatattaacgaaatcgtccgcgacgacaatcgccgtattcactaacaccgcgtcgacccccatttccaacgcctacgcgacataactaaaaacgccgataccaacatcgacaaccaccgacactataacctactaaataataatctccaacataacgcgaatttccaatccctaattcgaaccaatcgacgcgccgaacgacatcaccgctacacaaccgacttcttccaaacgtttacacaataccgaatcgaccccg

SEQ ID NO: 10317 - DNA, 1053 bp, Artificial Sequence
  chemically treated genomic DNA (Homo sapiens) CpG-island No: 10317
attttcgtttggttggttggcggcgtatggttgttatggtagaaagcgattcgttggtatattttttttagttttttagtaacgttggcgttatgcgtaatgttgggttggttgtttttattagaaatattggtagtatcgcgaatttatttgttgtttggagcgattatgttcggcgtattttttattttgattgattcggttatcgtttttacgattaatcgtggttcgttttatttttcggggggtttgcgggtttagtagtttggttgattcgtagttttcgggggttattttgacggtcgtgtttttgtcgttttgtgggcgaagattacggtttttgcgagtgattattataagcgttcggcggtgtacggttatcgtaaaagggtaaattaacggtgaaaattaatgttaaaatagcggtattagtcgtggggggaattgtgtaggcggggtttaaagaggggttaagattggcggtaaggtaacgttagattgcgttaaaaacgtagcgattggtcgtaagagaggcgggtttcggtaagcgagagaggcgcggaaggtgtaacgagggcgcgtgtcgagcgggtaagcgtaagaattaagtgcgggtgcgacgaaagttggttaatttgggtaattgcgtcgagagtgtaggtaaagggggagagtcggggttgagacgcggaacgaggtgataatacgggagtcgcgttcggaagaaatcgcgcgcgagggtgtcggtgtattagcggtggcgggagttgtaaggcggggatggtcggcggtatggcgttagcgcgcggtgggggaattttgggcgttgtgggggtcggtttcgggaggagagggttggtgggggtgggggtagttcgggggtgcggcgcgtgggtcggaggtgggggcggggtttttgcgggggtgtgggcgtgtgggttgagggtcgggttcgggggtgcgggtgggcggtggtggtgtgtgtttgtgtttaggatttttttttgatgagtatcgtataggattagttttgggaaatatattatgaagatg

SEQ ID NO: 10318 - DNA, 1053 bp, Artificial Sequence
  chemically treated genomic DNA (Homo sapiens) CpG-island No: 10318
catcttcataatatatttcccaaaactaatcctatacgatactcatcaaaaaaaaatcctaaacacaaacacacaccaccaccgcccacccgcacccccgaacccgaccctcaacccacacgcccacacccccgcaaaaaccccgcccccacctccgacccacgcgccgcacccccgaactacccccacccccaccaaccctctcctcccgaaaccgacccccacaacgcccaaaattcccccaccgcgcgctaacgccataccgccgaccatccccgccttacaactcccgccaccgctaatacaccgacaccctcgcgcgcgatttcttccgaacgcgactcccgtattatcacctcgttccgcgtctcaaccccgactctccccctttacctacactctcgacgcaattacccaaattaaccaactttcgtcgcacccgcacttaattcttacgcttacccgctcgacacgcgccctcgttacaccttccgcgcctctctcgcttaccgaaacccgcctctcttacgaccaatcgctacgtttttaacgcaatctaacgttaccttaccgccaatcttaacccctctttaaaccccgcctacacaattccccccacgactaataccgctattttaacattaattttcaccgttaatttacccttttacgataaccgtacaccgccgaacgcttataataatcactcgcaaaaaccgtaatcttcgcccacaaaacgacaaaaacacgaccgtcaaaataacccccgaaaactacgaatcaaccaaactactaaacccgcaaaccccccgaaaaataaaacgaaccacgattaatcgtaaaaacgataaccgaatcaatcaaaataaaaaatacgccgaacataatcgctccaaacaacaaataaattcgcgatactaccaatatttctaataaaaacaaccaacccaacattacgcataacgccaacgttactaaaaaactaaaaaaaatataccaacgaatcgctttctaccataacaaccatacgccgccaaccaaccaaacgaaaat

SEQ ID NO: 10319 - DNA, 1053 bp, Artificial Sequence
  chemically treated genomic DNA (Homo sapiens) CpG-island No: 10319
tatttttatagtatgttttttaaaattagttttatgcgatgtttattagaaaaaaattttgagtataggtatatattattatcgtttattcgtattttcgaattcgatttttaatttatacgtttatattttcgtaaaaatttcgtttttattttcgatttacgcgtcgtattttcggattgtttttatttttattagtttttttttttcgaagtcgatttttataacgtttagggtttttttatcgcgcgttggcgttatatcgtcggttattttcgttttatagttttcgttatcgttagtgtatcggtattttcgcgcgcggtttttttcgaacgcggttttcgtgttgttatttcgtttcgcgttttaatttcggttttttttttttatttatattttcggcgtagttatttaggttggttaattttcgtcgtattcgtatttggtttttgcgtttgttcgttcggtacgcgttttcgttgtatttttcgcgtttttttcgtttgtcgaggttcgttttttttgcgattaatcgttgcgtttttggcgtaatttggcgttgttttgtcgttagttttaatttttttttgaatttcgtttgtataattttttttacggttaatgtcgttgttttggtattagtttttatcgttggtttatttttttgcgatggtcgtatatcgtcggacgtttgtagtaattattcgtaggaatcgtgattttcgtttataggacggtaaaagtacggtcgttaggatagttttcgaaaattgcggattaattagattattaagttcgtaagtttttcggaaaataagacggattacgattggtcgtagaagcggtaatcgggttagttaaaataaagaatgcgtcgagtatggtcgttttagatagtagatgaattcgcggtgttgttagtgtttttggtgagaataattagtttaatattgcgtataacgttagcgttattaagaagttgaggggaatatgttagcgaatcgttttttgttatagtaattatacgtcgttagttagttaggcggagat

SEQ ID NO: 10320 - DNA, 1053 bp, Artificial Sequence
  chemically treated genomic DNA (Homo sapiens) CpG-island No: 10320
atctccgcctaactaactaacgacgtataattactataacaaaaaacgattcgctaacatattcccctcaacttcttaataacgctaacgttatacgcaatattaaactaattattctcaccaaaaacactaacaacaccgcgaattcatctactatctaaaacgaccatactcgacgcattctttattttaactaacccgattaccgcttctacgaccaatcgtaatccgtcttattttccgaaaaacttacgaacttaataatctaattaatccgcaattttcgaaaactatcctaacgaccgtacttttaccgtcctataaacgaaaatcacgattcctacgaataattactacaaacgtccgacgatatacgaccatcgcaaaaaaataaaccaacgataaaaactaataccaaaacaacgacattaaccgtaaaaaaaattatacaaacgaaattcaaaaaaaaattaaaactaacgacaaaacaacgccaaattacgccaaaaacgcaacgattaatcgcaaaaaaaacgaacctcgacaaacgaaaaaaacgcgaaaaatacaacgaaaacgcgtaccgaacgaacaaacgcaaaaaccaaatacgaatacgacgaaaattaaccaacctaaataactacgccgaaaatataaataaaaaaaaaaaaccgaaattaaaacgcgaaacgaaataacaacacgaaaaccgcgttcgaaaaaaaccgcgcgcgaaaataccgatacactaacgataacgaaaactataaaacgaaaataaccgacgatataacgccaacgcgcgataaaaaaaccctaaacgttataaaaatcgacttcgaaaaaaaaaaactaataaaaataaaaacaatccgaaaatacgacgcgtaaatcgaaaataaaaacgaaatttttacgaaaatataaacgtataaattaaaaatcgaattcgaaaatacgaataaacgataataatatatacctatactcaaaatttttttctaataaacatcgcataaaactaattttaaaaaacatactataaaaata

SEQ ID NO: 10321 - DNA, 633 bp, Artificial Sequence
  chemically treated genomic DNA (Homo sapiens) CpG-island No: 10321
gtatagttatcgttgtaaattgtaaattcgtgtttcgagcgttgtttttttttgtggagcggaggaggggaggtttggggtcgcggcggtgtgcgtttcgttttgatcgtagagtttttttttcgaggaaagcggttggttcggtttcggttggtgattacgcggggtttttgtttgtttggtgcgtaggtgagggtttgttttttcgttgcgtttcggatagtttggaggtgagtacgcgttgggttttggatcgcgagtagcgggagaagtacgagttggtggtcgtgtgtatcgtgtacgtcggcgcgcgcgaggaggtggtgatggtgtttttttcggtgatcgtgtacgacgaggacgattcggcgtttatttttttcgcgggcgtcgatatcgttagcgtcgtggtggagtttaagcggaaggaggtgtttgttcgcgcgtgttgtggtttatttagtgtttgttttcggttatagttcgtttttcggtcggtttagtgttcgtgtagttatttaatcgtgtggtcgattattcgcgtttttatttgtttttcgttttcgtttgcgtcgtttgttttagggggaggggaagggggagttttgttagtatttagttgggttttgtttt

SEQ ID NO: 10322 - DNA, 633 bp, Artificial Sequence
  chemically treated genomic DNA (Homo sapiens) CpG-island No: 10322
aaaacaaaacccaactaaatactaacaaaactcccccttcccctccccctaaaacaaacgacgcaaacgaaaacgaaaaacaaataaaaacgcgaataatcgaccacacgattaaataactacacgaacactaaaccgaccgaaaaacgaactataaccgaaaacaaacactaaataaaccacaacacgcgcgaacaaacacctccttccgcttaaactccaccacgacgctaacgatatcgacgcccgcgaaaaaaataaacgccgaatcgtcctcgtcgtacacgatcaccgaaaaaaacaccatcaccacctcctcgcgcgcgccgacgtacacgatacacacgaccaccaactcgtacttctcccgctactcgcgatccaaaacccaacgcgtactcacctccaaactatccgaaacgcaacgaaaaaacaaaccctcacctacgcaccaaacaaacaaaaaccccgcgtaatcaccaaccgaaaccgaaccaaccgctttcctcgaaaaaaaaactctacgatcaaaacgaaacgcacaccgccgcgaccccaaacctcccctcctccgctccacaaaaaaaaacaacgctcgaaacacgaatttacaatttacaacgataactatac

SEQ ID NO: 10323 - DNA, 633 bp, Artificial Sequence
  chemically treated genomic DNA (Homo sapiens) CpG-island No: 10323
gaggtaaggtttagttgggtgttggtaggattttttttttttttttttttaggatagacggcgtagacggaggcgaaggataaatgaaagcgcgaatggtcggttatacggttgggtggttatacggatattaaatcgatcgagaaacgaattgtggtcggagatagatattgggtagattatagtacgcgcggataagtattttttttcgtttgaattttattacggcgttggcggtgtcgacgttcgcggggaaggtgggcgtcgagtcgttttcgtcgtatacggttatcgggaagggtattattattattttttcgcgcgcgtcggcgtgtacggtgtatacggttattagttcgtatttttttcgttgttcgcggtttaaggtttagcgcgtgtttatttttaggttgttcggggcgtagcggaagggtagatttttatttgcgtattaagtagataggggtttcgcgtgattattagtcgggatcgggttagtcgtttttttcgggaagggggttttgcggttagagcggggcgtatatcgtcgcggttttaggttttttttttttcgttttataggggagggtagcgttcggagtacgagtttgtagtttgtagcgatgattgtgt

SEQ ID NO: 10324 - DNA, 633 bp, Artificial Sequence
  chemically treated genomic DNA (Homo sapiens) CpG-island No: 10324
acacaatcatcgctacaaactacaaactcgtactccgaacgctaccctcccctataaaacgaaaaaaaaaaaacctaaaaccgcgacgatatacgccccgctctaaccgcaaaacccccttcccgaaaaaaacgactaacccgatcccgactaataatcacgcgaaacccctatctacttaatacgcaaataaaaatctacccttccgctacgccccgaacaacctaaaaataaacacgcgctaaaccttaaaccgcgaacaacgaaaaaaatacgaactaataaccgtatacaccgtacacgccgacgcgcgcgaaaaaataataataatacccttcccgataaccgtatacgacgaaaacgactcgacgcccaccttccccgcgaacgtcgacaccgccaacgccgtaataaaattcaaacgaaaaaaaatacttatccgcgcgtactataatctacccaatatctatctccgaccacaattcgtttctcgatcgatttaatatccgtataaccacccaaccgtataaccgaccattcgcgctttcatttatccttcgcctccgtctacgccgtctatcctaaaaaaaaaaaaaaaaaaaatcctaccaacacccaactaaaccttacctc

SEQ ID NO: 10325 - DNA, 697 bp, Artificial Sequence
  chemically treated genomic DNA (Homo sapiens) CpG-island No: 10325
cgagaggtggcggggagagagtaggacgacggaacgatagttaggtcggttagtagtaggagcgtgtgatgcgtacgtaggtagcgacgtgggggttttaggagggcggtacggtattattaagtaagcggcgtgtattcgcggcgtcgtagtggtcgtgggttagggtggtcgcgcggacggcgggagtagcgggttttttgttcggattgtggggtacgttatgggggtaggggatgcggttgacgcgtttagcgcgaggttaagacggtcgatttagcgggtcgatggagcgtgatttcggcgtcgatcgagtcggtcggatgtggggaggggggtgagcggcgggcgggcgtatgcgtggcgggtgttcgggggcgaaaggatttgcgggagtcgcgttgtaggaggggtagcgtggggacggagcgggagagtgaggcgggggttagtgggggggagatcgcgggggggagaaggggagggtagagtagggtggcgagaagttcgggagtaggatggggggcgcgtggggggggggttgttcgaggcgttgagcgggttgggggagagaagcggcggaggtgtttcgggggggtttcgggatgagggaatagggggtgtttagcggggcgggttcggtttgttagaaggggagatttcgtagaaggtatcgagttaaggaggggaaaggttt

SEQ ID NO: 10326 - DNA, 697 bp, Artificial Sequence
  chemically treated genomic DNA (Homo sapiens) CpG-island No: 10326
aaacctttcccctccttaactcgataccttctacgaaatctccccttctaacaaaccgaacccgccccgctaaacaccccctattccctcatcccgaaacccccccgaaacacctccgccgcttctctcccccaacccgctcaacgcctcgaacaaccccccccccacgcgccccccatcctactcccgaacttctcgccaccctactctaccctccccttctcccccccgcgatctcccccccactaacccccgcctcactctcccgctccgtccccacgctacccctcctacaacgcgactcccgcaaatcctttcgcccccgaacacccgccacgcatacgcccgcccgccgctcacccccctccccacatccgaccgactcgatcgacgccgaaatcacgctccatcgacccgctaaatcgaccgtcttaacctcgcgctaaacgcgtcaaccgcatcccctacccccataacgtaccccacaatccgaacaaaaaacccgctactcccgccgtccgcgcgaccaccctaacccacgaccactacgacgccgcgaatacacgccgcttacttaataataccgtaccgccctcctaaaacccccacgtcgctacctacgtacgcatcacacgctcctactactaaccgacctaactatcgttccgtcgtcctactctctccccgccacctctcg

SEQ ID NO: 10327 - DNA, 697 bp, Artificial Sequence
  chemically treated genomic DNA (Homo sapiens) CpG-island No: 10327
agattttttttttttttggttcggtattttttgcggaatttttttttttggtaagtcggattcgtttcgttgagtattttttatttttttatttcggggttttttcgggatattttcgtcgttttttttttttaattcgtttaacgtttcgagtaattttttttttacgcgttttttattttgttttcggatttttcgttattttattttgttttttttttttttttttcgcgattttttttttattggttttcgttttattttttcgtttcgtttttacgttgttttttttgtagcgcgattttcgtagattttttcgttttcgagtattcgttacgtatgcgttcgttcgtcgtttatttttttttttatattcggtcgattcgatcggcgtcgaaattacgttttatcgattcgttaagtcggtcgttttggtttcgcgttagacgcgttagtcgtattttttgtttttatagcgtgttttatagttcggataagaagttcgttgttttcgtcgttcgcgcgattattttaatttacgattattgcggcgtcgcgagtgtacgtcgtttatttggtaatatcgtgtcgtttttttgaggtttttacgtcgttatttgcgtgcgtattatacgtttttgttgttgatcggtttagttatcgtttcgtcgttttgtttttttttcgttatttttcg

SEQ ID NO: 10328 - DNA, 697 bp, Artificial Sequence
  chemically treated genomic DNA (Homo sapiens) CpG-island No: 10328
cgaaaaataacgaaaaaaaaacaaaacgacgaaacgataactaaaccgatcaacaacaaaaacgtataatacgcacgcaaataacgacgtaaaaacctcaaaaaaacgacacgatattaccaaataaacgacgtacactcgcgacgccgcaataatcgtaaattaaaataatcgcgcgaacgacgaaaacaacgaacttcttatccgaactataaaacacgctataaaaacaaaaaatacgactaacgcgtctaacgcgaaaccaaaacgaccgacttaacgaatcgataaaacgtaatttcgacgccgatcgaatcgaccgaatataaaaaaaaaaataaacgacgaacgaacgcatacgtaacgaatactcgaaaacgaaaaaatctacgaaaatcgcgctacaaaaaaaacaacgtaaaaacgaaacgaaaaaataaaacgaaaaccaataaaaaaaaaatcgcgaaaaaaaaaaaaaaaaaacaaaataaaataacgaaaaatccgaaaacaaaataaaaaacgcgtaaaaaaaaaattactcgaaacgttaaacgaattaaaaaaaaaaaacgacgaaaatatcccgaaaaaaccccgaaataaaaaaataaaaaatactcaacgaaacgaatccgacttaccaaaaaaaaaaattccgcaaaaaataccgaaccaaaaaaaaaaaaaatct

SEQ ID NO: 10329 - DNA, 500 bp, Artificial Sequence
  chemically treated genomic DNA (Homo sapiens) CpG-island No: 10329
gattggtcgtcgttgtaatatttcgagtttatggtaggcggatttttagcggggagtgtattcgtttcggtcgttttcgttatttttttttaggcggtgtgatttcggatggcgcggttaagtgtttagagattgtcgttcgatcggagaatttaacgggtgcggagggtaagaaagcggtagcggtaaaggcgaattttttgatttggaagtttcggcggaaaagtcgtattcggtaggttggcgggcgggtaggtatgcgagtcggcgttttattttttagaagtatcgttggggttaaaatggcgtttgtttacgatttttaaaggaatgtagcgcgtaggcgtcgtaattcgttaatcggttaatgagaagacgtaatagtaatgacgttaggtacggtcggaaaggagatttttgggaaaattgagttggaattcgggttttagttaaatatttttttcgggtggattttggtttgattttcgtggtaataacgt

SEQ ID NO: 10330 - DNA, 500 bp, Artificial Sequence
  chemically treated genomic DNA (Homo sapiens) CpG-island No: 10330
acgttattaccacgaaaatcaaaccaaaatccacccgaaaaaaatatttaactaaaacccgaattccaactcaattttcccaaaaatctcctttccgaccgtacctaacgtcattactattacgtcttctcattaaccgattaacgaattacgacgcctacgcgctacattcctttaaaaatcgtaaacaaacgccattttaaccccaacgatacttctaaaaaataaaacgccgactcgcatacctacccgcccgccaacctaccgaatacgacttttccgccgaaacttccaaatcaaaaaattcgcctttaccgctaccgctttcttaccctccgcacccgttaaattctccgatcgaacgacaatctctaaacacttaaccgcgccatccgaaatcacaccgcctaaaaaaaaataacgaaaacgaccgaaacgaatacactccccgctaaaaatccgcctaccataaactcgaaatattacaacgacgaccaatc

SEQ ID NO: 10331 - DNA, 500 bp, Artificial Sequence
  chemically treated genomic DNA (Homo sapiens) CpG-island No: 10331
acgttattattacgggggttagattaggatttattcgaggaaggtatttaattaaagttcgagttttagtttaatttttttaggagtttttttttcggtcgtgtttggcgttattgttgttgcgtttttttattggtcggttgacgggttgcggcgtttgcgcgttgtatttttttgagggtcgtgggtagacgttattttggttttagcggtgtttttaggaagtagaacgtcggttcgtatgtttgttcgttcgttagtttgtcgggtacgattttttcgtcggggtttttaggttaaagaattcgtttttgtcgttatcgtttttttatttttcgtattcgttaagtttttcggtcgggcggtagtttttgaatatttagtcgcgttattcggggttatatcgtttggaaggaggtgacgggggcggtcggggcggatgtatttttcgttgagagttcgtttgttatggattcggaatattatagcggcgattagtt

SEQ ID NO: 10332 - DNA, 500 bp, Artificial Sequence
  chemically treated genomic DNA (Homo sapiens) CpG-island No: 10332
aactaatcgccgctataatattccgaatccataacaaacgaactctcaacgaaaaatacatccgccccgaccgcccccgtcacctccttccaaacgatataaccccgaataacgcgactaaatattcaaaaactaccgcccgaccgaaaaacttaacgaatacgaaaaataaaaaaacgataacgacaaaaacgaattctttaacctaaaaaccccgacgaaaaaatcgtacccgacaaactaacgaacgaacaaacatacgaaccgacgttctacttcctaaaaacaccgctaaaaccaaaataacgtctacccacgaccctcaaaaaaatacaacgcgcaaacgccgcaacccgtcaaccgaccaataaaaaaacgcaacaacaataacgccaaacacgaccgaaaaaaaaactcctaaaaaaattaaactaaaactcgaactttaattaaataccttcctcgaataaatcctaatctaacccccgtaataataacgt

SEQ ID NO: 10333 - DNA, 1427 bp, Artificial Sequence
  chemically treated genomic DNA (Homo sapiens) CpG-island No: 10333
gtcgtcggagatggagaggcggttgaagattggtaggcggcggttagggtcgaggttgggagatttagagtcgttgaggttgtcggagtttagggagtcgtttaggtagttgtcgcggttcgatagcgagttcggggggttggggggcgcgtcgaatacgggcgagtcggataggcggcgcggtagttggaagttgaagggcggcgagggaggtgcggcggtttcggcggggagggtcgcgttgggcggttcggcgttcgcgggggcgttaggttttgttgttgttgttgttgttgattgcggtagtaggcggcggcggttacggcggtaaagttgtgggtttggatggcgagcggcgtgatgaggttgttgagtttcggatcgaaggcgaaggcgttgttggcgtacgaggtcgacgagtaggtcgcgtacggggttttcggcgttagtaggttttcggcgttttcggtgtcgtatagtagagcggtcgtagtcgcggtcggcgcggaggcgtagtatgtcggggcgttcgagggcgtggaggtcgcggaggtcgaggaataggaggaggcggaggaggagtaggacgaggtcgaagagtaggagggcggcggcggcgtgcgcgacgtggggttgtcgagtagtagcggcgattcgaggtcgttcgggggttgatggtggttcgacgggaagttcgagaagttgaggttgtggtgtaatttgggtcgcggttttcgcgggaagtttaggtgtaacgtatcgcgcgtgttaaaggtacgtaggttttcggagggtttttcgacggcgcgggtcgtcgttcgttcgcgttgtggatgaagtggtagcgcggtttataggggtagaagtcgatggtatgaaaggtgcggtatagttcggttttgtatttcggatggcgagttaggttgcgtagttcgtggaagttatgcgcgaattggtatttttcgtcgtatttgtacgtgtcgtttttttcgaagggtcggtatagttcggttttgtagcgcgtggagttgatttgggagtcgtcgttttttttttgttgttgttgtaggtgtaggaggtgttggttgcgatcgtcgttttcgttaaacgagcggtttcggaatttgttttttttgttgagtagggttgtgcgtcgtttttcgacggttttttaagggtgtcgtaggaggtcggatcgtcggtcgtcgcgttgtcgtagttgttgtcgttagcggcgttcgggaatttgggcgagtagttgtcggggttgggcgcggggtgggcgagtgtatgtaggttgttggtcgagtgtcgtcggaggaatttcggcgcgaagttcgagttgggggcggcggtataggcgtttttatcgtttttttgtttagtatgttgtttaggttgaggttggttagggatttttttgtttg

SEQ ID NO: 10334 - DNA, 1427 bp, Artificial Sequence
  chemically treated genomic DNA (Homo sapiens) CpG-island No: 10334
caaacaaaaaaatccctaaccaacctcaacctaaacaacatactaaacaaaaaaacgataaaaacgcctataccgccgcccccaactcgaacttcgcgccgaaattcctccgacgacactcgaccaacaacctacatacactcgcccaccccgcgcccaaccccgacaactactcgcccaaattcccgaacgccgctaacgacaacaactacgacaacgcgacgaccgacgatccgacctcctacgacacccttaaaaaaccgtcgaaaaacgacgcacaaccctactcaacaaaaaaaacaaattccgaaaccgctcgtttaacgaaaacgacgatcgcaaccaacacctcctacacctacaacaacaacaaaaaaaaaacgacgactcccaaatcaactccacgcgctacaaaaccgaactataccgacccttcgaaaaaaacgacacgtacaaatacgacgaaaaataccaattcgcgcataacttccacgaactacgcaacctaactcgccatccgaaatacaaaaccgaactataccgcacctttcataccatcgacttctacccctataaaccgcgctaccacttcatccacaacgcgaacgaacgacgacccgcgccgtcgaaaaaccctccgaaaacctacgtacctttaacacgcgcgatacgttacacctaaacttcccgcgaaaaccgcgacccaaattacaccacaacctcaacttctcgaacttcccgtcgaaccaccatcaacccccgaacgacctcgaatcgccgctactactcgacaaccccacgtcgcgcacgccgccgccgccctcctactcttcgacctcgtcctactcctcctccgcctcctcctattcctcgacctccgcgacctccacgccctcgaacgccccgacatactacgcctccgcgccgaccgcgactacgaccgctctactatacgacaccgaaaacgccgaaaacctactaacgccgaaaaccccgtacgcgacctactcgtcgacctcgtacgccaacaacgccttcgccttcgatccgaaactcaacaacctcatcacgccgctcgccatccaaacccacaactttaccgccgtaaccgccgccgcctactaccgcaatcaacaacaacaacaacaacaaaacctaacgcccccgcgaacgccgaaccgcccaacgcgaccctccccgccgaaaccgccgcacctccctcgccgcccttcaacttccaactaccgcgccgcctatccgactcgcccgtattcgacgcgccccccaaccccccgaactcgctatcgaaccgcgacaactacctaaacgactccctaaactccgacaacctcaacgactctaaatctcccaacctcgaccctaaccgccgcctaccaatcttcaaccgcctctccatctccgacgac

SEQ ID NO: 10335 - DNA, 1427 bp, Artificial Sequence
  chemically treated genomic DNA (Homo sapiens) CpG-island No: 10335
tagatagagaaatttttggttaattttaatttgaataatatgttggataagaaggcggtggggacgtttgtgtcgtcgtttttagttcgggtttcgcgtcgggattttttcgacggtattcggttagtaatttgtatgtattcgtttatttcgcgtttagtttcggtagttgttcgtttaagttttcgggcgtcgttaacggtagtagttgcggtagcgcggcggtcggcggttcgattttttacggtatttttaaggagtcgtcggggggcggcgtatagttttgtttaataaggagaataaatttcgggatcgttcgtttagcgagaacggcgatcgtagttagtattttttgtatttgtagtagtagtagaaggggggcggcggtttttagattaattttacgcgttataagatcgagttgtgtcggtttttcgaggagagcggtacgtgtaagtacggcgaaaagtgttagttcgcgtatggtttttacgagttgcgtagtttgattcgttattcgaagtataagatcgagttgtgtcgtattttttatattatcggtttttgtttttatgggtcgcgttgttattttatttataacgcggacgagcggcggttcgcgtcgtcggggggtttttcggggatttgcgtgtttttggtacgcgcgatgcgttgtatttgggtttttcgcgggagtcgcggtttaagttgtattatagttttagtttttcgggtttttcgtcgggttattattagttttcgggcggtttcgagtcgtcgttgttgttcgatagttttacgtcgcgtacgtcgtcgtcgtttttttgtttttcggtttcgttttgtttttttttcgtttttttttgtttttcggttttcgcggtttttacgttttcgggcgtttcgatatgttgcgttttcgcgtcggtcgcggttgcggtcgttttgttgtacggtatcgggggcgtcgaggatttgttggcgtcgggggtttcgtgcgcggtttgttcgtcggtttcgtgcgttaataacgttttcgttttcggttcggagtttagtagttttattacgtcgttcgttatttagatttataattttgtcgtcgtggtcgtcgtcgtttattatcgtagttagtagtagtagtagtagtagggtttggcgttttcgcgagcgtcgggtcgtttagcgcgatttttttcgtcggggtcgtcgtatttttttcgtcgttttttagtttttagttgtcgcgtcgtttgttcgattcgttcgtgttcgacgcgttttttagtttttcggattcgttgtcggatcgcgatagttatttaagcggttttttgagtttcggtagttttagcggttttgagttttttagtttcgattttggtcgtcgtttgttaatttttagtcgtttttttattttcgacgat

SEQ ID NO: 10336 - DNA, 1427 bp, Artificial Sequence
  chemically treated genomic DNA (Homo sapiens) CpG-island No: 10336
atcgtcgaaaataaaaaaacgactaaaaattaacaaacgacgaccaaaatcgaaactaaaaaactcaaaaccgctaaaactaccgaaactcaaaaaaccgcttaaataactatcgcgatccgacaacgaatccgaaaaactaaaaaacgcgtcgaacacgaacgaatcgaacaaacgacgcgacaactaaaaactaaaaaacgacgaaaaaaatacgacgaccccgacgaaaaaaatcgcgctaaacgacccgacgctcgcgaaaacgccaaaccctactactactactactactaactacgataataaacgacgacgaccacgacgacaaaattataaatctaaataacgaacgacgtaataaaactactaaactccgaaccgaaaacgaaaacgttattaacgcacgaaaccgacgaacaaaccgcgcacgaaacccccgacgccaacaaatcctcgacgcccccgataccgtacaacaaaacgaccgcaaccgcgaccgacgcgaaaacgcaacatatcgaaacgcccgaaaacgtaaaaaccgcgaaaaccgaaaaacaaaaaaaaacgaaaaaaaaacaaaacgaaaccgaaaaacaaaaaaacgacgacgacgtacgcgacgtaaaactatcgaacaacaacgacgactcgaaaccgcccgaaaactaataataacccgacgaaaaacccgaaaaactaaaactataatacaacttaaaccgcgactcccgcgaaaaacccaaatacaacgcatcgcgcgtaccaaaaacacgcaaatccccgaaaaaccccccgacgacgcgaaccgccgctcgtccgcgttataaataaaataacaacgcgacccataaaaacaaaaaccgataatataaaaaatacgacacaactcgatcttatacttcgaataacgaatcaaactacgcaactcgtaaaaaccatacgcgaactaacacttttcgccgtacttacacgtaccgctctcctcgaaaaaccgacacaactcgatcttataacgcgtaaaattaatctaaaaaccgccgccccccttctactactactacaaatacaaaaaatactaactacgatcgccgttctcgctaaacgaacgatcccgaaatttattctccttattaaacaaaactatacgccgccccccgacgactccttaaaaataccgtaaaaaatcgaaccgccgaccgccgcgctaccgcaactactaccgttaacgacgcccgaaaacttaaacgaacaactaccgaaactaaacgcgaaataaacgaatacatacaaattactaaccgaataccgtcgaaaaaatcccgacgcgaaacccgaactaaaaacgacgacacaaacgtccccaccgccttcttatccaacatattattcaaattaaaattaaccaaaaatttctctatcta

SEQ ID NO: 10337 - DNA, 1042 bp, Artificial Sequence
  chemically treated genomic DNA (Homo sapiens) CpG-island No: 10337
atatcgtagaaggcggatagaagtgtggtcgatatgtttttggatttcgtagtggtcggagcggtaggtcgggaggtcgggaggagtttttggggggcgtggtcggtttgagttacgacgaataacgggcgagggcggggaggggtcgaaagtttgtcgaggggcgagaggagagggcgagtgtagcgatacgagtcgtcgggagggttcggcggagtgcggtaggggggaaggagagaagcgaggagcgttttttcgcgtttcggggtgttcggttcgtttttttcgcggagtcgacggtagttcgcggattgttggaattcggcggttttcgagcgcgcgttttatatagagttcgggagtgcggttgcggcggggcgggcgcgtcgggggaggggatagaattcggttttcgtcggggtttttaggtaacgtcgttcgttcgttcgcggacgttaggcgttttttcggttttttattggtcgtcgttaatttttttttttcgggggagggtgttggaggttttcgggcggggtcggcggttcgggcggtcggtgtggcgtgtagttttcggttttagtggatgtcgtcgggtggcggcgggaaggtacggttgttttttttcggggttgcgcggtcggagagtttcggtacgtttagcgtggtcgggattttgtagttttggacgtgtttttttttgttttgtttttcgaggcggatttgtggagttttaagtttttattttcggttttgtattgggcgcgggaattgtaaaatgttagaatatcgtaattattttcgcggttcggcgggtttgtaaagggtgtttcggttaggaggcgggggttcggggtttgcgtttagtcggtggcggttttagttcgattgtacgtggagtcgcggtgggggtgggggtggttacgcgggcggtcgtcgcggtagttttgtcggtggagttcgggttcgttttttcgtttttttttcgtttaggtttagtaaatagggtttgagcgtcggggtttgtcgggtagggttgagtgtt

SEQ ID NO: 10338 - DNA, 1042 bp, Artificial Sequence
  chemically treated genomic DNA (Homo sapiens) CpG-island No: 10338
aacactcaaccctacccgacaaaccccgacgctcaaaccctatttactaaacctaaacgaaaaaaaaacgaaaaaacgaacccgaactccaccgacaaaactaccgcgacgaccgcccgcgtaaccacccccacccccaccgcgactccacgtacaatcgaactaaaaccgccaccgactaaacgcaaaccccgaacccccgcctcctaaccgaaacaccctttacaaacccgccgaaccgcgaaaataattacgatattctaacattttacaattcccgcgcccaatacaaaaccgaaaataaaaacttaaaactccacaaatccgcctcgaaaaacaaaacaaaaaaaaacacgtccaaaactacaaaatcccgaccacgctaaacgtaccgaaactctccgaccgcgcaaccccgaaaaaaaacaaccgtaccttcccgccgccacccgacgacatccactaaaaccgaaaactacacgccacaccgaccgcccgaaccgccgaccccgcccgaaaacctccaacaccctcccccgaaaaaaaaaaattaacgacgaccaataaaaaaccgaaaaaacgcctaacgtccgcgaacgaacgaacgacgttacctaaaaaccccgacgaaaaccgaattctatcccctcccccgacgcgcccgccccgccgcaaccgcactcccgaactctatataaaacgcgcgctcgaaaaccgccgaattccaacaatccgcgaactaccgtcgactccgcgaaaaaaacgaaccgaacaccccgaaacgcgaaaaaacgctcctcgcttctctccttcccccctaccgcactccgccgaaccctcccgacgactcgtatcgctacactcgccctctcctctcgcccctcgacaaactttcgacccctccccgccctcgcccgttattcgtcgtaactcaaaccgaccacgccccccaaaaactcctcccgacctcccgacctaccgctccgaccactacgaaatccaaaaacatatcgaccacacttctatccgccttctacgatat

SEQ ID NO: 10339 - DNA, 1042 bp, Artificial Sequence
  chemically treated genomic DNA (Homo sapiens) CpG-island No: 10339
gatatttagttttgttcggtaggtttcggcgtttaagttttgtttattgagtttgggcggggagggggcggagaaacgagttcgggttttatcggtaagattgtcgcggcggtcgttcgcgtggttatttttatttttatcgcgattttacgtgtagtcgggttggagtcgttatcgattggacgtaggtttcgagttttcgttttttggtcggggtattttttgtaaattcgtcgggtcgcggggatggttgcgatattttggtattttgtaattttcgcgtttagtataaaatcgaaggtgggagtttaaagttttataggttcgtttcggagaatagggtagggaaagatacgtttagggttgtagaatttcggttacgttaaacgtatcggggtttttcgatcgcgtagtttcggaggagaatagtcgtgttttttcgtcgttattcggcggtatttattggggtcgagagttatacgttatatcggtcgttcgggtcgtcggtttcgttcggaggtttttagtattttttttcggaggaaaaaaattggcggcggttaatgggaggtcgggaaggcgtttgacgttcgcgagcgggcgggcggcgttgtttggagatttcggcgggggtcgagttttgttttttttttcggcgcgttcgtttcgtcgtagtcgtattttcgggttttatatagggcgcgcgttcggaggtcgtcgagttttagtagttcgcgagttgtcgtcggtttcgcggggggggcgggtcgggtatttcggggcgcggaggagcgtttttcgttttttttttttttttttgtcgtatttcgtcggattttttcgacggttcgtgtcgttgtattcgtttttttttttcgtttttcggtaaattttcggttttttttcgttttcgttcgttattcgtcgtggtttaagtcggttacgttttttaagggtttttttcgatttttcggtttgtcgtttcggttattgcgggatttagaaatatgtcgattatatttttgttcgttttttacgatgt

SEQ ID NO: 10340 - DNA, 1042 bp, Artificial Sequence
  chemically treated genomic DNA (Homo sapiens) CpG-island No: 10340
acatcgtaaaaaacgaacaaaaatataatcgacatatttctaaatcccgcaataaccgaaacgacaaaccgaaaaatcgaaaaaaacccttaaaaaacgtaaccgacttaaaccacgacgaataacgaacgaaaacgaaaaaaaaccgaaaatttaccgaaaaacgaaaaaaaaaaacgaatacaacgacacgaaccgtcgaaaaaatccgacgaaatacgacaaaaaaaaaaaaaaaaaacgaaaaacgctcctccgcgccccgaaatacccgacccgccccccccgcgaaaccgacgacaactcgcgaactactaaaactcgacgacctccgaacgcgcgccctatataaaacccgaaaatacgactacgacgaaacgaacgcgccgaaaaaaaaaacaaaactcgacccccgccgaaatctccaaacaacgccgcccgcccgctcgcgaacgtcaaacgccttcccgacctcccattaaccgccgccaatttttttcctccgaaaaaaaatactaaaaacctccgaacgaaaccgacgacccgaacgaccgatataacgtataactctcgaccccaataaataccgccgaataacgacgaaaaaacacgactattctcctccgaaactacgcgatcgaaaaaccccgatacgtttaacgtaaccgaaattctacaaccctaaacgtatctttccctaccctattctccgaaacgaacctataaaactttaaactcccaccttcgattttatactaaacgcgaaaattacaaaataccaaaatatcgcaaccatccccgcgacccgacgaatttacaaaaaataccccgaccaaaaaacgaaaactcgaaacctacgtccaatcgataacgactccaacccgactacacgtaaaatcgcgataaaaataaaaataaccacgcgaacgaccgccgcgacaatcttaccgataaaacccgaactcgtttctccgccccctccccgcccaaactcaataaacaaaacttaaacgccgaaacctaccgaacaaaactaaatatc

SEQ ID NO: 10341 - DNA, 540 bp, Artificial Sequence
  chemically treated genomic DNA (Homo sapiens) CpG-island No: 10341
gaagaggaaaaaaaattggatattttttacggcggttattattttgtgggagtagggaagtcggaagtttcgtttcggaggatcgcggttgggaggtttttagtcggtagggcggggtcgggtattttggggtttcgaggttggaggagggggcggggattgaaggcggggttggggaacgtgtggttcggaggttcgaggttgtgggtggggtttgagggcgggacggagattttgggtttaaggtttttggaaatgggcggggttcgagggcgggaagcggttcgttttgttggaagttcggggttgggggcggggtttgaaggcggggttgggagggagcggggtttgaaggcggggcgggggcggggtttcgcggtcggcgaggggttgagttgatagggtcgtatcggtttattttattttattttatcggaacgtgtttaagttgttgtagttggtattcggttgcgttcggcgaagagggttgggggcgggagatgacggtggttttttttttgtttggtattttgcgagtat

SEQ ID NO: 10342 - DNA, 540 bp, Artificial Sequence
  chemically treated genomic DNA (Homo sapiens) CpG-island No: 10342
atactcgcaaaataccaaacaaaaaaaaaaccaccgtcatctcccgcccccaaccctcttcgccgaacgcaaccgaataccaactacaacaacttaaacacgttccgataaaataaaataaaataaaccgatacgaccctatcaactcaacccctcgccgaccgcgaaaccccgcccccgccccgccttcaaaccccgctccctcccaaccccgccttcaaaccccgcccccaaccccgaacttccaacaaaacgaaccgcttcccgccctcgaaccccgcccatttccaaaaaccttaaacccaaaatctccgtcccgccctcaaaccccacccacaacctcgaacctccgaaccacacgttccccaaccccgccttcaatccccgccccctcctccaacctcgaaaccccaaaatacccgaccccgccctaccgactaaaaacctcccaaccgcgatcctccgaaacgaaacttccgacttccctactcccacaaaataataaccgccgtaaaaaatatccaattttttttcctcttc

SEQ ID NO: 10343 - DNA, 540 bp, Artificial Sequence
  chemically treated genomic DNA (Homo sapiens) CpG-island No: 10343
gtgttcgtagggtgttaagtagggagaagattatcgttatttttcgtttttagtttttttcgtcgagcgtaatcgggtgttagttgtagtagtttaggtacgtttcgataaagtaaggtggggtaagtcgatgcggttttgttagtttagtttttcgtcggtcgcgaggtttcgttttcgtttcgtttttaggtttcgtttttttttagtttcgtttttagatttcgtttttagtttcgaatttttagtaagacgggtcgtttttcgttttcgagtttcgtttatttttaggagttttgagtttagagttttcgtttcgtttttaggttttatttatagtttcgggttttcgagttatacgttttttaatttcgtttttagttttcgtttttttttttagtttcggagttttagggtattcggtttcgttttgtcggttgggagttttttagtcgcgatttttcggggcgggattttcggtttttttgtttttataaaatggtagtcgtcgtgggggatgtttagttttttttttttttt

SEQ ID NO: 10344 - DNA, 540 bp, Artificial Sequence
  chemically treated genomic DNA (Homo sapiens) CpG-island No: 10344
aaaaaaaaaaaaaaactaaacatcccccacgacgactaccattttataaaaacaaaaaaaccgaaaatcccgccccgaaaaatcgcgactaaaaaactcccaaccgacaaaacgaaaccgaataccctaaaactccgaaactaaaaaaaaaaacgaaaactaaaaacgaaattaaaaaacgtataactcgaaaacccgaaactataaataaaacctaaaaacgaaacgaaaactctaaactcaaaactcctaaaaataaacgaaactcgaaaacgaaaaacgacccgtcttactaaaaattcgaaactaaaaacgaaatctaaaaacgaaactaaaaaaaaacgaaacctaaaaacgaaacgaaaacgaaacctcgcgaccgacgaaaaactaaactaacaaaaccgcatcgacttaccccaccttactttatcgaaacgtacctaaactactacaactaacacccgattacgctcgacgaaaaaaactaaaaacgaaaaataacgataatcttctccctacttaacaccctacgaacac

SEQ ID NO: 10345 - DNA, 828 bp, Artificial Sequence
  chemically treated genomic DNA (Homo sapiens) CpG-island No: 10345
cgacgattcgtttatgttttcgttcgttttcgcgcggtggtcgcgtcggatattcgtcgtcgttcgtttggtttgttttcgtcgttttcgttttggtatagcggcggtcgttttggatgcgtatagttaggacgtttcgagtagtatgggggaggcgtcgtagcggtttcgcgcgttgtttaggttcggggtcgggtggagttcgttattcgtagttagtattaggattggggagtcgggttcgtcgtgattttttttatttcggttggtggttcgatgttagggttgtggcggtgcgaagtggtttatcgatcggtttgcgtggcggggacggttagtcgagttcgtttagttttgagcgtaggattgcggttgcgggttatatttgtttcgtcgtaagttcgtttcgcgcgggatcgggggtgttgtcgggtacgaagtttaacgggttttgtgttgtaagcggcggttcgcgtttgggagattagcggtaggaagtgcgggtagcggtcggttaggttttcggggaggtcggggcgcggcgtgtacgttttttcgcgtagttggcgagtcgtatcgttttcgcggtatttttatgcgtttttggtttgttcgttagtcgttgttttttagaggatttagtaggatcgttttttttttttagtcgcgagtacgtgcgcgggggtgcgcgcggaggttacggttattgcggggtttagggaaggaggcgtcgtgtttgtaggattttttttcgtttgggcgtaagtcggcgattagtttggttttttaggatatttttagggtttcggggaattttttttgcgtagg

SEQ ID NO: 10346 - DNA, 828 bp, Artificial Sequence
  chemically treated genomic DNA (Homo sapiens) CpG-island No: 10346
cctacgcaaaaaaaattccccgaaaccctaaaaatatcctaaaaaaccaaactaatcgccgacttacgcccaaacgaaaaaaaatcctacaaacacgacgcctccttccctaaaccccgcaataaccgtaacctccgcgcgcacccccgcgcacgtactcgcgactaaaaaaaaaaaacgatcctactaaatcctctaaaaaacaacgactaacgaacaaaccaaaaacgcataaaaataccgcgaaaacgatacgactcgccaactacgcgaaaaaacgtacacgccgcgccccgacctccccgaaaacctaaccgaccgctacccgcacttcctaccgctaatctcccaaacgcgaaccgccgcttacaacacaaaacccgttaaacttcgtacccgacaacacccccgatcccgcgcgaaacgaacttacgacgaaacaaatataacccgcaaccgcaatcctacgctcaaaactaaacgaactcgactaaccgtccccgccacgcaaaccgatcgataaaccacttcgcaccgccacaaccctaacatcgaaccaccaaccgaaataaaaaaaatcacgacgaacccgactccccaatcctaatactaactacgaataacgaactccacccgaccccgaacctaaacaacgcgcgaaaccgctacgacgcctcccccatactactcgaaacgtcctaactatacgcatccaaaacgaccgccgctataccaaaacgaaaacgacgaaaacaaaccaaacgaacgacgacgaatatccgacgcgaccaccgcgcgaaaacgaacgaaaacataaacgaatcgtcg

SEQ ID NO: 10347 - DNA, 828 bp, Artificial Sequence
  chemically treated genomic DNA (Homo sapiens) CpG-island No: 10347
tttgcgtaggagaggtttttcggagttttggagatgttttaggggattaggttaatcgtcggtttgcgtttaagcgaagggaagttttgtaggtacggcgtttttttttttgagtttcgtagtgatcgtgattttcgcgcgtattttcgcgtacgtgttcgcggttgaggaagaggaacggttttgttgaattttttggaggatagcgattagcgagtaggttaggggcgtatggaggtgtcgcgggggcggtgcggttcgttagttgcgcggaggagcgtgtacgtcgcgtttcggttttttcggggatttggtcggtcgttgttcgtattttttgtcgttggttttttaggcgcgagtcgtcgtttgtagtatagaattcgttgagtttcgtgttcggtagtattttcggtttcgcgcggggcggatttgcggcgggataggtgtagttcgtagtcgtagttttgcgtttaggattgggcgggttcggttggtcgttttcgttacgtaggtcggtcggtgagttatttcgtatcgttatagttttagtatcgggttattagtcggggtgaagaaagttacggcgagttcggttttttagttttgatgttggttgcgggtggcgggttttattcggtttcggatttaggtagcgcgcgagatcgttgcggcgttttttttatgttgttcggagcgttttggttgtgcgtatttaaggcggtcgtcgttgtgttagagcgagggcgacgaggataggttaggcgagcgacggcggatgttcggcgcggttatcgcgcgggggcgggcgaggatatggacgagtcgtcg

SEQ ID NO: 10348 - DNA, 828 bp, Artificial Sequence
  chemically treated genomic DNA (Homo sapiens) CpG-island No: 10348
cgacgactcgtccatatcctcgcccgcccccgcgcgataaccgcgccgaacatccgccgtcgctcgcctaacctatcctcgtcgccctcgctctaacacaacgacgaccgccttaaatacgcacaaccaaaacgctccgaacaacataaaaaaaacgccgcaacgatctcgcgcgctacctaaatccgaaaccgaataaaacccgccacccgcaaccaacatcaaaactaaaaaaccgaactcgccgtaactttcttcaccccgactaataacccgatactaaaactataacgatacgaaataactcaccgaccgacctacgtaacgaaaacgaccaaccgaacccgcccaatcctaaacgcaaaactacgactacgaactacacctatcccgccgcaaatccgccccgcgcgaaaccgaaaatactaccgaacacgaaactcaacgaattctatactacaaacgacgactcgcgcctaaaaaaccaacgacaaaaaatacgaacaacgaccgaccaaatccccgaaaaaaccgaaacgcgacgtacacgctcctccgcgcaactaacgaaccgcaccgcccccgcgacacctccatacgcccctaacctactcgctaatcgctatcctccaaaaaattcaacaaaaccgttcctcttcctcaaccgcgaacacgtacgcgaaaatacgcgcgaaaatcacgatcactacgaaactcaaaaaaaaaaacgccgtacctacaaaacttcccttcgcttaaacgcaaaccgacgattaacctaatcccctaaaacatctccaaaactccgaaaaacctctcctacgcaaa

SEQ ID NO: 10349 - DNA, 709 bp, Artificial Sequence
  chemically treated genomic DNA (Homo sapiens) CpG-island No: 10349
gttcgcggttagcggttcggtgaggcggggaggcggcggtcggtcggttcggtttagtttagttcgtagttgcggcggcgtttagagttggtttttgatcgttttttgtcgcggtcgggtttgttattaggttttggggtttgtatcggttcggttagatttcgtttttcgttttttcgttatggttttggtgcggggcgcggagtcggcggcggggttttttcgttggttgtttacgtacgtttaggtgacggtgttgcgggttcgcgggttgcgggcgaagagttcgggagcgtgtagtattagcgacgcgtatacggtgatttaggtgggtcgcgagaagtatagtacgtcggtggtggagaagacgtacggttgtttcgagtggcgtgaggagtgttttttcgagttgtcgtcgggggttttgggatggtttgttgcgggcgtaggaggatcgacgcgggttcggcgttttgggtcgcgaggtttcgtcgtcgtttgcgagttggtgtttattattatgtatcgttcgtttatcggcgtcgataagtttttgggttaggttacggtggcgttggacgaggttttcggcgtaggtcgcgtttagtatacgtagtaggtgagggtgcgcggggtatagaaatcgttaaaggtttaatagggcggggttggtgggggattaggatttcgaattttagtcgggttagtg

SEQ ID NO: 10350 - DNA, 709 bp, Artificial Sequence
  chemically treated genomic DNA (Homo sapiens) CpG-island No: 10350
cactaacccgactaaaattcgaaatcctaatcccccaccaaccccgccctattaaacctttaacgatttctataccccgcgcaccctcacctactacgtatactaaacgcgacctacgccgaaaacctcgtccaacgccaccgtaacctaacccaaaaacttatcgacgccgataaacgaacgatacataataataaacaccaactcgcaaacgacgacgaaacctcgcgacccaaaacgccgaacccgcgtcgatcctcctacgcccgcaacaaaccatcccaaaacccccgacgacaactcgaaaaaacactcctcacgccactcgaaacaaccgtacgtcttctccaccaccgacgtactatacttctcgcgacccacctaaatcaccgtatacgcgtcgctaatactacacgctcccgaactcttcgcccgcaacccgcgaacccgcaacaccgtcacctaaacgtacgtaaacaaccaacgaaaaaaccccgccgccgactccgcgccccgcaccaaaaccataacgaaaaaacgaaaaacgaaatctaaccgaaccgatacaaaccccaaaacctaataacaaacccgaccgcgacaaaaaacgatcaaaaaccaactctaaacgccgccgcaactacgaactaaactaaaccgaaccgaccgaccgccgcctccccgcctcaccgaaccgctaaccgcgaac

SEQ ID NO: 10351 - DNA, 709 bp, Artificial Sequence
  chemically treated genomic DNA (Homo sapiens) CpG-island No: 10351
tattggttcggttgaagttcggggttttgattttttattagtttcgttttgttaggtttttagcggtttttgtgtttcgcgtatttttatttattgcgtgtgttgggcgcggtttgcgtcgaagatttcgtttagcgttatcgtggtttggtttaggaatttgtcgacgtcgatgagcgagcggtgtatggtggtgagtattagttcgtaggcggcggcggagtttcgcggtttagggcgtcgggttcgcgtcggtttttttgcgttcgtagtaggttattttagggttttcggcggtagttcgaaggagtattttttacgttattcggggtagtcgtgcgttttttttattatcgacgtattgtatttttcgcggtttatttggattatcgtgtacgcgtcgttggtgttgtacgttttcgagtttttcgttcgtagttcgcgggttcgtagtatcgttatttggacgtgcgtgggtagttagcgggaaggtttcgtcgtcggtttcgcgtttcgtattagggttatggcggagaagcggggggcgaggtttggtcgagtcggtgtagattttaggatttggtgataaattcggtcgcggtagaaggcggttaggaattaattttgagcgtcgtcgtagttgcgggttgggttgggtcgggtcgatcggtcgtcgttttttcgttttatcgggtcgttggtcgcgggt

SEQ ID NO: 10352 - DNA, 709 bp, Artificial Sequence
  chemically treated genomic DNA (Homo sapiens) CpG-island No: 10352
acccgcgaccaacgacccgataaaacgaaaaaacgacgaccgatcgacccgacccaacccaacccgcaactacgacgacgctcaaaattaattcctaaccgccttctaccgcgaccgaatttatcaccaaatcctaaaatctacaccgactcgaccaaacctcgccccccgcttctccgccataaccctaatacgaaacgcgaaaccgacgacgaaaccttcccgctaactacccacgcacgtccaaataacgatactacgaacccgcgaactacgaacgaaaaactcgaaaacgtacaacaccaacgacgcgtacacgataatccaaataaaccgcgaaaaatacaatacgtcgataataaaaaaaacgcacgactaccccgaataacgtaaaaaatactccttcgaactaccgccgaaaaccctaaaataacctactacgaacgcaaaaaaaccgacgcgaacccgacgccctaaaccgcgaaactccgccgccgcctacgaactaatactcaccaccatacaccgctcgctcatcgacgtcgacaaattcctaaaccaaaccacgataacgctaaacgaaatcttcgacgcaaaccgcgcccaacacacgcaataaataaaaatacgcgaaacacaaaaaccgctaaaaacctaacaaaacgaaactaataaaaaatcaaaaccccgaacttcaaccgaaccaata

SEQ ID NO: 10353 - DNA, 787 bp, Artificial Sequence
  chemically treated genomic DNA (Homo sapiens) CpG-island No: 10353
tcgtagcgtcgtcgcggcggatttttttaaatttttggtggcggatatttttggaagtagtggcgtggttgtattattcgtgtcgtcgtcgtcgtttattttttttttttaggttaaggcgcgacgtaaggggcgtcgcggcggcgaaatgtagtacgcgttgtttttgttcgcggtcgtacgttaaggttttcgtttgttcggtggagagttgtgtgcggagttttgcgcgtttcgacgagtttaatcgttatttgcgtatttatacgggttataaatttttttagtgtcgtatttgttttcgtaattttagtcgtagcgattattttattacgtacgtgcgtatttatatcggcgagaagttttttgtttgcgacgtgtgcggtcgtcgtttcggcgtagcgatgagaagaaacggtatagtaaggtgtattttaagtagaaggcgcgcgtcgaggagcggtttaagggtttcggtttttattcgttgggtttttttttcgtttttttttgagtaagagatgggtttatgggttggggcgtcgtcgttcggcgcgtacgagtttcgggtcgttttttttttcgttttttttttaattttttttcgtacgttcgagggtcggttttcggtttcgtttttagtttttttgaagcgttcgtcgtatacgttttatttagtattagtttcgcggatagttttcgcggtttaggcgttgttatttttgttagtcgcgttttgggggaagttttttgagattatttagtgaataggtattattttgggatt

SEQ ID NO: 10354 - DNA, 787 bp, Artificial Sequence
  chemically treated genomic DNA (Homo sapiens) CpG-island No: 10354
aatcccaaaataatacctattcactaaataatctcaaaaaacttcccccaaaacgcgactaacaaaaataacaacgcctaaaccgcgaaaactatccgcgaaactaatactaaataaaacgtatacgacgaacgcttcaaaaaaactaaaaacgaaaccgaaaaccgaccctcgaacgtacgaaaaaaaattaaaaaaaaaacgaaaaaaaaaacgacccgaaactcgtacgcgccgaacgacgacgccccaacccataaacccatctcttactcaaaaaaaaacgaaaaaaaaacccaacgaataaaaaccgaaacccttaaaccgctcctcgacgcgcgccttctacttaaaatacaccttactataccgtttcttctcatcgctacgccgaaacgacgaccgcacacgtcgcaaacaaaaaacttctcgccgatataaatacgcacgtacgtaataaaataatcgctacgactaaaattacgaaaacaaatacgacactaaaaaaatttataacccgtataaatacgcaaataacgattaaactcgtcgaaacgcgcaaaactccgcacacaactctccaccgaacaaacgaaaaccttaacgtacgaccgcgaacaaaaacaacgcgtactacatttcgccgccgcgacgccccttacgtcgcgccttaacctaaaaaaaaaaaataaacgacgacgacgacacgaataatacaaccacgccactacttccaaaaatatccgccaccaaaaatttaaaaaaatccgccgcgacgacgctacga

SEQ ID NO: 10355 - DNA, 787 bp, Artificial Sequence
  chemically treated genomic DNA (Homo sapiens) CpG-island No: 10355
aattttagggtagtgtttatttattgggtggttttagaagattttttttaaagcgcggttgataagggtgatagcgtttggatcgcgggaattgttcgcggagttggtgttgaatagggcgtgtgcggcgggcgttttaaggaaattggaagcgggatcggaggtcggttttcgggcgtgcgaggaggagttggaagaagagcggggaggggaacggttcggaattcgtgcgcgtcgaacggcggcgttttaatttataaatttattttttgtttagagagaagcgaaggagaggtttagcgagtaaaagtcgaggtttttgagtcgtttttcggcgcgcgttttttgtttgaggtgtattttgttgtgtcgtttttttttatcgttgcgtcgaagcggcggtcgtatacgtcgtaagtaaaaggtttttcgtcggtgtgggtgcgtacgtgcgtggtgaggtggtcgttgcggttgaagttgcggaggtagatgcggtattggaagggtttgtggttcgtgtggatgcgtaggtggcgattgagttcgtcggagcgcgtaaagtttcgtatataattttttatcgggtaagcgaaggttttggcgtgcggtcgcgggtagaagtagcgcgtgttgtatttcgtcgtcgcgacgttttttgcgtcgcgttttggtttgggggaaaggggtgggcggcggcggcggtacgggtggtgtagttacgttattgtttttagggatgttcgttattagaggtttagggaagttcgtcgcggcggcgttgcga

SEQ ID NO: 10356 - DNA, 787 bp, Artificial Sequence
  chemically treated genomic DNA (Homo sapiens) CpG-island No: 10356
tcgcaacgccgccgcgacgaacttccctaaacctctaataacgaacatccctaaaaacaataacgtaactacaccacccgtaccgccgccgccgcccacccctttcccccaaaccaaaacgcgacgcaaaaaacgtcgcgacgacgaaatacaacacgcgctacttctacccgcgaccgcacgccaaaaccttcgcttacccgataaaaaattatatacgaaactttacgcgctccgacgaactcaatcgccacctacgcatccacacgaaccacaaacccttccaataccgcatctacctccgcaacttcaaccgcaacgaccacctcaccacgcacgtacgcacccacaccgacgaaaaaccttttacttacgacgtatacgaccgccgcttcgacgcaacgataaaaaaaaacgacacaacaaaatacacctcaaacaaaaaacgcgcgccgaaaaacgactcaaaaacctcgacttttactcgctaaacctctccttcgcttctctctaaacaaaaaataaatttataaattaaaacgccgccgttcgacgcgcacgaattccgaaccgttcccctccccgctcttcttccaactcctcctcgcacgcccgaaaaccgacctccgatcccgcttccaatttccttaaaacgcccgccgcacacgccctattcaacaccaactccgcgaacaattcccgcgatccaaacgctatcacccttatcaaccgcgctttaaaaaaaatcttctaaaaccacccaataaataaacactaccctaaaatt

SEQ ID NO: 10357 - DNA, 674 bp, Artificial Sequence
  chemically treated genomic DNA (Homo sapiens) CpG-island No: 10357
gcgtgcgggcgtcgggatcgtagtatttgtgacgtcgaagtttagtaggtcgtagacgggagttacgcgcggttttggtatagggtaaaaatttacgtttaggtaggcgggtagttacgatgtcgggtaagtttaggtagattttcggtggcgtatagggaagtagcggtttagaaggtcgggtggacgtaggcggagttcgacggttgggaggtcgtcggcgcgtaggggtcgggtttcgttaggatggtttcgatcgagaaaggggattcgaagcgttcgggagcgcggggcgtgttcgggttagtaggggatttgggcgtcgagagagcggttagagcgcggaggtcggattcgagagttcgagggagcgggtggcgggttgtttcgcggtttggggttaggtatgacgcggtcgttgttcggacggacgtaaggaagggagttcgggagaagtgagaagattttgtaaaaggtagcgagtaagatcggttgtttgggaattttttgcgcgttcggcgaaggtttttaaatttggcgggggcggggtatggggcggtttttttttattgcggtcgcggcggggtttttaaagtttgtgagcgttcgttttgtgcgaggtaaggtgggtatagtattaaagagtgtgtttttttttttttttcgtttttaaa

SEQ ID NO: 10358 - DNA, 674 bp, Artificial Sequence
  chemically treated genomic DNA (Homo sapiens) CpG-island No: 10358
tttaaaaacgaaaaaaaaaaaaaaacacactctttaatactatacccaccttacctcgcacaaaacgaacgctcacaaactttaaaaaccccgccgcgaccgcaataaaaaaaaaccgccccataccccgcccccgccaaatttaaaaaccttcgccgaacgcgcaaaaaattcccaaacaaccgatcttactcgctaccttttacaaaatcttctcacttctcccgaactcccttccttacgtccgtccgaacaacgaccgcgtcatacctaaccccaaaccgcgaaacaacccgccacccgctccctcgaactctcgaatccgacctccgcgctctaaccgctctctcgacgcccaaatcccctactaacccgaacacgccccgcgctcccgaacgcttcgaatcccctttctcgatcgaaaccatcctaacgaaacccgacccctacgcgccgacgacctcccaaccgtcgaactccgcctacgtccacccgaccttctaaaccgctacttccctatacgccaccgaaaatctacctaaacttacccgacatcgtaactacccgcctacctaaacgtaaatttttaccctataccaaaaccgcgcgtaactcccgtctacgacctactaaacttcgacgtcacaaatactacgatcccgacgcccgcacgc

SEQ ID NO: 10359 - DNA, 674 bp, Artificial Sequence
  chemically treated genomic DNA (Homo sapiens) CpG-island No: 10359
tttaaaagcggaggaagggagggaatatattttttggtgttgtgtttattttgtttcgtatagagcgggcgtttataggttttgggggtttcgtcgcgatcgtagtggggagaggtcgttttatgtttcgttttcgttaaatttaagagttttcgtcgagcgcgtaggaggtttttagataatcggttttgttcgttgttttttgtagaatttttttatttttttcgagtttttttttttgcgttcgttcgggtaacggtcgcgttatgtttagttttaggtcgcgaggtagttcgttattcgttttttcgggttttcgggttcgattttcgcgttttggtcgttttttcggcgtttaggttttttattggttcgaatacgtttcgcgttttcggacgtttcgagttttttttttcggtcgaggttattttggcgaggttcgatttttgcgcgtcggcggttttttagtcgtcgggtttcgtttgcgtttattcggttttttggatcgttgtttttttgtgcgttatcgggggtttgtttgggtttgttcgatatcgtggttgttcgtttatttgagcgtaggtttttattttgtgttagggtcgcgcgtggttttcgtttgcggtttgttgggtttcggcgttataggtattgcggtttcggcgttcgtacgt

SEQ ID NO: 10360 - DNA, 674 bp, Artificial Sequence
  chemically treated genomic DNA (Homo sapiens) CpG-island No: 10360
acgtacgaacgccgaaaccgcaatacctataacgccgaaacccaacaaaccgcaaacgaaaaccacgcgcgaccctaacacaaaataaaaacctacgctcaaataaacgaacaaccacgatatcgaacaaacccaaacaaacccccgataacgcacaaaaaaacaacgatccaaaaaaccgaataaacgcaaacgaaacccgacgactaaaaaaccgccgacgcgcaaaaatcgaacctcgccaaaataacctcgaccgaaaaaaaaaactcgaaacgtccgaaaacgcgaaacgtattcgaaccaataaaaaacctaaacgccgaaaaaacgaccaaaacgcgaaaatcgaacccgaaaacccgaaaaaacgaataacgaactacctcgcgacctaaaactaaacataacgcgaccgttacccgaacgaacgcaaaaaaaaaaactcgaaaaaaataaaaaaattctacaaaaaacaacgaacaaaaccgattatctaaaaacctcctacgcgctcgacgaaaactcttaaatttaacgaaaacgaaacataaaacgacctctccccactacgatcgcgacgaaacccccaaaacctataaacgcccgctctatacgaaacaaaataaacacaacaccaaaaaatatattccctcccttcctccgcttttaaa

SEQ ID NO: 10361 - DNA, 521 bp, Artificial Sequence
  chemically treated genomic DNA (Homo sapiens) CpG-island No: 10361
aggtgcgtcgtcgcgggtacggttcggttcgtttgttttttgttttggaaggaagtgttttcgaagatttttcgtcgggcgtcgggtacggtaggtagggcggcgggttcgggagttagcgggaatttcgaggtagcggcggcggcggcggcggcggggcgtttaaaaatgcgtgttggttttggagaggatgtagagcgtttcgtaggtgtggttgtattttaggtgcgtcgtagcgtacgataggtttcgaaagcgtttgtgtttttcgtagcgggggtagcggtacggtaggtttagcgaggttatggtttcgtcgttttcgcggtacgcgggttttatcgcggtcgtttcgtcggttagtcgggcgcgtttatgggggatcgcgggcgaggttttttgcggggttaggaaggtttagggcgttcgcggtttggggcgaggaggttggaagagacgcgatgagttttaggaagagggtatcgttgtttttattttggtttttagttcggagtttttat

SEQ ID NO: 10362 - DNA, 521 bp, Artificial Sequence
  chemically treated genomic DNA (Homo sapiens) CpG-island No: 10362
ataaaaactccgaactaaaaaccaaaataaaaacaacgataccctcttcctaaaactcatcgcgtctcttccaacctcctcgccccaaaccgcgaacgccctaaaccttcctaaccccgcaaaaaacctcgcccgcgatcccccataaacgcgcccgactaaccgacgaaacgaccgcgataaaacccgcgtaccgcgaaaacgacgaaaccataacctcgctaaacctaccgtaccgctacccccgctacgaaaaacacaaacgctttcgaaacctatcgtacgctacgacgcacctaaaatacaaccacacctacgaaacgctctacatcctctccaaaaccaacacgcatttttaaacgccccgccgccgccgccgccgccgctacctcgaaattcccgctaactcccgaacccgccgccctacctaccgtacccgacgcccgacgaaaaatcttcgaaaacacttccttccaaaacaaaaaacaaacgaaccgaaccgtacccgcgacgacgcacct

SEQ ID NO: 10363 - DNA, 521 bp, Artificial Sequence
  chemically treated genomic DNA (Homo sapiens) CpG-island No: 10363
atgagggtttcgggttgggagttagggtgggagtagcgatattttttttttaagatttatcgcgttttttttagttttttcgttttaggtcgcgggcgttttgagtttttttgatttcgtagggggtttcgttcgcggttttttatgagcgcgttcggttgatcggcggggcggtcgcggtggagttcgcgtgtcgcgggggcggcggggttatggtttcgttggatttgtcgtgtcgttgttttcgttgcggggagtataagcgttttcggagtttgtcgtgcgttacggcgtatttggagtatagttatatttacgagacgttttatattttttttaagattaatacgtatttttgagcgtttcgtcgtcgtcgtcgtcgtcgttgtttcggggttttcgttggttttcgagttcgtcgttttgtttgtcgtgttcggcgttcggcgagaggttttcgagagtatttttttttagggtaaggagtaggcggatcgggtcgtgttcgcggcgacgtattt

SEQ ID NO: 10364 - DNA, 521 bp, Artificial Sequence
  chemically treated genomic DNA (Homo sapiens) CpG-island No: 10364
aaatacgtcgccgcgaacacgacccgatccgcctactccttaccctaaaaaaaaatactctcgaaaacctctcgccgaacgccgaacacgacaaacaaaacgacgaactcgaaaaccaacgaaaaccccgaaacaacgacgacgacgacgacgacgaaacgctcaaaaatacgtattaatcttaaaaaaaatataaaacgtctcgtaaatataactatactccaaatacgccgtaacgcacgacaaactccgaaaacgcttatactccccgcaacgaaaacaacgacacgacaaatccaacgaaaccataaccccgccgcccccgcgacacgcgaactccaccgcgaccgccccgccgatcaaccgaacgcgctcataaaaaaccgcgaacgaaaccccctacgaaatcaaaaaaactcaaaacgcccgcgacctaaaacgaaaaaactaaaaaaaacgcgataaatcttaaaaaaaaaatatcgctactcccaccctaactcccaacccgaaaccctcat

SEQ ID NO: 10365 - DNA, 542 bp, Artificial Sequence
  chemically treated genomic DNA (Homo sapiens) CpG-island No: 10365
gacggcgcggcgaggtgtgtttgaggatggggcgaaaggagatcgtgttcgggtggtttttttcgaaggaaaaattcgtcgttttttattcggtgtttgttttttcgagtatttttcggggtgggcgtcgagggtattcgggcgttgggagcggggtcgttttttttttttattatcgagttattgtcgggtaggtatcgcgcgggcggaatcgagtattggggattgaggcggtcgtcgcgtgtttgtttagcgttcgttttcgtcgtcgcgggttttaattttcgatatatttgcgagttggttttttgtttcggggtttcggttttgtaagtaaataggtcgagcgcggcgttgtattcgaaatgcggtatttgagtagcgcggcgaaggcgagcgggggagcggtttattcgggtaattgtttttttcggtttttaattttttcgtcgggtttttttcgtcggttgtagtttattgattagtttaggagtcgtcggtttaatttagttttcgaggggttattataatttttattttgg

SEQ ID NO: 10366 - DNA, 542 bp, Artificial Sequence
  chemically treated genomic DNA (Homo sapiens) CpG-island No: 10366
ccaaaataaaaattataataacccctcgaaaactaaattaaaccgacgactcctaaactaatcaataaactacaaccgacgaaaaaaacccgacgaaaaaattaaaaaccgaaaaaaacaattacccgaataaaccgctcccccgctcgccttcgccgcgctactcaaataccgcatttcgaatacaacgccgcgctcgacctatttacttacaaaaccgaaaccccgaaacaaaaaaccaactcgcaaatatatcgaaaattaaaacccgcgacgacgaaaacgaacgctaaacaaacacgcgacgaccgcctcaatccccaatactcgattccgcccgcgcgatacctacccgacaataactcgataataaaaaaaaaaaacgaccccgctcccaacgcccgaataccctcgacgcccaccccgaaaaatactcgaaaaaacaaacaccgaataaaaaacgacgaatttttccttcgaaaaaaaccacccgaacacgatctcctttcgccccatcctcaaacacacctcgccgcgccgtc

SEQ ID NO: 10367 - DNA, 542 bp, Artificial Sequence
  chemically treated genomic DNA (Homo sapiens) CpG-island No: 10367
ttagggtggggattgtgatggtttttcgggagttgggttgagtcggcggtttttgagttaattaatgggttgtagtcggcggaaggggttcggcggggggattaggagtcgagaagggtaattattcgggtgggtcgttttttcgttcgttttcgtcgcgttgtttaaatgtcgtatttcggatgtagcgtcgcgttcggtttgtttgtttgtagagtcggggtttcggggtaggaagttaattcgtaagtgtatcggagattagggttcgcggcggcgggggcgggcgttgggtaaatacgcggcggtcgttttaatttttagtgttcgatttcgttcgcgcggtgtttgttcggtagtgattcggtggtgggggaagggggcggtttcgtttttagcgttcgggtgttttcgacgtttatttcgggggatattcggggaggtaggtatcggatggggagcgacgggtttttttttcgggagaggttattcgggtacggttttttttcgttttatttttaggtatatttcgtcgcgtcgtt

SEQ ID NO: 10368 - DNA, 542 bp, Artificial Sequence
  chemically treated genomic DNA (Homo sapiens) CpG-island No: 10368
aacgacgcgacgaaatatacctaaaaataaaacgaaaaaaaaccgtacccgaataacctctcccgaaaaaaaaacccgtcgctccccatccgatacctacctccccgaatatcccccgaaataaacgtcgaaaacacccgaacgctaaaaacgaaaccgcccccttcccccaccaccgaatcactaccgaacaaacaccgcgcgaacgaaatcgaacactaaaaattaaaacgaccgccgcgtatttacccaacgcccgcccccgccgccgcgaaccctaatctccgatacacttacgaattaacttcctaccccgaaaccccgactctacaaacaaacaaaccgaacgcgacgctacatccgaaatacgacatttaaacaacgcgacgaaaacgaacgaaaaaacgacccacccgaataattacccttctcgactcctaatccccccgccgaaccccttccgccgactacaacccattaattaactcaaaaaccgccgactcaacccaactcccgaaaaaccatcacaatccccaccctaa

SEQ ID NO: 10369 - DNA, 900 bp, Artificial Sequence
  chemically treated genomic DNA (Homo sapiens) CpG-island No: 10369
tattgtcggttattagtatcgcgtttataattttttataattttagggcggttcgggcgtcggtttcggcgttcgggggtgcgtagcggggaggtcgggtcggggttcgagtttcgggcgcggtgtgcggaggttttcgttcggtttagttttttcggattcgagggtttcgtagtcgttttcgggaggggtagcgttttcgcgtttcgcgcgtttcgggaggtcgtagcggggcgtgagagtcgcgtgggggcgggaagcgggttttgttcgaggcggtttttttttcgatgtcgagaaggaagtcgtatttatcgcgtcgggtttcggaggcggtcgtgggttacggcgggtcggggcggttaggcgggaggagcgggggaggcgggggtcggggtcggcgagttgagtgggatgttcggtttttcgcgcgtttttagattcgttcgggtagttttattttcggcgtcggtcggttcggagcgagttattttcgtttcgttaggcggcgttaggtcggggggttagagttttcgggtggtttcggagggggcgggcgagtaggtgggggtaggggatcggttagttcgttagtttcggcgcggcgtagtcggttgttcgtttcgttttttttcgttaggtttcgttttttcgtcgggtcgcgcgttcggagaggtcgcggtcgttattgtttcgtcgggggtttttttgtttttttgcgcggcgtggggacggttcgagtcggggaagggggtgggggaaggggagcgtttgtggtaagaggagttagtgggggaaggggacgttaggttgggcggggttttggcgaggagggggcgtggcgtagaggatttgataaagattttggttgtttttcgttttttgaaattggggttaggg

SEQ ID NO: 10370 - DNA, 900 bp, Artificial Sequence
  chemically treated genomic DNA (Homo sapiens) CpG-island No: 10370
ccctaaccccaatttcaaaaaacgaaaaacaaccaaaatctttatcaaatcctctacgccacgccccctcctcgccaaaaccccgcccaacctaacgtccccttcccccactaactcctcttaccacaaacgctccccttcccccacccccttccccgactcgaaccgtccccacgccgcgcaaaaaaacaaaaaaacccccgacgaaacaataacgaccgcgacctctccgaacgcgcgacccgacgaaaaaacgaaacctaacgaaaaaaaacgaaacgaacaaccgactacgccgcgccgaaactaacgaactaaccgatcccctacccccacctactcgcccgccccctccgaaaccacccgaaaactctaaccccccgacctaacgccgcctaacgaaacgaaaataactcgctccgaaccgaccgacgccgaaaataaaactacccgaacgaatctaaaaacgcgcgaaaaaccgaacatcccactcaactcgccgaccccgacccccgcctcccccgctcctcccgcctaaccgccccgacccgccgtaacccacgaccgcctccgaaacccgacgcgataaatacgacttccttctcgacatcgaaaaaaaaaccgcctcgaacaaaacccgcttcccgcccccacgcgactctcacgccccgctacgacctcccgaaacgcgcgaaacgcgaaaacgctacccctcccgaaaacgactacgaaaccctcgaatccgaaaaaactaaaccgaacgaaaacctccgcacaccgcgcccgaaactcgaaccccgacccgacctccccgctacgcacccccgaacgccgaaaccgacgcccgaaccgccctaaaattataaaaaattataaacgcgatactaataaccgacaata

SEQ ID NO: 10371 - DNA, 900 bp, Artificial Sequence
  chemically treated genomic DNA (Homo sapiens) CpG-island No: 10371
ttttaattttagttttaaggggcggggaataattagaatttttgttaggttttttacgttacgtttttttttcgttagagtttcgtttagtttgacgttttttttttttattagttttttttgttatagacgtttttttttttttattttttttttcggttcgggtcgtttttacgtcgcgtaggagagtaaagaaattttcggcggggtagtggcggtcgcggttttttcgaacgcgcgattcggcgagggggcggggtttggcgggagggggcggggcgggtagtcgattgcgtcgcgtcgggattgacgggttaatcggttttttatttttatttattcgttcgtttttttcggggttattcggggattttgatttttcggtttggcgtcgtttgacggagcgggagtggttcgtttcgggtcggtcggcgtcggggatgaggttgttcggacgggtttaggggcgcgcgaggggtcgagtattttatttagttcgtcggtttcggttttcgtttttttcgtttttttcgtttggtcgtttcggttcgtcgtgatttacggtcgttttcggagttcgacgcggtaagtgcgatttttttttcggtatcggggagggggtcgtttcgggtagggttcgtttttcgtttttacgcgatttttacgtttcgttgcggtttttcggagcgcgcggggcgcgaagacgttgtttttttcggaggcggttgcgaggttttcgggttcggaggggttgggtcgggcgggggttttcgtatatcgcgttcggggttcgaatttcggttcggttttttcgttgcgtattttcgagcgtcggagtcggcgttcgggtcgttttggagttgtggaaagttgtggacgcggtgttggtggtcggtagtg

SEQ ID NO: 10372 - DNA, 900 bp, Artificial Sequence
  chemically treated genomic DNA (Homo sapiens) CpG-island No: 10372
cactaccgaccaccaacaccgcgtccacaactttccacaactccaaaacgacccgaacgccgactccgacgctcgaaaatacgcaacgaaaaaaccgaaccgaaattcgaaccccgaacgcgatatacgaaaacccccgcccgacccaacccctccgaacccgaaaacctcgcaaccgcctccgaaaaaaacaacgtcttcgcgccccgcgcgctccgaaaaaccgcaacgaaacgtaaaaatcgcgtaaaaacgaaaaacgaaccctacccgaaacgaccccctccccgataccgaaaaaaaaatcgcacttaccgcgtcgaactccgaaaacgaccgtaaatcacgacgaaccgaaacgaccaaacgaaaaaaacgaaaaaaacgaaaaccgaaaccgacgaactaaataaaatactcgacccctcgcgcgcccctaaacccgtccgaacaacctcatccccgacgccgaccgacccgaaacgaaccactcccgctccgtcaaacgacgccaaaccgaaaaatcaaaatccccgaataaccccgaaaaaaacgaacgaataaataaaaataaaaaaccgattaacccgtcaatcccgacgcgacgcaatcgactacccgccccgccccctcccgccaaaccccgccccctcgccgaatcgcgcgttcgaaaaaaccgcgaccgccactaccccgccgaaaatttctttactctcctacgcgacgtaaaaacgacccgaaccgaaaaaaaaaataaaaaaaaaaaaacgtctataacaaaaaaaactaataaaaaaaaaaaacgtcaaactaaacgaaactctaacgaaaaaaaaacgtaacgtaaaaaacctaacaaaaattctaattattccccgccccttaaaactaaaattaaaa

SEQ ID NO: 10373 - DNA, 557 bp, Artificial Sequence
  chemically treated genomic DNA (Homo sapiens) CpG-island No: 10373
  misc_feature (124)..(124): n is either a, c, g or t
  misc_feature (452)..(452): n is either a, c, g or t
  misc_feature (472)..(472): n is either a, c, g or t
  misc_feature (479)..(479): n is either a, c, g or t
  misc_feature (488)..(488): n is either a, c, g or t
  misc_feature (491)..(491): n is either a, c, g or t
  misc_feature (529)..(529): n is either a, c, g or t
tcggcgtaggattcggattcgtatgttatcgcgattttattattcgtttaacgtttagtatttagagggtattcgttaattaatcgcggcgcggagaaaagtcgtgttgcgaggatattttttngtttcgtttattcgagttttaggcgttgaagtttttttatttttttttattttatcgtttttcggtttagttcgtttaggtgtatttcgttttttttttcgtttatttatcgtttttatttggaggtggttcgtcgtcgtttcgtacgttattgttttgtaaattgttttagtagttgggtagttagtaagcgggtcgggaggttggagcggttagttaattagcgatcggcgttataagttgatatgacggtagatcgcgcgaagggtttgcgcgtagtttttcgcggttacgtgggcgtcgcgcgttcggttacgttttttttgtntttttgattaaggggagggncgggcgnttttatttngangtatttttgcggtggaggatgcggtttcgggttttgtngtttgtttttttgttttttttttaaatt

SEQ ID NO: 10374 - DNA, 557 bp, Artificial Sequence
  chemically treated genomic DNA (Homo sapiens) CpG-island No: 10374
  misc_feature (29)..(29): n is either a, c, g or t
  misc_feature (67)..(67): n is either a, c, g or t
  misc_feature (70)..(70): n is either a, c, g or t
  misc_feature (79)..(79): n is either a, c, g or t
  misc_feature (86)..(86): n is either a, c, g or t
  misc_feature (106)..(106): n is either a, c, g or t
  misc_feature (434)..(434): n is either a, c, g or t
aatttaaaaaaaaaacaaaaaaacaaacnacaaaacccgaaaccgcatcctccaccgcaaaaatacntcnaaataaaancgcccgnccctccccttaatcaaaaanacaaaaaaaacgtaaccgaacgcgcgacgcccacgtaaccgcgaaaaactacgcgcaaacccttcgcgcgatctaccgtcatatcaacttataacgccgatcgctaattaactaaccgctccaacctcccgacccgcttactaactacccaactactaaaacaatttacaaaacaataacgtacgaaacgacgacgaaccacctccaaataaaaacgataaataaacgaaaaaaaaaacgaaatacacctaaacgaactaaaccgaaaaacgataaaataaaaaaaaataaaaaaacttcaacgcctaaaactcgaataaacgaaacnaaaaaatatcctcgcaacacgacttttctccgcgccgcgattaattaacgaataccctctaaatactaaacgttaaacgaataataaaatcgcgataacatacgaatccgaatcctacgccga

SEQ ID NO: 10375 - DNA, 557 bp, Artificial Sequence
  chemically treated genomic DNA (Homo sapiens) CpG-island No: 10375
  misc_feature (29)..(29): n is either a, c, g or t
  misc_feature (67)..(67): n is either a, c, g or t
  misc_feature (70)..(70): n is either a, c, g or t
  misc_feature (79)..(79): n is either a, c, g or t
  misc_feature (86)..(86): n is either a, c, g or t
  misc_feature (106)..(106): n is either a, c, g or t
  misc_feature (434)..(434): n is either a, c, g or t
agtttaaaaagaaagtaaagaaataaatngtaaaattcgaaatcgtattttttatcgtaaaggtatnttnggatggggncgttcgnttttttttttagttagaggnataaagggggcgtggtcgagcgcgcggcgtttacgtgatcgcggagagttgcgcgtaggtttttcgcgcgatttgtcgttatattagtttatggcgtcggtcgttgattggttggtcgttttagtttttcggttcgtttgttggttgtttagttgttaggatagtttgtagagtagtggcgtgcggagcggcggcggattatttttaggtggggacggtgggtgggcggggaaggaagcggaatatatttgagcgggttgggtcggggggcgatggaataaaagaagatggagagattttagcgtttgggattcgggtgggcgaggtnggaaggtgttttcgtagtacggttttttttcgcgtcgcggttggttagcgagtgttttttgggtgttaggcgttgggcggatggtaggatcgcggtagtatacggattcgagttttgcgtcga

SEQ ID NO: 10376 - DNA, 557 bp, Artificial Sequence
  chemically treated genomic DNA (Homo sapiens) CpG-island No: 10376
  misc_feature (124)..(124): n is either a, c, g or t
  misc_feature (452)..(452): n is either a, c, g or t
  misc_feature (472)..(472): n is either a, c, g or t
  misc_feature (479)..(479): n is either a, c, g or t
  misc_feature (488)..(488): n is either a, c, g or t
  misc_feature (491)..(491): n is either a, c, g or t
  misc_feature (529)..(529): n is either a, c, g or t
tcgacgcaaaactcgaatccgtatactaccgcgatcctaccatccgcccaacgcctaacacccaaaaaacactcgctaaccaaccgcgacgcgaaaaaaaaccgtactacgaaaacaccttccnacctcgcccacccgaatcccaaacgctaaaatctctccatcttcttttattccatcgccccccgacccaacccgctcaaatatattccgcttccttccccgcccacccaccgtccccacctaaaaataatccgccgccgctccgcacgccactactctacaaactatcctaacaactaaacaaccaacaaacgaaccgaaaaactaaaacgaccaaccaatcaacgaccgacgccataaactaatataacgacaaatcgcgcgaaaaacctacgcgcaactctccgcgatcacgtaaacgccgcgcgctcgaccacgccccctttatncctctaactaaaaaaaaaancgaacgnccccatccnaanatacctttacgataaaaaatacgatttcgaattttacnatttatttctttactttctttttaaact

SEQ ID NO: 10377 - DNA, 1010 bp, Artificial Sequence
  chemically treated genomic DNA (Homo sapiens) CpG-island No: 10377
gggggcgtcggttaagcgggtgttggagtcggcgtttgggtttgggtttgcgttagtaaatttttatttttttttttttttttttttttcgttttaatttcgtcgtttttttcgtttagaatcggtggttttaagattacggtgttatcggggatttgaagttgttattgtaggcgaggcgtagggtggtcgtcggcgatgtagtgtaatacgaacgttagttttgcgcgtagtggggtgtcgggtgttttaagcggtggttcggtatttagatgtacgttgggcggtgtatagggtagggcgggtaggcggtatatcggtattttttgtagcgcgggaggcgaggtataagtaatggagtcgggttcgggtaaggatattcgggtgttcgcggtttaggtttgtagttatataaggtcgtagtcgtagtggaagggattgtgatagagttgtaagtgtgatagcgcgttaagcgcgtcgaaggtgttaggcgttagcgtacgtagtcggttgttgttgatgcgtagggaacgtaggtcgggtagcgtatcgagtgcgtttcggggtagagagtttaggcggttgtggtttattttgagtagttgtagcgcgtttaggttgcgtaggtcgttttacggaaagttggatatgaagttgtggtttagatcgaggtttttgagttgatttagtacggttagtgcgtttggttttacggtgcgtattttattgtgcgttagttatagcgacgtgatttgtgtgacgtcggcgaaggtttcgcgtcgtagtatagtgattttgttcgcggatagattaagcgtcgttacgttggtaggtagttttttcggtattttacgtaattttttgtaagcgtagttcgcgaattggtgagcgtatttgtttacgtaggcgtacggtttcgggtatgattcggttatttttagaagcgtttagattaattatagggttcgaagggggaatatcgcggtttttgtagatggaagttaggtgaa

SEQ ID NO: 10378 - DNA, 1010 bp, Artificial Sequence
  chemically treated genomic DNA (Homo sapiens) CpG-island No: 10378
ttcacctaacttccatctacaaaaaccgcgatattcccccttcgaaccctataattaatctaaacgcttctaaaaataaccgaatcatacccgaaaccgtacgcctacgtaaacaaatacgctcaccaattcgcgaactacgcttacaaaaaattacgtaaaataccgaaaaaactacctaccaacgtaacgacgcttaatctatccgcgaacaaaatcactatactacgacgcgaaaccttcgccgacgtcacacaaatcacgtcgctataactaacgcacaataaaatacgcaccgtaaaaccaaacgcactaaccgtactaaatcaactcaaaaacctcgatctaaaccacaacttcatatccaactttccgtaaaacgacctacgcaacctaaacgcgctacaactactcaaaataaaccacaaccgcctaaactctctaccccgaaacgcactcgatacgctacccgacctacgttccctacgcatcaacaacaaccgactacgtacgctaacgcctaacaccttcgacgcgcttaacgcgctatcacacttacaactctatcacaatcccttccactacgactacgaccttatataactacaaacctaaaccgcgaacacccgaatatccttacccgaacccgactccattacttatacctcgcctcccgcgctacaaaaaataccgatataccgcctacccgccctaccctatacaccgcccaacgtacatctaaataccgaaccaccgcttaaaacacccgacaccccactacgcgcaaaactaacgttcgtattacactacatcgccgacgaccaccctacgcctcgcctacaataacaacttcaaatccccgataacaccgtaatcttaaaaccaccgattctaaacgaaaaaaacgacgaaattaaaacgaaaaaaaaaaaaaaaaaaaaaaataaaaatttactaacgcaaacccaaacccaaacgccgactccaacacccgcttaaccgacgccccc

SEQ ID NO: 10379 - DNA, 1010 bp, Artificial Sequence
  chemically treated genomic DNA (Homo sapiens) CpG-island No: 10379
tttatttggtttttatttgtaggagtcgcgatgtttttttttcgggttttgtggttggtttgggcgtttttaggagtggtcggattatgttcggagtcgtgcgtttgcgtggataagtacgtttattagttcgcggattgcgtttataaagagttgcgtgaggtgtcggaaggattgtttgttaacgtgacgacgtttagtttgttcgcgaataagattattgtgttgcggcgcggggttttcgtcgacgttatataggttacgtcgttgtggttggcgtataatgaggtgcgtatcgtggagttaggcgtattggtcgtgttgagttagtttaagaatttcgatttgagttataattttatatttagtttttcgtggagcgatttgcgtaatttgagcgcgttgtagttgtttaaaatgaattataatcgtttgggttttttgtttcgggacgtattcggtgcgttattcgatttgcgttttttgcgtattaataataatcggttgcgtacgttggcgtttggtattttcgacgcgtttagcgcgttgttatatttgtaattttattataattttttttattgcggttgcggttttgtgtggttgtaggtttgggtcgcgagtattcgggtgtttttattcgagttcgattttattgtttgtgtttcgtttttcgcgttgtagggggtgtcggtgtatcgtttgttcgttttgttttgtgtatcgtttagcgtgtatttgagtgtcgagttatcgtttgaagtattcggtattttattgcgcgtaggattggcgttcgtgttatattgtatcgtcgacggttattttacgtttcgtttgtaatggtaattttagattttcggtggtatcgtagttttagagttatcggttttgagcggggaggacgacggggttggggcggaggaaggagagggagaaggagatggggatttgttgacgtagatttaagtttaaacgtcgattttagtattcgtttggtcggcgttttt

SEQ ID NO: 10380 - DNA, 1010 bp, Artificial Sequence
  chemically treated genomic DNA (Homo sapiens) CpG-island No: 10380
aaaaacgccgaccaaacgaatactaaaatcgacgtttaaacttaaatctacgtcaacaaatccccatctccttctccctctccttcctccgccccaaccccgtcgtcctccccgctcaaaaccgataactctaaaactacgataccaccgaaaatctaaaattaccattacaaacgaaacgtaaaataaccgtcgacgatacaatataacacgaacgccaatcctacgcgcaataaaataccgaatacttcaaacgataactcgacactcaaatacacgctaaacgatacacaaaacaaaacgaacaaacgatacaccgacaccccctacaacgcgaaaaacgaaacacaaacaataaaatcgaactcgaataaaaacacccgaatactcgcgacccaaacctacaaccacacaaaaccgcaaccgcaataaaaaaaattataataaaattacaaatataacaacgcgctaaacgcgtcgaaaataccaaacgccaacgtacgcaaccgattattattaatacgcaaaaaacgcaaatcgaataacgcaccgaatacgtcccgaaacaaaaaacccaaacgattataattcattttaaacaactacaacgcgctcaaattacgcaaatcgctccacgaaaaactaaatataaaattataactcaaatcgaaattcttaaactaactcaacacgaccaatacgcctaactccacgatacgcacctcattatacgccaaccacaacgacgtaacctatataacgtcgacgaaaaccccgcgccgcaacacaataatcttattcgcgaacaaactaaacgtcgtcacgttaacaaacaatccttccgacacctcacgcaactctttataaacgcaatccgcgaactaataaacgtacttatccacgcaaacgcacgactccgaacataatccgaccactcctaaaaacgcccaaaccaaccacaaaacccgaaaaaaaaacatcgcgactcctacaaataaaaaccaaataaa

SEQ ID NO: 10381 - DNA, 728 bp, Artificial Sequence
  chemically treated genomic DNA (Homo sapiens) CpG-island No: 10381
agggtacgggtttcggggggttatttcgttttaggttcgcgtttgtgttgcgtttcgcggagagggttgatttcgaggattgaaattttttttattttaatttcgacgtttttttttaaaatggaaaaaagaatttcgtttcgagtcgtcgcgtcgcgttttttttttttttttttttttcgtttattcgttttttcgttcgtttttttatattatacggttatattttataggatatagattttttttttatagggtacgtttgttagggattatacgtcgggtaaatacgattttcgtcgaagtaggggcggggggggcggggcgacgcgaggatcgagacgcgaggacggaggggttcggttttattcggatttcgtcgtatagtcgtatagttacgagtaggttttgtgcgaattagggcgcgagttttttagagagtcgcggttcgggaggttatagttagtttttttcgttttcggcgttttttagttagggtttgggtcgggtggagtcgcgggagcggcgttgttgggcgtatagattttcggaaagtttaatatacggataacgaaattggttcgcgattaagtttataggtttagtcgttaaggggcgcgcggttttgcggcgttttaagttaggagagagacgatagaaaacgtattttttttttatttttcgatatatatattcgatttttttagaggttgggaagggggtgttag

SEQ ID NO: 10382 - DNA, 728 bp, Artificial Sequence
  chemically treated genomic DNA (Homo sapiens) CpG-island No: 10382
ctaacacccccttcccaacctctaaaaaaatcgaatatatatatcgaaaaataaaaaaaaaatacgttttctatcgtctctctcctaacttaaaacgccgcaaaaccgcgcgccccttaacgactaaacctataaacttaatcgcgaaccaatttcgttatccgtatattaaactttccgaaaatctatacgcccaacaacgccgctcccgcgactccacccgacccaaaccctaactaaaaaacgccgaaaacgaaaaaaactaactataacctcccgaaccgcgactctctaaaaaactcgcgccctaattcgcacaaaacctactcgtaactatacgactatacgacgaaatccgaataaaaccgaacccctccgtcctcgcgtctcgatcctcgcgtcgccccgccccccccgcccctacttcgacgaaaatcgtatttacccgacgtataatccctaacaaacgtaccctataaaaaaaaaatctatatcctataaaatataaccgtataatataaaaaaacgaacgaaaaaacgaataaacgaaaaaaaaaaaaaaaaaaaaaacgcgacgcgacgactcgaaacgaaattcttttttccattttaaaaaaaaacgtcgaaattaaaataaaaaaaatttcaatcctcgaaatcaaccctctccgcgaaacgcaacacaaacgcgaacctaaaacgaaataaccccccgaaacccgtaccct

SEQ ID NO: 10383 - DNA, 728 bp, Artificial Sequence
  chemically treated genomic DNA (Homo sapiens) CpG-island No: 10383
ttaatattttttttttagtttttgggaaaatcgagtgtgtgtgtcggggggtagggagggaatgcgttttttgtcgttttttttttaatttaaagcgtcgtaggatcgcgcgttttttggcggttgagtttgtggatttggtcgcgggttaatttcgttgttcgtgtgttgggtttttcggaggtttgtgcgtttaatagcgtcgttttcgcggttttattcgatttagattttagttggaaagcgtcggaggcggaggaagttgattgtggtttttcgggtcgcggttttttggagggttcgcgttttagttcgtataaagtttgttcgtgattgtgcgattgtgcgacgggattcggatggagtcgagttttttcgttttcgcgtttcggttttcgcgtcgtttcgtttttttcgtttttgtttcggcgggaatcgtgtttgttcggcgtgtagtttttgataagcgtgttttgtaggagaaaagtttgtgttttgtgaagtgtgatcgtgtagtgtaggggggcgggcgggggggcggatgggcggggagggagggaaggggaggggcgcggcgcggcgattcggggcggggtttttttttttattttgaaagaaagcgtcggggttggggtggggggagttttagttttcgggattagtttttttcgcgaagcgtagtataagcgcgggtttgggacggagtagtttttcggagttcgtgtttt

SEQ ID NO: 10384 - DNA, 728 bp, Artificial Sequence
  chemically treated genomic DNA (Homo sapiens) CpG-island No: 10384
aaaacacgaactccgaaaaactactccgtcccaaacccgcgcttatactacgcttcgcgaaaaaaactaatcccgaaaactaaaactccccccaccccaaccccgacgctttctttcaaaataaaaaaaaaaaccccgccccgaatcgccgcgccgcgcccctccccttccctccctccccgcccatccgcccccccgcccgcccccctacactacacgatcacacttcacaaaacacaaacttttctcctacaaaacacgcttatcaaaaactacacgccgaacaaacacgattcccgccgaaacaaaaacgaaaaaaacgaaacgacgcgaaaaccgaaacgcgaaaacgaaaaaactcgactccatccgaatcccgtcgcacaatcgcacaatcacgaacaaactttatacgaactaaaacgcgaaccctccaaaaaaccgcgacccgaaaaaccacaatcaacttcctccgcctccgacgctttccaactaaaatctaaatcgaataaaaccgcgaaaacgacgctattaaacgcacaaacctccgaaaaacccaacacacgaacaacgaaattaacccgcgaccaaatccacaaactcaaccgccaaaaaacgcgcgatcctacgacgctttaaattaaaaaaaaaacgacaaaaaacgcattccctccctaccccccgacacacacactcgattttcccaaaaactaaaaaaaaaatattaa

SEQ ID NO: 10385 - DNA, 621 bp, Artificial Sequence
  chemically treated genomic DNA (Homo sapiens) CpG-island No: 10385
gtggtagcgtggacgagttataagatagcggcgggagtggaaatttttttttttttggagtggggtagggtttggttttttcgaatcgtttagcgggtcgggcgttttcgttagggtttttcgggtcggagcgtttcgtataaaggaggttcgggggttcggtttttgtattttcggggttcggtttcgggtaggggttttcggttttcggcgtcgcgtcgggcgggaggttcgggtagtacgtgcgtttcgtttttagtagggagggaggaattagcgcggttcggtcgggttgttcgcgggtttcgttgtttcgggagcgagttgcggttagttcggtcggttcggggagtaatgaatggggtcgtattgcgtcgtcgtcgttcgggttagggtcgggcggtcgggagtttcggcgttgggagtcgtttttcgttttttcgtttttattagatcgcgttcggcgttttcggggatcgaggtcgggtttcggacgtttagttgttgttcgtttattttagtttttggcggtggcgtttttagaaatttcgcggattttttttttatagtgagtcgtattagcggtcgtaaatttattagagtaatatagttttataatgt

SEQ ID NO: 10386 - DNA, 621 bp, Artificial Sequence
  chemically treated genomic DNA (Homo sapiens) CpG-island No: 10386
acattataaaactatattactctaataaatttacgaccgctaatacgactcactataaaaaaaaaatccgcgaaatttctaaaaacgccaccgccaaaaactaaaataaacgaacaacaactaaacgtccgaaacccgacctcgatccccgaaaacgccgaacgcgatctaataaaaacgaaaaaacgaaaaacgactcccaacgccgaaactcccgaccgcccgaccctaacccgaacgacgacgacgcaatacgaccccattcattactccccgaaccgaccgaactaaccgcaactcgctcccgaaacaacgaaacccgcgaacaacccgaccgaaccgcgctaattcctccctccctactaaaaacgaaacgcacgtactacccgaacctcccgcccgacgcgacgccgaaaaccgaaaacccctacccgaaaccgaaccccgaaaatacaaaaaccgaacccccgaacctcctttatacgaaacgctccgacccgaaaaaccctaacgaaaacgcccgacccgctaaacgattcgaaaaaaccaaaccctaccccactccaaaaaaaaaaaaatttccactcccgccgctatcttataactcgtccacgctaccac

SEQ ID NO: 10387 - DNA, 621 bp, Artificial Sequence
  chemically treated genomic DNA (Homo sapiens) CpG-island No: 10387
atattgtaggattatattgttttaataaatttgcggtcgttaatacgatttattatagggagaggattcgcggaatttttgggggcgttatcgttaagagttggggtgagcgggtagtagttgggcgttcggggttcggtttcggttttcgggggcgtcgggcgcggtttggtgggaacggaaaggcgggaggcggtttttagcgtcggggttttcgatcgttcgattttaattcgggcggcggcggcgtagtgcggttttatttattgtttttcgggtcggtcggattggtcgtagttcgttttcgaagtagcggggttcgcgggtagttcggtcgggtcgcgttggtttttttttttttgttgggagcggggcgtacgtgttgttcgggtttttcgttcggcgcggcgtcggaagtcggggatttttgttcgaagtcgggtttcgagagtgtaggagtcgagttttcgggttttttttgtacggagcgtttcggttcgagaggttttggcggaggcgttcggttcgttgagcggttcggagaagttagattttgttttattttaggggagaggaaatttttattttcgtcgttattttgtgattcgtttacgttgttat

SEQ ID NO: 10388 - DNA, 621 bp, Artificial Sequence
  chemically treated genomic DNA (Homo sapiens) CpG-island No: 10388
ataacaacgtaaacgaatcacaaaataacgacgaaaataaaaatttcctctcccctaaaataaaacaaaatctaacttctccgaaccgctcaacgaaccgaacgcctccgccaaaacctctcgaaccgaaacgctccgtacaaaaaaaacccgaaaactcgactcctacactctcgaaacccgacttcgaacaaaaatccccgacttccgacgccgcgccgaacgaaaaacccgaacaacacgtacgccccgctcccaacaaaaaaaaaaaaaccaacgcgacccgaccgaactacccgcgaaccccgctacttcgaaaacgaactacgaccaatccgaccgacccgaaaaacaataaataaaaccgcactacgccgccgccgcccgaattaaaatcgaacgatcgaaaaccccgacgctaaaaaccgcctcccgcctttccgttcccaccaaaccgcgcccgacgcccccgaaaaccgaaaccgaaccccgaacgcccaactactacccgctcaccccaactcttaacgataacgcccccaaaaattccgcgaatcctctccctataataaatcgtattaacgaccgcaaatttattaaaacaatataatcctacaatat

SEQ ID NO: 10389 - DNA, 790 bp, Artificial Sequence
  chemically treated genomic DNA (Homo sapiens) CpG-island No: 10389
ggatagcgggttgagagtcgatttcgtttttgggtttttttcggtttttttggcgtttgttttttgttcgtttcgtcgggcggttttgtgcgggcggagagagtagtaaggcggtttttcgtattgtttggattttaagggcgggggtcgggcgcggggttagttcggttagggttaggagattcgggaaggggtcgttagcgagtggttttcgcggagttgtttttatttcgtttgtttggagtcgggagttcggcgtgtattgacgtttggggtacgttgggggcgattttcgtggtcgggcggttgatttcggcgattcggcgtagtgtttagaagtgcgttggggggtaatgaagggtagcgttcgttgaggttgaaaggagcgagggtcggcgttgtgtaggttagattttttgttgacgtttgggagtcgttttttgaagaatgagaacggggtcgttattgtaagtaggatgggttttatcgtgggtttcgaaggattaggggtgggcgcgtcggttgttagggttttttttacgttacgtcgcgtgtaggcgaggggaagcgcgtgtcgtgacgatttgcgatgagattagtttgagtaattatagtcgtcggggttgagaaatgtagttagttacgtagcgtagcgtagtttagcgttggttttggtcgggtggtcgtagtcgtttcgcgtttcgtagagggaggtgggggtggattagttttttttaggtggtcgtcggtgggggcgttagaattattttaagagggtggggagttagag

SEQ ID NO: 10390 - DNA, 790 bp, Artificial Sequence
  chemically treated genomic DNA (Homo sapiens) CpG-island No: 10390
ctctaactccccaccctcttaaaataattctaacgcccccaccgacgaccacctaaaaaaaactaatccacccccacctccctctacgaaacgcgaaacgactacgaccacccgaccaaaaccaacgctaaactacgctacgctacgtaactaactacatttctcaaccccgacgactataattactcaaactaatctcatcgcaaatcgtcacgacacgcgcttcccctcgcctacacgcgacgtaacgtaaaaaaaaccctaacaaccgacgcgcccacccctaatccttcgaaacccacgataaaacccatcctacttacaataacgaccccgttctcattcttcaaaaaacgactcccaaacgtcaacaaaaaatctaacctacacaacgccgaccctcgctcctttcaacctcaacgaacgctacccttcattaccccccaacgcacttctaaacactacgccgaatcgccgaaatcaaccgcccgaccacgaaaatcgcccccaacgtaccccaaacgtcaatacacgccgaactcccgactccaaacaaacgaaataaaaacaactccgcgaaaaccactcgctaacgaccccttcccgaatctcctaaccctaaccgaactaaccccgcgcccgacccccgcccttaaaatccaaacaatacgaaaaaccgccttactactctctccgcccgcacaaaaccgcccgacgaaacgaacaaaaaacaaacgccaaaaaaaccgaaaaaaacccaaaaacgaaatcgactctcaacccgctatcc

SEQ ID NO: 10391 - DNA, 790 bp, Artificial Sequence
  chemically treated genomic DNA (Homo sapiens) CpG-island No: 10391
ttttggttttttatttttttagaatagttttgacgtttttatcggcgattatttggaaggggttgatttatttttatttttttttgcgaagcgcggagcggttgcggttattcggttagagttagcgttgagttgcgttgcgttgcgtgattggttgtattttttagtttcgacggttgtggttatttaaattgattttatcgtaggtcgttacgatacgcgttttttttcgtttgtacgcggcgtggcgtgagaggggttttggtagtcggcgcgtttatttttgatttttcgaggtttacgatgaagtttattttatttgtaataacggtttcgtttttattttttaaaagacggtttttagacgttaataaagaatttaatttatatagcgtcggttttcgttttttttagttttagcgagcgttgttttttattattttttagcgtatttttggatattgcgtcgggtcgtcggggttagtcgttcggttacgaaagtcgtttttagcgtgttttaagcgttagtgtacgtcgggttttcggttttaggtaggcggggtggaggtagtttcgcgaaggttattcgttggcgattttttttcgggttttttagttttggtcgggttggtttcgcgttcggttttcgtttttgaaatttaggtagtgcgggaggtcgttttgttgtttttttcgttcgtatagggtcgttcgacggagcgggtagggagtaggcgttaaggaggtcgagaggggtttaggggcgaggtcgatttttagttcgttgttt

SEQ ID NO: 10392 - DNA, 790 bp, Artificial Sequence
  chemically treated genomic DNA (Homo sapiens) CpG-island No: 10392
aaacaacgaactaaaaatcgacctcgcccctaaacccctctcgacctccttaacgcctactccctacccgctccgtcgaacgaccctatacgaacgaaaaaaacaacaaaacgacctcccgcactacctaaatttcaaaaacgaaaaccgaacgcgaaaccaacccgaccaaaactaaaaaacccgaaaaaaaatcgccaacgaataaccttcgcgaaactacctccaccccgcctacctaaaaccgaaaacccgacgtacactaacgcttaaaacacgctaaaaacgactttcgtaaccgaacgactaaccccgacgacccgacgcaatatccaaaaatacgctaaaaaataataaaaaacaacgctcgctaaaactaaaaaaaacgaaaaccgacgctatataaattaaattctttattaacgtctaaaaaccgtcttttaaaaaataaaaacgaaaccgttattacaaataaaataaacttcatcgtaaacctcgaaaaatcaaaaataaacgcgccgactaccaaaacccctctcacgccacgccgcgtacaaacgaaaaaaaacgcgtatcgtaacgacctacgataaaatcaatttaaataaccacaaccgtcgaaactaaaaaatacaaccaatcacgcaacgcaacgcaactcaacgctaactctaaccgaataaccgcaaccgctccgcgcttcgcaaaaaaaaataaaaataaatcaaccccttccaaataatcgccgataaaaacgtcaaaactattctaaaaaaataaaaaaccaaaa

SEQ ID NO: 10393 - DNA, 825 bp, Artificial Sequence
  chemically treated genomic DNA (Homo sapiens) CpG-island No: 10393
ttcgtgacgttggggttttgcggtattttcggttaaaagtatttttcgaaaaaatcgtcgttttaaagtttgttcgttcgtcgtcgcgcgatatttcggcgtcgagttcgggttcgagtgacgttttttgttggtcgcggcggtttgtttagtttttggtttcgggtcgcgttaatttcgcgtagtgtagttgaggcgtcgttcggttttgtaatttcgggtgttttcgggcgttttcgttttcgttttttttttagtaggcgtttgggcgttttttaatttttgtttagtttttttcggattaacgattcgtttcggtttttttgtattttagagattattcgcggcgttttttttttttaatttttttttatttttttagtttatttttcgaggagcgtttaacgggttttgggggttcgtagaattgagtcgcgaagcgcgggggaaaggcggcgagcgtttttcgcggcggcggggaggaagacgaagatttgtgcgtttttaaagttaatgtgaaaatattttttaaatttttgggttgtagttcgaaacgcggggtagtcggaaggttttcgtagttgtcgtgtttttttttttcggggtttgggaagggtttttaggcgttttagagtattcggggtcggttcgcgggggaggtcgtatagacgcgtttttattttgacgaacggggaaggggtaggcgtttgcgattttaattaaatttttcggcgtttcggtttgatgtatatatttgttataggttttaagtgtttaagaagtgtaaattaattttatttttatgttgacgggattcgagtgaat

SEQ ID NO: 10394 - DNA, 825 bp, Artificial Sequence
  chemically treated genomic DNA (Homo sapiens) CpG-island No: 10394
attcactcgaatcccgtcaacataaaaataaaattaatttacacttcttaaacacttaaaacctataacaaatatatacatcaaaccgaaacgccgaaaaatttaattaaaatcgcaaacgcctaccccttccccgttcgtcaaaataaaaacgcgtctatacgacctcccccgcgaaccgaccccgaatactctaaaacgcctaaaaacccttcccaaaccccgaaaaaaaaaaacacgacaactacgaaaaccttccgactaccccgcgtttcgaactacaacccaaaaatttaaaaaatattttcacattaactttaaaaacgcacaaatcttcgtcttcctccccgccgccgcgaaaaacgctcgccgcctttcccccgcgcttcgcgactcaattctacgaacccccaaaacccgttaaacgctcctcgaaaaataaactaaaaaaataaaaaaaaattaaaaaaaaaaaacgccgcgaataatctctaaaatacaaaaaaaccgaaacgaatcgttaatccgaaaaaaactaaacaaaaattaaaaaacgcccaaacgcctactaaaaaaaaaacgaaaacgaaaacgcccgaaaacacccgaaattacaaaaccgaacgacgcctcaactacactacgcgaaattaacgcgacccgaaaccaaaaactaaacaaaccgccgcgaccaacaaaaaacgtcactcgaacccgaactcgacgccgaaatatcgcgcgacgacgaacgaacaaactttaaaacgacgattttttcgaaaaatacttttaaccgaaaataccgcaaaaccccaacgtcacgaa

SEQ ID NO: 10395 - DNA, 825 bp, Artificial Sequence
  chemically treated genomic DNA (Homo sapiens) CpG-island No: 10395
atttattcgggtttcgttagtatgaagatggaattggtttatattttttaggtatttagagtttgtggtaggtgtatatattagatcgaggcgtcgaaggatttagttggggtcgtaggcgtttgtttttttttcgttcgttagggtgggggcgcgtttatgcggtttttttcgcgggtcgatttcgggtgttttgaggcgtttaggagttttttttagatttcggggggggagggtacggtagttacgggagtttttcggttatttcgcgtttcgggttgtagtttagaagtttggaagatgtttttatattaattttgagagcgtataagttttcgttttttttttcgtcgtcgcgggaagcgttcgtcgtttttttttcgcgtttcgcggtttagttttgcgagtttttaagattcgttggacgtttttcgggaggtgagttgagggggtaaagaagaattagagagagaaggcgtcgcgagtagtttttgggatgtagggaggtcggggcgggtcgttggttcgaaggaggttggataggagttggggggcgtttaggcgtttgttgaggggaaggcgggggcggggacgttcgggaatattcggaattgtagagtcgggcggcgttttagttgtattgcgcggagttggcgcggttcgggattaggagttgagtaaatcgtcgcggttaataggaggcgttattcggattcgggttcggcgtcggggtgtcgcgcggcggcgggcgggtaggttttggagcggcggttttttcggaaagtgtttttggtcgggagtgtcgtagaattttagcgttacgag

SEQ ID NO: 10396 - DNA, 825 bp, Artificial Sequence
  chemically treated genomic DNA (Homo sapiens) CpG-island No: 10396
ctcgtaacgctaaaattctacgacactcccgaccaaaaacactttccgaaaaaaccgccgctccaaaacctacccgcccgccgccgcgcgacaccccgacgccgaacccgaatccgaataacgcctcctattaaccgcgacgatttactcaactcctaatcccgaaccgcgccaactccgcgcaatacaactaaaacgccgcccgactctacaattccgaatattcccgaacgtccccgcccccgccttcccctcaacaaacgcctaaacgccccccaactcctatccaacctccttcgaaccaacgacccgccccgacctccctacatcccaaaaactactcgcgacgccttctctctctaattcttctttaccccctcaactcacctcccgaaaaacgtccaacgaatcttaaaaactcgcaaaactaaaccgcgaaacgcgaaaaaaaaacgacgaacgcttcccgcgacgacgaaaaaaaaaacgaaaacttatacgctctcaaaattaatataaaaacatcttccaaacttctaaactacaacccgaaacgcgaaataaccgaaaaactcccgtaactaccgtaccctccccccccgaaatctaaaaaaaactcctaaacgcctcaaaacacccgaaatcgacccgcgaaaaaaaccgcataaacgcgcccccaccctaacgaacgaaaaaaaaacaaacgcctacgaccccaactaaatccttcgacgcctcgatctaatatatacacctaccacaaactctaaatacctaaaaaatataaaccaattccatcttcatactaacgaaacccgaataaat

SEQ ID NO: 10397 - DNA, 558 bp, Artificial Sequence
  chemically treated genomic DNA (Homo sapiens) CpG-island No: 10397
tttttcgattttttttttttttttttatagtatttcgcgtaagattagtttagtttttcgagttttattattagtttttttattttcgttcggcgcgtgagattttgggcggtgtaggggagcgttgacgatagacgtgggtcgtgacgtcgtcgcgttttgacgtttagtcgattggcggcgcggtcgttcgggagatcgggaaagtcgttttatattcgttttagtcgaagtcgaggtgagggacgatggttttttttagtttgggatgattcggttttttaaatgtagtttcggagtggaggcgtgttcgtattcggggagagagttagaaagttgagtcgcggcgttttagcgagagtacgaggtttcgggtttggatttcgttattacgtttttttgcggtttttttttggtgtttgttagttcgcggggtttaggcgcggttcgttttttttttagtttcggggaacgcgcggttttgtttttttattttcgtattttttttttttttttttttcggttattgtaggtttagggggaacggggttagaaagg

SEQ ID NO: 10398 - DNA, 558 bp, Artificial Sequence
  chemically treated genomic DNA (Homo sapiens) CpG-island No: 10398
cctttctaaccccgttccccctaaacctacaataaccgaaaaaaaaaaaaaaaaaaaatacgaaaataaaaaaacaaaaccgcgcgttccccgaaactaaaaaaaaaacgaaccgcgcctaaaccccgcgaactaacaaacaccaaaaaaaaaccgcaaaaaaacgtaataacgaaatccaaacccgaaacctcgtactctcgctaaaacgccgcgactcaactttctaactctctccccgaatacgaacacgcctccactccgaaactacatttaaaaaaccgaatcatcccaaactaaaaaaaaccatcgtccctcacctcgacttcgactaaaacgaatataaaacgactttcccgatctcccgaacgaccgcgccgccaatcgactaaacgtcaaaacgcgacgacgtcacgacccacgtctatcgtcaacgctcccctacaccgcccaaaatctcacgcgccgaacgaaaataaaaaaactaataataaaactcgaaaaactaaactaatcttacgcgaaatactataaaaaaaaaaaaaaaaaatcgaaaaa

SEQ ID NO: 10399 - DNA, 558 bp, Artificial Sequence
  chemically treated genomic DNA (Homo sapiens) CpG-island No: 10399
tttttttaatttcgttttttttggatttgtagtggtcggaagaggaggaggaggagggtgcgggggtgaggaagtagagtcgcgcgtttttcggggttgggaggaaggcggatcgcgtttgggtttcgcgggttggtagatattaggaaggggtcgtagaggagcgtggtggcggagtttagattcggggtttcgtgttttcgttggggcgtcgcggtttagttttttggtttttttttcgggtgcgagtacgtttttatttcggaattgtatttggaggatcgggttattttaggttgaggaaagttatcgttttttatttcgatttcgattaggacgggtgtgaaacggttttttcggtttttcgggcgatcgcgtcgttagtcggttggacgttagggcgcggcgacgttacggtttacgtttgtcgttaacgtttttttgtatcgtttagggttttacgcgtcgggcggaagtgggaaaattggtggtggggttcggaaggttgggttagttttacgcggaatgttgtgagagggagggaaggggatcgaggga

SEQ ID NO: 10400 - DNA, 558 bp, Artificial Sequence
  chemically treated genomic DNA (Homo sapiens) CpG-island No: 10400
tccctcgatccccttccctccctctcacaacattccgcgtaaaactaacccaaccttccgaaccccaccaccaattttcccacttccgcccgacgcgtaaaaccctaaacgatacaaaaaaacgttaacgacaaacgtaaaccgtaacgtcgccgcgccctaacgtccaaccgactaacgacgcgatcgcccgaaaaaccgaaaaaaccgtttcacacccgtcctaatcgaaatcgaaataaaaaacgataactttcctcaacctaaaataacccgatcctccaaatacaattccgaaataaaaacgtactcgcacccgaaaaaaaaaccaaaaaactaaaccgcgacgccccaacgaaaacacgaaaccccgaatctaaactccgccaccacgctcctctacgaccccttcctaatatctaccaacccgcgaaacccaaacgcgatccgccttcctcccaaccccgaaaaacgcgcgactctacttcctcacccccgcaccctcctcctcctcctcttccgaccactacaaatccaaaaaaaacgaaattaaaaaaa

SEQ ID NO: 10401 - DNA, 573 bp, Artificial Sequence
  chemically treated genomic DNA (Homo sapiens) CpG-island No: 10401
gggcgtcgtgcgtattgtattttttttggcggattattcgttgggtcggtaggcgcgcgtatttaggtgttattttttagcgtcgtgcgcggataggtaggcgcgtgtttcggcgcgtcgtttcgtatttatttacgcgcggtttttttgtatttcggttagtattcgtagcgcgttgggcgagtcggatcggaagttgaagaagtgaagcgtcgcgcgcgtcgtttgttgtaggagtttgcgcgggattttagtattttgaggttgtttagggtcgtcggggttttcggatttcgcgggcgtcgttatcggggcgagtaatagtagtagcgcgagtagcggggcggtggggcgcgggtttttgggttcggattagggagtaggtagtcgttgtcggcggggttgtatggacgtaggaaagttggttcggtattcgatagatacgggttcggagcgggtagtgtcggcgttcgcggaaataaggtcgtggtgggtttttttttttcgtttttagggcgaaggtttgtagcgagttcgggtttttatggggttattttttttttacgtttttcg

SEQ ID NO: 10402 - DNA, 573 bp, Artificial Sequence
  chemically treated genomic DNA (Homo sapiens) CpG-island No: 10402
cgaaaaacgtaaaaaaaaaataaccccataaaaacccgaactcgctacaaaccttcgccctaaaaacgaaaaaaaaaaacccaccacgaccttatttccgcgaacgccgacactacccgctccgaacccgtatctatcgaataccgaaccaactttcctacgtccatacaaccccgccgacaacgactacctactccctaatccgaacccaaaaacccgcgccccaccgccccgctactcgcgctactactattactcgccccgataacgacgcccgcgaaatccgaaaaccccgacgaccctaaacaacctcaaaatactaaaatcccgcgcaaactcctacaacaaacgacgcgcgcgacgcttcacttcttcaacttccgatccgactcgcccaacgcgctacgaatactaaccgaaatacaaaaaaaccgcgcgtaaataaatacgaaacgacgcgccgaaacacgcgcctacctatccgcgcacgacgctaaaaaataacacctaaatacgcgcgcctaccgacccaacgaataatccgccaaaaaaaatacaatacgcacgacgccc

SEQ ID NO: 10403 - DNA, 573 bp, Artificial Sequence
  chemically treated genomic DNA (Homo sapiens) CpG-island No: 10403
cgggaaacgtggaaaaggagtggttttatggggattcgggttcgttatagattttcgttttgggggcggaggggaggggtttattacggttttattttcgcgagcgtcggtattgttcgtttcgagttcgtgtttgtcgggtgtcgagttaatttttttgcgtttatgtagtttcgtcggtaacggttgtttgttttttggttcgggtttaggggttcgcgttttatcgtttcgttgttcgcgttgttgttgttgttcgtttcggtggcggcgttcgcggggttcggggatttcgacgattttgggtagttttaggatgttggggtttcgcgtaggtttttgtagtaggcggcgcgcgcggcgttttatttttttaattttcggttcggttcgtttagcgcgttacgagtgttggtcgaggtgtaggagggtcgcgcgtgggtgagtgcggagcgacgcgtcggggtacgcgtttgtttgttcgcgtacggcgttgggaggtgatatttgggtacgcgcgtttgtcggtttaacggatggttcgttagggaaggtgtagtgcgtacgacgttt

SEQ ID NO: 10404 - DNA, 573 bp, Artificial Sequence
  chemically treated genomic DNA (Homo sapiens) CpG-island No: 10404
aaacgtcgtacgcactacaccttccctaacgaaccatccgttaaaccgacaaacgcgcgtacccaaatatcacctcccaacgccgtacgcgaacaaacaaacgcgtaccccgacgcgtcgctccgcactcacccacgcgcgaccctcctacacctcgaccaacactcgtaacgcgctaaacgaaccgaaccgaaaattaaaaaaataaaacgccgcgcgcgccgcctactacaaaaacctacgcgaaaccccaacatcctaaaactacccaaaatcgtcgaaatccccgaaccccgcgaacgccgccaccgaaacgaacaacaacaacaacgcgaacaacgaaacgataaaacgcgaacccctaaacccgaaccaaaaaacaaacaaccgttaccgacgaaactacataaacgcaaaaaaattaactcgacacccgacaaacacgaactcgaaacgaacaataccgacgctcgcgaaaataaaaccgtaataaacccctcccctccgcccccaaaacgaaaatctataacgaacccgaatccccataaaaccactccttttccacgtttcccg

SEQ ID NO: 10405 - DNA, 575 bp, Artificial Sequence
  chemically treated genomic DNA (Homo sapiens) CpG-island No: 10405
gttaagtgggacgttttttttttttttttcgggcgtcgttggatggggcgtttcgtttgaagcggcgggtcggatgcggggcgcgtcgttgtggggacggagttttttttcgttaaatttcgttcgcggcgcggcgacgcgaagtcgtcggcggggttttgcgcggggcggtagggtcggatttgtttcgtggcgttcgcggttcgattagcggggtttattcgcgttttttcgacggattatgcgtaagtcgattcgtttgttattggtttatcgatcgcgttttaatagttggttagggggtcgggggcggcgcgtcgtttcgtgtacgttggtattgtcgggtcgcggtacgatcgtttcgcgtttcgttgagtaattttgatatcggtcgtgtagacgtgggcgcgggtttcgcgttttttcggagattgtataacgatataatataacggacgttcgtttattatcgcggttttcgtcgtttcgcgtcggcgtcggtcgtcgtcgttgcgagtttcgaggatttattaatagtattgatgtttgatttaaaggtaggaggaatttaaagt

SEQ ID NO: 10406 - DNA, 575 bp, Artificial Sequence
  chemically treated genomic DNA (Homo sapiens) CpG-island No: 10406
actttaaattcctcctacctttaaatcaaacatcaatactattaataaatcctcgaaactcgcaacgacgacgaccgacgccgacgcgaaacgacgaaaaccgcgataataaacgaacgtccgttatattatatcgttatacaatctccgaaaaaacgcgaaacccgcgcccacgtctacacgaccgatatcaaaattactcaacgaaacgcgaaacgatcgtaccgcgacccgacaataccaacgtacacgaaacgacgcgccgcccccgaccccctaaccaactattaaaacgcgatcgataaaccaataacaaacgaatcgacttacgcataatccgtcgaaaaaacgcgaataaaccccgctaatcgaaccgcgaacgccacgaaacaaatccgaccctaccgccccgcgcaaaaccccgccgacgacttcgcgtcgccgcgccgcgaacgaaatttaacgaaaaaaaactccgtccccacaacgacgcgccccgcatccgacccgccgcttcaaacgaaacgccccatccaacgacgcccgaaaaaaaaaaaaaaaacgtcccacttaac

SEQ ID NO: 10407 - DNA, 575 bp, Artificial Sequence
  chemically treated genomic DNA (Homo sapiens) CpG-island No: 10407
attttgggttttttttatttttaagttaaatattagtgttgttggtgagttttcggggttcgtagcgacggcgatcggcgtcgacgcggggcggcgggggtcgcggtgataggcgggcgttcgttgtgttgtgtcgttgtatagttttcggaggggcgcggggttcgcgtttacgtttgtacggtcggtgttagagttgtttaacggggcgcggggcggtcgtgtcgcggttcgataatgttagcgtgtacggggcggcgcgtcgttttcgattttttggttagttgttggggcgcggtcggtgagttagtggtaggcgggtcggtttacgtatagttcgtcgggagggcgcggatgggtttcgttggtcgggtcgcgggcgttacggggtaggttcggttttgtcgtttcgcgtagggtttcgtcggcggtttcgcgtcgtcgcgtcgcgggcggggtttggcgggggggggtttcgtttttatagcgacgcgtttcgtattcgattcgtcgttttagacgaggcgttttatttagcggcgttcggggggaaaaaaaaaagcgttttatttagt

SEQ ID NO: 10408 - DNA, 575 bp, Artificial Sequence
  chemically treated genomic DNA (Homo sapiens) CpG-island No: 10408
actaaataaaacgcttttttttttccccccgaacgccgctaaataaaacgcctcgtctaaaacgacgaatcgaatacgaaacgcgtcgctataaaaacgaaacccccccccgccaaaccccgcccgcgacgcgacgacgcgaaaccgccgacgaaaccctacgcgaaacgacaaaaccgaacctaccccgtaacgcccgcgacccgaccaacgaaacccatccgcgccctcccgacgaactatacgtaaaccgacccgcctaccactaactcaccgaccgcgccccaacaactaaccaaaaaatcgaaaacgacgcgccgccccgtacacgctaacattatcgaaccgcgacacgaccgccccgcgccccgttaaacaactctaacaccgaccgtacaaacgtaaacgcgaaccccgcgcccctccgaaaactatacaacgacacaacacaacgaacgcccgcctatcaccgcgacccccgccgccccgcgtcgacgccgatcgccgtcgctacgaaccccgaaaactcaccaacaacactaatatttaacttaaaaataaaaaaaacccaaaat

SEQ ID NO: 10409 - DNA, 560 bp, Artificial Sequence
  chemically treated genomic DNA (Homo sapiens) CpG-island No: 10409
atgtcgtcgtagtttacggtggttatggagatgacggtttattaatagttggcgggtacgttggagaagtcgcggcgcgcgtttagttcgcgttcggttaggtgtattagtggcgcgaagagcgttatggttacgtagaggaatagtagtagtagttcgaattcgcgcgcgtagcggcgtatggttaggtttagcgaacgtagttttagcgagtggcgcgttaggcgtattacgtagagtacgcgtagcgtacgtagtagtcgtagtattagtttcgcgcgttttaggagtttggtttcgttcgggtttgtcgttagttttagtagtagcgatacgtagaacggtaggagcgttaggatgttaatgatgttgagtggcgcgcgtaggaaggcgtatttgttttcggtttgtagggagcgtagtaggaattcgaaggagaattaggttacgtatacggtttttagtacgaataggttgcggtatttgggggagtattcgttttgcggggagaggggatacggggttgggggcgtaggttttttggagggtcgggggcgttt

SEQ ID NO: 10410 - DNA, 560 bp, Artificial Sequence
  chemically treated genomic DNA (Homo sapiens) CpG-island No: 10410
aaacgcccccgaccctccaaaaaacctacgcccccaaccccgtatcccctctccccgcaaaacgaatactcccccaaataccgcaacctattcgtactaaaaaccgtatacgtaacctaattctccttcgaattcctactacgctccctacaaaccgaaaacaaatacgccttcctacgcgcgccactcaacatcattaacatcctaacgctcctaccgttctacgtatcgctactactaaaactaacgacaaacccgaacgaaaccaaactcctaaaacgcgcgaaactaatactacgactactacgtacgctacgcgtactctacgtaatacgcctaacgcgccactcgctaaaactacgttcgctaaacctaaccatacgccgctacgcgcgcgaattcgaactactactactattcctctacgtaaccataacgctcttcgcgccactaatacacctaaccgaacgcgaactaaacgcgcgccgcgacttctccaacgtacccgccaactattaataaaccgtcatctccataaccaccgtaaactacgacgacat

SEQ ID NO: 10411 - DNA, 560 bp, Artificial Sequence
  chemically treated genomic DNA (Homo sapiens) CpG-island No: 10411
aggcgttttcggttttttaagaggtttgcgtttttaatttcgtgtttttttttttcgtagggcgagtgtttttttaagtgtcgtagtttgttcgtgttggagatcgtgtgcgtggtttggttttttttcgagtttttgttgcgttttttgtaggtcgagagtaagtgcgtttttttgcgcgcgttatttaatattattgatattttggcgtttttgtcgttttacgtgtcgttgttgttggggttggcggtaggttcgggcgggattaagtttttggagcgcgcggggttggtgttgcggttgttgcgtgcgttgcgcgtgttttacgtgatgcgtttggcgcgttattcgttggggttgcgttcgttgggtttgattatgcgtcgttgcgcgcgcgagttcgggttgttgttgttgtttttttgcgtggttatggcgtttttcgcgttattggtgtatttggtcgagcgcgagttgggcgcgcgtcgcgatttttttagcgtgttcgttagttattggtgggtcgttatttttatgattatcgtgggttacggcgatat

SEQ ID NO: 10412 - DNA, 560 bp, Artificial Sequence
  chemically treated genomic DNA (Homo sapiens) CpG-island No: 10412
atatcgccgtaacccacgataatcataaaaataacgacccaccaataactaacgaacacgctaaaaaaatcgcgacgcgcgcccaactcgcgctcgaccaaatacaccaataacgcgaaaaacgccataaccacgcaaaaaaacaacaacaacaacccgaactcgcgcgcgcaacgacgcataatcaaacccaacgaacgcaaccccaacgaataacgcgccaaacgcatcacgtaaaacacgcgcaacgcacgcaacaaccgcaacaccaaccccgcgcgctccaaaaacttaatcccgcccgaacctaccgccaaccccaacaacaacgacacgtaaaacgacaaaaacgccaaaatatcaataatattaaataacgcgcgcaaaaaaacgcacttactctcgacctacaaaaaacgcaacaaaaactcgaaaaaaaaccaaaccacgcacacgatctccaacacgaacaaactacgacacttaaaaaaacactcgccctacgaaaaaaaaaaacacgaaattaaaaacgcaaacctcttaaaaaaccgaaaacgcct

SEQ ID NO: 10413 - DNA, 877 bp, Artificial Sequence
  chemically treated genomic DNA (Homo sapiens) CpG-island No: 10413
cgtttttattcgtggttggaggatagttcgggcggcggcgggcggtttcggggcgggagcgtgggggtagggtacggcgagttcggggttttttaggattattaggtcgtttggacgttggggaggaatttttatttcgatagttgttatgacggaattaacggcgttttacggtgtttaggtcgtcgtcgttttattcggttaattatacgttcgcgcggcgtttatacgtatatgtcgttagtacgtacggcgttagcgcgcgcgtatgtcgttagtacgtacggcgtcggtgcgtgcgcgtttagacgttttgtcgggtggtagttttagcggagtttgcgtgtgcgggcgggatcggatttcgttcgtgggttcgggggcggcgggggtcggggagtgaggggtcggttgagtttatttcgttgggttttttttggcgtttcgttttgggcggcggcgagcgcgcgggtcgttatgtcgtatatgttttcgtatttgtataacggttggtaggtggattaggttattttttcggaggaggatcgcgtggtcgttattcgtttcggttacgattgggattttacgtgtatgaagatggacgaggttttgtatagtatcgtcgagaaggtagcgcgtcggattttttcgttttgcgggttgtgttttcgtatttgtttcgcgtttttgttttgtcggcgtcgtttgggggcgcgagttgtttttcgaggaggggtcgcggtttcgtcgtttaggcgattttttttttcgttgcggtcgagcgttttcggggattgtgtcggcgttttacgtttttttttgcggggagtttttgtagttttttatattttaaagggtttatgattttttttttttt

SEQ ID NO: 10414 - DNA, 877 bp, Artificial Sequence
  chemically treated genomic DNA (Homo sapiens) CpG-island No: 10414
aaaaaaaaaaaaatcataaaccctttaaaatataaaaaactacaaaaactccccgcaaaaaaaaacgtaaaacgccgacacaatccccgaaaacgctcgaccgcaacgaaaaaaaaaatcgcctaaacgacgaaaccgcgacccctcctcgaaaaacaactcgcgcccccaaacgacgccgacaaaacaaaaacgcgaaacaaatacgaaaacacaacccgcaaaacgaaaaaatccgacgcgctaccttctcgacgatactatacaaaacctcgtccatcttcatacacgtaaaatcccaatcgtaaccgaaacgaataacgaccacgcgatcctcctccgaaaaaataacctaatccacctaccaaccgttatacaaatacgaaaacatatacgacataacgacccgcgcgctcgccgccgcccaaaacgaaacgccaaaaaaaacccaacgaaataaactcaaccgacccctcactccccgacccccgccgcccccgaacccacgaacgaaatccgatcccgcccgcacacgcaaactccgctaaaactaccacccgacaaaacgtctaaacgcgcacgcaccgacgccgtacgtactaacgacatacgcgcgcgctaacgccgtacgtactaacgacatatacgtataaacgccgcgcgaacgtataattaaccgaataaaacgacgacgacctaaacaccgtaaaacgccgttaattccgtcataacaactatcgaaataaaaattcctccccaacgtccaaacgacctaataatcctaaaaaaccccgaactcgccgtaccctacccccacgctcccgccccgaaaccgcccgccgccgcccgaactatcctccaaccacgaataaaaacg

SEQ ID NO: 10415 - DNA, 877 bp, Artificial Sequence
  chemically treated genomic DNA (Homo sapiens) CpG-island No: 10415
gagaggagggggattataaattttttaaaatatgaaaaattataagagtttttcgtagaaaaaggcgtgaaacgtcggtatagttttcgagagcgttcgatcgtagcgaggggaggaatcgtttgaacgacggagtcgcggttttttttcggggaatagttcgcgtttttaggcgacgtcggtagggtagaggcgcggggtagatgcggaagtatagttcgtagagcgggagagttcggcgcgttattttttcggcgatgttgtataggatttcgtttatttttatgtacgtaggattttagtcgtggtcgaagcggatgacgattacgcggttttttttcgagaggatggtttggtttatttgttagtcgttgtgtaggtgcgggagtatgtacgatatggcggttcgcgcgttcgtcgtcgtttaaggcggggcgttagggagggtttagcgaggtgggtttagtcggttttttatttttcggttttcgtcgttttcgggtttacggacgaaattcggtttcgttcgtatacgtaaatttcgttgggattgttattcggtagaacgtttgggcgcgtacgtatcgacgtcgtgcgtgttgacggtatgcgcgcgcgttagcgtcgtgcgtgttgacggtatgtgcgtataggcgtcgcgcgaacgtgtagttggtcgggtggagcggcggcgatttgggtatcgtggagcgtcgttggtttcgttatagtagttgtcggagtgggggtttttttttagcgtttaggcggtttggtggttttgagaagtttcgggttcgtcgtgttttgtttttacgttttcgtttcgaggtcgttcgtcgtcgttcgggttgttttttagttacggatggggacg

SEQ ID NO: 10416 - DNA, 877 bp, Artificial Sequence
  chemically treated genomic DNA (Homo sapiens) CpG-island No: 10416
cgtccccatccgtaactaaaaaacaacccgaacgacgacgaacgacctcgaaacgaaaacgtaaaaacaaaacacgacgaacccgaaacttctcaaaaccaccaaaccgcctaaacgctaaaaaaaaacccccactccgacaactactataacgaaaccaacgacgctccacgatacccaaatcgccgccgctccacccgaccaactacacgttcgcgcgacgcctatacgcacataccgtcaacacgcacgacgctaacgcgcgcgcataccgtcaacacgcacgacgtcgatacgtacgcgcccaaacgttctaccgaataacaatcccaacgaaatttacgtatacgaacgaaaccgaatttcgtccgtaaacccgaaaacgacgaaaaccgaaaaataaaaaaccgactaaacccacctcgctaaaccctccctaacgccccgccttaaacgacgacgaacgcgcgaaccgccatatcgtacatactcccgcacctacacaacgactaacaaataaaccaaaccatcctctcgaaaaaaaaccgcgtaatcgtcatccgcttcgaccacgactaaaatcctacgtacataaaaataaacgaaatcctatacaacatcgccgaaaaaataacgcgccgaactctcccgctctacgaactatacttccgcatctaccccgcgcctctaccctaccgacgtcgcctaaaaacgcgaactattccccgaaaaaaaaccgcgactccgtcgttcaaacgattcctcccctcgctacgatcgaacgctctcgaaaactataccgacgtttcacgcctttttctacgaaaaactcttataatttttcatattttaaaaaatttataatccccctcctctc

SEQ ID NO: 10417 - DNA, 586 bp, Artificial Sequence
  chemically treated genomic DNA (Homo sapiens) CpG-island No: 10417
taatttcgcggttcgttttttattcgtgtatttttcgttttatattttcgcgttttttatttacgcgttttttattttatatatattcgtttattattcgcgtattttttattttttatttacgttttttttattttttatcggcgcgttttttattttttattttttatttaggcgttttttattttttattcgcgtattatttattttttattttttatttacgttttttttattttttattttttattcgcgttttttttattttttattcgcgcgttttttattttttattcgcgttttttttatattttattcgcgttttttttattttttattcgcgcgttttttatttacgcgtttttcgtttttagtttttattcgcgcgggttaagagggtttcgggcgagggtagtttttcgcgggcgggtgtggggttcggagttggtttggtacgcgaggtcggtagtagggttcgggttttacgtacgtttggttttcgagtttgttttgaggtttaggagttgttttttttgtaaataggcgtttaacggtttagttcggagaattatacggggatggggag

SEQ ID NO: 10418 - DNA, 586 bp, Artificial Sequence
  chemically treated genomic DNA (Homo sapiens) CpG-island No: 10418
ctccccatccccgtataattctccgaactaaaccgttaaacgcctatttacaaaaaaaacaactcctaaacctcaaaacaaactcgaaaaccaaacgtacgtaaaacccgaaccctactaccgacctcgcgtaccaaaccaactccgaaccccacacccgcccgcgaaaaactaccctcgcccgaaaccctcttaacccgcgcgaataaaaactaaaaacgaaaaacgcgtaaataaaaaacgcgcgaataaaaaataaaaaaaacgcgaataaaatataaaaaaaacgcgaataaaaaataaaaaacgcgcgaataaaaaataaaaaaaacgcgaataaaaaataaaaaataaaaaaaacgtaaataaaaaataaaaaataaataatacgcgaataaaaaataaaaaacgcctaaataaaaaataaaaaataaaaaacgcgccgataaaaaataaaaaaaacgtaaataaaaaataaaaaatacgcgaataataaacgaatatatataaaataaaaaacgcgtaaataaaaaacgcgaaaatataaaacgaaaaatacacgaataaaaaacgaaccgcgaaatta

SEQ ID NO: 10419 - DNA, 586 bp, Artificial Sequence
  chemically treated genomic DNA (Homo sapiens) CpG-island No: 10419
ttttttattttcgtgtagtttttcgggttgaatcgttgggcgtttatttgtagaaaaggtagtttttgagttttaagatagattcgggggttaggcgtgcgtgaagttcgggttttgttgtcggtttcgcgtgttaagttaatttcgagttttatattcgttcgcggggagttgttttcgttcgggatttttttggttcgcgcgggtgaggattgagggcgaggggcgcgtggatgaggggcgcgcgggtgaagagtgaggggagcgcgggtgaagtgtgaggggagcgcgggtgaggggtgaggggcgcgcgggtgaggggtgaggggagcgcgggtgaggggtgaggggtgaggggagcgtgggtgaggggtgaggggtgagtgatgcgcgagtgaagggtgaggggcgtttgggtgaggggtgaggggtgaggggcgcgtcggtgaagggtgaggggagcgtgggtgaggggtgaagggtgcgcgagtgatgggcgggtgtgtgtagggtgagggacgcgtgggtgaggggcgcgggggtgtgaggcgaggggtgtacgggtaaggggcgagtcgcgaggttg

SEQ ID NO: 10420 - DNA, 586 bp, Artificial Sequence
  chemically treated genomic DNA (Homo sapiens) CpG-island No: 10420
caacctcgcgactcgccccttacccgtacacccctcgcctcacacccccgcgcccctcacccacgcgtccctcaccctacacacacccgcccatcactcgcgcacccttcacccctcacccacgctcccctcacccttcaccgacgcgcccctcacccctcacccctcacccaaacgcccctcacccttcactcgcgcatcactcacccctcacccctcacccacgctcccctcacccctcacccctcacccgcgctcccctcacccctcacccgcgcgcccctcacccctcacccgcgctcccctcacacttcacccgcgctcccctcactcttcacccgcgcgcccctcatccacgcgcccctcgccctcaatcctcacccgcgcgaaccaaaaaaatcccgaacgaaaacaactccccgcgaacgaatataaaactcgaaattaacttaacacgcgaaaccgacaacaaaacccgaacttcacgcacgcctaacccccgaatctatcttaaaactcaaaaactaccttttctacaaataaacgcccaacgattcaacccgaaaaactacacgaaaataaaaaa

SEQ ID NO: 10421 - DNA, 917 bp, Artificial Sequence
  chemically treated genomic DNA (Homo sapiens) CpG-island No: 10421
ggtcgtttcgcgtttttgtagcgatagcgatcgtggtcgtaattacgataatgataatggttacggtgacggtcgcgcgtttagtcggtttttcggcgacggtttcggcgtatttgttcgtggggtatttgtatcggagcggagattcgcggggggcgtttcgtttttcgagatttcggtcgtttttgggcgttgtaaatttcgagtcgggttttcgggttttttgggttaggatagagttggacgagattcgttttcgggtggttcgtatttaggatacgcgtgagaggggcgttcggatttcgcgttttcggttttttaggacgacgtttttcgtttggatggtcgcgcgtcgggatagttggagacgggttaacgtgggcgttaggtttgagggatcggtttcgttcggttggtatttttcgatcgggcgggaggagttacgcgtttttatcgtttcgatagtttcggttttcggtttcgtttgcgttcgttttgtttagcgcgttttaggatatcgcggcgttttcgcgtagtttcggcgtgggcggggttcggtattgtgacgttacggggcggggtttttcggcgtttgagcggattgacgtcgagacgcgcgcgggttagcggcgcggggacgcggggcgttgggcgcggggttgggggcgtaggtaaggagcgcgggggcggcgcggggttttcggggggcggtttagggcggtcgaggacgtagggtcggggtagttggtcgcggtttttagttttttggtttggttttgtggggttttcggttcggtattttttttcgcgagtcgtgcgtttttattttggggtttgcgtttttttttttcgagtcgtgcgtttttatgttaggttttgtgattttttttcgaatagtgcgtttcgattttgggttt

SEQ ID NO: 10422 - DNA, 917 bp, Artificial Sequence
  chemically treated genomic DNA (Homo sapiens) CpG-island No: 10422
aaacccaaaatcgaaacgcactattcgaaaaaaaatcacaaaacctaacataaaaacgcacgactcgaaaaaaaaaaacgcaaaccccaaaataaaaacgcacgactcgcgaaaaaaaataccgaaccgaaaaccccacaaaaccaaaccaaaaaactaaaaaccgcgaccaactaccccgaccctacgtcctcgaccgccctaaaccgccccccgaaaaccccgcgccgcccccgcgctccttacctacgcccccaaccccgcgcccaacgccccgcgtccccgcgccgctaacccgcgcgcgtctcgacgtcaatccgctcaaacgccgaaaaaccccgccccgtaacgtcacaataccgaaccccgcccacgccgaaactacgcgaaaacgccgcgatatcctaaaacgcgctaaacaaaacgaacgcaaacgaaaccgaaaaccgaaactatcgaaacgataaaaacgcgtaactcctcccgcccgatcgaaaaataccaaccgaacgaaaccgatccctcaaacctaacgcccacgttaacccgtctccaactatcccgacgcgcgaccatccaaacgaaaaacgtcgtcctaaaaaaccgaaaacgcgaaatccgaacgcccctctcacgcgtatcctaaatacgaaccacccgaaaacgaatctcgtccaactctatcctaacccaaaaaacccgaaaacccgactcgaaatttacaacgcccaaaaacgaccgaaatctcgaaaaacgaaacgccccccgcgaatctccgctccgatacaaataccccacgaacaaatacgccgaaaccgtcgccgaaaaaccgactaaacgcgcgaccgtcaccgtaaccattatcattatcgtaattacgaccacgatcgctatcgctacaaaaacgcgaaacgacc

SEQ ID NO: 10423 - DNA, 917 bp, Artificial Sequence
  chemically treated genomic DNA (Homo sapiens) CpG-island No: 10423
gggtttaggatcggggcgtattgttcgggggagggttatagggtttagtatgggggcgtacggttcgggggaagggggcgtaggttttaggatgggggcgtacggttcgcgggaggaggtgtcgggtcggggattttataggattaagttaggggattgaaggtcgcgattaattgtttcggttttgcgttttcggtcgttttaggtcgtttttcgaggatttcgcgtcgttttcgcgttttttatttgcgtttttagtttcgcgtttagcgtttcgcgttttcgcgtcgttgattcgcgcgcgtttcggcgttagttcgtttaggcgtcgggaaatttcgtttcgtgacgttataatgtcgggtttcgtttacgtcggagttgcgcggaggcgtcgcggtgttttagagcgcgttgggtagggcgggcgtaggcggggtcgggagtcggggttgtcggggcggtgggggcgcgtggtttttttcgttcggtcgggaaatattagtcgggcggggtcggttttttaggtttggcgtttacgttaattcgtttttagttgtttcggcgcgcggttatttaagcggagggcgtcgttttggagggtcgggggcgcggggttcggacgttttttttacgcgtgttttgaatgcgggttattcggggacgagtttcgtttagttttgttttgatttaggagattcggggattcggttcggagtttgtagcgtttagaggcggtcggggtttcgggaaacggagcgtttttcgcgggttttcgtttcgatgtaagtgttttacgagtagatgcgtcggggtcgtcgtcggggggtcggttggacgcgcggtcgttatcgtggttattgttattatcgtggttgcggttacggtcgttgtcgttgtagaaacgcggggcggtt

SEQ ID NO: 10424 - DNA, 917 bp, Artificial Sequence
  chemically treated genomic DNA (Homo sapiens) CpG-island No: 10424
aaccgccccgcgtttctacaacgacaacgaccgtaaccgcaaccacgataataacaataaccacgataacgaccgcgcgtccaaccgaccccccgacgacgaccccgacgcatctactcgtaaaacacttacatcgaaacgaaaacccgcgaaaaacgctccgtttcccgaaaccccgaccgcctctaaacgctacaaactccgaaccgaatccccgaatctcctaaatcaaaacaaaactaaacgaaactcgtccccgaataacccgcattcaaaacacgcgtaaaaaaaacgtccgaaccccgcgcccccgaccctccaaaacgacgccctccgcttaaataaccgcgcgccgaaacaactaaaaacgaattaacgtaaacgccaaacctaaaaaaccgaccccgcccgactaatatttcccgaccgaacgaaaaaaaccacgcgcccccaccgccccgacaaccccgactcccgaccccgcctacgcccgccctacccaacgcgctctaaaacaccgcgacgcctccgcgcaactccgacgtaaacgaaacccgacattataacgtcacgaaacgaaatttcccgacgcctaaacgaactaacgccgaaacgcgcgcgaatcaacgacgcgaaaacgcgaaacgctaaacgcgaaactaaaaacgcaaataaaaaacgcgaaaacgacgcgaaatcctcgaaaaacgacctaaaacgaccgaaaacgcaaaaccgaaacaattaatcgcgaccttcaatcccctaacttaatcctataaaatccccgacccgacacctcctcccgcgaaccgtacgcccccatcctaaaacctacgcccccttcccccgaaccgtacgcccccatactaaaccctataaccctcccccgaacaatacgccccgatcctaaaccc

SEQ ID NO: 10425 - DNA, 579 bp, Artificial Sequence
  chemically treated genomic DNA (Homo sapiens) CpG-island No: 10425
cgagaggtttttgattgtttatttttatattagagtcgtgatcgagatttagaggttcgttttcggttacggtcgaatagttgtatcgtgcgtatcgggaacggttaaggcgtagtttggaatcgttgtaaaaggttttcgggcgtatcggataggtcgtaagggcgggggtttttatttagcggaaatgtacggaggttaatttttttttttgttttcgcgaggagcggggcggattcggtagtcgttattttttaggtttataggaagaaattgggacgttgcggacgcggaattggttagattcgcggcgcgtggtacggcgagttttttcgcgtatgttttattcgtcgtttttagttcgcgtttcgggtttcgtttttttttttgtttttttttttttttcgttagttttttttcgagtttggttttttcggtcgggcgatcgacgtttcgcgtgcgtgcgggcgtttgattttattttcggttaacgcgttcggtttgttttttggtttcggatggtgattggtggtggtgttgtatttttcgggattgttattgagtcgttttttagtgtga

SEQ ID NO: 10426 - DNA, 579 bp, Artificial Sequence
  chemically treated genomic DNA (Homo sapiens) CpG-island No: 10426
tcacactaaaaaacgactcaataacaatcccgaaaaatacaacaccaccaccaatcaccatccgaaaccaaaaaacaaaccgaacgcgttaaccgaaaataaaatcaaacgcccgcacgcacgcgaaacgtcgatcgcccgaccgaaaaaaccaaactcgaaaaaaaactaacgaaaaaaaaaaaaaaacaaaaaaaaaaacgaaacccgaaacgcgaactaaaaacgacgaataaaacatacgcgaaaaaactcgccgtaccacgcgccgcgaatctaaccaattccgcgtccgcaacgtcccaatttcttcctataaacctaaaaaataacgactaccgaatccgccccgctcctcgcgaaaacaaaaaaaaaaattaacctccgtacatttccgctaaataaaaacccccgcccttacgacctatccgatacgcccgaaaaccttttacaacgattccaaactacgccttaaccgttcccgatacgcacgatacaactattcgaccgtaaccgaaaacgaacctctaaatctcgatcacgactctaatataaaaataaacaatcaaaaacctctcg

SEQ ID NO: 10427 - DNA, 579 bp, Artificial Sequence
  chemically treated genomic DNA (Homo sapiens) CpG-island No: 10427
ttatattgggaagcggtttagtgatagtttcgggaggtgtagtattattattagttattattcggggttagggggtaagtcgagcgcgttagtcggaagtgaagttaggcgttcgtacgtacgcggaacgtcgatcgttcggtcggaggggttaaattcggagggaggttgacgggagagggggagaagtagggagggaggcggggttcggggcgcgggttggaggcggcgggtggagtatgcgcgggagggttcgtcgtgttacgcgtcgcgggtttggttagtttcgcgttcgtagcgttttagtttttttttgtgagtttggggagtggcggttgtcgagttcgtttcgtttttcgcgggggtagggggaggggttggttttcgtgtattttcgttaggtggggattttcgtttttgcgatttgttcggtacgttcggaggttttttgtagcggttttaagttgcgttttgatcgttttcggtacgtacggtgtagttgttcggtcgtggtcggaagcggatttttgggtttcggttacggttttggtgtgagaataaataattagaagtttttcg

SEQ ID NO: 10428 - DNA, 579 bp, Artificial Sequence
  chemically treated genomic DNA (Homo sapiens) CpG-island No: 10428
cgaaaaacttctaattatttattctcacaccaaaaccgtaaccgaaacccaaaaatccgcttccgaccacgaccgaacaactacaccgtacgtaccgaaaacgatcaaaacgcaacttaaaaccgctacaaaaaacctccgaacgtaccgaacaaatcgcaaaaacgaaaatccccacctaacgaaaatacacgaaaaccaacccctccccctacccccgcgaaaaacgaaacgaactcgacaaccgccactccccaaactcacaaaaaaaaactaaaacgctacgaacgcgaaactaaccaaacccgcgacgcgtaacacgacgaaccctcccgcgcatactccacccgccgcctccaacccgcgccccgaaccccgcctccctccctacttctccccctctcccgtcaacctccctccgaatttaacccctccgaccgaacgatcgacgttccgcgtacgtacgaacgcctaacttcacttccgactaacgcgctcgacttaccccctaaccccgaataataactaataataatactacacctcccgaaactatcactaaaccgcttcccaatataa

SEQ ID NO: 10429 - DNA, 1525 bp, Artificial Sequence
  chemically treated genomic DNA (Homo sapiens) CpG-island No: 10429
tcgacgcggcgcgagttttattaggttttcgaggtcgatcgggtaggagaggggggcggggaggttcgggggcgttggttgcgtttcgatttcgcgtcgtattcgatcgcgtcgggggttcggattttaaggtgcgcgttcgaggggatttaatttggtcgcggaggaggggaggagggtggttttttcggtgtcgagttttttcgaggatagggttttttttttcgaggtttcgatcgaataaagagtacggtagggttaaggggtaaaggtcgtggcggcgtggagtggatagcggttttcggttcgtcgtttcgagttcgttcgttcgcgcggttttcgggtttgcgttcggttcgttcgttgtaggtgtcgtttttttagcgcggttttttcgcggcggtcggatttttgcgttttatttatttgtcgtatttttgtgttatcgcgttcgttcgtcgttgtcgggtcgtagaattggattttcgggttgggatagtatattcgattcggggggaggaggcggcggcggcggttgcgggttcggagcggcggtttcgacgggttgggtttgtttttttcgttttgagtcggtttcgcgcgggttgtcgtattgggcgtcgggttcggtcgtttattggttggcgatgcgtcggttgggggcgaggtttcggggttgggaggtcggtcgcgttttttgattggtcggcgagaagagcgtcggggcggggttgacggggacgagcggcgcgtgagttggggggcgggggttcgcgtttcgcgaggttgcgttcgggattgcgttttacgggttgcgcgttcgattcgcggtcgtacgcgtttgttttgataggagagggagcgttgcggttgcggttgtattcgtttaattttcgcgcgtatcgagagtttttcgttcgcgtttcgttatcgttttcgtcggtttacgtcgttttcgtcgttttcggttatttttttcgcgacgagtttcggtcgtatagtcgttttttttttcgtttatttaggttttcgcgtttcgtgtttatattgttcgttgtttcggttttagcgtttcgttgttgtttttgcgttcgttcggcgggggcgtttttgtcggtcgtcgcgtttttcggtcgcgcgttttatttttcggttttcgtaggttgttacgttcgagtttcgtggtttttttcgagagtcgttttcggaatgtttttttttttggtttatcgcggtcgcgcgtttttaggattttttgttttcgtagttttcgcggttttttcggcggtagtttttggggtttcgcgatgtttgtgtttcgtagtttttcgggcgttattttttcgcgcggtcgttttacgttgttcgtgtagtcgcgcgtttcgggtcggtttcgggtattattttatcgcgacggtttttatttgtttttttcgagttgtcgttttttttagggttcgtttattgagtttttatatgtttagcgtcggatttgattttcggataggcgcggtttagacgcggg

SEQ ID NO: 10430 - DNA, 1525 bp, Artificial Sequence
  chemically treated genomic DNA (Homo sapiens) CpG-island No: 10430
cccgcgtctaaaccgcgcctatccgaaaatcaaatccgacgctaaacatataaaaactcaataaacgaaccctaaaaaaaacgacaactcgaaaaaaacaaataaaaaccgtcgcgataaaataatacccgaaaccgacccgaaacgcgcgactacacgaacaacgtaaaacgaccgcgcgaaaaaataacgcccgaaaaactacgaaacacaaacatcgcgaaaccccaaaaactaccgccgaaaaaaccgcgaaaactacgaaaacaaaaaatcctaaaaacgcgcgaccgcgataaaccaaaaaaaaaaacattccgaaaacgactctcgaaaaaaaccacgaaactcgaacgtaacaacctacgaaaaccgaaaaataaaacgcgcgaccgaaaaacgcgacgaccgacaaaaacgcccccgccgaacgaacgcaaaaacaacaacgaaacgctaaaaccgaaacaacgaacaatataaacacgaaacgcgaaaacctaaataaacgaaaaaaaaaacgactatacgaccgaaactcgtcgcgaaaaaaataaccgaaaacgacgaaaacgacgtaaaccgacgaaaacgataacgaaacgcgaacgaaaaactctcgatacgcgcgaaaattaaacgaatacaaccgcaaccgcaacgctccctctcctatcaaaacaaacgcgtacgaccgcgaatcgaacgcgcaacccgtaaaacgcaatcccgaacgcaacctcgcgaaacgcgaacccccgccccccaactcacgcgccgctcgtccccgtcaaccccgccccgacgctcttctcgccgaccaatcaaaaaacgcgaccgacctcccaaccccgaaacctcgcccccaaccgacgcatcgccaaccaataaacgaccgaacccgacgcccaatacgacaacccgcgcgaaaccgactcaaaacgaaaaaaacaaacccaacccgtcgaaaccgccgctccgaacccgcaaccgccgccgccgcctcctccccccgaatcgaatatactatcccaacccgaaaatccaattctacgacccgacaacgacgaacgaacgcgataacacaaaaatacgacaaataaataaaacgcaaaaatccgaccgccgcgaaaaaaccgcgctaaaaaaacgacacctacaacgaacgaaccgaacgcaaacccgaaaaccgcgcgaacgaacgaactcgaaacgacgaaccgaaaaccgctatccactccacgccgccacgacctttaccccttaaccctaccgtactctttattcgatcgaaacctcgaaaaaaaaaaccctatcctcgaaaaaactcgacaccgaaaaaaccaccctcctcccctcctccgcgaccaaattaaatcccctcgaacgcgcaccttaaaatccgaacccccgacgcgatcgaatacgacgcgaaatcgaaacgcaaccaacgcccccgaacctccccgcccccctctcctacccgatcgacctcgaaaacctaataaaactcgcgccgcgtcga

SEQ ID NO: 10431 - DNA, 1525 bp, Artificial Sequence
  chemically treated genomic DNA (Homo sapiens) CpG-island No: 10431
ttcgcgtttgggtcgcgtttgttcgagggttaggttcgacgttgggtatgtggggatttagtgagcggattttgggaaagacggtagttcgggaaggataagtgggggtcgtcgcggtggagtggtgttcggggtcggttcggggcgcgcgattgtacgggtagcgtggggcggtcgcgcggggaagtggcgttcgggaggttgcggggtatagatatcgcggagttttagggattgtcgtcgaggggatcgcgggagttgcgagggtaagaaattttaaaagcgcgcggtcgcggtgggttaggagaagggatatttcggagacggttttcgggggaagttacgggattcgggcgtgatagtttgcgagaatcgagaggtgagacgcgcgatcggggagcgcggcgatcggtagaggcgttttcgtcgggcgagcgtaggggtagtagcggggcgttggggtcggaatagcgggtaatgtgggtacggggcgcggaggtttgagtgagcgaagaaggaggcggttgtacggtcggggttcgtcgcgaaggggatggtcggggacggcggggacggcgtgggtcggcgggagcggtagcggggcgcgagcgggggattttcggtgcgcgcggaggttgggcgggtgtagtcgtagtcgtagcgtttttttttttgttagggtaggcgcgtacggtcgcgagtcgggcgcgtagttcgtggagcgtagtttcgggcgtaatttcgcggaacgcgggttttcgttttttagtttacgcgtcgttcgttttcgttagtttcgtttcggcgtttttttcgtcgattaattaggaggcgcgatcggttttttagtttcgaggtttcgtttttagtcggcgtatcgttagttaatgagcggtcgagttcggcgtttagtgcggtagttcgcgcggagtcggtttagagcgagaaaagtaaatttaattcgtcggggtcgtcgtttcggattcgtagtcgtcgtcgtcgtttttttttttcggatcgggtgtattgttttaattcgaaagtttagttttgcggttcggtagcggcgagcgggcgcgatgatataggagtacgataagtgagtgaggcgtaggagttcggtcgtcgcgggggggtcgcgttgagggggcggtatttgtagcgagcgagtcgggcgtagattcgaaggtcgcgcgggcgggcgggttcggggcggcgagtcgggagtcgttgtttattttacgtcgttacggtttttgttttttagttttgtcgtgttttttgttcggtcggagtttcgggaggagagattttgttttcggggaaattcgatatcggaggggttattttttttttttttttcgcggttaggttgggttttttcgggcgcgtattttggggttcgggttttcggcgcggtcgggtgcggcgcgaggtcggggcgtagttaacgttttcgggttttttcgttttttttttttgttcggtcggtttcgggagtttggtggggttcgcgtcgcgtcgg

SEQ ID NO: 10432 - DNA, 1525 bp, Artificial Sequence
  chemically treated genomic DNA (Homo sapiens) CpG-island No: 10432
ccgacgcgacgcgaaccccaccaaactcccgaaaccgaccgaacaaaaaaaaaaaacgaaaaaacccgaaaacgttaactacgccccgacctcgcgccgcacccgaccgcgccgaaaacccgaaccccaaaatacgcgcccgaaaaaacccaacctaaccgcgaaaaaaaaaaaaaaaataacccctccgatatcgaatttccccgaaaacaaaatctctcctcccgaaactccgaccgaacaaaaaacacgacaaaactaaaaaacaaaaaccgtaacgacgtaaaataaacaacgactcccgactcgccgccccgaacccgcccgcccgcgcgaccttcgaatctacgcccgactcgctcgctacaaataccgccccctcaacgcgacccccccgcgacgaccgaactcctacgcctcactcacttatcgtactcctatatcatcgcgcccgctcgccgctaccgaaccgcaaaactaaactttcgaattaaaacaatacacccgatccgaaaaaaaaaaacgacgacgacgactacgaatccgaaacgacgaccccgacgaattaaatttacttttctcgctctaaaccgactccgcgcgaactaccgcactaaacgccgaactcgaccgctcattaactaacgatacgccgactaaaaacgaaacctcgaaactaaaaaaccgatcgcgcctcctaattaatcgacgaaaaaaacgccgaaacgaaactaacgaaaacgaacgacgcgtaaactaaaaaacgaaaacccgcgttccgcgaaattacgcccgaaactacgctccacgaactacgcgcccgactcgcgaccgtacgcgcctaccctaacaaaaaaaaaaacgctacgactacgactacacccgcccaacctccgcgcgcaccgaaaatcccccgctcgcgccccgctaccgctcccgccgacccacgccgtccccgccgtccccgaccatccccttcgcgacgaaccccgaccgtacaaccgcctccttcttcgctcactcaaacctccgcgccccgtacccacattacccgctattccgaccccaacgccccgctactacccctacgctcgcccgacgaaaacgcctctaccgatcgccgcgctccccgatcgcgcgtctcacctctcgattctcgcaaactatcacgcccgaatcccgtaacttcccccgaaaaccgtctccgaaatatcccttctcctaacccaccgcgaccgcgcgcttttaaaatttcttaccctcgcaactcccgcgatcccctcgacgacaatccctaaaactccgcgatatctataccccgcaacctcccgaacgccacttccccgcgcgaccgccccacgctacccgtacaatcgcgcgccccgaaccgaccccgaacaccactccaccgcgacgacccccacttatccttcccgaactaccgtctttcccaaaatccgctcactaaatccccacatacccaacgtcgaacctaaccctcgaacaaacgcgacccaaacgcgaa

SEQ ID NO: 10433 - DNA, 1154 bp, Artificial Sequence
  chemically treated genomic DNA (Homo sapiens) CpG-island No: 10433
ttcgtttatacgtacgtttgtttatttgattcgtttatatatacgtttgtttatttgattcgtttatatatacgtttgtttacgtgatacgttgatacgtacgtttgtttacgtgagttatttatatttacgcgtgtttatttgaattatttatatgtatatttatatgtacgtttgtttatttgattcgtttatacgtatatttatacgtatatttgtttatttgatttatttatatgtacgtttgtttatttgattcgtttatacgtatgtttgtttatttgattcgtttatacgtacgtttgtttatttgatttatttatatttaattttgtttatttgattcgttcgtacgtacgtttgtttatttgattcgtttatacgtatgtttgtttatttgattcgttcgtacgtacgtttgtttatttgattcgtttatacgtacgtttgtttatttgattcgtttataagtaattttgtttatttgatttatttataagtaattttgtttatttgattcgattatacgtacgtttgtttatttgattcgttcgtacgtaattttgtttatttgattcgttagtacgtacgtttgtttatttgattcgattataggtacgtttgtttatttgattcgttcgtacgtaattttgtttatttgattcgttcgtacgtaattttgtttatttgattcgttagtacgtacgtttgtttatttgattcgttcgtacgtaattttgtttatttgatcggttcgtatttaattttgtttatttgatttttttatatatatgtttgtttatttgattcgtttgtacgtacgtttgtttatttgattcgtttgtacgtacgtttgtttatttgattcgtttgtacgtatgtttgtttatttgattcgtttgtacgcgattttgtttatttgatttgttcgtatgtacgttaatattgtttatttgattcgttcgtacgcgattttgtttatttgattcgttcgtacgtacgttaatattgtttatttgattcgttcgtatatacgtttgtttatttgattcgttcgtatgtatgtttgtttatttgattcgtttatatatatatttgtttatttgattcgattataagaacgtttgtttatttgatcggtttatataaatgtt

SEQ ID NO: 10434 - DNA, 1154 bp, Artificial Sequence
  chemically treated genomic DNA (Homo sapiens) CpG-island No: 10434
aacatttatataaaccgatcaaataaacaaacgttcttataatcgaatcaaataaacaaatatatatataaacgaatcaaataaacaaacatacatacgaacgaatcaaataaacaaacgtatatacgaacgaatcaaataaacaatattaacgtacgtacgaacgaatcaaataaacaaaatcgcgtacgaacgaatcaaataaacaatattaacgtacatacgaacaaatcaaataaacaaaatcgcgtacaaacgaatcaaataaacaaacatacgtacaaacgaatcaaataaacaaacgtacgtacaaacgaatcaaataaacaaacgtacgtacaaacgaatcaaataaacaaacatatatataaaaaaatcaaataaacaaaattaaatacgaaccgatcaaataaacaaaattacgtacgaacgaatcaaataaacaaacgtacgtactaacgaatcaaataaacaaaattacgtacgaacgaatcaaataaacaaaattacgtacgaacgaatcaaataaacaaacgtacctataatcgaatcaaataaacaaacgtacgtactaacgaatcaaataaacaaaattacgtacgaacgaatcaaataaacaaacgtacgtataatcgaatcaaataaacaaaattacttataaataaatcaaataaacaaaattacttataaacgaatcaaataaacaaacgtacgtataaacgaatcaaataaacaaacgtacgtacgaacgaatcaaataaacaaacatacgtataaacgaatcaaataaacaaacgtacgtacgaacgaatcaaataaacaaaattaaatataaataaatcaaataaacaaacgtacgtataaacgaatcaaataaacaaacatacgtataaacgaatcaaataaacaaacgtacatataaataaatcaaataaacaaatatacgtataaatatacgtataaacgaatcaaataaacaaacgtacatataaatatacatataaataattcaaataaacacgcgtaaatataaataactcacgtaaacaaacgtacgtatcaacgtatcacgtaaacaaacgtatatataaacgaatcaaataaacaaacgtatatataaacgaatcaaataaacaaacgtacgtataaacgaa

SEQ ID NO: 10435 - DNA, 1154 bp, Artificial Sequence
  chemically treated genomic DNA (Homo sapiens) CpG-island No: 10435
ggtatttgtatgggtcggttaggtgggtaggcgtttttatggtcgggttaggtgggtaggtgtgtgtatgagcgagttaggtgggtagatatgtatacgggcgggttaggtggataggcgtgtgtacgggcgggttaggtggatagtattggcgtgcgtacgggcgggttagatggataggatcgcgtacgggcgggttaggtggatagtattggcgtgtatacgggtaggttagatggataggatcgcgtataggcgggttaggtggataggtatgcgtataggcgggttaggtggataggcgtgcgtataggcgggttaggtggataggcgtgcgtataggcgggttaggtgggtaggtatgtgtgtgggagagttaggtggataggattgagtacgggtcggttaggtggataggattgcgtacgggcgggttaggtgagtaggcgtgcgtattggcgggttaggtggataggattgcgtacgggcgggttaggtggataggattgcgtacgggcgggttaggtgggtaggcgtgtttatggtcgggttaggtgggtaggcgtgcgtattggcgggttaggtggataggattgcgtacgggcgggttaggtgggtaggcgtgcgtatggtcgggttaggtgggtaggattgtttatgggtgagttaggtggataggattgtttatgggcgggttaggtggataggcgtgcgtatgggcgagttaggtgggtaggcgtgcgtacgagcgggttaggtggataggtatgcgtatgggcgggttaggtgggtaggcgtgcgtacgagcgagttaggtggataggattgggtatgggtgagttaggtggataggcgtgcgtatgagcgggttaggtgagtaggtatgcgtatgggcgggttaggtgggtaggcgtgtatatgggtgggttaggtggataggtgtgcgtatgagtgtgcgtatgggcgagttaggtgggtagacgtgtatatgggtgtgtatatgggtgatttaggtggatacgcgtgggtatgggtggtttacgtggataggcgtgcgtgttagcgtgttacgtggataggcgtgtgtgtgggcgggttaggtgggtaggcgtgtgtatgggcgggttaggtgggtaggcgtgcgtatgggcggg

SEQ ID NO: 10436 - DNA, 1154 bp, Artificial Sequence
  chemically treated genomic DNA (Homo sapiens) CpG-island No: 10436
cccgcccatacgcacgcctacccacctaacccgcccatacacacgcctacccacctaacccgcccacacacacgcctatccacgtaacacgctaacacgcacgcctatccacgtaaaccacccatacccacgcgtatccacctaaatcacccatatacacacccatatacacgtctacccacctaactcgcccatacgcacactcatacgcacacctatccacctaacccacccatatacacgcctacccacctaacccgcccatacgcatacctactcacctaacccgctcatacgcacgcctatccacctaactcacccatacccaatcctatccacctaactcgctcgtacgcacgcctacccacctaacccgcccatacgcatacctatccacctaacccgctcgtacgcacgcctacccacctaactcgcccatacgcacgcctatccacctaacccgcccataaacaatcctatccacctaactcacccataaacaatcctacccacctaacccgaccatacgcacgcctacccacctaacccgcccgtacgcaatcctatccacctaacccgccaatacgcacgcctacccacctaacccgaccataaacacgcctacccacctaacccgcccgtacgcaatcctatccacctaacccgcccgtacgcaatcctatccacctaacccgccaatacgcacgcctactcacctaacccgcccgtacgcaatcctatccacctaaccgacccgtactcaatcctatccacctaactctcccacacacatacctacccacctaacccgcctatacgcacgcctatccacctaacccgcctatacgcacgcctatccacctaacccgcctatacgcatacctatccacctaacccgcctatacgcgatcctatccatctaacctacccgtatacacgccaatactatccacctaacccgcccgtacgcgatcctatccatctaacccgcccgtacgcacgccaatactatccacctaacccgcccgtacacacgcctatccacctaacccgcccgtatacatatctacccacctaactcgctcatacacacacctacccacctaacccgaccataaaaacgcctacccacctaaccgacccatacaaatacc

SEQ ID NO: 10437 - DNA, 621 bp, Artificial Sequence
  chemically treated genomic DNA (Homo sapiens) CpG-island No: 10437
tttttatacgtacgtttgtttatttgatttttttatacgtacgtttgtttatttgattcgtttatacgtatatttatatatatgtttgtttatttgattcgattatatgtacgtttgtttatttgattcgattataagaacgtttgtttatttgattcgtttatataaacgtttgtttatttgattcgtttgtacgtacgtttgtttagttgattcgtttatacgtatatttatacgtacgtttgtttatttgatttttttatacgtaattttgtttatttgatttgtttatacgtacgtttgtttatttgattcgtttatacgtacgtttgtttatttgatttttttatacgtacgtttgtttatttgattcgtttatacgtatatttatatttaagtttgtttatttaaatcgattatatatacgtttgtttatttgattcgtttatataaacgtttgtttatttgattcgttcgtatgtacgtttgtttagattcgtttatatttacgtttgtttatttgattcgtttatatgtacgtttgtttattttatttgtttgtttattttattcgtttatacgtacgtttggttatttgatttgtttatatatatgtttgtt

SEQ ID NO: 10438 - DNA, 621 bp, Artificial Sequence
  chemically treated genomic DNA (Homo sapiens) CpG-island No: 10438
aacaaacatatatataaacaaatcaaataaccaaacgtacgtataaacgaataaaataaacaaacaaataaaataaacaaacgtacatataaacgaatcaaataaacaaacgtaaatataaacgaatctaaacaaacgtacatacgaacgaatcaaataaacaaacgtttatataaacgaatcaaataaacaaacgtatatataatcgatttaaataaacaaacttaaatataaatatacgtataaacgaatcaaataaacaaacgtacgtataaaaaaatcaaataaacaaacgtacgtataaacgaatcaaataaacaaacgtacgtataaacaaatcaaataaacaaaattacgtataaaaaaatcaaataaacaaacgtacgtataaatatacgtataaacgaatcaactaaacaaacgtacgtacaaacgaatcaaataaacaaacgtttatataaacgaatcaaataaacaaacgttcttataatcgaatcaaataaacaaacgtacatataatcgaatcaaataaacaaacatatatataaatatacgtataaacgaatcaaataaacaaacgtacgtataaaaaaatcaaataaacaaacgtacgtataaaaa

SEQ ID NO: 10439 - DNA, 621 bp, Artificial Sequence
  chemically treated genomic DNA (Homo sapiens) CpG-island No: 10439
gataggtatgtgtatgggtaggttaggtggttaggcgtgcgtatgggcgagtgaggtgggtaggtaagtgaggtgggtaggcgtgtatgtgggcgagttaggtgggtaggcgtgggtgtgggcgagtttggataggcgtgtatacgggcgggttaggtgggtaggcgtttgtatgggcgggttaggtgggtagacgtgtgtatggtcggtttaggtggataggtttgagtatgggtgtgcgtatggacgagttaggtggataggcgtgcgtatgggagagttaggtggataggcgtgcgtatgggcgagttaggtggataggcgtgcgtatgggtaagttaggtggataggattgcgtatgggagagttaggtggataggcgtgcgtatgggtgtgcgtatggacgagttagttgggtaggcgtgcgtataggcgggttaggtgggtaggcgtttgtatgggcgggttaggtgggtaggcgtttttatggtcgggttaggtgggtaggcgtgtatatggtcgggttaggtggataggtatgtgtatgggtgtgcgtatggacgagttaggtggataggcgtgcgtatgggagagttaggtggataggcgtgcgtatgggag

SEQ ID NO: 10440 - DNA, 621 bp, Artificial Sequence
  chemically treated genomic DNA (Homo sapiens) CpG-island No: 10440
ctcccatacgcacgcctatccacctaactctcccatacgcacgcctatccacctaactcgtccatacgcacacccatacacatacctatccacctaacccgaccatatacacgcctacccacctaacccgaccataaaaacgcctacccacctaacccgcccatacaaacgcctacccacctaacccgcctatacgcacgcctacccaactaactcgtccatacgcacacccatacgcacgcctatccacctaactctcccatacgcaatcctatccacctaacttacccatacgcacgcctatccacctaactcgcccatacgcacgcctatccacctaactctcccatacgcacgcctatccacctaactcgtccatacgcacacccatactcaaacctatccacctaaaccgaccatacacacgtctacccacctaacccgcccatacaaacgcctacccacctaacccgcccgtatacacgcctatccaaactcgcccacacccacgcctacccacctaactcgcccacatacacgcctacccacctcacttacctacccacctcactcgcccatacgcacgcctaaccacctaacctacccatacacatacctatc

SEQ ID NO: 10441 - DNA, 793 bp, Artificial Sequence
  chemically treated genomic DNA (Homo sapiens) CpG-island No: 10441
gcgtgcgtatgagcgagttaggtggataggattgcgtatgggagagttaggtggataggcgtgtatatgagcgagttaggtggataggtatgcgtatgggagagttaggtggataggtatgtatatgagcgagttaggtggataggcgtgcgtatgggtgtgtatatgggtgagttaggtgggtaggcgtgtatacgggcgggttaggtgggtaggcgtttgtgtgggtcggttaggtgggtaggtgtttttatggtcgggttaggtggataggtatgtgtatgggtgtgcgtatggacgagttaggtgggtaggcgtgcgtatgggagagttaggtggataggtgtgcgtatgggtgagttaggtggataggcgtgtatatgggtgtgcgtacgggcgagttaggtgggtaggcgtgtatatgggtgtgtgtatgggtgagttaggtgggtaggtatgcgtatgagcgagttaggcgggtaggcgtgcgtatgggtgagttaggtgggtaggagtgtatatgggtgtgcgtatgggtgagttaggtgggtaggtatgcgtatgagcgagttaggtgggtaggcgtgcgtatgggtgagttaggtgggtaggagtgtatatgggtgtgcgtatgggcgagttaggtgggtaggcgtgcgtgtgggcgagttaggtgggtaggtatgtatacgggcgggttaggtgggtaggtttttttatggtcgggttaggtgggtaggtatgcgtacgggtaggttaggtgggtaggcgtgtatacgggtaggttaggtgt

SEQ ID NO: 10442 - DNA, 793 bp, Artificial Sequence
  chemically treated genomic DNA (Homo sapiens) CpG-island No: 10442
acacctaacctacccgtatacacgcctacccacctaacctacccgtacgcatacctacccacctaacccgaccataaaaaaacctacccacctaacccgcccgtatacatacctacccacctaactcgcccacacgcacgcctacccacctaactcgcccatacgcacacccatatacactcctacccacctaactcacccatacgcacgcctacccacctaactcgctcatacgcatacctacccacctaactcacccatacgcacacccatatacactcctacccacctaactcacccatacgcacgcctacccgcctaactcgctcatacgcatacctacccacctaactcacccatacacacacccatatacacgcctacccacctaactcgcccgtacgcacacccatatacacgcctatccacctaactcacccatacgcacacctatccacctaactctcccatacgcacgcctacccacctaactcgtccatacgcacacccatacacatacctatccacctaacccgaccataaaaacacctacccacctaaccgacccacacaaacgcctacccacctaacccgcccgtatacacgcctacccacctaactcacccatatacacacccatacgcacgcctatccacctaactcgctcatatacatacctatccacctaactctcccatacgcatacctatccacctaactcgctcatatacacgcctatccacctaactctcccatacgcaatcctatccacctaactcgctcatacgcacgc

SEQ ID NO: 10443 - DNA, 793 bp, Artificial Sequence
  chemically treated genomic DNA (Homo sapiens) CpG-island No: 10443
atatttgatttgttcgtatgtacgtttgtttatttgatttgttcgtacgtatgtttgtttatttgattcgattataagaaagtttgtttatttgattcgttcgtatgtatgtttgtttatttgattcgtttatacgtacgtttgtttatttgattcgtttatacgtatatttatatgtatttttgtttatttgatttatttatacgtacgtttgtttatttgattcgtttatacgtatgtttgtttatttgatttatttatacgtatatttatatgtatttttgtttatttgatttatttatacgtacgtttgttcgtttgattcgtttatacgtatgtttgtttatttgatttatttatatatatatttatatgtacgtttgtttatttgattcgttcgtacgtatatttatatgtacgtttgtttatttgatttatttatacgtatatttgtttatttaatttttttatacgtacgtttgtttatttgattcgtttatacgtatatttatatatatgtttgtttatttgattcgattataagaatatttgtttatttgatcggtttatataaacgtttgtttatttgattcgttcgtatgtacgtttgtttatttgatttatttatatgtatatttatacgtacgtttgtttatttgattcgtttatatgtatgtttgtttatttgatttttttatacgtatgtttgtttatttgattcgtttatatgtacgtttgtttatttgatttttttatacgtaattttgtttatttgattcgtttatacgtacgt

SEQ ID NO: 10444 - DNA, 793 bp, Artificial Sequence
  chemically treated genomic DNA (Homo sapiens) CpG-island No: 10444
acgtacgtataaacgaatcaaataaacaaaattacgtataaaaaaatcaaataaacaaacgtacatataaacgaatcaaataaacaaacatacgtataaaaaaatcaaataaacaaacatacatataaacgaatcaaataaacaaacgtacgtataaatatacatataaataaatcaaataaacaaacgtacatacgaacgaatcaaataaacaaacgtttatataaaccgatcaaataaacaaatattcttataatcgaatcaaataaacaaacatatatataaatatacgtataaacgaatcaaataaacaaacgtacgtataaaaaaattaaataaacaaatatacgtataaataaatcaaataaacaaacgtacatataaatatacgtacgaacgaatcaaataaacaaacgtacatataaatatatatataaataaatcaaataaacaaacatacgtataaacgaatcaaacgaacaaacgtacgtataaataaatcaaataaacaaaaatacatataaatatacgtataaataaatcaaataaacaaacatacgtataaacgaatcaaataaacaaacgtacgtataaataaatcaaataaacaaaaatacatataaatatacgtataaacgaatcaaataaacaaacgtacgtataaacgaatcaaataaacaaacatacatacgaacgaatcaaataaacaaactttcttataatcgaatcaaataaacaaacatacgtacgaacaaatcaaataaacaaacgtacatacgaacaaatcaaatat

SEQ ID NO: 10445 - DNA, 537 bp, Artificial Sequence
  chemically treated genomic DNA (Homo sapiens) CpG-island No: 10445
gtcgtttcgagattttacgtttagggttagtatagtttcgggcgtttcgcgttatttttattaggttcgtttaatttcgtcgtttcgtagatttacgtgtaggatattttgaggacggagttggttgcggaggttatcgcgtgttgtgtttcgagcggggttatatgtttgtttgcggcgatgttattatggtaattaacgttttgtagatcgtgtagcgtattttggcgacggagggcgatatggagttggacgaggtcggcgacgttatcggcgtgttgcgggtgcggaggggcgggtcgggtttgagcgtgcggggtttttgttaaggttttcgagtcgggttttgatttattgtgttttttttcgataggattagtaacgttattacgaagatattttcgggttattgcgtatttaggaggtgataagtcgatacgtatttagagtttttttttgtaggagcgttagttgcggggcgtagtgttgggcgttcgattttcggtttagatattaatagtttttgagaggtttggt

SEQ ID NO: 10446 - DNA, 537 bp, Artificial Sequence
  chemically treated genomic DNA (Homo sapiens) CpG-island No: 10446
accaaacctctcaaaaactattaatatctaaaccgaaaatcgaacgcccaacactacgccccgcaactaacgctcctacaaaaaaaaactctaaatacgtatcgacttatcacctcctaaatacgcaataacccgaaaatatcttcgtaataacgttactaatcctatcgaaaaaaaacacaataaatcaaaacccgactcgaaaaccttaacaaaaaccccgcacgctcaaacccgacccgcccctccgcacccgcaacacgccgataacgtcgccgacctcgtccaactccatatcgccctccgtcgccaaaatacgctacacgatctacaaaacgttaattaccataataacatcgccgcaaacaaacatataaccccgctcgaaacacaacacgcgataacctccgcaaccaactccgtcctcaaaatatcctacacgtaaatctacgaaacgacgaaattaaacgaacctaataaaaataacgcgaaacgcccgaaactatactaaccctaaacgtaaaatctcgaaacgac

SEQ ID NO: 10447 - DNA, 537 bp, Artificial Sequence
  chemically treated genomic DNA (Homo sapiens) CpG-island No: 10447
gttaggttttttaggggttgttggtgtttgagtcgggagtcgaacgtttagtattgcgtttcgtaattgacgtttttgtaaggaaaagttttgggtgcgtatcggtttgttattttttgggtgcgtagtgattcgaaaatgttttcgtggtagcgttgttgattttgtcggaaaagagtatagtggattagaattcgattcggagattttagtaggaatttcgtacgtttaggttcggttcgttttttcgtattcgtagtacgtcgatgacgtcgtcggtttcgtttagttttatgtcgtttttcgtcgttaggatgcgttgtacggtttgtaggacgttggttgttatggtaatatcgtcgtagataaatatgtggtttcgttcgaggtatagtacgcggtgattttcgtagttagtttcgtttttaggatgttttgtacgtaggtttgcggggcggcggggttaggcgggtttggtgggggtggcgcggggcgttcggggttgtgttggttttggacgtaaagtttcggagcggt

SEQ ID NO: 10448 - DNA, 537 bp, Artificial Sequence
  chemically treated genomic DNA (Homo sapiens) CpG-island No: 10448
accgctccgaaactttacgtccaaaaccaacacaaccccgaacgccccgcgccacccccaccaaacccgcctaaccccgccgccccgcaaacctacgtacaaaacatcctaaaaacgaaactaactacgaaaatcaccgcgtactatacctcgaacgaaaccacatatttatctacgacgatattaccataacaaccaacgtcctacaaaccgtacaacgcatcctaacgacgaaaaacgacataaaactaaacgaaaccgacgacgtcatcgacgtactacgaatacgaaaaaacgaaccgaacctaaacgtacgaaattcctactaaaatctccgaatcgaattctaatccactatactcttttccgacaaaatcaacaacgctaccacgaaaacattttcgaatcactacgcacccaaaaaataacaaaccgatacgcacccaaaacttttccttacaaaaacgtcaattacgaaacgcaatactaaacgttcgactcccgactcaaacaccaacaacccctaaaaaacctaac

SEQ ID NO: 10449 - DNA, 511 bp, Artificial Sequence
  chemically treated genomic DNA (Homo sapiens) CpG-island No: 10449
tttttaatcgagagcgcgttttatttcgcgtattttgaatttatttcgacgtttttttaagaggttgatatataaaagaataataatagcggggtatattggaattacgcgtcgcggcggggcgttcggaaaacggattcgcgttgttttttgggatttgaagtttaaggtttgttttcgcggtagaaacggagttttggagtcgagtgttgtagagagcgtgcgtagacggttgggggttgtagtttttttgttttcggtttcgggtattgcggggagatttagtcgttttaggattataagttttagaaggttttgcgcgggtagacggggcggggttggaggtttaggtgtcgttttttttgtaacgtcggggttagagttttaaaatcgagggttcgtaggttttcgcggtcgtcgcgatgtagaaatacgagaaattggaaaagattggggaaggtaatggaatttcgagatgtttttgtaagagtttttttgtagatttttcggt

SEQ ID NO: 10450 - DNA, 511 bp, Artificial Sequence
  chemically treated genomic DNA (Homo sapiens) CpG-island No: 10450
accgaaaaatctacaaaaaaactcttacaaaaacatctcgaaattccattaccttccccaatcttttccaatttctcgtatttctacatcgcgacgaccgcgaaaacctacgaaccctcgattttaaaactctaaccccgacgttacaaaaaaaacgacacctaaacctccaaccccgccccgtctacccgcgcaaaaccttctaaaacttataatcctaaaacgactaaatctccccgcaatacccgaaaccgaaaacaaaaaaactacaacccccaaccgtctacgcacgctctctacaacactcgactccaaaactccgtttctaccgcgaaaacaaaccttaaacttcaaatcccaaaaaacaacgcgaatccgttttccgaacgccccgccgcgacgcgtaattccaatataccccgctattattattcttttatatatcaacctcttaaaaaaacgtcgaaataaattcaaaatacgcgaaataaaacgcgctctcgattaaaaa

SEQ ID NO: 10451 - DNA, 511 bp, Artificial Sequence
  chemically treated genomic DNA (Homo sapiens) CpG-island No: 10451
gtcgaaggatttgtagaggagtttttgtaggaatatttcgagattttattattttttttaattttttttagtttttcgtatttttgtatcgcggcggtcgcggggatttgcgggttttcggttttaagattttggtttcggcgttgtagaggaggcggtatttgagtttttagtttcgtttcgtttgttcgcgtagggttttttggggtttgtagttttaaaacgattaggttttttcgtaatgttcgagatcgaggataagaagattataatttttagtcgtttgcgtacgttttttgtagtattcgattttagggtttcgtttttatcgcggaggtaaattttggattttaagttttaggaagtaacgcgagttcgtttttcgggcgtttcgtcgcggcgcgtggttttagtgtgtttcgttgttgttatttttttatgtgttagttttttgaaagggcgtcgggataggtttagaatgcgcgaaatggggcgcgttttcggttagggg

SEQ ID NO: 10452 - DNA, 511 bp, Artificial Sequence
  chemically treated genomic DNA (Homo sapiens) CpG-island No: 10452
cccctaaccgaaaacgcgccccatttcgcgcattctaaacctatcccgacgccctttcaaaaaactaacacataaaaaaataacaacaacgaaacacactaaaaccacgcgccgcgacgaaacgcccgaaaaacgaactcgcgttacttcctaaaacttaaaatccaaaatttacctccgcgataaaaacgaaaccctaaaatcgaatactacaaaaaacgtacgcaaacgactaaaaattataatcttcttatcctcgatctcgaacattacgaaaaaacctaatcgttttaaaactacaaaccccaaaaaaccctacgcgaacaaacgaaacgaaactaaaaactcaaataccgcctcctctacaacgccgaaaccaaaatcttaaaaccgaaaacccgcaaatccccgcgaccgccgcgatacaaaaatacgaaaaactaaaaaaaattaaaaaaaataataaaatctcgaaatattcctacaaaaactcctctacaaatccttcgac

SEQ ID NO: 10453 - DNA, 510 bp, Artificial Sequence
  chemically treated genomic DNA (Homo sapiens) CpG-island No: 10453
tttatttcgcggaggattaatttcgcgttttttttggaagtttttttaagtttttcggcgtgtttgattttagatttcgttcggaattcgagattttacgttttttatttttattttttattattttttttattttttcgtttttcgaagtcgtagagggtacggcgatttcggttcgatcggggtttgggcggcggggtgggcgcggttacggtcgggggaatttatcgttcggtttttttagttttatcgcggtttttcggatttttcgggcgggaggcgcggaggtcgtaggtatttgaagtattttttttttttcgtcgtcgcgttcggggtattgtggaatttgtagttcggcgtcgcgttgttttcgtttttcgttttgcgatttacgtgtggggttttattcgcggttttttgcgtttgtagatcgcgaaggggttggcgggggcggttttgggggttgtgttattttttagaggtttggcggtataggttcgtttttttttt

SEQ ID NO: 10454 - DNA, 510 bp, Artificial Sequence
  chemically treated genomic DNA (Homo sapiens) CpG-island No: 10454
aaaaaaaaaacgaacctataccgccaaacctctaaaaaataacacaacccccaaaaccgcccccgccaaccccttcgcgatctacaaacgcaaaaaaccgcgaataaaaccccacacgtaaatcgcaaaacgaaaaacgaaaacaacgcgacgccgaactacaaattccacaataccccgaacgcgacgacgaaaaaaaaaaaatacttcaaatacctacgacctccgcgcctcccgcccgaaaaatccgaaaaaccgcgataaaactaaaaaaaccgaacgataaattcccccgaccgtaaccgcgcccaccccgccgcccaaaccccgatcgaaccgaaatcgccgtaccctctacgacttcgaaaaacgaaaaaataaaaaaaataataaaaaataaaaataaaaaacgtaaaatctcgaattccgaacgaaatctaaaatcaaacacgccgaaaaacttaaaaaaacttccaaaaaaaacgcgaaattaatcctccgcgaaataaa

SEQ ID NO: 10455 - DNA, 510 bp, Artificial Sequence
  chemically treated genomic DNA (Homo sapiens) CpG-island No: 10455
ggggagggggcggatttgtgtcgttaaatttttagggggtagtataatttttaaaatcgttttcgttagttttttcgcgatttgtaggcgtagagaatcgcgggtggagttttatacgtgggtcgtagggcggagggcggggatagcgcggcgtcggattataagttttataatgtttcgggcgcggcggcggggaaggaggggtgttttaggtgtttgcgattttcgcgtttttcgttcggaagattcgaggggtcgcgatggagttgggggagtcgggcggtgagttttttcggtcgtgatcgcgtttatttcgtcgtttaggtttcggtcgggtcgggatcgtcgtgttttttgcggtttcggggggcgggaaggtgggaggggtgatgagaggtgggggtggggaacgtgaagtttcggatttcgggcgggatttggggttaggtacgtcggggggtttggagagatttttagaggaggcgcggagttagtttttcgcggagtggg

SEQ ID NO: 10456 - DNA, 510 bp, Artificial Sequence
  chemically treated genomic DNA (Homo sapiens) CpG-island No: 10456
cccactccgcgaaaaactaactccgcgcctcctctaaaaatctctccaaaccccccgacgtacctaaccccaaatcccgcccgaaatccgaaacttcacgttccccacccccacctctcatcacccctcccaccttcccgccccccgaaaccgcaaaaaacacgacgatcccgacccgaccgaaacctaaacgacgaaataaacgcgatcacgaccgaaaaaactcaccgcccgactcccccaactccatcgcgacccctcgaatcttccgaacgaaaaacgcgaaaatcgcaaacacctaaaacacccctccttccccgccgccgcgcccgaaacattataaaacttataatccgacgccgcgctatccccgccctccgccctacgacccacgtataaaactccacccgcgattctctacgcctacaaatcgcgaaaaaactaacgaaaacgattttaaaaattatactaccccctaaaaatttaacgacacaaatccgccccctcccc

SEQ ID NO: 10457 - DNA, 732 bp, Artificial Sequence
  chemically treated genomic DNA (Homo sapiens) CpG-island No: 10457
ggtcgcgattggtgtttcggggcgcgaggttgggaaagtgtttaagtttcgcgttgtaggaggagagcggggagcggcgggtttgcgggatttcgggttgtagtttgttcggttgtatcgtcgggagaagttgggtttgagaggagggagggttcgagcggtgttgggttttgggcgagggagagggggcgatatttttcgaattttgttaagttgtttggcgttttcggtatttcgtgggagtggcgtcgtcgataggtgagcgatgcgcgaggtagtttgcggttacgttgaagttgggttgttgcgtttagagtgcgatagatgtggggttgcgggagcgtgggtagttgggtttagataggagcgcgtatatcgagaatagttaggtcgaagcgtttagaggcgtaaaggtttcgcgttttttttttagttcgtttattggttttcgattaagttttgtagagttggaatttcgattattgattttagtcgaacggttgttttgaaagtcggggtttggaagaaagggttgcggggtcggggatttagggtgcgcgcgtttataaacgtttttttttattttttgtggttattcgggtcgtcgcggggacggtttcggagaagggtcgtcgattcgggttcggggatttgcggcgtagtagcgtttggcgtttggtatttttatttaagttgtttttaggtggtcgtttagggatttttagagttttg

SEQ ID NO: 10458 - DNA, 732 bp, Artificial Sequence
  chemically treated genomic DNA (Homo sapiens) CpG-island No: 10458
caaaactctaaaaatccctaaacgaccacctaaaaacaacttaaataaaaataccaaacgccaaacgctactacgccgcaaatccccgaacccgaatcgacgacccttctccgaaaccgtccccgcgacgacccgaataaccacaaaaaataaaaaaaaacgtttataaacgcgcgcaccctaaatccccgaccccgcaaccctttcttccaaaccccgactttcaaaacaaccgttcgactaaaatcaataatcgaaattccaactctacaaaacttaatcgaaaaccaataaacgaactaaaaaaaaaacgcgaaacctttacgcctctaaacgcttcgacctaactattctcgatatacgcgctcctatctaaacccaactacccacgctcccgcaaccccacatctatcgcactctaaacgcaacaacccaacttcaacgtaaccgcaaactacctcgcgcatcgctcacctatcgacgacgccactcccacgaaataccgaaaacgccaaacaacttaacaaaattcgaaaaatatcgccccctctccctcgcccaaaacccaacaccgctcgaaccctccctcctctcaaacccaacttctcccgacgatacaaccgaacaaactacaacccgaaatcccgcaaacccgccgctccccgctctcctcctacaacgcgaaacttaaacactttcccaacctcgcgccccgaaacaccaatcgcgacc

SEQ ID NO: 10459 - DNA, 732 bp, Artificial Sequence
  chemically treated genomic DNA (Homo sapiens) CpG-island No: 10459
tagggttttgaggatttttgagcgattatttgggaataatttgggtggaggtgttagacgttaagcgttgttgcgtcgtaagttttcgagttcgggtcggcggttttttttcggggtcgttttcgcggcgattcgaatggttatagagggtgggaaagggcgtttgtgagcgcgcgtattttggattttcgatttcgtagtttttttttttaggtttcggtttttaggataatcgttcgattagggttagtggtcggggttttagttttgtagagtttagtcgggagttagtaggcgaattggagagaggacgcgagatttttgcgtttttggacgtttcggtttggttgttttcggtgtacgcgtttttgtttagatttaattatttacgttttcgtagttttatatttatcgtattttgagcgtagtaatttagttttagcgtggtcgtaggttgtttcgcgtatcgtttatttgtcggcggcgttatttttacggggtgtcggaggcgttagataatttggtagggttcgggagatgtcgttttttttttttcgtttagaatttagtatcgttcggattttttttttttttaagtttagtttttttcgacggtgtagtcggataagttgtagttcggagtttcgtaaattcgtcgtttttcgttttttttttgtagcgcgggatttggatatttttttagtttcgcgtttcggggtattagtcgcggtt

SEQ ID NO: 10460 - DNA, 732 bp, Artificial Sequence
  chemically treated genomic DNA (Homo sapiens) CpG-island No: 10460
aaccgcgactaataccccgaaacgcgaaactaaaaaaatatccaaatcccgcgctacaaaaaaaaaacgaaaaacgacgaatttacgaaactccgaactacaacttatccgactacaccgtcgaaaaaaactaaacttaaaaaaaaaaaaaatccgaacgatactaaattctaaacgaaaaaaaaaaaacgacatctcccgaaccctaccaaattatctaacgcctccgacaccccgtaaaaataacgccgccgacaaataaacgatacgcgaaacaacctacgaccacgctaaaactaaattactacgctcaaaatacgataaatataaaactacgaaaacgtaaataattaaatctaaacaaaaacgcgtacaccgaaaacaaccaaaccgaaacgtccaaaaacgcaaaaatctcgcgtcctctctccaattcgcctactaactcccgactaaactctacaaaactaaaaccccgaccactaaccctaatcgaacgattatcctaaaaaccgaaacctaaaaaaaaaaactacgaaatcgaaaatccaaaatacgcgcgctcacaaacgccctttcccaccctctataaccattcgaatcgccgcgaaaacgaccccgaaaaaaaaccgccgacccgaactcgaaaacttacgacgcaacaacgcttaacgtctaacacctccacccaaattattcccaaataatcgctcaaaaatcctcaaaacccta

SEQ ID NO: 10461 - DNA, 703 bp, Artificial Sequence
  chemically treated genomic DNA (Homo sapiens) CpG-island No: 10461
atcggttcggttttaattttttatcgattcgggttttattttggtttcgttttttttttcgcgcgttcgtttcggttttttttcgtcgttttattttcgttcggtagtattttttttagatgtaatttttttgagttattttttttttttttggtaaggtttttttcgttttttttcgttttcgttttttttcgcgggtatttttagtttagagcgtttcgttttattggcggtcggtttaaggggacgttttggcgttcggaagtttttcgtttcgcggttcgttagggtttcgttcggttcgttatttttttttcgtttcgtgtagtagggagttttttaaataaagagcgggtttgggcgggcgtagcgcgttatcgtttcgggatttcgttcgttgtttttcggtttcgcgggcggtttacggcgaggtaagcgcggttaggcgggcgtggggcgggggttataaatttggggtcgttgggcggagttgggagcgcggcggggttcgcgggtcggggtgcgttcgggaaggggttaggagagcgggtttttttcgcgttttttcggtgttttcggttttgtcgcggtttgggcgttttcgatcgcggattgtcgggtatttttcggttttgtatttttttgttcgtttttttatttttaatttttattatcgggggtcggtttaggggcggggacgtta

SEQ ID NO: 10462 - DNA, 703 bp, Artificial Sequence
  chemically treated genomic DNA (Homo sapiens) CpG-island No: 10462
taacgtccccgcccctaaaccgacccccgataataaaaattaaaaataaaaaaacgaacaaaaaaatacaaaaccgaaaaatacccgacaatccgcgatcgaaaacgcccaaaccgcgacaaaaccgaaaacaccgaaaaaacgcgaaaaaaacccgctctcctaaccccttcccgaacgcaccccgacccgcgaaccccgccgcgctcccaactccgcccaacgaccccaaatttataacccccgccccacgcccgcctaaccgcgcttacctcgccgtaaaccgcccgcgaaaccgaaaaacaacgaacgaaatcccgaaacgataacgcgctacgcccgcccaaacccgctctttatttaaaaaactccctactacacgaaacgaaaaaaaaataacgaaccgaacgaaaccctaacgaaccgcgaaacgaaaaacttccgaacgccaaaacgtccccttaaaccgaccgccaataaaacgaaacgctctaaactaaaaatacccgcgaaaaaaaacgaaaacgaaaaaaaacgaaaaaaaccttaccaaaaaaaaaaaaaataactcaaaaaaattacatctaaaaaaaatactaccgaacgaaaataaaacgacgaaaaaaaaccgaaacgaacgcgcgaaaaaaaaaacgaaaccaaaataaaacccgaatcgataaaaaattaaaaccgaaccgat

SEQ ID NO: 10463 - DNA, 703 bp, Artificial Sequence
  chemically treated genomic DNA (Homo sapiens) CpG-island No: 10463
tggcgttttcgtttttgggtcggttttcgatggtgggggttagggatgggaaggcgggtaggaaggtgtagagtcgggaggtgttcggtagttcgcggtcgggggcgtttaggtcgcggtagggtcgagagtatcggaggggcgcggaggggattcgtttttttggttttttttcgggcgtatttcggttcgcgagtttcgtcgcgtttttaatttcgtttaacggttttaagtttgtggttttcgttttacgttcgtttagtcgcgtttatttcgtcgtgggtcgttcgcggggtcgaagggtaacgagcggggtttcggggcggtggcgcgttgcgttcgtttaagttcgttttttgtttgggaggttttttattatacggggcgggggaagaatggcgggtcgggcggaattttgacgagtcgcggggcggaaagttttcggacgttaaggcgtttttttggatcggtcgttagtagggcggggcgttttgagttgaaaatattcgcgggagggggcgagagcggggaggggcgggaggaattttattagggggggagggagtagtttaggaggattgtatttggagggagtgttgtcgggcgggagtgagacggcgaggggaggtcgaggcgagcgcgcgggaggaggaacgagattaaggtggagttcgggtcggtggaaggttggggtcgggtcggt

SEQ ID NO: 10464 - DNA, 703 bp, Artificial Sequence
  chemically treated genomic DNA (Homo sapiens) CpG-island No: 10464
accgacccgaccccaaccttccaccgacccgaactccaccttaatctcgttcctcctcccgcgcgctcgcctcgacctcccctcgccgtctcactcccgcccgacaacactccctccaaatacaatcctcctaaactactccctccccccctaataaaattcctcccgcccctccccgctctcgccccctcccgcgaatattttcaactcaaaacgccccgccctactaacgaccgatccaaaaaaacgccttaacgtccgaaaactttccgccccgcgactcgtcaaaattccgcccgacccgccattcttcccccgccccgtataataaaaaacctcccaaacaaaaaacgaacttaaacgaacgcaacgcgccaccgccccgaaaccccgctcgttacccttcgaccccgcgaacgacccacgacgaaataaacgcgactaaacgaacgtaaaacgaaaaccacaaacttaaaaccgttaaacgaaattaaaaacgcgacgaaactcgcgaaccgaaatacgcccgaaaaaaaaccaaaaaaacgaatcccctccgcgcccctccgatactctcgaccctaccgcgacctaaacgcccccgaccgcgaactaccgaacacctcccgactctacaccttcctacccgccttcccatccctaacccccaccatcgaaaaccgacccaaaaacgaaaacgcca

SEQ ID NO: 10465 - DNA, 504 bp, Artificial Sequence
  chemically treated genomic DNA (Homo sapiens) CpG-island No: 10465
cgtacgtaatttcgggcgtggggatttttttttgttttcggcgttcggttcgtgttgcgtttttagagcggagcgtttcgtagtttcgcgttatttcggcgttcgtatcgggattcgggcgcggagtttggggacgacggggggcgttttaggtgggtttcgggttttcgtttcgcgcgttcgggtttgggcgatttttgggcgggtatacggtcggtcggggaggagcgcggaggaggaggaaagcgcgagaagcggtttgtcgggggagggtcgtcgcgtcgtcgtcgtcgcgcgtcgttgtcggggatcgtaggcggacgcgcgtcgacggcggagcggagagaggtttagcgtaggagtcgcggcgtcgagcggtaggttcgtcggcggtagcgttcgtcgcgcggatggagagatagagagataagaacgcgtttgcggtacgcgatatcgcgtcgggattacgcgttttttcggtttcggacgtttaggtaagtaacg

SEQ ID NO: 10466 - DNA, 504 bp, Artificial Sequence
  chemically treated genomic DNA (Homo sapiens) CpG-island No: 10466
cgttacttacctaaacgtccgaaaccgaaaaaacgcgtaatcccgacgcgatatcgcgtaccgcaaacgcgttcttatctctctatctctccatccgcgcgacgaacgctaccgccgacgaacctaccgctcgacgccgcgactcctacgctaaacctctctccgctccgccgtcgacgcgcgtccgcctacgatccccgacaacgacgcgcgacgacgacgacgcgacgaccctcccccgacaaaccgcttctcgcgctttcctcctcctccgcgctcctccccgaccgaccgtatacccgcccaaaaatcgcccaaacccgaacgcgcgaaacgaaaacccgaaacccacctaaaacgccccccgtcgtccccaaactccgcgcccgaatcccgatacgaacgccgaaataacgcgaaactacgaaacgctccgctctaaaaacgcaacacgaaccgaacgccgaaaacaaaaaaaaatccccacgcccgaaattacgtacg

SEQ ID NO: 10467 - DNA, 504 bp, Artificial Sequence
  chemically treated genomic DNA (Homo sapiens) CpG-island No: 10467
cgttatttgtttgggcgttcggagtcgagggagcgcgtggtttcggcgcggtgtcgcgtgtcgtaagcgcgtttttgtttttttgtttttttattcgcgcggcggacgttgtcgtcggcggatttgtcgttcggcgtcgcgatttttgcgttaagttttttttcgtttcgtcgtcggcgcgcgttcgtttacgattttcggtagcggcgcgcggcggcggcggcgcggcgattttttttcggtaggtcgtttttcgcgttttttttttttttcgcgttttttttcggtcggtcgtgtattcgtttaggggtcgtttaggttcgggcgcgcggggcggggattcgagatttatttggggcgtttttcgtcgtttttaggtttcgcgttcgggtttcggtacgggcgtcgggatagcgcggggttgcgggacgtttcgttttggaggcgtagtacgggtcgggcgtcgggggtaggaaagggtttttacgttcgaaattgcgtgcg

SEQ ID NO: 10468 - DNA, 504 bp, Artificial Sequence
  chemically treated genomic DNA (Homo sapiens) CpG-island No: 10468
cgcacgcaatttcgaacgtaaaaaccctttcctacccccgacgcccgacccgtactacgcctccaaaacgaaacgtcccgcaaccccgcgctatcccgacgcccgtaccgaaacccgaacgcgaaacctaaaaacgacgaaaaacgccccaaataaatctcgaatccccgccccgcgcgcccgaacctaaacgacccctaaacgaatacacgaccgaccgaaaaaaaacgcgaaaaaaaaaaaaaacgcgaaaaacgacctaccgaaaaaaaatcgccgcgccgccgccgccgcgcgccgctaccgaaaatcgtaaacgaacgcgcgccgacgacgaaacgaaaaaaaacttaacgcaaaaatcgcgacgccgaacgacaaatccgccgacgacaacgtccgccgcgcgaataaaaaaacaaaaaaacaaaaacgcgcttacgacacgcgacaccgcgccgaaaccacgcgctccctcgactccgaacgcccaaacaaataacg

SEQ ID NO: 10469 - DNA, 613 bp, Artificial Sequence
  chemically treated genomic DNA (Homo sapiens) CpG-island No: 10469
ttgcgcgtttaggtcggtttaggtagcggtttcgagtgtttcgcgcgtttaggacggtttaggtgcggggaggtcggtttagcgttcgtttttgtttttttaggggttcgtttcgggtcgtcgtttttatcgtttttaacggagtttcgttttttttcgcgtttaagacggttttattttgtaggacgtcgttttcggtttgtacgtcggaaagttgggagcggcggggagttacgagggtgtttttatttatcgggtgtttaggggacggttcggggcgtatagttagcgcgggttgtgtttttttttattcgcgtagggcgcgcgagttcgaggcgtaagtttcggacgtcggtttttattttgaagaagtttcggagaatgtgtacgacgttgagtatggtggtcgtcgggacgttcgggagttcggtcgtagtattacgagtcgcgtcgtcgagtcggttttatcgacgttatttcgcgtttcgttttagggttcgttttcgcgttttcgttcggacgtttcgttttcgtaaatttggttattggaggtacgtgaggtttaggtttttgtttgttcgtttttgggttttggttagtcgcgggattgggt

SEQ ID NO: 10470 - DNA, 613 bp, Artificial Sequence
  chemically treated genomic DNA (Homo sapiens) CpG-island No: 10470
acccaatcccgcgactaaccaaaacccaaaaacgaacaaacaaaaacctaaacctcacgtacctccaataaccaaatttacgaaaacgaaacgtccgaacgaaaacgcgaaaacgaaccctaaaacgaaacgcgaaataacgtcgataaaaccgactcgacgacgcgactcgtaatactacgaccgaactcccgaacgtcccgacgaccaccatactcaacgtcgtacacattctccgaaacttcttcaaaataaaaaccgacgtccgaaacttacgcctcgaactcgcgcgccctacgcgaataaaaaaaaacacaacccgcgctaactatacgccccgaaccgtcccctaaacacccgataaataaaaacaccctcgtaactccccgccgctcccaactttccgacgtacaaaccgaaaacgacgtcctacaaaataaaaccgtcttaaacgcgaaaaaaaacgaaactccgttaaaaacgataaaaacgacgacccgaaacgaacccctaaaaaaacaaaaacgaacgctaaaccgacctccccgcacctaaaccgtcctaaacgcgcgaaacactcgaaaccgctacctaaaccgacctaaacgcgcaa

SEQ ID NO: 10471 - DNA, 613 bp, Artificial Sequence
  chemically treated genomic DNA (Homo sapiens) CpG-island No: 10471
gtttagtttcgcggttgattaaagtttaggggcgggtaggtaggagtttggattttacgtgtttttagtggttaggtttgcgggggcggagcgttcgggcgagggcgcgggggcggattttagggcggggcgcggggtggcgtcggtggagtcggttcggcggcgcggttcgtagtgttgcggtcgggttttcgggcgtttcggcggttattatgtttagcgtcgtgtatatttttcggagtttttttaaggtgagagtcggcgttcgggatttgcgtttcgggttcgcgcgttttgcgcgggtggggaggagtatagttcgcgttggttgtgcgtttcgggtcgttttttgggtattcggtgggtggggatattttcgtggtttttcgtcgtttttaatttttcgacgtgtagatcggaggcggcgttttgtaaagtggggtcgttttgagcgcggggaaggacggggtttcgttgggggcggtagggacggcggttcggggcgagtttttgagagggtaagggcgagcgttgagtcggttttttcgtatttggatcgttttgggcgcgcggggtattcggagtcgttgtttggatcggtttgggcgcgtag

SEQ ID NO: 10472 - DNA, 613 bp, Artificial Sequence
  chemically treated genomic DNA (Homo sapiens) CpG-island No: 10472
ctacgcgcccaaaccgatccaaacaacgactccgaataccccgcgcgcccaaaacgatccaaatacgaaaaaaccgactcaacgctcgcccttaccctctcaaaaactcgccccgaaccgccgtccctaccgcccccaacgaaaccccgtccttccccgcgctcaaaacgaccccactttacaaaacgccgcctccgatctacacgtcgaaaaattaaaaacgacgaaaaaccacgaaaatatccccacccaccgaatacccaaaaaacgacccgaaacgcacaaccaacgcgaactatactcctccccacccgcgcaaaacgcgcgaacccgaaacgcaaatcccgaacgccgactctcaccttaaaaaaactccgaaaaatatacacgacgctaaacataataaccgccgaaacgcccgaaaacccgaccgcaacactacgaaccgcgccgccgaaccgactccaccgacgccaccccgcgccccgccctaaaatccgcccccgcgccctcgcccgaacgctccgcccccgcaaacctaaccactaaaaacacgtaaaatccaaactcctacctacccgcccctaaactttaatcaaccgcgaaactaaac

SEQ ID NO: 10473 - DNA, 698 bp, Artificial Sequence
  chemically treated genomic DNA (Homo sapiens) CpG-island No: 10473
agattgtcgtcgatggtataaatgcgtcgtttaaatgtcgttcgcgttgttataaatatttcgtcgagtaatagtaacgttagtagtagaataggagtgggaacgttacggtaattatttaatagttagattgcgtttaatacgatgatagcggttaaagtttggcgatcgattattgcggtagaggtcggagattgtaaatttaaagtttgacggcgtattttttcgcgttattgttaattaataaaagttattaagttaagcgcgttaatgatgaagtcggtattggcggggagatagttttgtttaatttgtgatatcgcggcgttggtgggggatatagtcgtgtcgttggtgatgttaatgagtatgtcgcgaaatgttaatatgttcgcgagggtgataataaatgaagggattttacggtacgcgatttattattcgttttaggtatcgagaagtagttttagaattagcgttataatgatggtaagtggtaaaggttagtttaattagacgttataaatcgtcgcgacgttatttaatagttttattattgagttcgcgggaaaggtcgattttagtagaaattttgacgaatattatttttatcgcgaggatgttcggtaatcgcggttttgcgttaataggttggagaatttacgggcggtttaagtgggtaatattggtgggttagg

SEQ ID NO: 10474 - DNA, 698 bp, Artificial Sequence
  chemically treated genomic DNA (Homo sapiens) CpG-island No: 10474
cctaacccaccaatattacccacttaaaccgcccgtaaattctccaacctattaacgcaaaaccgcgattaccgaacatcctcgcgataaaaataatattcgtcaaaatttctactaaaatcgacctttcccgcgaactcaataataaaactattaaataacgtcgcgacgatttataacgtctaattaaactaacctttaccacttaccatcattataacgctaattctaaaactacttctcgatacctaaaacgaataataaatcgcgtaccgtaaaatcccttcatttattatcaccctcgcgaacatattaacatttcgcgacatactcattaacatcaccaacgacacgactatatcccccaccaacgccgcgatatcacaaattaaacaaaactatctccccgccaataccgacttcatcattaacgcgcttaacttaataacttttattaattaacaataacgcgaaaaaatacgccgtcaaactttaaatttacaatctccgacctctaccgcaataatcgatcgccaaactttaaccgctatcatcgtattaaacgcaatctaactattaaataattaccgtaacgttcccactcctattctactactaacgttactattactcgacgaaatatttataacaacgcgaacgacatttaaacgacgcatttataccatcgacgacaatct

SEQ ID NO: 10475 - DNA, 698 bp, Artificial Sequence
  chemically treated genomic DNA (Homo sapiens) CpG-island No: 10475
tttggtttattaatgttgtttatttaaatcgttcgtaagttttttaatttgttaacgtaggatcgcgattatcgggtattttcgcggtaggaatggtgttcgttaaaatttttgttgaaatcgatttttttcgcgggtttaatgatggggttgttaggtggcgtcgcggcgatttgtaacgtttggttaggttggtttttgttatttattattattgtgacgttggttttgggattgtttttcggtgtttggaacggatggtgggtcgcgtatcgtaaagtttttttatttattgttattttcgcgggtatgttggtatttcgcggtatatttattggtattattaacggtacgattgtattttttattagcgtcgcgatgttataaattgggtaaagttattttttcgttagtatcggttttattattggcgcgtttggtttaatggtttttgttggttggtaatggcgcggaagaatgcgtcgttaggttttgggtttatagttttcggtttttatcgtagtagtcggtcgttaggttttaatcgttattatcgtattaggcgtaatttggttgttgaatgattatcgtggcgtttttatttttgttttgttgttgacgttgttgttattcggcggaatgtttatggtaacgcggacggtatttggacgacgtatttatgttatcggcggtaattt

SEQ ID NO: 10476 - DNA, 698 bp, Artificial Sequence
  chemically treated genomic DNA (Homo sapiens) CpG-island No: 10476
aaattaccgccgataacataaatacgtcgtccaaataccgtccgcgttaccataaacattccgccgaataacaacaacgtcaacaacaaaacaaaaataaaaacgccacgataatcattcaacaaccaaattacgcctaatacgataataacgattaaaacctaacgaccgactactacgataaaaaccgaaaactataaacccaaaacctaacgacgcattcttccgcgccattaccaaccaacaaaaaccattaaaccaaacgcgccaataataaaaccgatactaacgaaaaaataactttacccaatttataacatcgcgacgctaataaaaaatacaatcgtaccgttaataataccaataaatataccgcgaaataccaacatacccgcgaaaataacaataaataaaaaaactttacgatacgcgacccaccatccgttccaaacaccgaaaaacaatcccaaaaccaacgtcacaataataataaataacaaaaaccaacctaaccaaacgttacaaatcgccgcgacgccacctaacaaccccatcattaaacccgcgaaaaaaatcgatttcaacaaaaattttaacgaacaccattcctaccgcgaaaatacccgataatcgcgatcctacgttaacaaattaaaaaacttacgaacgatttaaataaacaacattaataaaccaaa

SEQ ID NO: 10477 - DNA, 529 bp, Artificial Sequence
  chemically treated genomic DNA (Homo sapiens) CpG-island No: 10477
ggaattgggagtggcgggcggggaggacgcgggttgtgtgacgattatcgataattagttggtggttaacgtataagtaggataaaagagttcgttttaggttgttagtagaaaaaagttatcgtggtacgtgtttcggggagtgatgcggtggttcggtttgtacggagagcgggatatcgtttggggagtcgcgttcgtagtttgggggcgggacgcggcggtcgtttttttcgttttcgagtagttgttatcgtttggttgcgttttagtttagtagtttagacgcggtcgtatttcggtggattgtagaggcggtagcgagttagagttcgagtcgtagtttcgggtcgtagagcgttgggcgagcgcgagcgttagggtatcggtagggtaggtagttgcgcgcggttggtacgtatttggtggagcgggcgcgtgagtgggtgtttttatgcgaggagggaggagtgggatttgggaagtcgggggagattgatttagggaagatgtggtaagtgtaattttt

SEQ ID NO: 10478 - DNA, 529 bp, Artificial Sequence
  chemically treated genomic DNA (Homo sapiens) CpG-island No: 10478
aaaaattacacttaccacatcttccctaaatcaatctcccccgacttcccaaatcccactcctccctcctcgcataaaaacacccactcacgcgcccgctccaccaaatacgtaccaaccgcgcgcaactacctaccctaccgataccctaacgctcgcgctcgcccaacgctctacgacccgaaactacgactcgaactctaactcgctaccgcctctacaatccaccgaaatacgaccgcgtctaaactactaaactaaaacgcaaccaaacgataacaactactcgaaaacgaaaaaaacgaccgccgcgtcccgcccccaaactacgaacgcgactccccaaacgatatcccgctctccgtacaaaccgaaccaccgcatcactccccgaaacacgtaccacgataacttttttctactaacaacctaaaacgaactcttttatcctacttatacgttaaccaccaactaattatcgataatcgtcacacaacccgcgtcctccccgcccgccactcccaattcc

SEQ ID NO: 10479 - DNA, 529 bp, Artificial Sequence
  chemically treated genomic DNA (Homo sapiens) CpG-island No: 10479
gaaagttgtatttattatattttttttgggttagtttttttcgattttttaagttttattttttttttttcgtatagggatatttatttacgcgttcgttttattaggtacgtattagtcgcgcgtagttgtttgttttgtcggtgttttggcgttcgcgttcgtttagcgttttgcggttcggagttgcgattcgggttttagttcgttgtcgtttttatagtttatcgggatgcggtcgcgtttgagttattgggttggggcgtagttaggcggtggtagttattcgggggcggagggagcggtcgtcgcgtttcgtttttaggttacgagcgcggttttttaggcggtgtttcgtttttcgtgtaaatcgggttatcgtattatttttcggggtacgtgttacggtagtttttttttgttggtagtttggggcgagtttttttattttatttgtgcgttaattattaattaattatcggtgatcgttatataattcgcgtttttttcgttcgttatttttagtttt

SEQ ID NO: 10480 - DNA, 529 bp, Artificial Sequence
  chemically treated genomic DNA (Homo sapiens) CpG-island No: 10480
aaaactaaaaataacgaacgaaaaaaacgcgaattatataacgatcaccgataattaattaataattaacgcacaaataaaataaaaaaactcgccccaaactaccaacaaaaaaaaactaccgtaacacgtaccccgaaaaataatacgataacccgatttacacgaaaaacgaaacaccgcctaaaaaaccgcgctcgtaacctaaaaacgaaacgcgacgaccgctccctccgcccccgaataactaccaccgcctaactacgccccaacccaataactcaaacgcgaccgcatcccgataaactataaaaacgacaacgaactaaaacccgaatcgcaactccgaaccgcaaaacgctaaacgaacgcgaacgccaaaacaccgacaaaacaaacaactacgcgcgactaatacgtacctaataaaacgaacgcgtaaataaatatccctatacgaaaaaaaaaaaataaaacttaaaaaatcgaaaaaaactaacccaaaaaaaatataataaatacaactttc

SEQ ID NO: 10481 - DNA, 561 bp, Artificial Sequence
  chemically treated genomic DNA (Homo sapiens) CpG-island No: 10481
agtatgtatttcggtaggtacggttacggttataatggtatgattttagcgtcggcgttcggtttcggtattttggtttcggagagcgcgtcgtagtacgttgagcgttagcggttcgcgagtttaggtatagttagtcggttacgtttacgtattttttttagttcgattcgttgtttttttcgtcgtggttttttcgttcggtagcgatagtattacggcgggaaaaattttttaagtaattttagcgcgttttcgacgcggtagtatttatattagtagtagagagggggttggtacggcgttcggagtcgaggaggacgtttttgttagtagcgagtaggcgagtgtagaggatcgagttcgcgtcgtcgtttaattttagatttatttttggatgcgtaattgtatataagttatggtaaagttagtttttttttaaatttacgcgacgcggggacgcggttttcggtttttttttttttttttgtcgtttttttttagttttttttggttttattttttttagttttgcgagtttttttgtcgtttttttttttt

SEQ ID NO: 10482 - DNA, 561 bp, Artificial Sequence
  chemically treated genomic DNA (Homo sapiens) CpG-island No: 10482
aaaaaaaaaaaacgacaaaaaaactcgcaaaactaaaaaaaataaaaccaaaaaaaactaaaaaaaaacgacaaaaaaaaaaaaaaaaaccgaaaaccgcgtccccgcgtcgcgtaaatttaaaaaaaaactaactttaccataacttatatacaattacgcatccaaaaataaatctaaaattaaacgacgacgcgaactcgatcctctacactcgcctactcgctactaacaaaaacgtcctcctcgactccgaacgccgtaccaaccccctctctactactaatataaatactaccgcgtcgaaaacgcgctaaaattacttaaaaaatttttcccgccgtaatactatcgctaccgaacgaaaaaaccacgacgaaaaaaacaacgaatcgaactaaaaaaaatacgtaaacgtaaccgactaactatacctaaactcgcgaaccgctaacgctcaacgtactacgacgcgctctccgaaaccaaaataccgaaaccgaacgccgacgctaaaatcataccattataaccgtaaccgtacctaccgaaatacatact

SEQ ID NO: 10483 - DNA, 561 bp, Artificial Sequence
  chemically treated genomic DNA (Homo sapiens) CpG-island No: 10483
ggggagggagaacggtaaggagattcgtagggttgggagaaatgagattaagagagattgggagagggcggtagagaagagaggggggatcgagagtcgcgttttcgcgtcgcgtggatttagaaaaaggttggttttattatgatttatgtgtagttgcgtatttaggggtagatttggggttgggcggcggcgcgggttcggttttttgtattcgtttgttcgttgttggtaggggcgtttttttcggtttcggacgtcgtgttaattttttttttgttgttgatgtgggtgttgtcgcgtcggaggcgcgttggagttgtttagggagtttttttcgtcgtggtgttgtcgttgtcgggcgagggggttacggcggagagggtagcggatcgggttgaggagagtgcgtggacgtggtcggttggttgtatttgggttcgcgggtcgttggcgtttagcgtattgcggcgcgtttttcggagttaaagtgtcggagtcgagcgtcgacgttgagattatgttattgtagtcgtagtcgtatttgtcggagtgtatgtt

SEQ ID NO: 10484 - DNA, 561 bp, Artificial Sequence
  chemically treated genomic DNA (Homo sapiens) CpG-island No: 10484
aacatacactccgacaaatacgactacgactacaataacataatctcaacgtcgacgctcgactccgacactttaactccgaaaaacgcgccgcaatacgctaaacgccaacgacccgcgaacccaaatacaaccaaccgaccacgtccacgcactctcctcaacccgatccgctaccctctccgccgtaaccccctcgcccgacaacgacaacaccacgacgaaaaaaactccctaaacaactccaacgcgcctccgacgcgacaacacccacatcaacaacaaaaaaaaaattaacacgacgtccgaaaccgaaaaaaacgcccctaccaacaacgaacaaacgaatacaaaaaaccgaacccgcgccgccgcccaaccccaaatctacccctaaatacgcaactacacataaatcataataaaaccaacctttttctaaatccacgcgacgcgaaaacgcgactctcgatcccccctctcttctctaccgccctctcccaatctctcttaatctcatttctcccaaccctacgaatctccttaccgttctccctcccc

SEQ ID NO: 10485 - DNA, 579 bp, Artificial Sequence
  chemically treated genomic DNA (Homo sapiens) CpG-island No: 10485
tcgcggtcgtcgtcggttcgttcgatcgttatcgagaagttgttttttgtcgtcgtagtcgtcgggtgggggaagtttcgttttcggtttcggtagtcgcgtcgttgtagtcgttgttgacgcgtcgtcgttttttttatgtttttgttgagttcgtcggttattaggttcgtcgttgtcgtagagaaatatgacggtgggttcgatttagcgggggtggaggagtacggaggttgttatagttcgagtcgtatggagaagattttagtggcgttgttttaaaaagtttttaagaagtgaagagcgcgcggcggtcgggtagagcggggggcggatcgcggcggggtcgcgttaggcgtcgtttattggttcggttttttcgtttcgtttacggttatgtaaagcgggcggtttcgattttagttttgtacggtgtattcgtcgttttcgtcgcggttcggtcgttttcgcgtatcgcgcgttcgcgattatttattcggggggagcggaggaacgtgcgggtggggtagggaaggaagggcggttttattttcgttttttttttttttttttatttta

SEQ ID NO: 10486 - DNA, 579 bp, Artificial Sequence
  chemically treated genomic DNA (Homo sapiens) CpG-island No: 10486
taaaataaaaaaaaaaaaaaaaaacgaaaataaaaccgcccttccttccctaccccacccgcacgttcctccgctccccccgaataaataatcgcgaacgcgcgatacgcgaaaacgaccgaaccgcgacgaaaacgacgaatacaccgtacaaaactaaaatcgaaaccgcccgctttacataaccgtaaacgaaacgaaaaaaccgaaccaataaacgacgcctaacgcgaccccgccgcgatccgccccccgctctacccgaccgccgcgcgctcttcacttcttaaaaactttttaaaacaacgccactaaaatcttctccatacgactcgaactataacaacctccgtactcctccacccccgctaaatcgaacccaccgtcatatttctctacgacaacgacgaacctaataaccgacgaactcaacaaaaacataaaaaaaacgacgacgcgtcaacaacgactacaacgacgcgactaccgaaaccgaaaacgaaacttcccccacccgacgactacgacgacaaaaaacaacttctcgataacgatcgaacgaaccgacgacgaccgcga

SEQ ID NO: 10487 - DNA, 579 bp, Artificial Sequence
  chemically treated genomic DNA (Homo sapiens) CpG-island No: 10487
tgggataaaggaagggaaggggggcggagatggggtcgtttttttttttttgttttattcgtacgttttttcgtttttttcgggtgaatggtcgcgggcgcgcggtgcgcggggacggtcgggtcgcggcggggacgacgggtgtatcgtgtagagttggagtcggagtcgttcgttttgtatagtcgtgggcggagcgggggggtcgggttaatgggcggcgtttggcgcgatttcgtcgcgattcgtttttcgttttgttcggtcgtcgcgcgttttttattttttgggggttttttaaaatagcgttattggggttttttttatgcggttcgggttatgatagttttcgtgtttttttattttcgttggatcgagtttatcgttatgtttttttacgataacggcgggtttggtggtcgacgagtttaataagaatatggaaggggcggcggcgcgttagtagcggttgtagcggcgcggttgtcggggtcgggggcggggttttttttattcggcggttgcggcggtagggggtaatttttcggtggcggtcgagcgggtcggcggcggtcgcgg

SEQ ID NO: 10488 - DNA, 579 bp, Artificial Sequence
  chemically treated genomic DNA (Homo sapiens) CpG-island No: 10488
ccgcgaccgccgccgacccgctcgaccgccaccgaaaaattaccccctaccgccgcaaccgccgaataaaaaaaaccccgcccccgaccccgacaaccgcgccgctacaaccgctactaacgcgccgccgccccttccatattcttattaaactcgtcgaccaccaaacccgccgttatcgtaaaaaaacataacgataaactcgatccaacgaaaataaaaaaacacgaaaactatcataacccgaaccgcataaaaaaaaccccaataacgctattttaaaaaacccccaaaaaataaaaaacgcgcgacgaccgaacaaaacgaaaaacgaatcgcgacgaaatcgcgccaaacgccgcccattaacccgacccccccgctccgcccacgactatacaaaacgaacgactccgactccaactctacacgatacacccgtcgtccccgccgcgacccgaccgtccccgcgcaccgcgcgcccgcgaccattcacccgaaaaaaacgaaaaaacgtacgaataaaacaaaaaaaaaaaaacgaccccatctccgccccccttcccttcctttatccca

SEQ ID NO: 10489 - DNA, 596 bp, Artificial Sequence
  chemically treated genomic DNA (Homo sapiens) CpG-island No: 10489
gtacggcgtgtataaaaggtttggtgttgtcggtcggggacgagtttgggtcggggtcggagttatttttagagagcgcgttggtttaggtagggtttgtatcgtcgttttcgttttcgtcgtcgtcgtcgtcgttgtgtttattgttttttagggtagaaagcgagggcgttgtgtttatgatttattcgcgcgtatgggagtagcgggggggagggtttcgggaggcgcggggcgggttcggggttgcgcgttcgtttcgggagtaggagtagcgggaggaggaggagttggcgcggcggttacgggcgtttagcgcgttttttcggcgtttggagttagacgcgagtaattttgggtggttcgtagcggagtcgtggtcgggttagaggagtcggttggattgcgggagtgtcgggcggttcgcggtgttcgtttcgggttgtttttttgcgttgcgttttcgcggtttcgcgtcggcgttgcgttttgcgatgcgagtcgttgcgtgtttagtcggggttttggcgaggaaatttattttaaaagtagttgtattaagggggagattaaagtttttgtcgttttttaattaa

SEQ ID NO: 10490 - DNA, 596 bp, Artificial Sequence
  chemically treated genomic DNA (Homo sapiens) CpG-island No: 10490
ttaattaaaaaacgacaaaaactttaatctcccccttaatacaactacttttaaaataaatttcctcgccaaaaccccgactaaacacgcaacgactcgcatcgcaaaacgcaacgccgacgcgaaaccgcgaaaacgcaacgcaaaaaaacaacccgaaacgaacaccgcgaaccgcccgacactcccgcaatccaaccgactcctctaacccgaccacgactccgctacgaaccacccaaaattactcgcgtctaactccaaacgccgaaaaaacgcgctaaacgcccgtaaccgccgcgccaactcctcctcctcccgctactcctactcccgaaacgaacgcgcaaccccgaacccgccccgcgcctcccgaaaccctcccccccgctactcccatacgcgcgaataaatcataaacacaacgccctcgctttctaccctaaaaaacaataaacacaacgacgacgacgacgacgaaaacgaaaacgacgatacaaaccctacctaaaccaacgcgctctctaaaaataactccgaccccgacccaaactcgtccccgaccgacaacaccaaaccttttatacacgccgtac

SEQ ID NO: 10491 - DNA, 596 bp, Artificial Sequence
  chemically treated genomic DNA (Homo sapiens) CpG-island No: 10491
ttgattggaaggcggtaaaggttttaattttttttttggtgtagttgtttttgaagtgagttttttcgttagagtttcggttggatacgtagcggttcgtatcgtagagcgtagcgtcggcgcggggtcgcgagaacgtagcgtaggggagtagttcgaggcggatatcgcgagtcgttcggtattttcgtagtttagtcggtttttttagttcggttacggtttcgttgcgggttatttaggattattcgcgtttggttttaggcgtcgagaaggcgcgttgggcgttcgtggtcgtcgcgttagtttttttttttttcgttgtttttgttttcggggcgagcgcgtagtttcgagttcgtttcgcgtttttcggagttttttttttcgttgtttttatgcgcgcgggtgggttatgagtatagcgttttcgttttttgttttaagaagtagtaagtatagcggcggcggcggcggcggaggcggaggcggcggtgtagattttgtttggattagcgcgttttttggaaatagtttcggtttcggtttaggttcgttttcggtcggtagtattaagttttttgtgtacgtcgtgt

SEQ ID NO: 10492 - DNA, 596 bp, Artificial Sequence
  chemically treated genomic DNA (Homo sapiens) CpG-island No: 10492
acacgacgtacacaaaaaacttaatactaccgaccgaaaacgaacctaaaccgaaaccgaaactatttccaaaaaacgcgctaatccaaacaaaatctacaccgccgcctccgcctccgccgccgccgccgccgctatacttactacttcttaaaacaaaaaacgaaaacgctatactcataacccacccgcgcgcataaaaacaacgaaaaaaaaaactccgaaaaacgcgaaacgaactcgaaactacgcgctcgccccgaaaacaaaaacaacgaaaaaaaaaaaaactaacgcgacgaccacgaacgcccaacgcgccttctcgacgcctaaaaccaaacgcgaataatcctaaataacccgcaacgaaaccgtaaccgaactaaaaaaaccgactaaactacgaaaataccgaacgactcgcgatatccgcctcgaactactcccctacgctacgttctcgcgaccccgcgccgacgctacgctctacgatacgaaccgctacgtatccaaccgaaactctaacgaaaaaactcacttcaaaaacaactacaccaaaaaaaaaattaaaacctttaccgccttccaatcaa

SEQ ID NO: 10493 - DNA, 998 bp, Artificial Sequence
  chemically treated genomic DNA (Homo sapiens) CpG-island No: 10493
ttggcggcggtcgcggtcgggtttttgggttgtagtaagtcggtcggttttagttttttggtcggagcgttttcgtcgttcgtgatgatagttagtttgtgtcgggatttttattgttttagttattattgcgttagttatttggtaggggcggcggtcgttagcgttttttgcgtatatgattcggttgttgcggttgcggcgttgaagttcggatattcgttggtgtattttacgtattcgttgtacggtgtgtatttttcgttaacggtcgtcgcggttgttggcgttatatcgttttttttggtcggttattttttttatttttacggttttatgttttttaacgatttatttttttatatttgtaattgggtgtcggttaacgggtcgtgcgataagcgtttcgttacgttcgaagagttgttgagttatttgcggatttatacggtatttttcgggatagataaattgttgtcgggttattttagttcgtcgtttttggttagcgttgtcgcggtcgttatggtttgttatatgtatatttttatttcgggcgtatcgggtagttttgggacgttggcgttgcgtagtttttattacgcgttgggatttagtagtcgttattatttttattttaagagttcgttttttacgtttggcgttttcgtgtcggtgttcgtcgttatcggatcgtattattttttttacgttttttacggatagagattgattatcgtttcggcgttggggtattagtgagggcggtcgggagggcgagcgagggagaggagggagagggggaggggaggagtttagggagaggcgggattacggtttaggttgttgatattcgcgcgtggggaggattcgggttacgaaaggaaagaaatgtatatcgtatttatttattcgatagtagcgatcgagattcggtgggatattttttttttttttatttttatttttttatttaaattttataaaagttgaaaaaa

SEQ ID NO: 10494 - DNA, 998 bp, Artificial Sequence
  chemically treated genomic DNA (Homo sapiens) CpG-island No: 10494
ttttttcaacttttataaaatttaaataaaaaaataaaaataaaaaaaaaaaaaatatcccaccgaatctcgatcgctactatcgaataaataaatacgatatacatttctttcctttcgtaacccgaatcctccccacgcgcgaatatcaacaacctaaaccgtaatcccgcctctccctaaactcctcccctccccctctccctcctctccctcgctcgccctcccgaccgccctcactaataccccaacgccgaaacgataatcaatctctatccgtaaaaaacgtaaaaaaaataatacgatccgataacgacgaacaccgacacgaaaacgccaaacgtaaaaaacgaactcttaaaataaaaataataacgactactaaatcccaacgcgtaataaaaactacgcaacgccaacgtcccaaaactacccgatacgcccgaaataaaaatatacatataacaaaccataacgaccgcgacaacgctaaccaaaaacgacgaactaaaataacccgacaacaatttatctatcccgaaaaataccgtataaatccgcaaataactcaacaactcttcgaacgtaacgaaacgcttatcgcacgacccgttaaccgacacccaattacaaatataaaaaaataaatcgttaaaaaacataaaaccgtaaaaataaaaaaaataaccgaccaaaaaaaacgatataacgccaacaaccgcgacgaccgttaacgaaaaatacacaccgtacaacgaatacgtaaaatacaccaacgaatatccgaacttcaacgccgcaaccgcaacaaccgaatcatatacgcaaaaaacgctaacgaccgccgcccctaccaaataactaacgcaataataactaaaacaataaaaatcccgacacaaactaactatcatcacgaacgacgaaaacgctccgaccaaaaaactaaaaccgaccgacttactacaacccaaaaacccgaccgcgaccgccgccaa

SEQ ID NO: 10495 - DNA, 998 bp, Artificial Sequence
  chemically treated genomic DNA (Homo sapiens) CpG-island No: 10495
tttttttaatttttataaagtttgggtggggaggtgaaagtggggagaaggggagtgttttatcgggtttcggtcgttgttgtcgggtagatagatacggtatatattttttttttttcgtggttcgagttttttttacgcgcgggtgttagtagtttgggtcgtgatttcgtttttttttggatttttttttttttttttttttttttttttttcgttcgttttttcggtcgtttttattgatattttagcgtcgaggcggtggttagtttttgttcgtagagggcgtagggggagtagtacggttcggtggcggcgggtatcggtacgggggcgttaggcgtgggaagcgggtttttggagtaggggtggtagcggttgttgagttttagcgcgtggtgggggttgcgtagcgttagcgttttagggttgttcggtgcgttcgaggtggggatgtgtatgtggtaagttatggcggtcgcggtagcgttggttagagacgacgagttggggtagttcgatagtagtttgtttgtttcgggaaatgtcgtatgggttcgtaagtggtttagtagtttttcggacgtggcgaagcgtttgtcgtacggttcgttggtcgatatttagttgtagatgtgggggagtgggtcgttagggagtataaagtcgtaggggtagagggggtggtcggttagggagggcggtgtggcgttagtagtcgcggcggtcgttagcgaggagtgtatatcgtgtagcgggtgcgtggggtatattagcgggtattcggattttagcgtcgtagtcgtagtagtcggattatgtgcgtaagaagcgttggcggtcgtcgtttttgttaggtggttagcgtagtggtagttgaggtagtaagggtttcggtataaattggttgttattacggacggcggagacgtttcggttaaagggttggagtcggtcggtttattgtagtttagagattcggtcgcggtcgtcgttag

SEQ ID NO: 10496 - DNA, 998 bp, Artificial Sequence
  chemically treated genomic DNA (Homo sapiens) CpG-island No: 10496
ctaacgacgaccgcgaccgaatctctaaactacaataaaccgaccgactccaaccctttaaccgaaacgtctccgccgtccgtaataacaaccaatttataccgaaacccttactacctcaactaccactacgctaaccacctaacaaaaacgacgaccgccaacgcttcttacgcacataatccgactactacgactacgacgctaaaatccgaatacccgctaatataccccacgcacccgctacacgatatacactcctcgctaacgaccgccgcgactactaacgccacaccgccctccctaaccgaccaccccctctacccctacgactttatactccctaacgacccactcccccacatctacaactaaatatcgaccaacgaaccgtacgacaaacgcttcgccacgtccgaaaaactactaaaccacttacgaacccatacgacatttcccgaaacaaacaaactactatcgaactaccccaactcgtcgtctctaaccaacgctaccgcgaccgccataacttaccacatacacatccccacctcgaacgcaccgaacaaccctaaaacgctaacgctacgcaacccccaccacgcgctaaaactcaacaaccgctaccacccctactccaaaaacccgcttcccacgcctaacgcccccgtaccgatacccgccgccaccgaaccgtactactccccctacgccctctacgaacaaaaactaaccaccgcctcgacgctaaaatatcaataaaaacgaccgaaaaaacgaacgaaaaaaaaaaaaaaaaaaaaaaaaaaaaaaatccaaaaaaaaacgaaatcacgacccaaactactaacacccgcgcgtaaaaaaaactcgaaccacgaaaaaaaaaaaatatataccgtatctatctacccgacaacaacgaccgaaacccgataaaacactccccttctccccactttcacctccccacccaaactttataaaaattaaaaaaa

SEQ ID NO: 10497 - DNA, 528 bp, Artificial Sequence
  chemically treated genomic DNA (Homo sapiens) CpG-island No: 10497
gatgtagtcgtttgagattcgtttttgtagtagtttgttaggaggtgcggatgttgtcggcgtttggatcgcgcgttgagtagtgtaggtgaatagttcgtttaacgtataagttacgtttatattttttttatacgttttttcgtttattttttattgtaatttttttcgtcgcgtggataggtttagtattttcggagtcgatgttattattcgttatcgacgcgaatttcggtaaagagacgggttttatcggttttcgaatgtttttaggttttaagcgcgtagtttcgtattcgggtgtagtcggcgcggttttacgtgtttttatcgcgagtcgtttttcgcgtttttgttgtcgtcgcgcgtttaattttgtttgttcgttcgtttcgtttcgttcggtcgtttttgcgtagttttgggtcggtttcgcgtttttgtgtttaaataagtttcgtttttgtgttgtttattgtaattttaaagggaaatagggttcgttgatttcgggagggagagaaggat

SEQ ID NO: 10498 - DNA, 528 bp, Artificial Sequence
  chemically treated genomic DNA (Homo sapiens) CpG-island No: 10498
atccttctctccctcccgaaatcaacgaaccctatttccctttaaaattacaataaacaacacaaaaacgaaacttatttaaacacaaaaacgcgaaaccgacccaaaactacgcaaaaacgaccgaacgaaacgaaacgaacgaacaaacaaaattaaacgcgcgacgacaacaaaaacgcgaaaaacgactcgcgataaaaacacgtaaaaccgcgccgactacacccgaatacgaaactacgcgcttaaaacctaaaaacattcgaaaaccgataaaacccgtctctttaccgaaattcgcgtcgataacgaataataacatcgactccgaaaatactaaacctatccacgcgacgaaaaaaattacaataaaaaataaacgaaaaaacgtataaaaaaaatataaacgtaacttatacgttaaacgaactattcacctacactactcaacgcgcgatccaaacgccgacaacatccgcacctcctaacaaactactacaaaaacgaatctcaaacgactacatc

SEQ ID NO: 10499 - DNA, 528 bp, Artificial Sequence
  chemically treated genomic DNA (Homo sapiens) CpG-island No: 10499
gtttttttttttttttcgggattagcgggttttgtttttttttaaagttgtagtgggtaatataagggcgaggtttgtttaaatatagaagcgcgaggtcgatttagggttgcgtaggaacggtcgggcggggcggggcgggcgggtaggtagagttaagcgcgcggcggtagtagggacgcggggagcggttcgcggtagggatacgtgggatcgcgtcggttgtattcgggtgcggggttgcgcgtttagggtttgagaatattcggagatcggtaagattcgtttttttgtcgaggttcgcgtcgatggcgaataatgatatcgatttcgagagtgttgaatttgtttacgcggcggaaggagttgtaatgagaagtgaacgagaaagcgtgtagaaagggtgtgggcgtggtttgtgcgttaggcgagttgtttatttgtattgtttaacgcgcggtttaggcgtcggtagtattcgtattttttggtaggttgttgtaaaggcgggttttaggcggttgtatt

SEQ ID NO: 10500 - DNA, 528 bp, Artificial Sequence
  chemically treated genomic DNA (Homo sapiens) CpG-island No: 10500
aatacaaccgcctaaaacccgcctttacaacaacctaccaaaaaatacgaatactaccgacgcctaaaccgcgcgttaaacaatacaaataaacaactcgcctaacgcacaaaccacgcccacaccctttctacacgctttctcgttcacttctcattacaactccttccgccgcgtaaacaaattcaacactctcgaaatcgatatcattattcgccatcgacgcgaacctcgacaaaaaaacgaatcttaccgatctccgaatattctcaaaccctaaacgcgcaaccccgcacccgaatacaaccgacgcgatcccacgtatccctaccgcgaaccgctccccgcgtccctactaccgccgcgcgcttaactctacctacccgcccgccccgccccgcccgaccgttcctacgcaaccctaaatcgacctcgcgcttctatatttaaacaaacctcgcccttatattacccactacaactttaaaaaaaaacaaaacccgctaatcccgaaaaaaaaaaaaaaac

SEQ ID NO: 10501 - DNA, 564 bp, Artificial Sequence
  chemically treated genomic DNA (Homo sapiens) CpG-island No: 10501
gtcgatttatttatttttcgttaagggataatgggtttacggcggtattagtgtttcggttttttttcgacggtgtcgattacggtcgcgtcgtgggtgcgttcgttcggtcgttttcgtttagtacggcgtagggtgatagggggtgcgggtttcgatttagcgaaagataatagatcggtaagggatttcgatacgagcgttaagttaacggcgcgggcgtatattatatcgttttatgttattcgtgttcgcggcgatcgaaattttttcggtttaaaagtcgttcggggaagttaatcgagcggtcgttcggtcgggtagagggtggcgttatgtcgttttaggtgttttatcggtgtgttcggcgagcggtatcgtcggattcgaggcgttcgcgggttcgttacggtcgtatttttatttcggcggggttgtggatagcgtcgtcgtattacgggtttaggcgaatcggcgttttcgggggtaatagtggagtttgtatcggatttcgttagacgggttttttttttaaaagtgttttttttttaggtatgaattatt

SEQ ID NO: 10502 - DNA, 564 bp, Artificial Sequence
  chemically treated genomic DNA (Homo sapiens) CpG-island No: 10502
aataattcatacctaaaaaaaaaacacttttaaaaaaaaaacccgtctaacgaaatccgatacaaactccactattacccccgaaaacgccgattcgcctaaacccgtaatacgacgacgctatccacaaccccgccgaaataaaaatacgaccgtaacgaacccgcgaacgcctcgaatccgacgataccgctcgccgaacacaccgataaaacacctaaaacgacataacgccaccctctacccgaccgaacgaccgctcgattaacttccccgaacgacttttaaaccgaaaaaatttcgatcgccgcgaacacgaataacataaaacgatataatatacgcccgcgccgttaacttaacgctcgtatcgaaatcccttaccgatctattatctttcgctaaatcgaaacccgcaccccctatcaccctacgccgtactaaacgaaaacgaccgaacgaacgcacccacgacgcgaccgtaatcgacaccgtcgaaaaaaaaccgaaacactaataccgccgtaaacccattatcccttaacgaaaaataaataaatcgac

SEQ ID NO: 10503 - DNA, 564 bp, Artificial Sequence
  chemically treated genomic DNA (Homo sapiens) CpG-island No: 10503
ggtggtttatgtttggagggggggtatttttggaggaggagttcgtttggcgaggttcggtgtagattttattgttgttttcgggggcgtcgattcgtttgagttcgtagtgcggcggcgttgtttataatttcgtcggggtgaaggtgcggtcgtggcgagttcgcgggcgtttcgggttcggcgatatcgttcgtcggatatatcgatggagtatttggaacggtatggcgttattttttgttcggtcgaacggtcgttcggttagttttttcgggcggtttttgagtcgagagagtttcggtcgtcgcggatacgggtggtatggggcgatataatgtacgttcgcgtcgttagtttagcgttcgtgtcggggttttttgtcggtttgttgtttttcgttgaatcggagttcgtattttttattattttgcgtcgtattaaacggggacggtcggacggacgtatttacgacgcggtcgtggtcggtatcgtcggggagggatcggggtattaatgtcgtcgtgggtttattgttttttggcggggggtgagtgggtcgat

SEQ ID NO: 10504 - DNA, 564 bp, Artificial Sequence
  chemically treated genomic DNA (Homo sapiens) CpG-island No: 10504
atcgacccactcaccccccgccaaaaaacaataaacccacgacgacattaataccccgatccctccccgacgataccgaccacgaccgcgtcgtaaatacgtccgtccgaccgtccccgtttaatacgacgcaaaataataaaaaatacgaactccgattcaacgaaaaacaacaaaccgacaaaaaaccccgacacgaacgctaaactaacgacgcgaacgtacattatatcgccccataccacccgtatccgcgacgaccgaaactctctcgactcaaaaaccgcccgaaaaaactaaccgaacgaccgttcgaccgaacaaaaaataacgccataccgttccaaatactccatcgatatatccgacgaacgatatcgccgaacccgaaacgcccgcgaactcgccacgaccgcaccttcaccccgacgaaattataaacaacgccgccgcactacgaactcaaacgaatcgacgcccccgaaaacaacaataaaatctacaccgaacctcgccaaacgaactcctcctccaaaaataccccccctccaaacataaaccacc

SEQ ID NO: 10505 - DNA, 551 bp, Artificial Sequence
  chemically treated genomic DNA (Homo sapiens) CpG-island No: 10505
gttttttcgttttattgagcgtttattataagcgggttttgggttaggcgcgttattcgtgtaagttttcggggagcggcggtgtatttttcgtttcgcgcgttcgtagttattgtagggtgggcgttcgttaggtagggtgtcgatacgtttttttcgcgttgcgacgggcggtcgggggaggagagggtgcgttgtgcgtatcggagggagaggtttcggtttagcgtcgtttgttcgttagtagattagtaggtttttttttgcggcgggtgttttacgcgtttttcgggcgcgcgtttttagtttcgttcgcgtgcggcggtcgtacggtcgcgagagcgcgttttcgtttggcgggtacggtcgcgagcgcgcgtgcgttttttcgaacgttttcgggagtttagttagagcgagcgtcggggtcgggcgcgtaggagtgaaaaggaggcggcggtcgtagttgcgagtaatagattcggacgtcgcgagttgattcgttttgttgttgggcgatttttttttaattgtagaaaaatttattaaat

SEQ ID NO: 10506 - DNA, 551 bp, Artificial Sequence
  chemically treated genomic DNA (Homo sapiens) CpG-island No: 10506
atttaataaatttttctacaattaaaaaaaaatcgcccaacaacaaaacgaatcaactcgcgacgtccgaatctattactcgcaactacgaccgccgcctccttttcactcctacgcgcccgaccccgacgctcgctctaactaaactcccgaaaacgttcgaaaaaacgcacgcgcgctcgcgaccgtacccgccaaacgaaaacgcgctctcgcgaccgtacgaccgccgcacgcgaacgaaactaaaaacgcgcgcccgaaaaacgcgtaaaacacccgccgcaaaaaaaaacctactaatctactaacgaacaaacgacgctaaaccgaaacctctccctccgatacgcacaacgcaccctctcctcccccgaccgcccgtcgcaacgcgaaaaaaacgtatcgacaccctacctaacgaacgcccaccctacaataactacgaacgcgcgaaacgaaaaatacaccgccgctccccgaaaacttacacgaataacgcgcctaacccaaaacccgcttataataaacgctcaataaaacgaaaaaac

SEQ ID NO: 10507 - DNA, 551 bp, Artificial Sequence
  chemically treated genomic DNA (Homo sapiens) CpG-island No: 10507
atttaataaatttttttgtaattaaaaaaaaatcgtttaatagtagagcgggttagttcgcggcgttcggatttgttgttcgtagttgcggtcgtcgttttttttttatttttgcgcgttcggtttcggcgttcgttttggttgggttttcggggacgttcggaggggcgtacgcgcgttcgcggtcgtgttcgttaagcggaggcgcgttttcgcggtcgtgcggtcgtcgtacgcgggcggggttgggagcgcgcgttcgagaggcgcgtggggtattcgtcgtaaagaggagtttgttggtttgttggcgggtaggcggcgttgggtcggagttttttttttcggtgcgtatagcgtatttttttttttttcggtcgttcgtcgtagcgcggagagggcgtgtcggtattttgtttggcgagcgtttattttataatggttgcgagcgcgcgggacggagggtgtatcgtcgtttttcggggatttgtacgggtggcgcgtttagtttagagttcgtttgtagtgagcgtttagtagggcgggaaagt

SEQ ID NO: 10508 - DNA, 551 bp, Artificial Sequence
  chemically treated genomic DNA (Homo sapiens) CpG-island No: 10508
actttcccgccctactaaacgctcactacaaacgaactctaaactaaacgcgccacccgtacaaatccccgaaaaacgacgatacaccctccgtcccgcgcgctcgcaaccattataaaataaacgctcgccaaacaaaataccgacacgccctctccgcgctacgacgaacgaccgaaaaaaaaaaaaatacgctatacgcaccgaaaaaaaaaactccgacccaacgccgcctacccgccaacaaaccaacaaactcctctttacgacgaataccccacgcgcctctcgaacgcgcgctcccaaccccgcccgcgtacgacgaccgcacgaccgcgaaaacgcgcctccgcttaacgaacacgaccgcgaacgcgcgtacgcccctccgaacgtccccgaaaacccaaccaaaacgaacgccgaaaccgaacgcgcaaaaataaaaaaaaaacgacgaccgcaactacgaacaacaaatccgaacgccgcgaactaacccgctctactattaaacgatttttttttaattacaaaaaaatttattaaat

SEQ ID NO: 10509 - DNA, 634 bp, Artificial Sequence
  chemically treated genomic DNA (Homo sapiens) CpG-island No: 10509
cgaattttacggcggaggtatgagtcgtcgggaacgcgtatagtgtagcgcggtttgttcgcgttgtattgataaatttcgacgttacgacgtacgtcgtagtagtggtcgtaaataacgcgtcgttttattgtcggcgtgtcggtggtgttatcggaaagtcggaaataggttattgtattagtaggtgatggcgtggtagtaaaatttttagtcggatggttaatcgtattttgtaagttatgtttatcgttgtcggtgagtagttgtattacgcgaatggaggaatgtattgtgacgaaagtagttgtaggaatattatttttcggcgtatatatatgcggtattgttagttgtcgtttcgggtaatttaggtataggttgggggcgtataatttcggtatggttatatggcgttttagttttatttatcgcgcgatttggtttcgaattaattgtttagttattcgtgcggtaaacgttttagttttttagttagtcgcgatgataattggttaatattataaattttagcgaacgtttatttaggttgtattagcgcgggttttattaggttttaatgtttttgatcggtgtgaatttatacgtttagggttattttttttgtttttat

SEQ ID NO: 10510 - DNA, 634 bp, Artificial Sequence
  chemically treated genomic DNA (Homo sapiens) CpG-island No: 10510
ataaaaacaaaaaaaataaccctaaacgtataaattcacaccgatcaaaaacattaaaacctaataaaacccgcgctaatacaacctaaataaacgttcgctaaaatttataatattaaccaattatcatcgcgactaactaaaaaactaaaacgtttaccgcacgaataactaaacaattaattcgaaaccaaatcgcgcgataaataaaactaaaacgccatataaccataccgaaattatacgcccccaacctatacctaaattacccgaaacgacaactaacaataccgcatatatatacgccgaaaaataatattcctacaactactttcgtcacaatacattcctccattcgcgtaatacaactactcaccgacaacgataaacataacttacaaaatacgattaaccatccgactaaaaattttactaccacgccatcacctactaatacaataacctatttccgactttccgataacaccaccgacacgccgacaataaaacgacgcgttatttacgaccactactacgacgtacgtcgtaacgtcgaaatttatcaatacaacgcgaacaaaccgcgctacactatacgcgttcccgacgactcatacctccgccgtaaaattcg

SEQ ID NO: 10511 - DNA, 634 bp, Artificial Sequence
  chemically treated genomic DNA (Homo sapiens) CpG-island No: 10511
gtgaggataggagggataattttaggcgtgtagatttatatcgattaggggtattgagatttggtggaattcgcgttggtgtaatttgggtaaacgttcgttggaatttgtagtattaattagttattatcgcggttggttgagaaattggggcgtttatcgtacgggtggttgagtagttagttcgaggttaagtcgcgcggtaggtgaagttgaaacgttatatggttatgtcgggattatgcgtttttagtttgtgtttgaattgttcggagcgatagttaatagtgtcgtatgtatatacgtcgggggatgatatttttgtaattattttcgttatagtatatttttttattcgcgtggtgtagttgtttatcgatagcggtgagtatgatttgtaggatgcgattaattattcggttgaggattttattgttacgttattatttgttgatgtagtggtttattttcggtttttcggtggtattatcggtacgtcggtaataaaacggcgcgttgtttacggttattattgcggcgtgcgtcgtagcgtcgagatttgttagtataacgcgagtagatcgcgttatattgtgcgcgttttcggcggtttatgttttcgtcgtggggttcg

SEQ ID NO: 10512 - DNA, 634 bp, Artificial Sequence
  chemically treated genomic DNA (Homo sapiens) CpG-island No: 10512
cgaaccccacgacgaaaacataaaccgccgaaaacgcgcacaatataacgcgatctactcgcgttatactaacaaatctcgacgctacgacgcacgccgcaataataaccgtaaacaacgcgccgttttattaccgacgtaccgataataccaccgaaaaaccgaaaataaaccactacatcaacaaataataacgtaacaataaaatcctcaaccgaataattaatcgcatcctacaaatcatactcaccgctatcgataaacaactacaccacgcgaataaaaaaatatactataacgaaaataattacaaaaatatcatcccccgacgtatatacatacgacactattaactatcgctccgaacaattcaaacacaaactaaaaacgcataatcccgacataaccatataacgtttcaacttcacctaccgcgcgacttaacctcgaactaactactcaaccacccgtacgataaacgccccaatttctcaaccaaccgcgataataactaattaatactacaaattccaacgaacgtttacccaaattacaccaacgcgaattccaccaaatctcaatacccctaatcgatataaatctacacgcctaaaattatccctcctatcctcac

SEQ ID NO: 10513 - DNA, 627 bp, Artificial Sequence
  chemically treated genomic DNA (Homo sapiens) CpG-island No: 10513
  misc_feature (57)..(57): n is either a, c, g or t
  misc_feature (91)..(91): n is either a, c, g or t
  misc_feature (164)..(164): n is either a, c, g or t
  misc_feature (237)..(237): n is either a, c, g or t
cgttttttaatttagtttcgtttttaattacgttggttttgtttttcgggaagttanggtgcgtcgttggatattttagtcggcggggttnttattagatttcggttttcgtttcgttcgtttcgttttcgggttgtttttagcgtcgtttgattgtatttgtnggattcgttgtcgtattttaggttaagcgtcgcgtttaaagtcgtgcggagattggaggtcgcgcgggttttntggtttgggttatgtttggttgtgatgttcgggagggagattgttgttttcggagatgcggcgcgtaggtaggggcggggttatcggtgttcggtatttttaggaggagaggtttaggcgggattcggcggttggagttgggcgtagggtagcgggtcgggcgtttagttgcggggcggggtttcgggtttggtcgttcgttatttcggcgtatcgcgattttggcgttcggaagtaaggttgcgaggttttaggagattagtggtttcgggcggggcgtttcgatggcgggagttgggcgttaaacgttggaaagaagtaaataattgagagaggagagcgtttaggtgattttatcgggtatttattaggaaagtaggttagagaagg

SEQ ID NO: 10514 - DNA, 627 bp, Artificial Sequence
  chemically treated genomic DNA (Homo sapiens) CpG-island No: 10514
  misc_feature (391)..(391): n is either a, c, g or t
  misc_feature (464)..(464): n is either a, c, g or t
  misc_feature (537)..(537): n is either a, c, g or t
  misc_feature (571)..(571): n is either a, c, g or t
ccttctctaacctactttcctaataaatacccgataaaatcacctaaacgctctcctctctcaattatttacttctttccaacgtttaacgcccaactcccgccatcgaaacgccccgcccgaaaccactaatctcctaaaacctcgcaaccttacttccgaacgccaaaatcgcgatacgccgaaataacgaacgaccaaacccgaaaccccgccccgcaactaaacgcccgacccgctaccctacgcccaactccaaccgccgaatcccgcctaaacctctcctcctaaaaataccgaacaccgataaccccgcccctacctacgcgccgcatctccgaaaacaacaatctccctcccgaacatcacaaccaaacataacccaaaccanaaaacccgcgcgacctccaatctccgcacgactttaaacgcgacgcttaacctaaaatacgacaacgaatccnacaaatacaatcaaacgacgctaaaaacaacccgaaaacgaaacgaacgaaacgaaaaccgaaatctaataanaaccccgccgactaaaatatccaacgacgcaccntaacttcccgaaaaacaaaaccaacgtaattaaaaacgaaactaaattaaaaaacg

SEQ ID NO: 10515 - DNA, 627 bp, Artificial Sequence
  chemically treated genomic DNA (Homo sapiens) CpG-island No: 10515
  misc_feature (391)..(391): n is either a, c, g or t
  misc_feature (464)..(464): n is either a, c, g or t
  misc_feature (537)..(537): n is either a, c, g or t
  misc_feature (571)..(571): n is either a, c, g or t
ttttttttggtttgtttttttgataaatattcggtgaggttatttaaacgttttttttttttagttatttgtttttttttaacgtttggcgtttagttttcgttatcggagcgtttcgttcgagattattgattttttggggtttcgtagttttgttttcgaacgttaaggtcgcggtgcgtcggggtagcgaacggttaggttcgaaatttcgtttcgtagttaaacgttcggttcgttattttgcgtttagttttagtcgtcgggtttcgtttgggtttttttttttgggaatatcgggtatcggtggtttcgtttttatttgcgcgtcgtattttcgggaataatagtttttttttcgagtattatagttagatatggtttagattangggattcgcgcggtttttaattttcgtacggttttgggcgcggcgtttagtttgggatacggtagcgagtttngtaaatgtaattaggcggcgttgagggtagttcgggggcggggcgaacggggcgggggtcggggtttggtaanggtttcgtcggttgagatatttagcggcgtattntgatttttcgggaggtaaggttaacgtggttggaggcggggttgggttggggggcg

SEQ ID NO: 10516 - DNA, 627 bp, Artificial Sequence
  chemically treated genomic DNA (Homo sapiens) CpG-island No: 10516
  misc_feature (57)..(57): n is either a, c, g or t
  misc_feature (91)..(91): n is either a, c, g or t
  misc_feature (164)..(164): n is either a, c, g or t
  misc_feature (237)..(237): n is either a, c, g or t
cgccccccaacccaaccccgcctccaaccacgttaaccttacctcccgaaaaatcanaatacgccgctaaatatctcaaccgacgaaaccnttaccaaaccccgacccccgccccgttcgccccgcccccgaactaccctcaacgccgcctaattacatttacnaaactcgctaccgtatcccaaactaaacgccgcgcccaaaaccgtacgaaaattaaaaaccgcgcgaatcccntaatctaaaccatatctaactataatactcgaaaaaaaaactattattcccgaaaatacgacgcgcaaataaaaacgaaaccaccgatacccgatattcccaaaaaaaaaaacccaaacgaaacccgacgactaaaactaaacgcaaaataacgaaccgaacgtttaactacgaaacgaaatttcgaacctaaccgttcgctaccccgacgcaccgcgaccttaacgttcgaaaacaaaactacgaaaccccaaaaaatcaataatctcgaacgaaacgctccgataacgaaaactaaacgccaaacgttaaaaaaaaacaaataactaaaaaaaaaaaacgtttaaataacctcaccgaatatttatcaaaaaaacaaaccaaaaaaaa

SEQ ID NO: 10517 - DNA, 628 bp, Artificial Sequence
  chemically treated genomic DNA (Homo sapiens) CpG-island No: 10517
  misc_feature (22)..(22): n is either a, c, g or t
  misc_feature (70)..(70): n is either a, c, g or t
  misc_feature (79)..(79): n is either a, c, g or t
  misc_feature (163)..(163): n is either a, c, g or t
  misc_feature (556)..(556): n is either a, c, g or t
gggattagggaggatttcgttnattcgggagttgggaggtcgcgcgcgtttttgcggagcgtgacggttnacggtcgtnttagtaacgaacggggatgcgcggggcgtttgggtgggtaaggggtgtttgtcgtcgtcgtcgcgcgttttcgggttttcgggnatcgcgggaaaatttcgcggtttttcggcgttggggcgtcggcgttaggttcggtagatagagtaatgcgtttcgcgggttgagggtagaggatgcggtcgcggtttagcgttcggtcgggggagtcgcggggtggtacgcggggaaagttggcgcgcgtttgatcgcgtttggaagtcgcgcggtgttagggtcgagttgttttttaagtttttgcggcgatttgttattttttggggatttggcggtttgaatttcgcggggttttcggtttagggattttgagcgttaggagagagaagttcgcgtttttttcggggatttgcgtttgagttggtgtttggcgggttcgttttgaatggtagcgattcgagttgttttttgttttttttntttttttagatagtgagtttgtggaagtttcgttcgtattttatagtttagacgagttaggtaagtttgttt

SEQ ID NO: 10518 - DNA, 628 bp, Artificial Sequence
  chemically treated genomic DNA (Homo sapiens) CpG-island No: 10518
  misc_feature (73)..(73): n is either a, c, g or t
  misc_feature (466)..(466): n is either a, c, g or t
  misc_feature (550)..(550): n is either a, c, g or t
  misc_feature (559)..(559): n is either a, c, g or t
  misc_feature (607)..(607): n is either a, c, g or t
aaacaaacttacctaactcgtctaaactataaaatacgaacgaaacttccacaaactcactatctaaaaaaanaaaaaaaacaaaaaacaactcgaatcgctaccattcaaaacgaacccgccaaacaccaactcaaacgcaaatccccgaaaaaaacgcgaacttctctctcctaacgctcaaaatccctaaaccgaaaaccccgcgaaattcaaaccgccaaatccccaaaaaataacaaatcgccgcaaaaacttaaaaaacaactcgaccctaacaccgcgcgacttccaaacgcgatcaaacgcgcgccaactttccccgcgtaccaccccgcgactcccccgaccgaacgctaaaccgcgaccgcatcctctaccctcaacccgcgaaacgcattactctatctaccgaacctaacgccgacgccccaacgccgaaaaaccgcgaaattttcccgcgatncccgaaaacccgaaaacgcgcgacgacgacgacaaacaccccttacccacccaaacgccccgcgcatccccgttcgttactaanacgaccgtnaaccgtcacgctccgcaaaaacgcgcgcgacctcccaactcccgaatnaacgaaatcctccctaatccc

SEQ ID NO: 10519 - DNA, 628 bp, Artificial Sequence
  chemically treated genomic DNA (Homo sapiens) CpG-island No: 10519
  misc_feature (73)..(73): n is either a, c, g or t
  misc_feature (466)..(466): n is either a, c, g or t
  misc_feature (550)..(550): n is either a, c, g or t
  misc_feature (559)..(559): n is either a, c, g or t
  misc_feature (607)..(607): n is either a, c, g or t
gagtagatttatttaattcgtttgggttgtaggatgcgggcgaggtttttataaatttattgtttgggggagnaagaaaagtagaaaataattcgaatcgttattatttaggacgaattcgttaagtattagtttaagcgtaggttttcgggaaaagcgcgggttttttttttttagcgtttagaatttttgagtcggaggtttcgcgggatttagatcgttagatttttagggagtgataaatcgtcgtagaaatttgggggataattcggttttggtatcgcgcggtttttaggcgcggttaggcgcgcgttaatttttttcgcgtgttatttcgcggttttttcggtcgggcgttgggtcgcggtcgtattttttgtttttagttcgcggggcgtattgttttgtttgtcgggtttggcgtcgacgttttagcgtcgaggagtcgcgaagttttttcgcggtnttcgggggttcgagggcgcgcggcggcggcggtaagtattttttgtttatttaggcgtttcgcgtattttcgttcgttgttagngcgatcgtnggtcgttacgtttcgtagaggcgcgcgcggttttttaattttcgggtnggcggaattttttttagtttt

SEQ ID NO: 10520 - DNA, 628 bp, Artificial Sequence
  chemically treated genomic DNA (Homo sapiens) CpG-island No: 10520
  misc_feature (22)..(22): n is either a, c, g or t
  misc_feature (70)..(70): n is either a, c, g or t
  misc_feature (79)..(79): n is either a, c, g or t
  misc_feature (163)..(163): n is either a, c, g or t
  misc_feature (556)..(556): n is either a, c, g or t
aaaactaaaaaaaattccgccnacccgaaaattaaaaaaccgcgcgcgcctctacgaaacgtaacgaccnacgatcgcnctaacaacgaacgaaaatacgcgaaacgcctaaataaacaaaaaatacttaccgccgccgccgcgcgccctcgaacccccgaanaccgcgaaaaaacttcgcgactcctcgacgctaaaacgtcgacgccaaacccgacaaacaaaacaatacgccccgcgaactaaaaacaaaaaatacgaccgcgacccaacgcccgaccgaaaaaaccgcgaaataacacgcgaaaaaaattaacgcgcgcctaaccgcgcctaaaaaccgcgcgataccaaaaccgaattatcccccaaatttctacgacgatttatcactccctaaaaatctaacgatctaaatcccgcgaaacctccgactcaaaaattctaaacgctaaaaaaaaaaaacccgcgcttttcccgaaaacctacgcttaaactaatacttaacgaattcgtcctaaataataacgattcgaattattttctacttttcttnctcccccaaacaataaatttataaaaacctcgcccgcatcctacaacccaaacgaattaaataaatctactc

SEQ ID NO: 10521 - DNA, 920 bp, Artificial Sequence
  chemically treated genomic DNA (Homo sapiens) CpG-island No: 10521
gcgttttcggtttcgtattcggcgtttttcgtagttttcgttttcggggcggtgtcgggaaaacgcggcgttttcgtcggttacgtaggggtcgtttcggcgggcggcgttgtcgttttttaatcgcgtttttttagcgtcggggacgcggcgttcgcgttttcgttcgagttcggggaaacggagataaggaggcgtcgtcgtttttttttcgcggttgcgttttagttttgcgttcgtagtatgttcgtcgtcgggtcgagcgtcgtttttttttaggagttcgaggaggcgacgtcgttgtcggtcgcgggatcgcggttgcgagggtagcggggtcggagtcgggtatttcgaggcgtcgcgcggcgggcggagagggaggaggagtaggtatttttcgcggcgcgcgggcggcggttttgttgttcggcgcgtttatggttcggtcgtagggagaatgtaagttgttttttacgcgttcggcgtttttcggagtcgttcgcgtcgtcgtcgttttttagtcgttagcgttcggtcgttggttgcgttaggattcgcggtcgtcggtcgtcgagcgcgggagggtaggtaggggtaggagtcggagggttcggggcgcggcgcggtatgtagttgcgggttttcgcgttcgcgtgaggttgtcggttcggggtttcgttatggttgggatggatagtggtaatttgaagatcgcgaggttgtggcgggacgtcgttttgcgtgttaggaagttgcggagtaatttgcgttagtttacgtttatcgtcgtcggggtttgtttcggggtcggggtcgacgcgttcgagtttttcgtttttttttagttcgtgttgtcggttaatttcggggatattgaggtattgaatttggggaataacggtttggaggaggtattt

SEQ ID NO: 10522 - DNA, 920 bp, Artificial Sequence
  chemically treated genomic DNA (Homo sapiens) CpG-island No: 10522
aaatacctcctccaaaccgttattccccaaattcaatacctcaatatccccgaaattaaccgacaacacgaactaaaaaaaaacgaaaaactcgaacgcgtcgaccccgaccccgaaacaaaccccgacgacgataaacgtaaactaacgcaaattactccgcaacttcctaacacgcaaaacgacgtcccgccacaacctcgcgatcttcaaattaccactatccatcccaaccataacgaaaccccgaaccgacaacctcacgcgaacgcgaaaacccgcaactacataccgcgccgcgccccgaaccctccgactcctacccctacctaccctcccgcgctcgacgaccgacgaccgcgaatcctaacgcaaccaacgaccgaacgctaacgactaaaaaacgacgacgacgcgaacgactccgaaaaacgccgaacgcgtaaaaaacaacttacattctccctacgaccgaaccataaacgcgccgaacaacaaaaccgccgcccgcgcgccgcgaaaaatacctactcctcctccctctccgcccgccgcgcgacgcctcgaaatacccgactccgaccccgctaccctcgcaaccgcgatcccgcgaccgacaacgacgtcgcctcctcgaactcctaaaaaaaaacgacgctcgacccgacgacgaacatactacgaacgcaaaactaaaacgcaaccgcgaaaaaaaaacgacgacgcctccttatctccgtttccccgaactcgaacgaaaacgcgaacgccgcgtccccgacgctaaaaaaacgcgattaaaaaacgacaacgccgcccgccgaaacgacccctacgtaaccgacgaaaacgccgcgttttcccgacaccgccccgaaaacgaaaactacgaaaaacgccgaatacgaaaccgaaaacgc

SEQ ID NO: 10523 - DNA, 920 bp, Artificial Sequence
  chemically treated genomic DNA (Homo sapiens) CpG-island No: 10523
gggtattttttttaggtcgttgttttttaggtttagtgttttaatgttttcgaggttggtcggtagtacgagttggggggaggcgggggattcgagcgcgtcggtttcggtttcggggtaggtttcggcggcggtaagcgtgagttggcgtaggttgtttcgtagttttttggtacgtagggcggcgtttcgttatagtttcgcggtttttaggttgttattgtttattttagttatggcggggtttcgggtcgatagttttacgcggacgcgggagttcgtagttatatgtcgcgtcgcgtttcgggtttttcggtttttgtttttgtttgttttttcgcgttcggcggtcggcggtcgcgggttttagcgtagttagcggtcgagcgttggcggttagggggcggcggcgacgcgagcggtttcgggggacgtcgagcgcgtggagagtagtttgtattttttttgcggtcgggttatgggcgcgtcgggtagtagggtcgtcgttcgcgcgtcgcggaggatgtttgtttttttttttttttcgttcgtcgcgcggcgtttcggggtgttcggtttcggtttcgttattttcgtagtcgcggtttcgcggtcggtagcggcgtcgttttttcgagtttttgggggagggcggcgttcggttcggcggcgggtatgttgcgggcgtagggttggggcgtagtcgcggggagggggcggcggcgtttttttgttttcgttttttcgggttcgggcgggagcgcgggcgtcgcgttttcggcgttgggagggcgcgattgggaagcggtagcgtcgttcgtcggagcggtttttacgtgatcggcggaggcgtcgcgttttttcggtatcgtttcgggggcgggagttgcggagggcgtcgggtgcggggtcgggggcgt

SEQ ID NO: 10524 - DNA, 920 bp, Artificial Sequence
  chemically treated genomic DNA (Homo sapiens) CpG-island No: 10524
acgcccccgaccccgcacccgacgccctccgcaactcccgcccccgaaacgataccgaaaaaacgcgacgcctccgccgatcacgtaaaaaccgctccgacgaacgacgctaccgcttcccaatcgcgccctcccaacgccgaaaacgcgacgcccgcgctcccgcccgaacccgaaaaaacgaaaacaaaaaaacgccgccgccccctccccgcgactacgccccaaccctacgcccgcaacatacccgccgccgaaccgaacgccgccctcccccaaaaactcgaaaaaacgacgccgctaccgaccgcgaaaccgcgactacgaaaataacgaaaccgaaaccgaacaccccgaaacgccgcgcgacgaacgaaaaaaaaaaaaaaacaaacatcctccgcgacgcgcgaacgacgaccctactacccgacgcgcccataacccgaccgcaaaaaaaatacaaactactctccacgcgctcgacgtcccccgaaaccgctcgcgtcgccgccgccccctaaccgccaacgctcgaccgctaactacgctaaaacccgcgaccgccgaccgccgaacgcgaaaaaacaaacaaaaacaaaaaccgaaaaacccgaaacgcgacgcgacatataactacgaactcccgcgtccgcgtaaaactatcgacccgaaaccccgccataactaaaataaacaataacaacctaaaaaccgcgaaactataacgaaacgccgccctacgtaccaaaaaactacgaaacaacctacgccaactcacgcttaccgccgccgaaacctaccccgaaaccgaaaccgacgcgctcgaatcccccgcctccccccaactcgtactaccgaccaacctcgaaaacattaaaacactaaacctaaaaaacaacgacctaaaaaaaataccc

SEQ ID NO: 10525 - DNA, 542 bp, Artificial Sequence
  chemically treated genomic DNA (Homo sapiens) CpG-island No: 10525
gtcgcgaagtcgtagtacgttcgggtgtggagttcgtttttttttttaggggtttataggaggggtcgttcgcgcgtttcgtttcgcgttcgtgatgggcgcggaaatggtatcggggttcgttatattatatttgtttttcgcgttttcggggtttttttatttggttcgcgtagtgtcggggttgtttttcgttaagggtttttcgcgtaagttcgatgagttatacgtttattttcgggtatttattttcggcgtatggcgaatgggaagcgtcgttattgttgcgttatattcggtcgggatttgcgtcgcgttattagtttttagcggcgttagttgcgttttttgcgggggttaaatttgtaggtttcgttttttgcggtaggtttcgtttttattaattattatcggttacgttcgaatatggttcggttagtttcgttttcggagtttttcggttatattttcgaaggagttgtcggtggggtgtagttttagggttttaattaagtaaataagcgggggaggaaaggcgggaa

SEQ ID NO: 10526 - DNA, 542 bp, Artificial Sequence
  chemically treated genomic DNA (Homo sapiens) CpG-island No: 10526
ttcccgcctttcctcccccgcttatttacttaattaaaaccctaaaactacaccccaccgacaactccttcgaaaatataaccgaaaaactccgaaaacgaaactaaccgaaccatattcgaacgtaaccgataataattaataaaaacgaaacctaccgcaaaaaacgaaacctacaaatttaacccccgcaaaaaacgcaactaacgccgctaaaaactaataacgcgacgcaaatcccgaccgaatataacgcaacaataacgacgcttcccattcgccatacgccgaaaataaatacccgaaaataaacgtataactcatcgaacttacgcgaaaaacccttaacgaaaaacaaccccgacactacgcgaaccaaataaaaaaaccccgaaaacgcgaaaaacaaatataatataacgaaccccgataccatttccgcgcccatcacgaacgcgaaacgaaacgcgcgaacgacccctcctataaacccctaaaaaaaaaaacgaactccacacccgaacgtactacgacttcgcgac

SEQ ID NO: 10527 - DNA, 542 bp, Artificial Sequence
  chemically treated genomic DNA (Homo sapiens) CpG-island No: 10527
ttttcgttttttttttttcgtttatttatttaattaaggttttggggttgtattttatcggtagttttttcgggggtgtggtcgaagagtttcgagggcggggttgatcgagttatattcgggcgtggtcggtggtgattggtgagggcggggtttgtcgtagggggcggggtttgtaggtttggttttcgtagggagcgtagttggcgtcgttgggagttggtggcgcggcgtaggtttcggtcgagtgtggcgtagtagtggcggcgttttttattcgttatgcgtcgggggtgggtgttcgaaggtaagcgtgtggtttatcgagtttgcgcgaggaatttttggcggagaatagtttcggtattgcgcgggttaggtggagggatttcgggggcgcgggaggtaggtgtggtgtgacgggtttcggtgttattttcgcgtttattacgagcgcggggcggggcgcgcgggcggttttttttgtgaatttttgagaggagaggcgggttttatattcgggcgtgttgcgatttcgcggt

SEQ ID NO: 10528 - DNA, 542 bp, Artificial Sequence
  chemically treated genomic DNA (Homo sapiens) CpG-island No: 10528
accgcgaaatcgcaacacgcccgaatataaaacccgcctctcctctcaaaaattcacaaaaaaaaccgcccgcgcgccccgccccgcgctcgtaataaacgcgaaaataacaccgaaacccgtcacaccacacctacctcccgcgcccccgaaatccctccacctaacccgcgcaataccgaaactattctccgccaaaaattcctcgcgcaaactcgataaaccacacgcttaccttcgaacacccacccccgacgcataacgaataaaaaacgccgccactactacgccacactcgaccgaaacctacgccgcgccaccaactcccaacgacgccaactacgctccctacgaaaaccaaacctacaaaccccgccccctacgacaaaccccgccctcaccaatcaccaccgaccacgcccgaatataactcgatcaaccccgccctcgaaactcttcgaccacacccccgaaaaaactaccgataaaatacaaccccaaaaccttaattaaataaataaacgaaaaaaaaaaaacgaaaa

SEQ ID NO: 10529 - DNA, 1034 bp, Artificial Sequence
  chemically treated genomic DNA (Homo sapiens) CpG-island No: 10529
ggcgcggtgttattagaggttcgttacgttttacgtcgttttgtaggcgaacgttggaggtttcgtcgggtcgtcgtagcgttgcggttcgggtcgtttttttcgcgtcgtttttcgtttttagtttttcggcgtcgcggtagttttgggtagggagcgtcgtcgtcgtcgtcgtcgtcgtcgttttttcgtttgtagtcgttcggtcgttgcgtgacgcgtcgtttttttttaatatggcggtcggggtaggtcggcggtgatgggggttagttcgcggtcgcggcgggtgttaatttttatagtagttagggtagtttttttttcgcggtgtttttgagagtcgtcgttatttcgttttttagttttcggtagatagtcgttcgggtcgggtttttttatcgttattagggtcggagggacgagtgagaggggcggtcgggacgcgattttcgggtcgggagaagcggaggttcgacgggcgcggttttcgaggtacggttttttgggggcggcgaggatttcgacgtttttcgtcgatatcgcggttggtttcgttcgttcgtttttttttgattttgtcgttgttttttacgtttttaattttttatttttattttttttttttttttttttttttttttttttttttttttttttttttttagtcgttgggagtcgcgggtcggacgagtcgtcgtttttttttttgcgtttatgtatgaggggaagaagacgaagaatatgtttttgattcgggttttggagaagatattggtcgataaggaagtgaagaaggcgtattatttttagttgcgtaaagtttgcgaggtggcgttaggtgagcggggaggaggttcgggggatggggtgtttgttgtggggcggggaggggggcgtttgtgggggggtggggtcgttcggggtttgttcgaggttcgcgtttttgatttcgggaagttttcgcggagttttttgttttttgtttggagttgataggaattcggttggatgtggggtagaggcggggtaga

SEQ ID NO: 10530 - DNA, 1034 bp, Artificial Sequence
  chemically treated genomic DNA (Homo sapiens) CpG-island No: 10530
tctaccccgcctctaccccacatccaaccgaattcctatcaactccaaacaaaaaacaaaaaactccgcgaaaacttcccgaaatcaaaaacgcgaacctcgaacaaaccccgaacgaccccacccccccacaaacgcccccctccccgccccacaacaaacaccccatcccccgaacctcctccccgctcacctaacgccacctcgcaaactttacgcaactaaaaataatacgccttcttcacttccttatcgaccaatatcttctccaaaacccgaatcaaaaacatattcttcgtcttcttcccctcatacataaacgcaaaaaaaaaaacgacgactcgtccgacccgcgactcccaacgactaaaaaaaaaaaaaaaaaaaaaaaaaaaaaaaaaaaaaaaaaaaaaaaaaataaaaataaaaaattaaaaacgtaaaaaacaacgacaaaatcaaaaaaaaacgaacgaacgaaaccaaccgcgatatcgacgaaaaacgtcgaaatcctcgccgcccccaaaaaaccgtacctcgaaaaccgcgcccgtcgaacctccgcttctcccgacccgaaaatcgcgtcccgaccgcccctctcactcgtccctccgaccctaataacgataaaaaaacccgacccgaacgactatctaccgaaaactaaaaaacgaaataacgacgactctcaaaaacaccgcgaaaaaaaaactaccctaactactataaaaattaacacccgccgcgaccgcgaactaacccccatcaccgccgacctaccccgaccgccatattaaaaaaaaacgacgcgtcacgcaacgaccgaacgactacaaacgaaaaaacgacgacgacgacgacgacgacgacgctccctacccaaaactaccgcgacgccgaaaaactaaaaacgaaaaacgacgcgaaaaaaacgacccgaaccgcaacgctacgacgacccgacgaaacctccaacgttcgcctacaaaacgacgtaaaacgtaacgaacctctaataacaccgcgcc

SEQ ID NO: 10531 - DNA, 1034 bp, Artificial Sequence
  chemically treated genomic DNA (Homo sapiens) CpG-island No: 10531
tttatttcgtttttgttttatatttagtcgagtttttgttaattttagatagggaatagagggtttcgcgagggtttttcgaggttagaggcgcgggtttcgggtaagtttcgggcgattttatttttttataggcgttttttttttcgttttataataagtattttatttttcgggtttttttttcgtttatttaacgttatttcgtaagttttgcgtagttgggagtgatgcgttttttttatttttttgtcggttaatattttttttagagttcgggttaggaatatgtttttcgtttttttttttttatatatggacgtagagaaggaggcggcggttcgttcgattcgcggtttttagcggttggaggggaggaggaggagaggaaggaagagaagagagaaaggagagggggtggaggtgggggattggaggcgtggagggtagcggtaggattaggaaggggcgggcgagcgggattagtcgcggtgtcggcgaagggcgtcgaggttttcgtcgtttttaagaagtcgtatttcgagggtcgcgttcgtcgggttttcgtttttttcggttcgggggtcgcgtttcggtcgttttttttattcgttttttcggttttggtggcggtgagggagttcggttcgggcggttgtttgtcgggaattgagggacgaggtggcggcggtttttagaggtatcgcgagagaagggttattttggttattgtggggattagtattcgtcgcggtcgcgaattggtttttattatcgtcgatttgtttcggtcgttatgttgggaggaaacgacgcgttacgtagcggtcgaacggttgtagacgaggaagcggcggcggcggcggcggcggcggcgttttttgtttagagttgtcgcggcgtcgggaggttgggggcggagggcggcgcgggaggagcggttcgagtcgtagcgttacggcggttcggcggggtttttagcgttcgtttgtagggcggcgtggggcgtggcgggtttttggtggtatcgcgtt

SEQ ID NO: 10532 - DNA, 1034 bp, Artificial Sequence
  chemically treated genomic DNA (Homo sapiens) CpG-island No: 10532
aacgcgataccaccaaaaacccgccacgccccacgccgccctacaaacgaacgctaaaaaccccgccgaaccgccgtaacgctacgactcgaaccgctcctcccgcgccgccctccgcccccaacctcccgacgccgcgacaactctaaacaaaaaacgccgccgccgccgccgccgccgccgcttcctcgtctacaaccgttcgaccgctacgtaacgcgtcgtttcctcccaacataacgaccgaaacaaatcgacgataataaaaaccaattcgcgaccgcgacgaatactaatccccacaataaccaaaataacccttctctcgcgatacctctaaaaaccgccgccacctcgtccctcaattcccgacaaacaaccgcccgaaccgaactccctcaccgccaccaaaaccgaaaaaacgaataaaaaaaacgaccgaaacgcgacccccgaaccgaaaaaaacgaaaacccgacgaacgcgaccctcgaaatacgacttcttaaaaacgacgaaaacctcgacgcccttcgccgacaccgcgactaatcccgctcgcccgccccttcctaatcctaccgctaccctccacgcctccaatcccccacctccaccccctctcctttctctcttctcttccttcctctcctcctcctcccctccaaccgctaaaaaccgcgaatcgaacgaaccgccgcctccttctctacgtccatatataaaaaaaaaaaaacgaaaaacatattcctaacccgaactctaaaaaaaatattaaccgacaaaaaaataaaaaaaacgcatcactcccaactacgcaaaacttacgaaataacgttaaataaacgaaaaaaaaacccgaaaaataaaatacttattataaaacgaaaaaaaaaacgcctataaaaaaataaaatcgcccgaaacttacccgaaacccgcgcctctaacctcgaaaaaccctcgcgaaaccctctattccctatctaaaattaacaaaaactcgactaaatataaaacaaaaacgaaataaa

SEQ ID NO: 10533 - DNA, 678 bp, Artificial Sequence
  chemically treated genomic DNA (Homo sapiens) CpG-island No: 10533
tacgtcgtgcgggtacgttttttgcgttagttgtttgttgttttgggcggtgcggaggcgtcggtgttcgttgtagtgttagtttttggcgttcggcgagttgtatcgggtgttgtcgttgcgtagttttatttagaagttgcgagtttagtgcgattatcgcgttcgcggttgcggttattcggttaggttgtacgagttggaggcgtacgtcgagtattgcgatttcggttttgttcgtcggtttcgtagtcgcgggggttgcgtttcggggttgggcggtggtgaggtgttcgcgcgggggggttgcggttcgatatttagggttggtcggggcgggggcgcgcgcggggggtcgtcgggcggtcgttggggtcgcgggcggggattcgggtttcgggttttcgtttggaggcggcgcgagaaggcgttgttggcgtagttttgggcgttgtagggcgaggtgtagtttacggcgcgtaggtattaggagaagtttatttaatatatggtttacgttcgtaatttcgtcggcgatttcggtggcggttatcgtagggtaagtaaaggggggtgggtatcgcgggtatggtcgattggggtgggaaaaggagcggttttttttgacgttttaggatttttttggaattgggtatttttttttattatgtagtagga

SEQ ID NO: 10534 - DNA, 678 bp, Artificial Sequence
  chemically treated genomic DNA (Homo sapiens) CpG-island No: 10534
tcctactacataataaaaaaaaatacccaattccaaaaaaatcctaaaacgtcaaaaaaaaccgctccttttcccaccccaatcgaccatacccgcgatacccacccccctttacttaccctacgataaccgccaccgaaatcgccgacgaaattacgaacgtaaaccatatattaaataaacttctcctaatacctacgcgccgtaaactacacctcgccctacaacgcccaaaactacgccaacaacgccttctcgcgccgcctccaaacgaaaacccgaaacccgaatccccgcccgcgaccccaacgaccgcccgacgaccccccgcgcgcgcccccgccccgaccaaccctaaatatcgaaccgcaacccccccgcgcgaacacctcaccaccgcccaaccccgaaacgcaacccccgcgactacgaaaccgacgaacaaaaccgaaatcgcaatactcgacgtacgcctccaactcgtacaacctaaccgaataaccgcaaccgcgaacgcgataatcgcactaaactcgcaacttctaaataaaactacgcaacgacaacacccgatacaactcgccgaacgccaaaaactaacactacaacgaacaccgacgcctccgcaccgcccaaaacaacaaacaactaacgcaaaaaacgtacccgcacgacgta

SEQ ID NO: 10535 - DNA, 678 bp, Artificial Sequence
  chemically treated genomic DNA (Homo sapiens) CpG-island No: 10535
ttttgttgtatagtgaggaaggatgtttaattttaaaggaattttgaagcgttagaaagaatcgtttttttttttattttaatcgattatgttcgcggtgtttatttttttttgtttattttgcggtggtcgttatcgaggtcgtcgacgaagttgcggacgtgagttatgtattgggtgaattttttttggtatttgcgcgtcgtgagttgtatttcgttttgtagcgtttagagttgcgttagtagcgttttttcgcgtcgtttttaggcgaggattcgaggttcgggttttcgttcgcggttttagcggtcgttcggcggtttttcgcgcgcgttttcgtttcggttagttttgggtgtcggatcgtagttttttcgcgcgggtattttattatcgtttagtttcgaagcgtagttttcgcggttgcggagtcggcgggtagggtcgaagtcgtagtgttcgacgtgcgtttttagttcgtgtagtttgatcgagtggtcgtagtcgcgggcgcggtagtcgtattggattcgtagtttttggatgaggttgcgtagcggtagtattcggtatagttcgtcgggcgttaagggttggtattgtagcgggtatcggcgttttcgtatcgtttagggtaataggtagttggcgtagaagacgtgttcgtacggcgtg

SEQ ID NO: 10536 - DNA, 678 bp, Artificial Sequence
  chemically treated genomic DNA (Homo sapiens) CpG-island No: 10536
cacgccgtacgaacacgtcttctacgccaactacctattaccctaaacgatacgaaaacgccgatacccgctacaataccaacccttaacgcccgacgaactataccgaatactaccgctacgcaacctcatccaaaaactacgaatccaatacgactaccgcgcccgcgactacgaccactcgatcaaactacacgaactaaaaacgcacgtcgaacactacgacttcgaccctacccgccgactccgcaaccgcgaaaactacgcttcgaaactaaacgataataaaatacccgcgcgaaaaaactacgatccgacacccaaaactaaccgaaacgaaaacgcgcgcgaaaaaccgccgaacgaccgctaaaaccgcgaacgaaaacccgaacctcgaatcctcgcctaaaaacgacgcgaaaaaacgctactaacgcaactctaaacgctacaaaacgaaatacaactcacgacgcgcaaataccaaaaaaaattcacccaatacataactcacgtccgcaacttcgtcgacgacctcgataacgaccaccgcaaaataaacaaaaaaaaataaacaccgcgaacataatcgattaaaataaaaaaaaaaacgattctttctaacgcttcaaaattcctttaaaattaaacatccttcctcactatacaacaaaa

SEQ ID NO: 10537 - DNA, 547 bp, Artificial Sequence
  chemically treated genomic DNA (Homo sapiens) CpG-island No: 10537
tcggcgtttgttgcgacgggagtttcgagcgtttggtggatttttgtttggaatttaattttttttacgattcggtaaatttgtttcggttggcgtttcggttgcgtttgcggtttttcgcgttgttttcgcggtcggagtagtttcgttttattttcgtcgtatttttttattttttttttatgagaagttcgtttttttcggtcgggaaatagtttagcgtcgagcgttttcgttggtttttcgtcgcgggtttttttttagtttgcgcgcggttttcggttggcgttgtttttgttttcgtcggtttttgttagagtttcgcgtttcgttatcgtcgtcgttattaggttgcgtttgcgttcgcgattggtttaattgtgggttggggttgcgagcgttatttgcgttcgagttagtttttttttgcgtttttaaattgttttttattcggtagtcgtcgttttttttggagagtgtagggtttacgtttgaggttgttgatgcgtcgtagggtagcgtttttagcggttattttattttgttt

SEQ ID NO: 10538 - DNA, 547 bp, Artificial Sequence
  chemically treated genomic DNA (Homo sapiens) CpG-island No: 10538
aaacaaaataaaataaccgctaaaaacgctaccctacgacgcatcaacaacctcaaacgtaaaccctacactctccaaaaaaaacgacgactaccgaataaaaaacaatttaaaaacgcaaaaaaaaactaactcgaacgcaaataacgctcgcaaccccaacccacaattaaaccaatcgcgaacgcaaacgcaacctaataacgacgacgataacgaaacgcgaaactctaacaaaaaccgacgaaaacaaaaacaacgccaaccgaaaaccgcgcgcaaactaaaaaaaaacccgcgacgaaaaaccaacgaaaacgctcgacgctaaactatttcccgaccgaaaaaaacgaacttctcataaaaaaaaaataaaaaaatacgacgaaaataaaacgaaactactccgaccgcgaaaacaacgcgaaaaaccgcaaacgcaaccgaaacgccaaccgaaacaaatttaccgaatcgtaaaaaaaattaaattccaaacaaaaatccaccaaacgctcgaaactcccgtcgcaacaaacgccga

SEQ ID NO: 10539 - DNA, 547 bp, Artificial Sequence
  chemically treated genomic DNA (Homo sapiens) CpG-island No: 10539
gggtagggtgaggtgatcgttgggagcgttattttgcggcgtattaatagttttaggcgtgggttttgtattttttagagaaggcggcggttgtcgggtggagagtaatttggggacgtaaaagaaagttggttcgggcgtaggtggcgttcgtagttttagtttatagttgagttaatcgcgggcgtaagcgtagtttggtggcggcggcggtaacggagcgcggggttttggtaggagtcggcggaggtaaaggtagcgttaatcgagagtcgcgcgtaggttggagggagattcgcggcgaggagttagcgagagcgttcggcgttgggttgtttttcggtcgagggaggcgaattttttatggggaagaagtggagggatgcggcggaaatggagcggggttgtttcgatcgcgaggataacgcggagagtcgtagacgtagtcggagcgttagtcggggtaggtttgtcgagtcgtggaaaaggttaagttttaagtaggggtttattaaacgttcgggattttcgtcgtagtagacgtcgg

SEQ ID NO: 10540 - DNA, 547 bp, Artificial Sequence
  chemically treated genomic DNA (Homo sapiens) CpG-island No: 10540
ccgacgtctactacgacgaaaatcccgaacgtttaataaacccctacttaaaacttaaccttttccacgactcgacaaacctaccccgactaacgctccgactacgtctacgactctccgcgttatcctcgcgatcgaaacaaccccgctccatttccgccgcatccctccacttcttccccataaaaaattcgcctccctcgaccgaaaaacaacccaacgccgaacgctctcgctaactcctcgccgcgaatctccctccaacctacgcgcgactctcgattaacgctacctttacctccgccgactcctaccaaaaccccgcgctccgttaccgccgccgccaccaaactacgcttacgcccgcgattaactcaactataaactaaaactacgaacgccacctacgcccgaaccaactttcttttacgtccccaaattactctccacccgacaaccgccgccttctctaaaaaatacaaaacccacgcctaaaactattaatacgccgcaaaataacgctcccaacgatcacctcaccctaccc

SEQ ID NO: 10541 - DNA, 1203 bp, Artificial Sequence
  chemically treated genomic DNA (Homo sapiens) CpG-island No: 10541
tttttcgtttttcggcgtcgcggttttttgttatttcgggtttttgtcgtcgcggttttttgttttcgtcgtcgtggtttgttgtcgtcgttgtcgcggttttttgtggttttttattttagtttttattgttttttgtttttatcgcggcggttttttgttggttttcgtttttgtcgtcgcggttttttgttttcgttttagcggttttttttcgtcgcgattttttttattcgtatcgaggtttttgtagttttttgttttttgtcgtcgcggttttttgttttcgtcgtcgcggtttttcgttttcgtcgtcgcggtttttgcggttttttgtttgggtcgtcgcggttttttgtttttatcgtcgcggttttttgttatcgttgttttttattttcgttatcgtggttttttgttttcgttgtcgaggttttttgtcgtcgttgtcgcggttttttgtggtttttttgttttagtttttattgtttttcgttttatttcgtcgcggttttttttttcgtcgtcgcgtatttttgttatcgcggttttttgttttcgtcgtcgttttttgtcgttgtagttttttgttttcgttgtcgaggttttttgtcgtcgttgtttcggttttttgtggttttttgttttagtttttattgtttttcgttttttttttcgcggttttttgcggtttttagttttcgacgtcgcggttttttgcgttcgtcgtcgcggttttttgttgttacggttttttgtttttcgtcgtcgcggttttttgtttttcgtcgtcgcgattttttgttttcgtcgtcgcggttttttgttttcgcggtattttgttttttgtcgtcgcggttttttgttttcgtcgtcgttttttgtcgtcgcggttttttgttttcgtcgtcgcggttttgagggcgggagcggtagatttcgttgttagttttattggcgttttggtaagggtagcgtcgaggggttttttcggttcgggggttttttgtttaggcgttcgagtttcgggttttttgtttcggtcgttgtggtttgtatagggcggtattgcgcgcggaggcgatgggagagaagaaggagggcggtggcgggggtgatgtagcggtcgttgagggtggcgtaggggtttcggttagttcggggttgtagtagtgcggatagttttagaagtttatcggtatt

SEQ ID NO: 10542 - DNA, 1203 bp, Artificial Sequence
  chemically treated genomic DNA (Homo sapiens) CpG-island No: 10542
aataccgataaacttctaaaactatccgcactactacaaccccgaactaaccgaaacccctacgccaccctcaacgaccgctacatcacccccgccaccgccctccttcttctctcccatcgcctccgcgcgcaataccgccctatacaaaccacaacgaccgaaacaaaaaacccgaaactcgaacgcctaaacaaaaaacccccgaaccgaaaaaacccctcgacgctacccttaccaaaacgccaataaaactaacaacgaaatctaccgctcccgccctcaaaaccgcgacgacgaaaacaaaaaaccgcgacgacaaaaaacgacgacgaaaacaaaaaaccgcgacgacaaaaaacaaaataccgcgaaaacaaaaaaccgcgacgacgaaaacaaaaaatcgcgacgacgaaaaacaaaaaaccgcgacgacgaaaaacaaaaaaccgtaacaacaaaaaaccgcgacgacgaacgcaaaaaaccgcgacgtcgaaaactaaaaaccgcaaaaaaccgcgaaaaaaaaaacgaaaaacaataaaaactaaaacaaaaaaccacaaaaaaccgaaacaacgacgacaaaaaacctcgacaacgaaaacaaaaaactacaacgacaaaaaacgacgacgaaaacaaaaaaccgcgataacaaaaatacgcgacgacgaaaaaaaaaaccgcgacgaaataaaacgaaaaacaataaaaactaaaacaaaaaaaccacaaaaaaccgcgacaacgacgacaaaaaacctcgacaacgaaaacaaaaaaccacgataacgaaaataaaaaacaacgataacaaaaaaccgcgacgataaaaacaaaaaaccgcgacgacccaaacaaaaaaccgcaaaaaccgcgacgacgaaaacgaaaaaccgcgacgacgaaaacaaaaaaccgcgacgacaaaaaacaaaaaactacaaaaacctcgatacgaataaaaaaaatcgcgacgaaaaaaaaccgctaaaacgaaaacaaaaaaccgcgacgacaaaaacgaaaaccaacaaaaaaccgccgcgataaaaacaaaaaacaataaaaactaaaataaaaaaccacaaaaaaccgcgacaacgacgacaacaaaccacgacgacgaaaacaaaaaaccgcgacgacaaaaacccgaaataacaaaaaaccgcgacgccgaaaaacgaaaaa

SEQ ID NO: 10543 - DNA, 1203 bp, Artificial Sequence
  chemically treated genomic DNA (Homo sapiens) CpG-island No: 10543
gatgtcgatgagtttttggagttgttcgtattgttgtagtttcgggttggtcggggtttttgcgttatttttagcggtcgttgtattattttcgttatcgttttttttttttttttttatcgttttcgcgcgtagtgtcgttttatgtaggttatagcggtcgaggtagggagttcggggttcgggcgtttaggtaaggaattttcgagtcgggagagtttttcggcgttgtttttgttaggacgttagtagagttggtagcggagtttgtcgttttcgtttttagagtcgcggcggcgggagtagaaagtcgcggcggtaaaaagcggcggcgggggtaaaaagtcgcggcggtagggggtaaaatgtcgcgggagtaaaaagtcgcggcggcgggggtagaaagtcgcggcggcggggggtaaaaagtcgcggcggcggggggtaaaaagtcgtggtagtagaaagtcgcggcggcgggcgtaaaaagtcgcggcgtcgggggttaaaagtcgtaaaaagtcgcggaggggggagcgaaaagtagtgggagttggggtaaaaaattataaaaagtcgaggtagcggcggtagaaaatttcggtagcgggggtaaaaagttgtagcggtaaaaagcggcgacgggggtaaaaagtcgcggtggtaaaaatgcgcggcggcgggggaaaaagtcgcggcggagtggggcgaaaagtagtgggagttggggtaaaaaaattataaaaagtcgcggtagcggcggtagaaaatttcggtagcgggggtaaaaagttacggtggcgggggtaaaaagtagcggtggtaagaagtcgcgacggtgggggtaagaagtcgcggcggtttaggtaaaaggtcgtaaaagtcgcggcgacgggggcgaaaagtcgcggcggcggaggtaaaaagtcgcgacggtagggggtaaaaagttgtaaaagtttcggtgcgggtgaaaaaagtcgcggcgagaaaaagtcgttgaggcgggggtaaaaagtcgcggcggtaggggcgaaaattagtaaaaagtcgtcgcggtgggggtaaaaagtagtgggagttggggtaaaaaattataaaaaatcgcggtagcggcggtagtaagttacggcggcgggggtaaaaagtcgcggcggtaaaaattcggggtggtaaaaagtcgcggcgtcgggggacgaaaag

SEQ ID NO: 10544 - DNA, 1203 bp, Artificial Sequence
  chemically treated genomic DNA (Homo sapiens) CpG-island No: 10544
cttttcgtcccccgacgccgcgactttttaccaccccgaatttttaccgccgcgactttttacccccgccgccgtaacttactaccgccgctaccgcgattttttataattttttaccccaactcccactactttttacccccaccgcgacgactttttactaattttcgcccctaccgccgcgactttttacccccgcctcaacgactttttctcgccgcgacttttttcacccgcaccgaaacttttacaactttttaccccctaccgtcgcgactttttacctccgccgccgcgacttttcgcccccgtcgccgcgacttttacgaccttttacctaaaccgccgcgacttcttacccccaccgtcgcgacttcttaccaccgctactttttacccccgccaccgtaactttttacccccgctaccgaaattttctaccgccgctaccgcgactttttataatttttttaccccaactcccactacttttcgccccactccgccgcgactttttcccccgccgccgcgcatttttaccaccgcgactttttacccccgtcgccgctttttaccgctacaactttttacccccgctaccgaaattttctaccgccgctacctcgactttttataattttttaccccaactcccactacttttcgctcccccctccgcgactttttacgacttttaacccccgacgccgcgactttttacgcccgccgccgcgactttctactaccacgactttttaccccccgccgccgcgactttttaccccccgccgccgcgactttctacccccgccgccgcgactttttactcccgcgacattttaccccctaccgccgcgactttttacccccgccgccgctttttaccgccgcgactttctactcccgccgccgcgactctaaaaacgaaaacgacaaactccgctaccaactctactaacgtcctaacaaaaacaacgccgaaaaactctcccgactcgaaaattccttacctaaacgcccgaaccccgaactccctacctcgaccgctataacctacataaaacgacactacgcgcgaaaacgataaaaaaaaaaaaaaaaaacgataacgaaaataatacaacgaccgctaaaaataacgcaaaaaccccgaccaacccgaaactacaacaatacgaacaactccaaaaactcatcgacatc

SEQ ID NO: 10545 - DNA, 611 bp, Artificial Sequence
  chemically treated genomic DNA (Homo sapiens) CpG-island No: 10545
tggttcgtgcgtagatggatagttgaggttggttgaacgttcggcgatttcgcgaggttgcgggtgcgggtttcgcggcggtcggcgcgttgcgttgatattggttgtgcgggtcgcggggtaggtgggtcgcggtaggaggttggcgttttgattgtagatttttcgttttagcgttaggtagtcgtcgtagtcgtagtatattcgagcgttcggtcgttttttgtgtttgcggtagtcggtatgtatcgtagcgggacggggttttatcgcggagtcgcgggtttttagcgttgtttgtaggggcggggcggagcgcggtttagagttttgacgttattttcggggttgcgcggggttggggtcgcggcgttgcgatttatttgtagtgggggaaggaacgcgggggagggcgttgtttcgtttatgcgtatagggtttggttcgggattcggttgcgttttacgttgcggttattgtttcgatttcggttttaggcggattttgtcgggatcggtcgagcgttaggcgtaggatacggttttttaaggtcgtagttttggtgttagcggggtgagaggtttttttgtttagtttttaggtaaggttga

SEQ ID NO: 10546 - DNA, 611 bp, Artificial Sequence
  chemically treated genomic DNA (Homo sapiens) CpG-island No: 10546
tcaaccttacctaaaaactaaacaaaaaaacctctcaccccgctaacaccaaaactacgaccttaaaaaaccgtatcctacgcctaacgctcgaccgatcccgacaaaatccgcctaaaaccgaaatcgaaacaataaccgcaacgtaaaacgcaaccgaatcccgaaccaaaccctatacgcataaacgaaacaacgccctcccccgcgttccttcccccactacaaataaatcgcaacgccgcgaccccaaccccgcgcaaccccgaaaataacgtcaaaactctaaaccgcgctccgccccgcccctacaaacaacgctaaaaacccgcgactccgcgataaaaccccgtcccgctacgatacataccgactaccgcaaacacaaaaaacgaccgaacgctcgaatatactacgactacgacgactacctaacgctaaaacgaaaaatctacaatcaaaacgccaacctcctaccgcgacccacctaccccgcgacccgcacaaccaatatcaacgcaacgcgccgaccgccgcgaaacccgcacccgcaacctcgcgaaatcgccgaacgttcaaccaacctcaactatccatctacgcacgaacca

SEQ ID NO: 10547 - DNA, 611 bp, Artificial Sequence
  chemically treated genomic DNA (Homo sapiens) CpG-island No: 10547
ttagttttgtttggaggttgggtaggagagttttttatttcgttaatattaaaattgcgattttggaggatcgtgttttgcgtttggcgttcggtcgatttcggtagagttcgtttggggtcggggtcgggatagtggtcgtagcgtggagcgtagtcgggtttcgggttaaattttgtgcgtatgggcggagtagcgttttttttcgcgtttttttttttattgtaggtgagtcgtagcgtcgcggttttaatttcgcgtagtttcgggggtgacgttaggattttggatcgcgtttcgtttcgtttttgtaggtaacgttgagggttcgcgatttcgcggtggaatttcgtttcgttgcggtatatgtcggttgtcgtaagtatagggggcgatcgggcgttcgaatgtgttgcggttgcggcggttgtttgacgttaggacgaggagtttgtagttagagcgttagttttttgtcgcggtttatttgtttcgcggttcgtatagttaatgttagcgtagcgcgtcggtcgtcgcggggttcgtattcgtagtttcgcgggatcgtcgggcgtttagttagttttagttgtttatttacgtacgagtta

SEQ ID NO: 10548 - DNA, 611 bp, Artificial Sequence
  chemically treated genomic DNA (Homo sapiens) CpG-island No: 10548
taactcgtacgtaaataaacaactaaaactaactaaacgcccgacgatcccgcgaaactacgaatacgaaccccgcgacgaccgacgcgctacgctaacattaactatacgaaccgcgaaacaaataaaccgcgacaaaaaactaacgctctaactacaaactcctcgtcctaacgtcaaacaaccgccgcaaccgcaacacattcgaacgcccgatcgccccctatacttacgacaaccgacatataccgcaacgaaacgaaattccaccgcgaaatcgcgaaccctcaacgttacctacaaaaacgaaacgaaacgcgatccaaaatcctaacgtcacccccgaaactacgcgaaattaaaaccgcgacgctacgactcacctacaataaaaaaaaaaacgcgaaaaaaaacgctactccgcccatacgcacaaaatttaacccgaaacccgactacgctccacgctacgaccactatcccgaccccgaccccaaacgaactctaccgaaatcgaccgaacgccaaacgcaaaacacgatcctccaaaatcgcaattttaatattaacgaaataaaaaactctcctacccaacctccaaacaaaactaa

SEQ ID NO: 10549 - DNA, 910 bp, Artificial Sequence
  chemically treated genomic DNA (Homo sapiens) CpG-island No: 10549
ggtacgttttttaaatttagtcgcgcgttattatcgtgcgagttttcggtcgttttttttttcgtagagaggataaaggcgtttattatgtcgcggggggcggtttcgggtcgaaggttttcgtagtgttttaagaatttgtttaggatgaagttgttgaagttgcggttgagttgttcgaattcgcggaaaacggtgcgtatcgggttggggaagtattgtagttagggtattacgtttattaggttgttcgcgtttatcgtgcgttcgaatttttcgttgtggttgagtagtttacggaattcggggtcgtcgtggttgtagcggtagtcgaaatatacggtatttatgacgttggttacggttacgacggttagcggtttcgggtcgaggaaggcgtcgttcgcgttgtcgcgtattagtagcgttattagttcgcgcgtttcgtttagtacgtggttttcgaggatttggcggttgcgcggttggcgcgtgaagaagttgcgtattatgttgtgggttgcgcgtcgttgtattttttagtgtttcgagtagtggtcgaaagttatgttgcggtcgtcggatattatacggaaggaggcgaaggtcggtcggtcggcgaaggtcgagttttgttgtattagggtttggtggatggcgcgttcgttatttagtattattatggggtagttgtttaggcggatttggaaaacgtcgtcgtagcgtcgcgttaggcgagcgaacgagaggtgagtcgtttggtttatcgtcgtcgcgttttcgattagtggttacgtaaacgggttcgggggcgcggatcggagttgtcgttttcgttgttttagtagtcgttggtttatatgtatagtggttagtatcgataggagtagtaggagcgtggtttgttgga

SEQ ID NO: 10550 - DNA, 910 bp, Artificial Sequence
  chemically treated genomic DNA (Homo sapiens) CpG-island No: 10550
tccaacaaaccacgctcctactactcctatcgatactaaccactatacatataaaccaacgactactaaaacaacgaaaacgacaactccgatccgcgcccccgaacccgtttacgtaaccactaatcgaaaacgcgacgacgataaaccaaacgactcacctctcgttcgctcgcctaacgcgacgctacgacgacgttttccaaatccgcctaaacaactaccccataataatactaaataacgaacgcgccatccaccaaaccctaatacaacaaaactcgaccttcgccgaccgaccgaccttcgcctccttccgtataatatccgacgaccgcaacataactttcgaccactactcgaaacactaaaaaatacaacgacgcgcaacccacaacataatacgcaacttcttcacgcgccaaccgcgcaaccgccaaatcctcgaaaaccacgtactaaacgaaacgcgcgaactaataacgctactaatacgcgacaacgcgaacgacgccttcctcgacccgaaaccgctaaccgtcgtaaccgtaaccaacgtcataaataccgtatatttcgactaccgctacaaccacgacgaccccgaattccgtaaactactcaaccacaacgaaaaattcgaacgcacgataaacgcgaacaacctaataaacgtaataccctaactacaatacttccccaacccgatacgcaccgttttccgcgaattcgaacaactcaaccgcaacttcaacaacttcatcctaaacaaattcttaaaacactacgaaaaccttcgacccgaaaccgccccccgcgacataataaacgcctttatcctctctacgaaaaaaaaaacgaccgaaaactcgcacgataataacgcgcgactaaatttaaaaaacgtacc

SEQ ID NO: 10551 - DNA, 910 bp, Artificial Sequence
  chemically treated genomic DNA (Homo sapiens) CpG-island No: 10551
tttagtagattacgtttttgttatttttgtcggtgttggttattgtgtatgtgggttagcggttgttgaggtaacggaggcggtagtttcggttcgcgttttcgggttcgtttgcgtggttattgatcggaaacgcggcggcggtgggttaggcggtttatttttcgttcgttcgtttggcgcggcgttacggcgacgttttttagattcgtttgggtagttgttttatagtggtgttgaatggcgagcgcgttatttattaggttttggtgtagtagggttcggttttcgtcgatcggtcggttttcgttttttttcgtgtggtgttcggcggtcgtagtatggttttcggttattattcggagtattggaaggtgtagcggcgcgtagtttatagtatgatgcgtaatttttttacgcgttagtcgcgtagtcgttaagttttcgagggttacgtgttgagcgaggcgcgcgagttggtggcgttgttggtgcgcggtagcgcggacggcgtttttttcgattcgaggtcgttgatcgtcgtggtcgtggttaacgttatgagtgtcgtgtgtttcggttgtcgttatagttacgacgatttcgagtttcgtgagttgtttagttataacgaagagttcgggcgtacggtgggcgcgggtagtttggtggacgtgatgttttggttgtagtatttttttaattcggtgcgtatcgtttttcgcgaattcgagtagtttaatcgtaattttagtaattttattttggataagtttttgaggtattgcgaaagttttcggttcggggtcgtttttcgcgatatgatggacgtttttattttttttgcggaaaagaaggcggtcggggattcgtacggtggtggcgcgcggttggatttggagaacgtatt

SEQ ID NO: 10552 - DNA, 910 bp, Artificial Sequence
  chemically treated genomic DNA (Homo sapiens) CpG-island No: 10552
aatacgttctccaaatccaaccgcgcgccaccaccgtacgaatccccgaccgccttcttttccgcaaaaaaaataaaaacgtccatcatatcgcgaaaaacgaccccgaaccgaaaactttcgcaatacctcaaaaacttatccaaaataaaattactaaaattacgattaaactactcgaattcgcgaaaaacgatacgcaccgaattaaaaaaatactacaaccaaaacatcacgtccaccaaactacccgcgcccaccgtacgcccgaactcttcgttataactaaacaactcacgaaactcgaaatcgtcgtaactataacgacaaccgaaacacacgacactcataacgttaaccacgaccacgacgatcaacgacctcgaatcgaaaaaaacgccgtccgcgctaccgcgcaccaacaacgccaccaactcgcgcgcctcgctcaacacgtaaccctcgaaaacttaacgactacgcgactaacgcgtaaaaaaattacgcatcatactataaactacgcgccgctacaccttccaatactccgaataataaccgaaaaccatactacgaccgccgaacaccacacgaaaaaaaacgaaaaccgaccgatcgacgaaaaccgaaccctactacaccaaaacctaataaataacgcgctcgccattcaacaccactataaaacaactacccaaacgaatctaaaaaacgtcgccgtaacgccgcgccaaacgaacgaacgaaaaataaaccgcctaacccaccgccgccgcgtttccgatcaataaccacgcaaacgaacccgaaaacgcgaaccgaaactaccgcctccgttacctcaacaaccgctaacccacatacacaataaccaacaccgacaaaaataacaaaaacgtaatctactaaa

SEQ ID NO: 10553 - DNA, 745 bp, Artificial Sequence
  chemically treated genomic DNA (Homo sapiens) CpG-island No: 10553
cgtcgttcgttggtgggcgcggggtcgtttaggttgcgatggaagtcgttggcgtagggcggggagttaagttggggcgattgggggggtttgggggagttagcggggcgggattcgagcggggcggagagtggtaggaggaggcgaattttcgcgtttcggcgaattttatcgggttgaagtttttgttgtcgttttttttttgcgtgcggagttgggttttgcgtgcgtcgtttttggaaagtcggttttagttatatttttgggcgttgtttgcggtcgtttttttcgcgttttttacggtatttgaaacgcggaggcggcggtcgagggtggggtgtcggttattattatttttggcgtggggtgtcggtcgttattattttcggttgcgtacgtatagtcgcgtttgttaggttagcgaggcggacgtttgggttattattcgtaggtcgagttcgggcgcgtatcgttatttcgttgcgtatcggcggttttgtggtttttttgggcgcgtttgcggtcgcgaagggggttttttttttataagggaagtcggaggcgtttgggcgggggtggtttttttcgtttggcgcgtttttttttatatgttgatgtataggatttttaagatagttaagagaataaggattttacgaggcggggggaagggcgaattcgagggaagaggtgggatgtatttggttaattaggtaggaattgtattggttttattaaaggataa

SEQ ID NO: 10554 - DNA, 745 bp, Artificial Sequence
  chemically treated genomic DNA (Homo sapiens) CpG-island No: 10554
ttatcctttaataaaaccaatacaattcctacctaattaaccaaatacatcccacctcttccctcgaattcgcccttccccccgcctcgtaaaatccttattctcttaactatcttaaaaatcctatacatcaacatataaaaaaaaacgcgccaaacgaaaaaaaccacccccgcccaaacgcctccgacttcccttataaaaaaaaaacccccttcgcgaccgcaaacgcgcccaaaaaaaccacaaaaccgccgatacgcaacgaaataacgatacgcgcccgaactcgacctacgaataataacccaaacgtccgcctcgctaacctaacaaacgcgactatacgtacgcaaccgaaaataataacgaccgacaccccacgccaaaaataataataaccgacaccccaccctcgaccgccgcctccgcgtttcaaataccgtaaaaaacgcgaaaaaaacgaccgcaaacaacgcccaaaaatataactaaaaccgactttccaaaaacgacgcacgcaaaacccaactccgcacgcaaaaaaaaaacgacaacaaaaacttcaacccgataaaattcgccgaaacgcgaaaattcgcctcctcctaccactctccgccccgctcgaatcccgccccgctaactcccccaaacccccccaatcgccccaacttaactccccgccctacgccaacgacttccatcgcaacctaaacgaccccgcgcccaccaacgaacgacg

SEQ ID NO: 10555 - DNA, 745 bp, Artificial Sequence
  chemically treated genomic DNA (Homo sapiens) CpG-island No: 10555
ttattttttgatgaagttagtataatttttatttggttaattagatatattttattttttttttcgagttcgttttttttttcgtttcgtgaagtttttgtttttttagttgttttgaaaattttatgtattagtatgtaggaaagggcgcgttaggcgggggaagttattttcgtttaagcgttttcggttttttttataaagggagggtttttttcgcgatcgtaagcgcgtttaggaagattatagagtcgtcggtgcgtagcgaggtggcgatacgcgttcgggttcggtttgcgggtggtggtttaagcgttcgtttcgttggtttggtaggcgcgattgtgcgtgcgtagtcgagggtggtggcggtcggtattttacgttaagggtggtggtggtcggtattttattttcggtcgtcgttttcgcgttttaggtgtcgtgagaagcgcgggaggagcggtcgtaggtagcgtttagggatatgattggagtcgattttttagaagcggcgtacgtaaagtttagtttcgtacgtaaaggggaggcgatagtagaaattttaattcgataaagttcgtcggggcgcggagattcgtttttttttgttatttttcgtttcgttcgggtttcgtttcgttagtttttttaggtttttttagtcgttttagtttggtttttcgttttgcgttaacggtttttatcgtagtttgggcggtttcgcgtttattagcgggcggcg

SEQ ID NO: 10556 - DNA, 745 bp, Artificial Sequence
  chemically treated genomic DNA (Homo sapiens) CpG-island No: 10556
cgccgcccgctaataaacgcgaaaccgcccaaactacgataaaaaccgttaacgcaaaacgaaaaaccaaactaaaacgactaaaaaaacctaaaaaaactaacgaaacgaaacccgaacgaaacgaaaaataacaaaaaaaaacgaatctccgcgccccgacgaactttatcgaattaaaatttctactatcgcctcccctttacgtacgaaactaaactttacgtacgccgcttctaaaaaatcgactccaatcatatccctaaacgctacctacgaccgctcctcccgcgcttctcacgacacctaaaacgcgaaaacgacgaccgaaaataaaataccgaccaccaccacccttaacgtaaaataccgaccgccaccaccctcgactacgcacgcacaatcgcgcctaccaaaccaacgaaacgaacgcttaaaccaccacccgcaaaccgaacccgaacgcgtatcgccacctcgctacgcaccgacgactctataatcttcctaaacgcgcttacgatcgcgaaaaaaaccctccctttataaaaaaaaccgaaaacgcttaaacgaaaataacttcccccgcctaacgcgccctttcctacatactaatacataaaattttcaaaacaactaaaaaaacaaaaacttcacgaaacgaaaaaaaaaacgaactcgaaaaaaaaaataaaatatatctaattaaccaaataaaaattatactaacttcatcaaaaaataa

SEQ ID NO: 10557 - DNA, 736 bp, Artificial Sequence
  chemically treated genomic DNA (Homo sapiens) CpG-island No: 10557
agcgtattcgggttataggcggaggagttagttaaatttttttttcgcgttcgtagtcgcgtttttttagtcgttatttttttagtatcggggcgtatttataggtcggtattagttttaggaaaagcgttttttgcgtacggtttcgaagtcgtagttgtcgtacgatgtggcgtttttagcgcgttgcgggggtatcggggacgttcggtttcgttatggtcgcgttttttcgtttagcggcgcgtttttttcgtttaggacggcgttaggtcggggcggggtttcgcggggatttcgtgacgttagggggcgggcggcggcggggaattttcggtttgttttaagagggttttggcggggaggatcgaaggtcgacgtcgggaggatttgttttcgggaggagtcgttttcgggtttgaatcgtcggggtttcgttcgaaatgtttatttaagtgggggtttttgtggttgcgagggttataagtaggagcgaggtcggagttttcggggaggttttttttacgcgggtggagcgtttcggaggcggggtttttaaggttcgggtgttttaatttcgtcgcgttcgggtcgagttcgagagtcgttggtgttttttaggtcgtcgcgtttttggtcgcgtatttagttagggatttagaggtttttagtttcgggttttgcgcgtatattgagggcgcggcgtagtaggatagtaagataaggaagtagagat

SEQ ID NO: 10558 - DNA, 736 bp, Artificial Sequence
  chemically treated genomic DNA (Homo sapiens) CpG-island No: 10558
atctctacttccttatcttactatcctactacgccgcgccctcaatatacgcgcaaaacccgaaactaaaaacctctaaatccctaactaaatacgcgaccaaaaacgcgacgacctaaaaaacaccaacgactctcgaactcgacccgaacgcgacgaaattaaaacacccgaaccttaaaaaccccgcctccgaaacgctccacccgcgtaaaaaaaacctccccgaaaactccgacctcgctcctacttataaccctcgcaaccacaaaaacccccacttaaataaacatttcgaacgaaaccccgacgattcaaacccgaaaacgactcctcccgaaaacaaatcctcccgacgtcgaccttcgatcctccccgccaaaaccctcttaaaacaaaccgaaaattccccgccgccgcccgccccctaacgtcacgaaatccccgcgaaaccccgccccgacctaacgccgtcctaaacgaaaaaaacgcgccgctaaacgaaaaaacgcgaccataacgaaaccgaacgtccccgatacccccgcaacgcgctaaaaacgccacatcgtacgacaactacgacttcgaaaccgtacgcaaaaaacgcttttcctaaaactaataccgacctataaatacgccccgatactaaaaaaataacgactaaaaaaacgcgactacgaacgcgaaaaaaaaatttaactaactcctccgcctataacccgaatacgct

SEQ ID NO: 10559 - DNA, 736 bp, Artificial Sequence
  chemically treated genomic DNA (Homo sapiens) CpG-island No: 10559
gtttttgtttttttattttgttgttttgttgcgtcgcgtttttagtgtacgcgtagagttcggggttgagggtttttgggtttttggttgggtgcgcggttaggagcgcgacggtttgggaagtattagcggttttcgaattcggttcgggcgcggcggggttaagatattcgggttttgagggtttcgttttcggagcgttttattcgcgtgggggaagttttttcggaggtttcgatttcgtttttgtttatgattttcgtagttataggagtttttatttaggtgaatatttcggacggggtttcggcggtttagattcggaggcggtttttttcggaggtagattttttcggcgtcggttttcggtttttttcgttaaagtttttttgggataagtcggggatttttcgtcgtcgttcgttttttggcgttacggagttttcgcgaggtttcgtttcggtttggcgtcgttttgggcgggaggaacgcgtcgttaggcgggagagcgcggttatggcggggtcgggcgttttcggtgttttcgtagcgcgttggaaacgttatatcgtgcggtagttgcggtttcgggatcgtacgtaaaaggcgttttttttggagttggtgtcggtttgtgagtgcgtttcggtgttgagaggatggcggttgaggggacgcggttacgggcgcggggagagggtttggttggttttttcgtttgtgattcgagtgcgtt

SEQ ID NO: 10560 - DNA, 736 bp, Artificial Sequence
  chemically treated genomic DNA (Homo sapiens) CpG-island No: 10560
aacgcactcgaatcacaaacgaaaaaaccaaccaaaccctctccccgcgcccgtaaccgcgtcccctcaaccgccatcctctcaacaccgaaacgcactcacaaaccgacaccaactccaaaaaaaacgccttttacgtacgatcccgaaaccgcaactaccgcacgatataacgtttccaacgcgctacgaaaacaccgaaaacgcccgaccccgccataaccgcgctctcccgcctaacgacgcgttcctcccgcccaaaacgacgccaaaccgaaacgaaacctcgcgaaaactccgtaacgccaaaaaacgaacgacgacgaaaaatccccgacttatcccaaaaaaactttaacgaaaaaaaccgaaaaccgacgccgaaaaaatctacctccgaaaaaaaccgcctccgaatctaaaccgccgaaaccccgtccgaaatattcacctaaataaaaactcctataactacgaaaatcataaacaaaaacgaaatcgaaacctccgaaaaaacttcccccacgcgaataaaacgctccgaaaacgaaaccctcaaaacccgaatatcttaaccccgccgcgcccgaaccgaattcgaaaaccgctaatacttcccaaaccgtcgcgctcctaaccgcgcacccaaccaaaaacccaaaaaccctcaaccccgaactctacgcgtacactaaaaacgcgacgcaacaaaacaacaaaataaaaaaacaaaaac

SEQ ID NO: 10561 - DNA, 1329 bp, Artificial Sequence
  chemically treated genomic DNA (Homo sapiens) CpG-island No: 10561
atttcggtggtcgcggtagtagtaaggtcgttttggtgagtgtacgtggtttacgggtaggtcgcgcgttcggtcggtataggaagtttggggcgttgggtagggatcgcggggtgatatttggattttcggttgttcgaaagggcgacgattttatttttttttttttcggtgtcgaggtgtaagaggcggttgaatttaggagcgcggcgtagggcgggtttttttcggttgttttttcggggttcgtttttttttttcgtatcgtttcggtcgtcgagcgttacgttagtcgttagtgttcggttcgttgagtttacgtttttcgattcggagttttaagttttcggttttttgtagttttcggttttcggtttcgagtcgcggcgttcgcgtttttcgtttttcgttagtcggagtttcgaattcgtagagttttcgcgttttcggtttcgcgtttttagtattatatttcgtatttttgagtttcgagtttcgcgttcgtagtacgtacgtcgtagattagagtcgtcggcgtttacgtggtttcgggatttttcgttcgcggcgtttaagcgttttacgtttcgcgaagcgttaagtgcggggtagggcgtcggtttgcgcggcgttattagggcgcgaagaatatgacgaagtgcgcggcgttttggatttcgtgcgtgaatatgtcggtcgtgtataggtgtttgttgtgcgggttttgttcgttttcgtcgtttgtcgcggggggttcgttcgtcgtcgtcgtcgtcgttttttgggttcgggcgttttagcgttcgtcgtcgttatggtttagtagtagtagtagtagcgtagttagggtcgtcggtcgggttagtagcgggaggaggcgttttgggcgcgcgggtatcgcggcggggttgggcgcgttttcgtcgcggttttcggttttttcgtagcgttcgtttcgcgtttcgtttcggagaggtcgcgttttttttttttttcgttcgttcgcgtcggcgcgcgatcgttattcgttcgagtttcggtttcgcgtatcggtagggaagggttggagcgagggatcgagtttgggagagtttttcgagttcggttttttgttttttcgttatgggacggttcgtattaatttcgcgaggtttttgcgttttcgtaatttaggttcgtatttttttttttaggggttcgttttgtttagagcggcggtgaatatacgaagtaacgatgaggttagcgggaagttacggaggggtaggttagtttcggttaattttagtttatataagtatttcgcgattttaggttaaaggaaggaga

SEQ ID NO: 10562 - DNA, 1329 bp, Artificial Sequence
  chemically treated genomic DNA (Homo sapiens) CpG-island No: 10562
tctccttcctttaacctaaaatcgcgaaatacttatataaactaaaattaaccgaaactaacctacccctccgtaacttcccgctaacctcatcgttacttcgtatattcaccgccgctctaaacaaaacgaacccctaaaaaaaaaaatacgaacctaaattacgaaaacgcaaaaacctcgcgaaattaatacgaaccgtcccataacgaaaaaacaaaaaaccgaactcgaaaaactctcccaaactcgatccctcgctccaacccttccctaccgatacgcgaaaccgaaactcgaacgaataacgatcgcgcgccgacgcgaacgaacgaaaaaaaaaaaaaacgcgacctctccgaaacgaaacgcgaaacgaacgctacgaaaaaaccgaaaaccgcgacgaaaacgcgcccaaccccgccgcgatacccgcgcgcccaaaacgcctcctcccgctactaacccgaccgacgaccctaactacgctactactactactactaaaccataacgacgacgaacgctaaaacgcccgaacccaaaaaacgacgacgacgacgacgaacgaaccccccgcgacaaacgacgaaaacgaacaaaacccgcacaacaaacacctatacacgaccgacatattcacgcacgaaatccaaaacgccgcgcacttcgtcatattcttcgcgccctaataacgccgcgcaaaccgacgccctaccccgcacttaacgcttcgcgaaacgtaaaacgcttaaacgccgcgaacgaaaaatcccgaaaccacgtaaacgccgacgactctaatctacgacgtacgtactacgaacgcgaaactcgaaactcaaaaatacgaaatataatactaaaaacgcgaaaccgaaaacgcgaaaactctacgaattcgaaactccgactaacgaaaaacgaaaaacgcgaacgccgcgactcgaaaccgaaaaccgaaaactacaaaaaaccgaaaacttaaaactccgaatcgaaaaacgtaaactcaacgaaccgaacactaacgactaacgtaacgctcgacgaccgaaacgatacgaaaaaaaaaaacgaaccccgaaaaaacaaccgaaaaaaacccgccctacgccgcgctcctaaattcaaccgcctcttacacctcgacaccgaaaaaaaaaaaaataaaatcgtcgccctttcgaacaaccgaaaatccaaatatcaccccgcgatccctacccaacgccccaaacttcctataccgaccgaacgcgcgacctacccgtaaaccacgtacactcaccaaaacgaccttactactaccgcgaccaccgaaat

SEQ ID NO: 10563 - DNA, 1329 bp, Artificial Sequence
  chemically treated genomic DNA (Homo sapiens) CpG-island No: 10563
ttttttttttttggtttgaaatcgcggggtgtttgtgtgagttgagattagtcgaggttgatttgttttttcgtggtttttcgttggttttatcgttatttcgtgtgtttatcgtcgttttgagtagagcgggtttttggggaaaggggtgcgggtttgggttgcggaggcgtaggagtttcgcgggattggtgcgagtcgttttatggcgggaaggtaggaggtcggattcggaaggtttttttagattcggtttttcgttttagtttttttttgtcggtgcgcggagtcggggttcgggcgggtagcggtcgcgcgtcggcgcgggcgggcggggagaggaaggggcgcggttttttcggggcggggcgcggggcgggcgttgcgaggggatcggaggtcgcggcgagagcgcgtttagtttcgtcgcgatgttcgcgcgtttaggacgttttttttcgttgttggttcggtcggcggttttgattgcgttgttgttgttgttgttgggttatggcggcggcgggcgttggggcgttcgggtttaggaggcggcggcggcggcggcggacgggtttttcgcggtagacggcgaggacggataggattcgtatagtaagtatttgtatacggtcgatatgtttacgtacgggatttagagcgtcgcgtatttcgttatgtttttcgcgttttggtaacgtcgcgtaggtcggcgttttgtttcgtatttggcgtttcgcggggcgtggggcgtttgggcgtcgcgggcggggggtttcggggttacgtggacgtcgacggttttggtttgcggcgtgcgtgttacgggcgcggggttcggggtttaggggtgcggggtgtaatattgggggcgcggggtcgggagcgcggggattttgcgggttcggggtttcggttggcggggagcggggggcgcgggcgtcgcggttcggggtcgggagtcggggattgtaggggatcgagggtttggggtttcgggtcggggggcgtgagtttagcgggtcgggtattggcggttgacgtggcgttcggcggtcggggcggtgcgggaggagggggcggatttcgaggggatagtcgggaaaagttcgttttgcgtcgcgtttttgaatttaatcgttttttgtatttcggtatcgagggaggggaaggtggggtcgtcgttttttcgggtagtcgggagtttaaatgttatttcgcggtttttgtttagcgttttaaattttttgtgtcggtcggacgcgcggtttgttcgtgggttacgtgtatttattagagcggttttgttgttgtcgcggttatcggggt

SEQ ID NO: 10564 - DNA, 1329 bp, Artificial Sequence
  chemically treated genomic DNA (Homo sapiens) CpG-island No: 10564
accccgataaccgcgacaacaacaaaaccgctctaataaatacacgtaacccacgaacaaaccgcgcgtccgaccgacacaaaaaatttaaaacgctaaacaaaaaccgcgaaataacatttaaactcccgactacccgaaaaaacgacgaccccaccttcccctccctcgataccgaaatacaaaaaacgattaaattcaaaaacgcgacgcaaaacgaacttttcccgactatcccctcgaaatccgccccctcctcccgcaccgccccgaccgccgaacgccacgtcaaccgccaatacccgacccgctaaactcacgccccccgacccgaaaccccaaaccctcgatcccctacaatccccgactcccgaccccgaaccgcgacgcccgcgccccccgctccccgccaaccgaaaccccgaacccgcaaaatccccgcgctcccgaccccgcgcccccaatattacaccccgcacccctaaaccccgaaccccgcgcccgtaacacgcacgccgcaaaccaaaaccgtcgacgtccacgtaaccccgaaaccccccgcccgcgacgcccaaacgccccacgccccgcgaaacgccaaatacgaaacaaaacgccgacctacgcgacgttaccaaaacgcgaaaaacataacgaaatacgcgacgctctaaatcccgtacgtaaacatatcgaccgtatacaaatacttactatacgaatcctatccgtcctcgccgtctaccgcgaaaaacccgtccgccgccgccgccgccgcctcctaaacccgaacgccccaacgcccgccgccgccataacccaacaacaacaacaacaacgcaatcaaaaccgccgaccgaaccaacaacgaaaaaaaacgtcctaaacgcgcgaacatcgcgacgaaactaaacgcgctctcgccgcgacctccgatcccctcgcaacgcccgccccgcgccccgccccgaaaaaaccgcgccccttcctctccccgcccgcccgcgccgacgcgcgaccgctacccgcccgaaccccgactccgcgcaccgacaaaaaaaaactaaaacgaaaaaccgaatctaaaaaaaccttccgaatccgacctcctaccttcccgccataaaacgactcgcaccaatcccgcgaaactcctacgcctccgcaacccaaacccgcacccctttccccaaaaacccgctctactcaaaacgacgataaacacacgaaataacgataaaaccaacgaaaaaccacgaaaaaacaaatcaacctcgactaatctcaactcacacaaacaccccgcgatttcaaaccaaaaaaaaaaaa

SEQ ID NO: 10565 - DNA, 811 bp, Artificial Sequence
  chemically treated genomic DNA (Homo sapiens) CpG-island No: 10565
tttcgcgacgtcgcgttcgggaggaggtaggagcgcgacgttgcggtcgtagggtaggagcgtagtcggtttcgcgttttttcgttttttggtttcggttcgggttcgcgaggcgtttttggggcgaggtcgcggcggtcgtttcgttataggtagcgttagttttcgttcgtcgtcgtttcggcgtttcgggtaggttcgttttaggtatttggatgaattggatggtgagcgtcgatttgtttacgtcgttttcgtcgattattacgagtcggtattttttttggtcggagtcgtttcgttagtcggtcgcggttatggggacgttatagagtttagtttgattgcgtcgagtcgtcgttgtcgttcgttttaggttcggtttcggggacgtgtgcggtcggcgggttgcgggcgagcggtcgggttggggtttcgggtatcgggaggcgtttggagggtcggttagcgcggtagcgcggcgttggggattggttgggtatcgttcgaggcgcggagaagcggggtgacggtacgggttaggggcggtagcggtcggggggcgcgtttttttacgcgttttcgtagcgtttgtcgaacgtagtttttagcgtcgttataaatggtcgtttgggggtcgggttgttaggttgaggtgttgtatatgtatgagggggcggggaggggcggggtcgcgtcgtttggggttgaggttcgggaggtaattcgggttttagatttttacggatatatcgttttaatttttagttagtgagcgagtgcgtgagagtgtgggagtgggtgttagttg

SEQ ID NO: 10566 - DNA, 811 bp, Artificial Sequence
  chemically treated genomic DNA (Homo sapiens) CpG-island No: 10566
caactaacacccactcccacactctcacgcactcgctcactaactaaaaattaaaacgatatatccgtaaaaatctaaaacccgaattacctcccgaacctcaaccccaaacgacgcgaccccgcccctccccgccccctcatacatatacaacacctcaacctaacaacccgacccccaaacgaccatttataacgacgctaaaaactacgttcgacaaacgctacgaaaacgcgtaaaaaaacgcgccccccgaccgctaccgcccctaacccgtaccgtcaccccgcttctccgcgcctcgaacgatacccaaccaatccccaacgccgcgctaccgcgctaaccgaccctccaaacgcctcccgatacccgaaaccccaacccgaccgctcgcccgcaacccgccgaccgcacacgtccccgaaaccgaacctaaaacgaacgacaacgacgactcgacgcaatcaaactaaactctataacgtccccataaccgcgaccgactaacgaaacgactccgaccaaaaaaaataccgactcgtaataatcgacgaaaacgacgtaaacaaatcgacgctcaccatccaattcatccaaatacctaaaacgaacctacccgaaacgccgaaacgacgacgaacgaaaactaacgctacctataacgaaacgaccgccgcgacctcgccccaaaaacgcctcgcgaacccgaaccgaaaccaaaaaacgaaaaaacgcgaaaccgactacgctcctaccctacgaccgcaacgtcgcgctcctacctcctcccgaacgcgacgtcgcgaaa

SEQ ID NO: 10567 - DNA, 811 bp, Artificial Sequence
  chemically treated genomic DNA (Homo sapiens) CpG-island No: 10567
taattgatatttatttttatatttttacgtattcgtttattggttagggattagagcggtgtgttcgtgggggtttgaagttcgggttatttttcgaattttagttttaagcggcgcggtttcgttttttttcgtttttttatgtatatgtagtattttagtttggtagttcggtttttagacggttatttgtggcggcgttggaggttgcgttcggtaggcgttgcggagacgcgtagaggagcgcgtttttcggtcgttgtcgtttttggttcgtgtcgttatttcgttttttcgcgtttcgggcggtatttagttagtttttagcgtcgcgttatcgcgttgatcggttttttagacgtttttcggtattcgggattttagttcggtcgttcgttcgtagttcgtcggtcgtatacgttttcggagtcgggtttagggcgggcggtagcggcggttcggcgtagttaggttgggttttgtagcgtttttatggtcgcggtcggttggcgggacggtttcggttaggagaagtatcggttcgtggtggtcggcgggggcggcgtgggtaagtcggcgtttattatttagtttatttaggtatttggagcgggtttgttcggggcgtcggagcggcggcgggcgggggttggcgttatttgtggcggggcggtcgtcgcgatttcgttttagaggcgtttcgcgggttcgggtcggggttagggggcgggagggcgcggggtcgattacgtttttgttttgcggtcgtagcgtcgcgtttttgttttttttcgggcgcggcgtcgcggga

SEQ ID NO: 10568 - DNA, 811 bp, Artificial Sequence
  chemically treated genomic DNA (Homo sapiens) CpG-island No: 10568
tcccgcgacgccgcgcccgaaaaaaaacaaaaacgcgacgctacgaccgcaaaacaaaaacgtaatcgaccccgcgccctcccgccccctaaccccgacccgaacccgcgaaacgcctctaaaacgaaatcgcgacgaccgccccgccacaaataacgccaacccccgcccgccgccgctccgacgccccgaacaaacccgctccaaatacctaaataaactaaataataaacgccgacttacccacgccgcccccgccgaccaccacgaaccgatacttctcctaaccgaaaccgtcccgccaaccgaccgcgaccataaaaacgctacaaaacccaacctaactacgccgaaccgccgctaccgcccgccctaaacccgactccgaaaacgtatacgaccgacgaactacgaacgaacgaccgaactaaaatcccgaataccgaaaaacgtctaaaaaaccgatcaacgcgataacgcgacgctaaaaactaactaaataccgcccgaaacgcgaaaaaacgaaataacgacacgaaccaaaaacgacaacgaccgaaaaacgcgctcctctacgcgtctccgcaacgcctaccgaacgcaacctccaacgccgccacaaataaccgtctaaaaaccgaactaccaaactaaaatactacatatacataaaaaaacgaaaaaaaacgaaaccgcgccgcttaaaactaaaattcgaaaaataacccgaacttcaaacccccacgaacacaccgctctaatccctaaccaataaacgaatacgtaaaaatataaaaataaatatcaatta

SEQ ID NO: 10569 - DNA, 533 bp, Artificial Sequence
  chemically treated genomic DNA (Homo sapiens) CpG-island No: 10569
ggatttttcgcggatgagggtagcgtcggttttttgcggttaagatgttgtaaaacgtgattttttataataagtacgttttcgcgagttcgtgtgggaaggggatgttgtagggcggcggtataggggtgtggggcgtcgtgttgggagtattgagcggtttcggcgcgttgttgttgcggcgtagttgtcgattcggtcgcgcggagggaattgagcgacggttttggaacggtggtggcggttcggttattgttcgtggaggggaatataggttgttaatttatacgttattaatgtcgtcgtggtttagttttaatcgagttaggtagagttagtttgacggtggagtggagtgaggttgaatagtaggtttggcgtttggtgggtttggtatttagcggcggtttgttagttttttaggggggatttacggatatttttagcgttttgtagggttgttatggtgacggagcgtttaagggattggtaacggggatttttagagaagggtaaagggattattttttcgt

SEQ ID NO: 10570 - DNA, 533 bp, Artificial Sequence
  chemically treated genomic DNA (Homo sapiens) CpG-island No: 10570
acgaaaaaataatccctttacccttctctaaaaatccccgttaccaatcccttaaacgctccgtcaccataacaaccctacaaaacgctaaaaatatccgtaaatcccccctaaaaaactaacaaaccgccgctaaataccaaacccaccaaacgccaaacctactattcaacctcactccactccaccgtcaaactaactctacctaactcgattaaaactaaaccacgacgacattaataacgtataaattaacaacctatattcccctccacgaacaataaccgaaccgccaccaccgttccaaaaccgtcgctcaattccctccgcgcgaccgaatcgacaactacgccgcaacaacaacgcgccgaaaccgctcaatactcccaacacgacgccccacacccctataccgccgccctacaacatccccttcccacacgaactcgcgaaaacgtacttattataaaaaatcacgttttacaacatcttaaccgcaaaaaaccgacgctaccctcatccgcgaaaaatcc

SEQ ID NO: 10571 - DNA, 533 bp, Artificial Sequence
  chemically treated genomic DNA (Homo sapiens) CpG-island No: 10571
acgggagagtgatttttttatttttttttgggaattttcgttgttagttttttaagcgtttcgttattatggtaattttatagggcgttagaggtgttcgtgaattttttttaaaaggttaatagatcgtcgttagatattagatttattaaacgttaaatttgttgtttaattttattttattttatcgttaaattagttttgtttgattcggttaagattgggttacggcggtattaatagcgtataaattgataatttgtatttttttttacgagtagtagtcgagtcgttattatcgttttaaaatcgtcgtttaatttttttcgcgcgatcgagtcgatagttgcgtcgtaatagtagcgcgtcggggtcgtttagtatttttaatacggcgttttatatttttgtgtcgtcgttttgtaatattttttttttatacgggttcgcggaaacgtatttattgtggggagttacgttttgtagtattttgatcgtaaggaatcggcgttgtttttattcgcggaaagttt

SEQ ID NO: 10572 - DNA, 533 bp, Artificial Sequence
  chemically treated genomic DNA (Homo sapiens) CpG-island No: 10572
aaactttccgcgaataaaaacaacgccgattccttacgatcaaaatactacaaaacgtaactccccacaataaatacgtttccgcgaacccgtataaaaaaaaaatattacaaaacgacgacacaaaaatataaaacgccgtattaaaaatactaaacgaccccgacgcgctactattacgacgcaactatcgactcgatcgcgcgaaaaaaattaaacgacgattttaaaacgataataacgactcgactactactcgtaaaaaaaaatacaaattatcaatttatacgctattaataccgccgtaacccaatcttaaccgaatcaaacaaaactaatttaacgataaaataaaataaaattaaacaacaaatttaacgtttaataaatctaatatctaacgacgatctattaaccttttaaaaaaaattcacgaacacctctaacgccctataaaattaccataataacgaaacgcttaaaaaactaacaacgaaaattcccaaaaaaaaataaaaaaatcactctcccgt

SEQ ID NO: 10573 - DNA, 645 bp, Artificial Sequence
  chemically treated genomic DNA (Homo sapiens) CpG-island No: 10573
tttcgggcggtagggcgggagggcggtcgagcgcgggcgggaggcgtttttattttgaaggtttgtttcgtttttttcggcgcggggttttttgatcggagggcgagtttacgagaacgttagggaggcgtacgtagggtattaagggcgtcgcgttttaattttttcgcgttttagatttaggtcgtttttggaggtgtttgtagttttcgtcgtcggagttacgggaggagtcgtagtcgttttttcgggagtcgcgcgttgattgtagtgttaggcggaacgcggtttagcgcggttgtagtttcgtcgtatttttttttttggaatttcggttttcgttttgcgtatttcggtagtagtcgaatcgtagtttgggatttcgattgttatagtttttttcgtcggattcggggttttttcgttttcggcgttataataataaggaagttttttcgtaagtttgcgggcggcggaatgcgttgggtgaatggtttcgtatcgggttaatgggcgtcgttttgggatgggttcgcgttaatggcggtcgtcgtggtacgggttggaggcggggcggtaaggttcgcgggtaggaggaggggagaggtttaggttttagagttaggcgtaggttgttcgaggtga

SEQ ID NO: 10574 - DNA, 645 bp, Artificial Sequence
  chemically treated genomic DNA (Homo sapiens) CpG-island No: 10574
tcacctcgaacaacctacgcctaactctaaaacctaaacctctcccctcctcctacccgcgaaccttaccgccccgcctccaacccgtaccacgacgaccgccattaacgcgaacccatcccaaaacgacgcccattaacccgatacgaaaccattcacccaacgcattccgccgcccgcaaacttacgaaaaaacttccttattattataacgccgaaaacgaaaaaaccccgaatccgacgaaaaaaactataacaatcgaaatcccaaactacgattcgactactaccgaaatacgcaaaacgaaaaccgaaattccaaaaaaaaaaatacgacgaaactacaaccgcgctaaaccgcgttccgcctaacactacaatcaacgcgcgactcccgaaaaaacgactacgactcctcccgtaactccgacgacgaaaactacaaacacctccaaaaacgacctaaatctaaaacgcgaaaaaattaaaacgcgacgcccttaataccctacgtacgcctccctaacgttctcgtaaactcgccctccgatcaaaaaaccccgcgccgaaaaaaacgaaacaaaccttcaaaataaaaacgcctcccgcccgcgctcgaccgccctcccgccctaccgcccgaaa

SEQ ID NO: 10575 - DNA, 645 bp, Artificial Sequence
  chemically treated genomic DNA (Homo sapiens) CpG-island No: 10575
ttatttcgggtagtttgcgtttggttttggggtttgggttttttttttttttttgttcgcggattttgtcgtttcgtttttagttcgtgttacggcggtcgttattggcgcgggtttattttagaacggcgtttattggttcggtgcgaagttatttatttagcgtatttcgtcgttcgtaggtttgcggggaaatttttttattattgtgacgtcgaaaacggagaaatttcgggttcggcgagaggggttgtgatagtcggagttttaagttgcggttcggttgttgtcgaggtgcgtagggcgggggtcggggttttagggaggggggtacggcggagttgtagtcgcgttgggtcgcgtttcgtttggtattgtagttagcgcgcggttttcggaggggcggttgcggtttttttcgtggtttcggcggcgggggttgtaggtatttttagagacgatttgggtttggggcgcggggaggttggggcgcggcgtttttagtattttgcgtacgtttttttggcgttttcgtgggttcgtttttcggttagagagtttcgcgtcgggaaaggcgagataagtttttaaaatgggagcgtttttcgttcgcgttcggtcgttttttcgttttgtcgttcggga

SEQ ID NO: 10576 - DNA, 645 bp, Artificial Sequence
  chemically treated genomic DNA (Homo sapiens) CpG-island No: 10576
tcccgaacgacaaaacgaaaaaacgaccgaacgcgaacgaaaaacgctcccattttaaaaacttatctcgcctttcccgacgcgaaactctctaaccgaaaaacgaacccacgaaaacgccaaaaaaacgtacgcaaaatactaaaaacgccgcgccccaacctccccgcgccccaaacccaaatcgtctctaaaaatacctacaacccccgccgccgaaaccacgaaaaaaaccgcaaccgcccctccgaaaaccgcgcgctaactacaataccaaacgaaacgcgacccaacgcgactacaactccgccgtacccccctccctaaaaccccgacccccgccctacgcacctcgacaacaaccgaaccgcaacttaaaactccgactatcacaacccctctcgccgaacccgaaatttctccgttttcgacgtcacaataataaaaaaatttccccgcaaacctacgaacgacgaaatacgctaaataaataacttcgcaccgaaccaataaacgccgttctaaaataaacccgcgccaataacgaccgccgtaacacgaactaaaaacgaaacgacaaaatccgcgaacaaaaaaaaaaaaaaaacccaaaccccaaaaccaaacgcaaactacccgaaataa

SEQ ID NO: 10577 - DNA, 512 bp, Artificial Sequence
  chemically treated genomic DNA (Homo sapiens) CpG-island No: 10577
agttggaggggtgcgattaatttaggggagacgcgggttttttttttttattacgtatttcgtttttttttttttcgggttgatttttttttttttcgtttttttagggcgaagggcgaagagtagcgagtgtatcgcgggcgcgaggttggggaagggcgagagttcggagtttcgcggcggcgatttagtttcggcggtttatggtcggcgaagttgtttattttttcgtttggcgttcgggttcgaggggcgggagagcgggtcggcgggaggcgggcggtttcgggtataacggcggcggcggaagggttcgttgggtagttgtcgtacggatttcggttttgggcggcggaggcggtttcgtggagttcgtagtagatttttacgcgattttgtgtttcgtaaatagattgatcgatcgcggggacgcgttttttttttttattttttagtttttttggttaattgttttattttttttttttttttttttagattttttttttttt

SEQ ID NO: 10578 - DNA, 512 bp, Artificial Sequence
  chemically treated genomic DNA (Homo sapiens) CpG-island No: 10578
aaaaaaaaaaaaatctaaaaaaaaaaaaaaaaaaaataaaacaattaaccaaaaaaactaaaaaataaaaaaaaaaaacgcgtccccgcgatcgatcaatctatttacgaaacacaaaatcgcgtaaaaatctactacgaactccacgaaaccgcctccgccgcccaaaaccgaaatccgtacgacaactacccaacgaacccttccgccgccgccgttatacccgaaaccgcccgcctcccgccgacccgctctcccgcccctcgaacccgaacgccaaacgaaaaaataaacaacttcgccgaccataaaccgccgaaactaaatcgccgccgcgaaactccgaactctcgcccttccccaacctcgcgcccgcgatacactcgctactcttcgcccttcgccctaaaaaaacgaaaaaaaaaaaaatcaacccgaaaaaaaaaaaaacgaaatacgtaataaaaaaaaaaaacccgcgtctcccctaaattaatcgcacccctccaact

SEQ ID NO: 10579 - DNA, 512 bp, Artificial Sequence
  chemically treated genomic DNA (Homo sapiens) CpG-island No: 10579
ggggaaagaggagtttggagagagggagggagagagtaaggtagttggttagaagggttggggggtgggaggggggaacgcgttttcgcggtcggttagtttgtttgcggggtataggatcgcgtggaaatttgttgcgagttttacggagtcgttttcgtcgtttagagtcggggttcgtgcggtagttgtttagcgagttttttcgtcgtcgtcgttgtgttcgggatcgttcgtttttcgtcggttcgttttttcgtttttcggattcgggcgttaaacgaggaggtgggtagtttcgtcggttatggatcgtcggagttgagtcgtcgtcgcggagtttcgagttttcgtttttttttagtttcgcgttcgcggtgtattcgttgtttttcgtttttcgttttggaaaaacggggaaaagagagattaattcgaagagagaaagaacgggatacgtggtggggggggggagttcgcgttttttttgggttagtcgtatttttttagtt

SEQ ID NO: 10580 - DNA, 512 bp, Artificial Sequence
  chemically treated genomic DNA (Homo sapiens) CpG-island No: 10580
aactaaaaaaatacgactaacccaaaaaaaacgcgaactccccccccccaccacgtatcccgttctttctctcttcgaattaatctctcttttccccgtttttccaaaacgaaaaacgaaaaacaacgaatacaccgcgaacgcgaaactaaaaaaaaacgaaaactcgaaactccgcgacgacgactcaactccgacgatccataaccgacgaaactacccacctcctcgtttaacgcccgaatccgaaaaacgaaaaaacgaaccgacgaaaaacgaacgatcccgaacacaacgacgacgacgaaaaaactcgctaaacaactaccgcacgaaccccgactctaaacgacgaaaacgactccgtaaaactcgcaacaaatttccacgcgatcctataccccgcaaacaaactaaccgaccgcgaaaacgcgttcccccctcccaccccccaacccttctaaccaactaccttactctctccctccctctctccaaactcctctttcccc

SEQ ID NO: 10581 - DNA, 1254 bp, Artificial Sequence
  chemically treated genomic DNA (Homo sapiens) CpG-island No: 10581
tatagggtgggcggcgggggcggcggaggcgtttttttcgcggttatttcgtttttttcgggggtagattggaggtttttcggggttacggttgtcgttgtttttttttcgtacgatttttcgcggacggtttcgttcgggttgttaatggttttcggggttttttgttgcggttgaggcgaggaagtcgtttggggaagcgggaggggttgcgcggggtggtcgggacggcggggttggttcgggattttcgtcggggtcgaggttgcgtcggtttcgagttttttcgacgacgacgaggagtcgtcgtcgttgttgtaggggtttaatcggttagatacgttttcggcgttgggatttagattgaagttttcggtgtcggagattataggtcgtggggcgcggggcgaagagatagggtttttaacgaacggttcgtcggggttggagttcgagggcgttgggttggcgcggcgcgattattcgttcgggtcgtcgacgggtaggggtaggtcggcggggggcgcgcgcggaggtttttcgaaggtattcggcgcgtttttcgcgggcggtattttcgagtttcgcggtttcgggggcgttagtcgggggtcggtttcggggggcggtttagcgggttttcgggcggcggcggtttcgggtttttggtttagtatttttattacgtcgtcgtttttgtggtttagttgtagtaggcgggcggttatttcgtcggtcgtggtgtttagtgtgtagagtatcgggcgtaggtaggtcgaggttatgtggcggtcgaagacgtgtacgtagtcgcgttggagttggtgttttatttagtttcggttcgacggttgtagttgtagcgtttgtcggtgttttagaagtagcgtttttttgtttaggtttcgggtgtatagcgacgtcgaggtcgagtaggaggcggggaggtcggtagcgtcgggggagtgcgaggtagtagcggtcgaggacgacgacgacgaggaggcggtcgcggcggtcgcggatagatttttttttagtcgttttttttttagtaggagggagttggcgtcgtcgtcggtttcgggtacgggggtagtttcgtcggtaatgggttggggcgtttcgcgtcgttttttgcgttcggtatttttcgttttgttcggtagcggtttcggcggcgtttcgtttggggttttttttcgcgtttcgttgtcgttgtcgttttcgtcgttcggggtcgtcggggttagt

SEQ ID NO: 10582 - DNA, 1254 bp, Artificial Sequence
  chemically treated genomic DNA (Homo sapiens) CpG-island No: 10582
actaaccccgacgaccccgaacgacgaaaacgacaacgacaacgaaacgcgaaaaaaaaccccaaacgaaacgccgccgaaaccgctaccgaacaaaacgaaaaataccgaacgcaaaaaacgacgcgaaacgccccaacccattaccgacgaaactacccccgtacccgaaaccgacgacgacgccaactccctcctactaaaaaaaaaacgactaaaaaaaaatctatccgcgaccgccgcgaccgcctcctcgtcgtcgtcgtcctcgaccgctactacctcgcactcccccgacgctaccgacctccccgcctcctactcgacctcgacgtcgctatacacccgaaacctaaacaaaaaaacgctacttctaaaacaccgacaaacgctacaactacaaccgtcgaaccgaaactaaataaaacaccaactccaacgcgactacgtacacgtcttcgaccgccacataacctcgacctacctacgcccgatactctacacactaaacaccacgaccgacgaaataaccgcccgcctactacaactaaaccacaaaaacgacgacgtaataaaaatactaaaccaaaaacccgaaaccgccgccgcccgaaaacccgctaaaccgccccccgaaaccgacccccgactaacgcccccgaaaccgcgaaactcgaaaataccgcccgcgaaaaacgcgccgaataccttcgaaaaacctccgcgcgcgccccccgccgacctacccctacccgtcgacgacccgaacgaataatcgcgccgcgccaacccaacgccctcgaactccaaccccgacgaaccgttcgttaaaaaccctatctcttcgccccgcgccccacgacctataatctccgacaccgaaaacttcaatctaaatcccaacgccgaaaacgtatctaaccgattaaacccctacaacaacgacgacgactcctcgtcgtcgtcgaaaaaactcgaaaccgacgcaacctcgaccccgacgaaaatcccgaaccaaccccgccgtcccgaccaccccgcgcaacccctcccgcttccccaaacgacttcctcgcctcaaccgcaacaaaaaaccccgaaaaccattaacaacccgaacgaaaccgtccgcgaaaaatcgtacgaaaaaaaaacaacgacaaccgtaaccccgaaaaacctccaatctacccccgaaaaaaacgaaataaccgcgaaaaaaacgcctccgccgcccccgccgcccaccctata

SEQ ID NO: 10583 - DNA, 1254 bp, Artificial Sequence
  chemically treated genomic DNA (Homo sapiens) CpG-island No: 10583
gttgatttcggcggtttcgagcggcgggaacggtagcggtagcggggcgcgggaagaggttttaggcgaggcgtcgtcggggtcgttgtcgggtagagcggggggtgtcgggcgtaggaggcggcgcggggcgttttagtttattgtcggcggggttgttttcgtattcggggtcggcggcggcgttaatttttttttgttgaggagagggcggttgaagaggaatttgttcgcggtcgtcgcggtcgttttttcgtcgtcgtcgttttcggtcgttgttgtttcgtattttttcggcgttgtcggttttttcgttttttgttcggtttcggcgtcgttgtgtattcggagtttggataggaagacgttgtttttgaagtatcggtagacgttgtagttgtagtcgtcggatcgggattgggtgaggtattagttttagcgcggttgcgtgtacgttttcgatcgttatatggtttcgatttatttgcgttcggtgttttgtatattggatattacggtcggcgaggtggtcgttcgtttgttgtagttgggttataaaggcggcggcgtggtgaaggtgttgggttaggggttcggagtcgtcgtcgttcgggagttcgttgaatcgtttttcgaggtcggttttcggttggcgttttcggagtcgcgggattcggaggtatcgttcgcgaggagcgcgtcgggtgttttcggggggttttcgcgcgcgtttttcgtcgatttatttttgttcgtcggcggttcgggcgggtggtcgcgtcgcgttagtttagcgttttcggattttagtttcggcgagtcgttcgttgggggttttgttttttcgtttcgcgttttacggtttgtggttttcgatatcgagagttttagtttgagttttagcgtcgagagcgtgtttgatcggttggatttttatagtagcggcggcggtttttcgtcgtcgtcggaagagttcgaggtcgacgtagtttcggtttcgacgggggtttcgggttagtttcgtcgtttcggttatttcgcgtagtttttttcgtttttttagacggttttttcgttttagtcgtagtagaaagtttcgagggttattgatagttcgggcggggtcgttcgcgaggggtcgtgcgaggagaaggtagcggtagtcgtggtttcgggaggtttttagtttattttcgggaggagcggggtgatcgcggagaaggcgttttcgtcgttttcgtcgtttattttgta

SEQ ID NO: 10584 - DNA, 1254 bp, Artificial Sequence
  chemically treated genomic DNA (Homo sapiens) CpG-island No: 10584
tacaaaataaacgacgaaaacgacgaaaacgccttctccgcgatcaccccgctcctcccgaaaataaactaaaaacctcccgaaaccacgactaccgctaccttctcctcgcacgacccctcgcgaacgaccccgcccgaactatcaataaccctcgaaactttctactacgactaaaacgaaaaaaccgtctaaaaaaacgaaaaaaactacgcgaaataaccgaaacgacgaaactaacccgaaacccccgtcgaaaccgaaactacgtcgacctcgaactcttccgacgacgacgaaaaaccgccgccgctactataaaaatccaaccgatcaaacacgctctcgacgctaaaactcaaactaaaactctcgatatcgaaaaccacaaaccgtaaaacgcgaaacgaaaaaacaaaacccccaacgaacgactcgccgaaactaaaatccgaaaacgctaaactaacgcgacgcgaccacccgcccgaaccgccgacgaacaaaaataaatcgacgaaaaacgcgcgcgaaaaccccccgaaaacacccgacgcgctcctcgcgaacgatacctccgaatcccgcgactccgaaaacgccaaccgaaaaccgacctcgaaaaacgattcaacgaactcccgaacgacgacgactccgaacccctaacccaacaccttcaccacgccgccgcctttataacccaactacaacaaacgaacgaccacctcgccgaccgtaatatccaatatacaaaacaccgaacgcaaataaatcgaaaccatataacgatcgaaaacgtacacgcaaccgcgctaaaactaatacctcacccaatcccgatccgacgactacaactacaacgtctaccgatacttcaaaaacaacgtcttcctatccaaactccgaatacacaacgacgccgaaaccgaacaaaaaacgaaaaaaccgacaacgccgaaaaaatacgaaacaacaacgaccgaaaacgacgacgacgaaaaaacgaccgcgacgaccgcgaacaaattcctcttcaaccgccctctcctcaacaaaaaaaaattaacgccgccgccgaccccgaatacgaaaacaaccccgccgacaataaactaaaacgccccgcgccgcctcctacgcccgacaccccccgctctacccgacaacgaccccgacgacgcctcgcctaaaacctcttcccgcgccccgctaccgctaccgttcccgccgctcgaaaccgccgaaatcaac

SEQ ID NO: 10585 - DNA, 755 bp, Artificial Sequence
  chemically treated genomic DNA (Homo sapiens) CpG-island No: 10585
tcgtaaacgttggagttatcgatgtaggttgtttgttggttgatttgttttcgtgtatagattgaatttatcgtcgtagagggacggtcgttggtatacgcggggttggagcgcgcgaagagtatgtagggcgcgtgggtgtttcgggggtcggcgtgtcgggtgtttatggggaaataaggagggtcgttggtgtagacggagttgtacggtcgtttattcgagaagcgggttgtgtttagcgtaggtattgtgtggtttaagtcgtgttttagaaattagttttagtgtatgagtatgcgcgtgtagttgtggtcgggggtgacggtcgtcgcgcgcgtttatattgtggcgattagtcggggcggcgggaggggttggcgggagtttataggaaggtcgagttcgcggggcgcgcggatgtcgtttcggtaggttggttgtagtaggcgcgcgaaggcggttagcgtcgcgttttacgtgggttgttgtaggttgttgtacgtgtcgtcgtgggcgcggtatttcgtatggaaatatcggttggagtagtttggtagaggtttgcgagttgtgtatttagataaattggcgatgaggttgagggagcgcggggatattaagttattgtatcggaattttgaaaggtaagcggcgaaagtcgtgaggagggcgggtttgggagggcgcgggtaatttggaattttagatgttgcgggaattattttttatttcgttcgttttgagtgaaaaga

SEQ ID NO: 10586 - DNA, 755 bp, Artificial Sequence
  chemically treated genomic DNA (Homo sapiens) CpG-island No: 10586
tcttttcactcaaaacgaacgaaataaaaaataattcccgcaacatctaaaattccaaattacccgcgccctcccaaacccgccctcctcacgactttcgccgcttacctttcaaaattccgatacaataacttaatatccccgcgctccctcaacctcatcgccaatttatctaaatacacaactcgcaaacctctaccaaactactccaaccgatatttccatacgaaataccgcgcccacgacgacacgtacaacaacctacaacaacccacgtaaaacgcgacgctaaccgccttcgcgcgcctactacaaccaacctaccgaaacgacatccgcgcgccccgcgaactcgaccttcctataaactcccgccaacccctcccgccgccccgactaatcgccacaatataaacgcgcgcgacgaccgtcacccccgaccacaactacacgcgcatactcatacactaaaactaatttctaaaacacgacttaaaccacacaatacctacgctaaacacaacccgcttctcgaataaacgaccgtacaactccgtctacaccaacgaccctccttatttccccataaacacccgacacgccgacccccgaaacacccacgcgccctacatactcttcgcgcgctccaaccccgcgtataccaacgaccgtccctctacgacgataaattcaatctatacacgaaaacaaatcaaccaacaaacaacctacatcgataactccaacgtttacga

SEQ ID NO: 10587 - DNA, 755 bp, Artificial Sequence
  chemically treated genomic DNA (Homo sapiens) CpG-island No: 10587
tttttttatttagggcgggcggggtgggaggtggttttcgtagtatttggagttttaagttgttcgcgtttttttaggttcgttttttttacggttttcgtcgtttgttttttagaatttcggtataatgatttggtgttttcgcgtttttttagttttatcgttaatttatttggatgtatagttcgtaggtttttgttaaattgttttaatcggtgtttttatgcgaagtatcgcgtttacgacggtacgtgtaataatttgtagtagtttacgtggggcgcggcgttgatcgttttcgcgcgtttgttgtagttagtttatcgggacggtattcgcgcgtttcgcgggttcggtttttttgtgggttttcgttagtttttttcgtcgtttcggttggtcgttatagtgtgggcgcgcgcggcggtcgttattttcgattatagttatacgcgtatgtttatgtattggggttggtttttagagtacgatttggattatatagtgtttgcgttgagtatagttcgtttttcggatgggcggtcgtgtagtttcgtttgtattaacgattttttttgtttttttatgaatattcggtacgtcgattttcggggtatttacgcgttttgtatgtttttcgcgcgttttagtttcgcgtgtgttagcggtcgtttttttgcgacggtggatttagtttatgtacgagagtagattaattagtaaatagtttatatcgatggttttaacgtttacgg

SEQ ID NO: 10588 - DNA, 755 bp, Artificial Sequence
  chemically treated genomic DNA (Homo sapiens) CpG-island No: 10588
ccgtaaacgttaaaaccatcgatataaactatttactaattaatctactctcgtacataaactaaatccaccgtcgcaaaaaaacgaccgctaacacacgcgaaactaaaacgcgcgaaaaacatacaaaacgcgtaaataccccgaaaatcgacgtaccgaatattcataaaaaaacaaaaaaaatcgttaatacaaacgaaactacacgaccgcccatccgaaaaacgaactatactcaacgcaaacactatataatccaaatcgtactctaaaaaccaaccccaatacataaacatacgcgtataactataatcgaaaataacgaccgccgcgcgcgcccacactataacgaccaaccgaaacgacgaaaaaaactaacgaaaacccacaaaaaaaccgaacccgcgaaacgcgcgaataccgtcccgataaactaactacaacaaacgcgcgaaaacgatcaacgccgcgccccacgtaaactactacaaattattacacgtaccgtcgtaaacgcgatacttcgcataaaaacaccgattaaaacaatttaacaaaaacctacgaactatacatccaaataaattaacgataaaactaaaaaaacgcgaaaacaccaaatcattataccgaaattctaaaaaacaaacgacgaaaaccgtaaaaaaaacgaacctaaaaaaacgcgaacaacttaaaactccaaatactacgaaaaccacctcccaccccgcccgccctaaataaaaaaa

SEQ ID NO: 10589 - DNA, 856 bp, Artificial Sequence
  chemically treated genomic DNA (Homo sapiens) CpG-island No: 10589
gattatcgtttaattgaaggatatcgtgcgttttatcgtaattttgcgggcgattcggaaagttggaggcgtttcggggagtcgtcgtatttgtcgttcgcgttttttaatttgagtatttaaggagttttgatttggtcgttggcgtatttcgtatttatttagtcggtgttgatgcgggagggtggggtcgcggcggggcggggtaacgcgagttcgtatttcgttttttttcgtttttttttgtcggtttcgttcgcgcgcgtttttcgttcgcggttcgggcgttcggttcgtttttttttttcggcgcgtaaacgaatttcgcgacgtcgcgttcggcggcgggcgggggtcgggcgagggagggggttggtttcggtcgttttattttgtagttgtttttcgagcgttggttgcgtcgttcgagtcgttgggtcggggaagtattggtcgttcgttttcgggtcggtttcgttaggcgttcgtaggtatgtagttcgggagtaggaggcgtttttcgggtcgttgttgagtcggtcggggcggcggggattagcgttagcggagttttttttattttgtttcggggtagacgagcggcgtttcgatatttttttttttttcgtagtttcgttagcgttatttttcgcgggtcgtaggggtttatgtagtcgttaaggtaagcgcgggtcgggagtcgggtagattcggttttgatattttcgaggcgtcgtcgatatatgtcggggttacggcgttgttttggttttttttagtttcgcgttttattttgtttttattttgtttatatttggagttttgttgcgtttttatcgttttagttgttggtagt

SEQ ID NO: 10590 - DNA, 856 bp, Artificial Sequence
  chemically treated genomic DNA (Homo sapiens) CpG-island No: 10590
actaccaacaactaaaacgataaaaacgcaacaaaactccaaatataaacaaaataaaaacaaaataaaacgcgaaactaaaaaaaaccaaaacaacgccgtaaccccgacatatatcgacgacgcctcgaaaatatcaaaaccgaatctacccgactcccgacccgcgcttaccttaacgactacataaacccctacgacccgcgaaaaataacgctaacgaaactacgaaaaaaaaaaaaatatcgaaacgccgctcgtctaccccgaaacaaaataaaaaaaactccgctaacgctaatccccgccgccccgaccgactcaacaacgacccgaaaaacgcctcctactcccgaactacatacctacgaacgcctaacgaaaccgacccgaaaacgaacgaccaatacttccccgacccaacgactcgaacgacgcaaccaacgctcgaaaaacaactacaaaataaaacgaccgaaaccaaccccctccctcgcccgacccccgcccgccgccgaacgcgacgtcgcgaaattcgtttacgcgccgaaaaaaaaaaacgaaccgaacgcccgaaccgcgaacgaaaaacgcgcgcgaacgaaaccgacaaaaaaaaacgaaaaaaaacgaaatacgaactcgcgttaccccgccccgccgcgaccccaccctcccgcatcaacaccgactaaataaatacgaaatacgccaacgaccaaatcaaaactccttaaatactcaaattaaaaaacgcgaacgacaaatacgacgactccccgaaacgcctccaactttccgaatcgcccgcaaaattacgataaaacgcacgatatccttcaattaaacgataatc

SEQ ID NO: 10591 - DNA, 856 bp, Artificial Sequence
  chemically treated genomic DNA (Homo sapiens) CpG-island No: 10591
gttgttaatagttaaagcgatagaggcgtagtaaagttttaaatgtgggtaagatgggagtaagatgagacgcggggttaaggaagattaaagtagcgtcgtggtttcggtatgtgtcggcggcgtttcggagatgttagagtcgggtttgttcggttttcgattcgcgtttattttggcggttgtatgagtttttgcggttcgcggggggtggcgttggcggggttgcgggagaagagggggtgtcggggcgtcgttcgtttgtttcggggtaaggtgggaggggtttcgttggcgttggttttcgtcgtttcggtcggtttagtagcggttcggggagcgttttttgttttcgggttgtatgtttgcgagcgtttggcggagtcggttcgggagcgaacggttagtgttttttcggtttagcggttcgggcggcgtagttagcgttcgggagataattgtagagtggggcggtcgggattagttttttttttcgttcggttttcgttcgtcgtcgagcgcggcgtcgcgaggttcgtttgcgcgtcgaggggagggggcgggtcgggcgttcgggtcgcgggcggggggcgcgcgcgggcggggtcggtagggaggggcggggaggagcggggtgcgggttcgcgttgtttcgtttcgtcgcggttttattttttcgtattagtatcggttgggtgggtgcggagtgcgttagcggttaagttaagattttttgaatgtttaggttagggggcgcgggcggtaagtgcggcgatttttcggggcgtttttaatttttcgaatcgttcgtagggttgcggtggagcgtacggtgttttttagttaggcggtggtt

SEQ ID NO: 10592 - DNA, 856 bp, Artificial Sequence
  chemically treated genomic DNA (Homo sapiens) CpG-island No: 10592
aaccaccgcctaactaaaaaacaccgtacgctccaccgcaaccctacgaacgattcgaaaaattaaaaacgccccgaaaaatcgccgcacttaccgcccgcgccccctaacctaaacattcaaaaaatcttaacttaaccgctaacgcactccgcacccacccaaccgatactaatacgaaaaaataaaaccgcgacgaaacgaaacaacgcgaacccgcaccccgctcctccccgcccctccctaccgaccccgcccgcgcgcgccccccgcccgcgacccgaacgcccgacccgccccctcccctcgacgcgcaaacgaacctcgcgacgccgcgctcgacgacgaacgaaaaccgaacgaaaaaaaaaactaatcccgaccgccccactctacaattatctcccgaacgctaactacgccgcccgaaccgctaaaccgaaaaaacactaaccgttcgctcccgaaccgactccgccaaacgctcgcaaacatacaacccgaaaacaaaaaacgctccccgaaccgctactaaaccgaccgaaacgacgaaaaccaacgccaacgaaacccctcccaccttaccccgaaacaaacgaacgacgccccgacaccccctcttctcccgcaaccccgccaacgccaccccccgcgaaccgcaaaaactcatacaaccgccaaaataaacgcgaatcgaaaaccgaacaaacccgactctaacatctccgaaacgccgccgacacataccgaaaccacgacgctactttaatcttccttaaccccgcgtctcatcttactcccatcttacccacatttaaaactttactacgcctctatcgctttaactattaacaac

SEQ ID NO: 10593 - DNA, 519 bp, Artificial Sequence
  chemically treated genomic DNA (Homo sapiens) CpG-island No: 10593
ttagcgcgcgtggttgggtagattcggtatacgttttttatatcgtgtgcgggttgggagtttttttttttagttcggttcgcggagtttcggacggagtcggttattcgattgtttcgtcgtgaatttttattggttcgcgtcgttcgggttttcgtttttcgttcgacgttcggttgcggagttgtttggttattttttgttttcggggatgtcggcgtagtgtatcgcgtgggttcgcgtttcggcggttttttgtttcggcgcgtcggcgtacgggaaggtgcggattttggattgaggttcgaggatgtttattgttaagtcgtttcggtttttttaagtggacgggagggtacggcgacgatttagcgtcggttcgcgtcgtagtttaatttagggtataagttcgggtatgggggataggtgtatttaatgggagggcgggtgtgggggacgttcgggtgtaattcgggattgcgttttattaatgtaattgtattagatttgttcggaggt

SEQ ID NO: 10594 - DNA, 519 bp, Artificial Sequence
  chemically treated genomic DNA (Homo sapiens) CpG-island No: 10594
acctccgaacaaatctaatacaattacattaataaaacgcaatcccgaattacacccgaacgtcccccacacccgccctcccattaaatacacctatcccccatacccgaacttataccctaaattaaactacgacgcgaaccgacgctaaatcgtcgccgtaccctcccgtccacttaaaaaaaccgaaacgacttaacaataaacatcctcgaacctcaatccaaaatccgcaccttcccgtacgccgacgcgccgaaacaaaaaaccgccgaaacgcgaacccacgcgatacactacgccgacatccccgaaaacaaaaaataaccaaacaactccgcaaccgaacgtcgaacgaaaaacgaaaacccgaacgacgcgaaccaataaaaattcacgacgaaacaatcgaataaccgactccgtccgaaactccgcgaaccgaactaaaaaaaaaaactcccaacccgcacacgatataaaaaacgtataccgaatctacccaaccacgcgcgctaa

SEQ ID NO: 10595 - DNA, 519 bp, Artificial Sequence
  chemically treated genomic DNA (Homo sapiens) CpG-island No: 10595
attttcgagtaagtttaatataattatattaataagacgtaatttcgaattgtattcgagcgttttttatattcgtttttttattgaatatatttgttttttatgttcgggtttgtattttgggttgagttgcggcgcgagtcggcgttgaatcgtcgtcgtgttttttcgtttatttaggaaagtcggggcggtttggtaatgggtattttcgggttttaatttaaggttcgtattttttcgtacgtcggcgcgtcgaggtaaagggtcgtcgggacgcgagtttacgcggtgtattgcgtcgatattttcgagggtaggagatggttaggtagtttcgtagtcgggcgtcgagcgggaggcgggggttcgggcggcgcgggttaatgggggtttacggcgggatagtcgggtggtcggtttcgttcggggtttcgcgagtcgggttgagggaaggagtttttagttcgtatacggtgtaagggacgtgtgtcgggtttgtttaattacgcgcgttgg

SEQ ID NO: 10596 - DNA, 519 bp, Artificial Sequence
  chemically treated genomic DNA (Homo sapiens) CpG-island No: 10596
ccaacgcgcgtaattaaacaaacccgacacacgtcccttacaccgtatacgaactaaaaactccttccctcaacccgactcgcgaaaccccgaacgaaaccgaccacccgactatcccgccgtaaacccccattaacccgcgccgcccgaacccccgcctcccgctcgacgcccgactacgaaactacctaaccatctcctaccctcgaaaatatcgacgcaatacaccgcgtaaactcgcgtcccgacgaccctttacctcgacgcgccgacgtacgaaaaaatacgaaccttaaattaaaacccgaaaatacccattaccaaaccgccccgactttcctaaataaacgaaaaaacacgacgacgattcaacgccgactcgcgccgcaactcaacccaaaatacaaacccgaacataaaaaacaaatatattcaataaaaaaacgaatataaaaaacgctcgaatacaattcgaaattacgtcttattaatataattatattaaacttactcgaaaat

SEQ ID NO: 10597 - DNA, 1172 bp, Artificial Sequence
  chemically treated genomic DNA (Homo sapiens) CpG-island No: 10597
cggtttcgatcgaggggcggggcggggtgtgtgtgtgtgtgtgtggaggggggggttattattcggttaggtttaagtgcgtatgtgcgcgaggagtcgttcgggtatttattgagcgtcgattgtttacgggcggtcgggggtgtgtagtttaggcgcgttgggggcgtgttgggcgggtgcgggggcgcggaggcgcggggggcgggcgggggtgtgtttcgagtgtcgtcgttgggcgtcggttggtaggggttggcgtgttgtttcgtttttttttcgggcgggaattcgggtcgggttgtggtcgcggtcgcgtacgtgagcgtagtgtttcggggaggagggtaggtcggttaggtgggcgttaatcgagtttcggcgggcggtcggagcggagtcgggtcgcgggtcgcgtcgggagggcgggtagggtcgcggtcgttgtagttcggagttgagttagtcgttcgagtcgagtcgttcgagtcggggaagtcgggcgcgtgttgtcgttcgtggcgggtcgaggtgagttgcgcggggatttaacggcgcggtagtcggggacgggggcggtcgcgaattttttacgtttcgcgcgttcgcggttgtcgggtcggcggtttggggggttcgggggtttgggaggtcggggtcgcggcgggcggggcgcgggacgttgcggtagggtcggggtggcgggcggggtggttgtcgttttcgcgcgtcgttttgtttatttcgtttttcgtcggcgtttttattttcggagttttttttcgatttcgggtagtcgggattcgtttttcgtagggatagggatcggttcgtttgttttttttcggtttttttcggcggggtcgttcgttcggttttttcgcgttcggttttttcgcgtttcgcgcgtttttgtcggtttttgtttatttcggtcggcgcgcgaggttaggttgcgggacgggcgggatagagggatatatttttcgttcgcgggcgattcgcgtttttttcgttttggcggttatcgttttttttgttcgtacgttttcgttcggtttcgttttcgttcgcgtttttggtttttttcggcggtggtatcgtgggtttacgcgggtgttcggggggggggcggggttgtatagggagtttgttttgtgtaaataattttt

SEQ ID NO: 10598 - DNA, 1172 bp, Artificial Sequence
  chemically treated genomic DNA (Homo sapiens) CpG-island No: 10598
aaaaattatttacacaaaacaaactccctatacaaccccgccccccccccgaacacccgcgtaaacccacgataccaccgccgaaaaaaaccaaaaacgcgaacgaaaacgaaaccgaacgaaaacgtacgaacaaaaaaaacgataaccgccaaaacgaaaaaaacgcgaatcgcccgcgaacgaaaaatatatccctctatcccgcccgtcccgcaacctaacctcgcgcgccgaccgaaataaacaaaaaccgacaaaaacgcgcgaaacgcgaaaaaaccgaacgcgaaaaaaccgaacgaacgaccccgccgaaaaaaaccgaaaaaaaacaaacgaaccgatccctatccctacgaaaaacgaatcccgactacccgaaatcgaaaaaaaactccgaaaataaaaacgccgacgaaaaacgaaataaacaaaacgacgcgcgaaaacgacaaccaccccgcccgccaccccgaccctaccgcaacgtcccgcgccccgcccgccgcgaccccgacctcccaaacccccgaaccccccaaaccgccgacccgacaaccgcgaacgcgcgaaacgtaaaaaattcgcgaccgcccccgtccccgactaccgcgccgttaaatccccgcgcaactcacctcgacccgccacgaacgacaacacgcgcccgacttccccgactcgaacgactcgactcgaacgactaactcaactccgaactacaacgaccgcgaccctacccgccctcccgacgcgacccgcgacccgactccgctccgaccgcccgccgaaactcgattaacgcccacctaaccgacctaccctcctccccgaaacactacgctcacgtacgcgaccgcgaccacaacccgacccgaattcccgcccgaaaaaaaaacgaaacaacacgccaacccctaccaaccgacgcccaacgacgacactcgaaacacacccccgcccgccccccgcgcctccgcgcccccgcacccgcccaacacgcccccaacgcgcctaaactacacacccccgaccgcccgtaaacaatcgacgctcaataaatacccgaacgactcctcgcgcacatacgcacttaaacctaaccgaataataacccccccctccacacacacacacacacaccccgccccgcccctcgatcgaaaccg

SEQ ID NO: 10599 - DNA, 1172 bp, Artificial Sequence
  chemically treated genomic DNA (Homo sapiens) CpG-island No: 10599
ggaaattgtttgtataagataaattttttgtgtagtttcgtttttttttcgggtattcgcgtgagtttacggtgttatcgtcggggagggttaggggcgcgggcggaggcgggatcgggcgagagcgtgcgggtagagggggcggtggtcgttagggcgggagggacgcgggtcgttcgcgggcggagggtgtgtttttttgtttcgttcgtttcgtagtttggtttcgcgcgtcggtcggagtgggtaggaatcggtagaaacgcgcggggcgcgggagggtcgggcgcgggagggtcgggcgggcggtttcgtcggaaagggtcggggaggggtaggcgggtcggtttttgtttttgcgaggggcgagtttcgattgttcgaagtcgggagggggtttcgagagtgggggcgtcggcggagggcgaggtaaataaggcgacgcgcgggagcggtagttatttcgttcgttatttcggttttgtcgtagcgtttcgcgtttcgttcgtcgcggtttcggttttttagattttcggattttttaggtcgtcggttcgatagtcgcgggcgcgcggggcgtgggaagttcgcggtcgttttcgttttcggttgtcgcgtcgttaggttttcgcgtagtttatttcggttcgttacgagcggtagtacgcgttcggttttttcggttcggacggttcggttcggacggttagtttagtttcgggttgtagcggtcgcggttttgttcgttttttcggcgcggttcgcggttcggtttcgtttcggtcgttcgtcgaggttcggttggcgtttatttggtcggtttgttttttttttcgggatattgcgtttacgtacgcggtcgcggttataattcggttcggattttcgttcgggaagggagcggagtagtacgttagtttttgttagtcggcgtttagcggcgatattcgggatatattttcgttcgtttttcgcgttttcgcgttttcgtattcgtttagtacgtttttagcgcgtttgggttatatattttcggtcgttcgtagatagtcggcgtttaataagtgttcgagcgatttttcgcgtatatgcgtatttgaatttgatcgagtggtgatttttttttttatatatatatatatatatttcgtttcgtttttcgatcggaatcg

SEQ ID NO: 10600 - DNA, 1172 bp, Artificial Sequence
  chemically treated genomic DNA (Homo sapiens) CpG-island No: 10600
cgattccgatcgaaaaacgaaacgaaatatatatatatatatataaaaaaaaaaatcaccactcgatcaaattcaaatacgcatatacgcgaaaaatcgctcgaacacttattaaacgccgactatctacgaacgaccgaaaatatataacccaaacgcgctaaaaacgtactaaacgaatacgaaaacgcgaaaacgcgaaaaacgaacgaaaatatatcccgaatatcgccgctaaacgccgactaacaaaaactaacgtactactccgctcccttcccgaacgaaaatccgaaccgaattataaccgcgaccgcgtacgtaaacgcaatatcccgaaaaaaaaaacaaaccgaccaaataaacgccaaccgaacctcgacgaacgaccgaaacgaaaccgaaccgcgaaccgcgccgaaaaaacgaacaaaaccgcgaccgctacaacccgaaactaaactaaccgtccgaaccgaaccgtccgaaccgaaaaaaccgaacgcgtactaccgctcgtaacgaaccgaaataaactacgcgaaaacctaacgacgcgacaaccgaaaacgaaaacgaccgcgaacttcccacgccccgcgcgcccgcgactatcgaaccgacgacctaaaaaatccgaaaatctaaaaaaccgaaaccgcgacgaacgaaacgcgaaacgctacgacaaaaccgaaataacgaacgaaataactaccgctcccgcgcgtcgccttatttacctcgccctccgccgacgcccccactctcgaaaccccctcccgacttcgaacaatcgaaactcgcccctcgcaaaaacaaaaaccgacccgcctacccctccccgaccctttccgacgaaaccgcccgcccgaccctcccgcgcccgaccctcccgcgccccgcgcgtttctaccgattcctacccactccgaccgacgcgcgaaaccaaactacgaaacgaacgaaacaaaaaaacacaccctccgcccgcgaacgacccgcgtccctcccgccctaacgaccaccgccccctctacccgcacgctctcgcccgatcccgcctccgcccgcgcccctaaccctccccgacgataacaccgtaaactcacgcgaatacccgaaaaaaaaacgaaactacacaaaaaatttatcttatacaaacaatttcc

SEQ ID NO: 10601 - DNA, 747 bp, Artificial Sequence
  chemically treated genomic DNA (Homo sapiens) CpG-island No: 10601
tgtagatcggatagtttttcgggttaagggcgtttatttcgcggattatcgtagtacgtcggtcggttgggtgcggatggtagttttggtgaattgttttaggatgttcggtagtttcgggggaatgtggatttgttgagcgtagaatatggtgtcgggaagcggtatcgtttttcgtagaagggattaggttggtgaatcgcggcgcgttgcgaggaagaagggcggttgtcggttacgacgcggtggattcgttagtagcgcggggtttgcggttagggtcgttttttatttcgttttcgaggttggggtcggattcgcggggtttttattcgttttttcgcgggtttcgggagaaattcggattaattgttatttcgataatattttagattttgtagttttttagcgttagtcgttattacggacgcgttcggtatttaggtattcgggacgcgagtaggtttcgtttttggagtcgcgtacgcgtacgcggttttgagcgaggcggggttgttttcgggttggataaggaggtgttggcgtagttcgattagtagtagtcgttgtttttcggtggtttagagtcgcgcgagttgagcgtttcgtttataaaagtattttcggatcggttttttatcgtcgaatgtgagcggcgaatttacgaaggatttttttttttttttgttttggttgcgtgaggttgaggttaggggattcgggtttgttaggagggaagcgggttaa

SEQ ID NO: 10602 - DNA, 747 bp, Artificial Sequence
  chemically treated genomic DNA (Homo sapiens) CpG-island No: 10602
ttaacccgcttccctcctaacaaacccgaatcccctaacctcaacctcacgcaaccaaaacaaaaaaaaaaaaaaatccttcgtaaattcgccgctcacattcgacgataaaaaaccgatccgaaaatacttttataaacgaaacgctcaactcgcgcgactctaaaccaccgaaaaacaacgactactactaatcgaactacgccaacacctccttatccaacccgaaaacaaccccgcctcgctcaaaaccgcgtacgcgtacgcgactccaaaaacgaaacctactcgcgtcccgaatacctaaataccgaacgcgtccgtaataacgactaacgctaaaaaactacaaaatctaaaatattatcgaaataacaattaatccgaatttctcccgaaacccgcgaaaaaacgaataaaaaccccgcgaatccgaccccaacctcgaaaacgaaataaaaaacgaccctaaccgcaaaccccgcgctactaacgaatccaccgcgtcgtaaccgacaaccgcccttcttcctcgcaacgcgccgcgattcaccaacctaatcccttctacgaaaaacgataccgcttcccgacaccatattctacgctcaacaaatccacattcccccgaaactaccgaacatcctaaaacaattcaccaaaactaccatccgcacccaaccgaccgacgtactacgataatccgcgaaataaacgcccttaacccgaaaaactatccgatctaca

SEQ ID NO: 10603 - DNA, 747 bp, Artificial Sequence
  chemically treated genomic DNA (Homo sapiens) CpG-island No: 10603
ttaattcgttttttttttagtaggttcgagttttttagttttagttttacgtagttagagtaaggggaagagggagtttttcgtgagttcgtcgtttatattcggcggtgggaaatcgattcgaagatgtttttgtaggcgaaacgtttagttcgcgcggttttgaattatcggggagtagcggttgttgttagtcggattacgttagtatttttttgtttagttcgggagtagtttcgtttcgtttagggtcgcgtgcgcgtgcgcggttttaggggcggggtttgttcgcgtttcgggtgtttggatatcgagcgcgttcgtagtggcggttggcgttagggaattgtagggtttagggtgttgtcggagtggtagttggttcgaatttttttcgaagttcgcggaggagcgggtaagagtttcgcgaattcggttttaatttcgggaacgggatgggaggcggttttggtcgtaagtttcgcgttgttagcgggtttatcgcgtcgtagtcgatagtcgtttttttttttcgtagcgcgtcgcgatttattagtttggttttttttgcggagagcgatgtcgtttttcgatattatgttttgcgtttagtagatttatattttttcggagttgtcggatattttgaagtaatttattaaggttgttattcgtatttagtcggtcgacgtgttgcggtggttcgcggggtaagcgtttttggttcggggagttgttcggtttata

SEQ ID NO: 10604 - DNA, 747 bp, Artificial Sequence
  chemically treated genomic DNA (Homo sapiens) CpG-island No: 10604
tataaaccgaacaactccccgaaccaaaaacgcttaccccgcgaaccaccgcaacacgtcgaccgactaaatacgaataacaaccttaataaattacttcaaaatatccgacaactccgaaaaaatataaatctactaaacgcaaaacataatatcgaaaaacgacatcgctctccgcaaaaaaaaccaaactaataaatcgcgacgcgctacgaaaaaaaaaaacgactatcgactacgacgcgataaacccgctaacaacgcgaaacttacgaccaaaaccgcctcccatcccgttcccgaaattaaaaccgaattcgcgaaactcttacccgctcctccgcgaacttcgaaaaaaattcgaaccaactaccactccgacaacaccctaaaccctacaattccctaacgccaaccgccactacgaacgcgctcgatatccaaacacccgaaacgcgaacaaaccccgcccctaaaaccgcgcacgcgcacgcgaccctaaacgaaacgaaactactcccgaactaaacaaaaaaatactaacgtaatccgactaacaacaaccgctactccccgataattcaaaaccgcgcgaactaaacgtttcgcctacaaaaacatcttcgaatcgatttcccaccgccgaatataaacgacgaactcacgaaaaactccctcttccccttactctaactacgtaaaactaaaactaaaaaactcgaacctactaaaaaaaaaacgaattaa

SEQ ID NO: 10605 - DNA, 1157 bp, Artificial Sequence
  chemically treated genomic DNA (Homo sapiens) CpG-island No: 10605
cgggtttcgggtgggcggcggagtttttttcggttcggtttgttaggaggggcggggcgcgagggggcggaggcgagggttcgggcggggtcgatataggtgtttcgtattcggtcggggggcggtttcgaggagcggttcgtaggagttttataagttgtcggggtgcggggttgcgcgcggttcgttgtaaaaatagtgtttacgtgcgtgcgcgtttttcgttcgtcggttggtcggttagttcgttagtttcgtagggttatatcggttttatggcgttttcgttggtaagagttattcgtcgttcgtttgggcggggtcgcgtttcggtcgtagtagttaacggttcgcgcgtagtcgggttcggcgtcgcggtatttttatttttcgtttcgtgcgggcgagtttcgggcggggcgcggttacgtgttcgcgggcgtggggtttcgtggaggggtggagggcgaggggggtagggagttttttcgtgatttagggtttttgggtttaaaggcgtcgtagttttgcgggggcggtcggtggggttttcgagtcgtattgcggtttttaggcggtttcgagcgtttgtttagacgggagttgatcgaatataaaggagtatcggcgttcgtaacgttttttttttatattgtcgtcgtacgggagattagaagtcgttggcgttgaaagtttacgttttttgcgggtttttttagtattcggcgcgcggtgggggcgttcgggcgggacggggcggggttgttgacggcgtagatttcgtgttttgtggagagttttacgacggcggcggtcgcggtatttttaaggtggagggtttaagtttttcgtgcggttttttaattttgggtaggttacgtggttttatattttcgtttggcgtcggagagggagtttcgggggcggggttggttaggtagtgtggcgcgagggcggaagattggcggggtttcgtgttcgggagattcgtcgggttggcggtattgaggtgggttttggttatgggcgggagagggttaggtttgtaggtcgcggaggtggcgtaggcggggagcgattcgagtttattttgggttgtgttgttcggatttttagtttggcgagtgggtgtatgtggtttggcgttttggttattt

SEQ ID NO: 10606 - DNA, 1157 bp, Artificial Sequence
  chemically treated genomic DNA (Homo sapiens) CpG-island No: 10606
aaataaccaaaacgccaaaccacatacacccactcgccaaactaaaaatccgaacaacacaacccaaaataaactcgaatcgctccccgcctacgccacctccgcgacctacaaacctaaccctctcccgcccataaccaaaacccacctcaataccgccaacccgacgaatctcccgaacacgaaaccccgccaatcttccgccctcgcgccacactacctaaccaaccccgcccccgaaactccctctccgacgccaaacgaaaatataaaaccacgtaacctacccaaaattaaaaaaccgcacgaaaaacttaaaccctccaccttaaaaataccgcgaccgccgccgtcgtaaaactctccacaaaacacgaaatctacgccgtcaacaaccccgccccgtcccgcccgaacgcccccaccgcgcgccgaatactaaaaaaacccgcaaaaaacgtaaactttcaacgccaacgacttctaatctcccgtacgacgacaatataaaaaaaaaacgttacgaacgccgatactcctttatattcgatcaactcccgtctaaacaaacgctcgaaaccgcctaaaaaccgcaatacgactcgaaaaccccaccgaccgcccccgcaaaactacgacgcctttaaacccaaaaaccctaaatcacgaaaaaactccctacccccctcgccctccacccctccacgaaaccccacgcccgcgaacacgtaaccgcgccccgcccgaaactcgcccgcacgaaacgaaaaataaaaataccgcgacgccgaacccgactacgcgcgaaccgttaactactacgaccgaaacgcgaccccgcccaaacgaacgacgaataactcttaccaacgaaaacgccataaaaccgatataaccctacgaaactaacgaactaaccgaccaaccgacgaacgaaaaacgcgcacgcacgtaaacactatttttacaacgaaccgcgcgcaaccccgcaccccgacaacttataaaactcctacgaaccgctcctcgaaaccgccccccgaccgaatacgaaacacctatatcgaccccgcccgaaccctcgcctccgccccctcgcgccccgcccctcctaacaaaccgaaccgaaaaaaactccgccgcccacccgaaacccg

SEQ ID NO: 10607 - DNA, 1157 bp, Artificial Sequence
  chemically treated genomic DNA (Homo sapiens) CpG-island No: 10607
gaatgattagaacgttaggttatatgtatttattcgttaggttgagggttcgaatagtatagtttagagtgggttcgggtcgtttttcgtttacgttattttcgcggtttgtaagtttaattttttttcgtttatgattaggatttattttaatgtcgttagttcggcgggtttttcgggtacgaagtttcgttagtttttcgttttcgcgttatattatttggttagtttcgttttcgagatttttttttcggcgttaagcgaaggtgtgaagttacgtgatttgtttaggattgggaagtcgtacgaggggtttgagttttttattttaaaggtgtcgcgatcgtcgtcgtcgtggggttttttatagagtacggggtttacgtcgttagtagtttcgtttcgtttcgttcgggcgtttttatcgcgcgtcgggtgttaaagagattcgtagggggcgtgagtttttagcgttagcggtttttggtttttcgtgcgacggtagtgtgagaaagaaacgttacgggcgtcggtgtttttttatgttcggttagttttcgtttggatagacgttcgaggtcgtttggaggtcgtagtgcggttcggaggttttatcggtcgttttcgtagggttgcggcgtttttaagtttaaaggttttgagttacgaggaggttttttgtttttttcgttttttatttttttacgaggttttacgttcgcgggtacgtgatcgcgtttcgttcgggattcgttcgtacggggcgggggatgggggtatcgcggcgtcggattcggttgcgcgcggatcgttagttattgcggtcgggacgcggtttcgtttaggcgagcggcgggtggtttttattagcgggaacgttatggggtcggtgtggttttgcggggttgacgggttgatcggttagtcggcgggcgagagacgcgtacgtacgtgggtattatttttgtagcgggtcgcgcgtagtttcgtatttcggtagtttatgaagtttttacgagtcgtttttcggagtcgtttttcggtcggatgcggagtatttgtgtcggtttcgttcgggttttcgttttcgttttttcgcgtttcgttttttttagtaggtcgagtcgaggagggtttcgtcgtttattcggaattcg

SEQ ID NO: 10608 - DNA, 1157 bp, Artificial Sequence
  chemically treated genomic DNA (Homo sapiens) CpG-island No: 10608
cgaattccgaataaacgacgaaaccctcctcgactcgacctactaaaaaaaacgaaacgcgaaaaaacgaaaacgaaaacccgaacgaaaccgacacaaatactccgcatccgaccgaaaaacgactccgaaaaacgactcgtaaaaacttcataaactaccgaaatacgaaactacgcgcgacccgctacaaaaataatacccacgtacgtacgcgtctctcgcccgccgactaaccgatcaacccgtcaaccccgcaaaaccacaccgaccccataacgttcccgctaataaaaaccacccgccgctcgcctaaacgaaaccgcgtcccgaccgcaataactaacgatccgcgcgcaaccgaatccgacgccgcgatacccccatcccccgccccgtacgaacgaatcccgaacgaaacgcgatcacgtacccgcgaacgtaaaacctcgtaaaaaaataaaaaacgaaaaaaacaaaaaacctcctcgtaactcaaaacctttaaacttaaaaacgccgcaaccctacgaaaacgaccgataaaacctccgaaccgcactacgacctccaaacgacctcgaacgtctatccaaacgaaaactaaccgaacataaaaaaacaccgacgcccgtaacgtttctttctcacactaccgtcgcacgaaaaaccaaaaaccgctaacgctaaaaactcacgccccctacgaatctctttaacacccgacgcgcgataaaaacgcccgaacgaaacgaaacgaaactactaacgacgtaaaccccgtactctataaaaaaccccacgacgacgacgatcgcgacacctttaaaataaaaaactcaaacccctcgtacgacttcccaatcctaaacaaatcacgtaacttcacaccttcgcttaacgccgaaaaaaaaatctcgaaaacgaaactaaccaaataatataacgcgaaaacgaaaaactaacgaaacttcgtacccgaaaaacccgccgaactaacgacattaaaataaatcctaatcataaacgaaaaaaaattaaacttacaaaccgcgaaaataacgtaaacgaaaaacgacccgaacccactctaaactatactattcgaaccctcaacctaacgaataaatacatataacctaacgttctaatcattc

SEQ ID NO: 10609 - DNA, 594 bp, Artificial Sequence
  chemically treated genomic DNA (Homo sapiens) CpG-island No: 10609
gtcgaagtgtgtttcggggaggcgtttatagattcgtcggttttttcgtttaggaatttttattagaggagaacgcggaaaaagttttttacggtttagaggaggacgaggttaagggcgcggggtttgaggagacggtcgtcgcggtcgttttttttcgaaagttttatgttatggatttcgattatcggttgttgttgcgtaatattaaatttttgttgtagagtcgtagcgtcgcggtggtgatggcggtggcgtagttttatttttatttggcgtttaaggcggaagtgggcgttatcgttaaggcgttggtgcgtttgttgcgtagttataggtgcgtttcgtttttagtttcgttttttttttcgttttttgtttcgttttacgggttgttcggtttcgtttttttacgtttattagtcgtttttatttttgtttattcgttttatattgatcgtagttttgtttttcgtattggtttttttttcgtaacgatttgttttattttttttttttattcgttgatttttgttttaatcgaggggttcggggtgttttgattcgtttttttcgtagtgaggtgtagtacgt

SEQ ID NO: 10610 - DNA, 594 bp, Artificial Sequence
  chemically treated genomic DNA (Homo sapiens) CpG-island No: 10610
acgtactacacctcactacgaaaaaaacgaatcaaaacaccccgaacccctcgattaaaacaaaaatcaacgaataaaaaaaaaaaataaaacaaatcgttacgaaaaaaaaaccaatacgaaaaacaaaactacgatcaatataaaacgaataaacaaaaataaaaacgactaataaacgtaaaaaaacgaaaccgaacaacccgtaaaacgaaacaaaaaacgaaaaaaaaaacgaaactaaaaacgaaacgcacctataactacgcaacaaacgcaccaacgccttaacgataacgcccacttccgccttaaacgccaaataaaaataaaactacgccaccgccatcaccaccgcgacgctacgactctacaacaaaaatttaatattacgcaacaacaaccgataatcgaaatccataacataaaactttcgaaaaaaaacgaccgcgacgaccgtctcctcaaaccccgcgcccttaacctcgtcctcctctaaaccgtaaaaaactttttccgcgttctcctctaataaaaattcctaaacgaaaaaaccgacgaatctataaacgcctccccgaaacacacttcgac

SEQ ID NO: 10611 - DNA, 594 bp, Artificial Sequence
  chemically treated genomic DNA (Homo sapiens) CpG-island No: 10611
acgtattgtattttattgcggagaggacgggttagagtatttcgggtttttcggttggggtaagggttagcggatgaggggaaaaggtggggtaagtcgttgcggggagaggattagtgcggagggtaggattacggttagtgtggagcgggtgggtagaggtggaagcggttggtgggcgtgagggggcggagtcgggtagttcgtggggcggggtaggaggcgagggagggggcggggttgggggcggagcgtatttgtggttgcgtagtaggcgtattagcgttttggcgatgacgtttattttcgttttgggcgttaggtggaagtagagttgcgttatcgttattattatcgcggcgttgcggttttgtagtaggggtttggtgttgcgtagtagtagtcggtggtcggggtttatgatatagggttttcgggagggggcggtcgcggcggtcgtttttttagatttcgcgtttttggtttcgtttttttttgagtcgtagaaggtttttttcgcgtttttttttagtagggatttttggacggggagatcgacgggtttgtgggcgttttttcgggatatatttcggt

SEQ ID NO: 10612 - DNA, 594 bp, Artificial Sequence
  chemically treated genomic DNA (Homo sapiens) CpG-island No: 10612
accgaaatatatcccgaaaaaacgcccacaaacccgtcgatctccccgtccaaaaatccctactaaaaaaaaacgcgaaaaaaaccttctacgactcaaaaaaaaacgaaaccaaaaacgcgaaatctaaaaaaacgaccgccgcgaccgccccctcccgaaaaccctatatcataaaccccgaccaccgactactactacgcaacaccaaacccctactacaaaaccgcaacgccgcgataataataacgataacgcaactctacttccacctaacgcccaaaacgaaaataaacgtcatcgccaaaacgctaatacgcctactacgcaaccacaaatacgctccgcccccaaccccgccccctccctcgcctcctaccccgccccacgaactacccgactccgccccctcacgcccaccaaccgcttccacctctacccacccgctccacactaaccgtaatcctaccctccgcactaatcctctccccgcaacgacttaccccaccttttcccctcatccgctaacccttaccccaaccgaaaaacccgaaatactctaacccgtcctctccgcaataaaatacaatacgt

SEQ ID NO: 10613 - DNA, 513 bp, Artificial Sequence
  chemically treated genomic DNA (Homo sapiens) CpG-island No: 10613
  misc_feature (206)..(206): n is either a, c, g or t
tttttgttcgagcgtcggttttttcgtttcggttcggagtcggggttcgggggcgcggtcgttaggggaggcgtcgcggcggtggcggtttttgcggttcggagggcgggtcgagcgggagtcgttgtttgggtcgcgcgtcgtttttatttcgtttcgcgttgtcggcgtttgtagcggagggcgtagttagttcggttttcggnttggatttttttattgatataatttcggttcggtcgttttacgtagggatattttcgtttttcgtaggttgttttcgttcgtcgattcgttcgtttttttttcggtgttatttattaggagtatatattttagtcggcgtttttcgttttcgttcgtaaatatagcgttgtttacgtttttttcgggttttgtattcgtttatacgtacgttttgatatagatttcgtttttttatacgttttttttagttttttttttattttattttttagaagaattttagtatagttttcgtattttgtttgt

SEQ ID NO: 10614 - DNA, 513 bp, Artificial Sequence
  chemically treated genomic DNA (Homo sapiens) CpG-island No: 10614
  misc_feature (308)..(308): n is either a, c, g or t
acaaacaaaatacgaaaactatactaaaattcttctaaaaaataaaataaaaaaaaaactaaaaaaaacgtataaaaaaacgaaatctatatcaaaacgtacgtataaacgaatacaaaacccgaaaaaaacgtaaacaacgctatatttacgaacgaaaacgaaaaacgccgactaaaatatatactcctaataaataacaccgaaaaaaaaacgaacgaatcgacgaacgaaaacaacctacgaaaaacgaaaatatccctacgtaaaacgaccgaaccgaaattatatcaataaaaaaatccaanccgaaaaccgaactaactacgccctccgctacaaacgccgacaacgcgaaacgaaataaaaacgacgcgcgacccaaacaacgactcccgctcgacccgccctccgaaccgcaaaaaccgccaccgccgcgacgcctcccctaacgaccgcgcccccgaaccccgactccgaaccgaaacgaaaaaaccgacgctcgaacaaaaa

SEQ ID NO: 10615 - DNA, 513 bp, Artificial Sequence
  chemically treated genomic DNA (Homo sapiens) CpG-island No: 10615
  misc_feature (308)..(308): n is either a, c, g or t
gtaagtaaagtgcggaagttgtattgggatttttttagaaagtggggtgggaaaggagttagggagggcgtgtggagggacgagatttgtgttagaacgtgcgtgtgagcggatataaaattcgagagaggcgtgagtagcgttgtgtttgcgagcgggagcgaggggcgtcggttggggtgtgtgtttttggtgagtgatatcgaggggaaggcgggcgggtcggcgggcgggggtagtttgcgaggggcgggagtgtttttgcgtggggcggtcgagtcggagttgtgttagtgaaggaatttagntcgggggtcgagttggttgcgtttttcgttgtaagcgtcggtagcgcggggcgaggtggggacggcgcgcggtttaagtagcggttttcgttcggttcgtttttcgagtcgtaggggtcgttatcgtcgcggcgttttttttggcgatcgcgttttcgggtttcggtttcgggtcgggacggaggagtcggcgttcgaataaagg

SEQ ID NO: 10616 - DNA, 513 bp, Artificial Sequence
  chemically treated genomic DNA (Homo sapiens) CpG-island No: 10616
  misc_feature (206)..(206): n is either a, c, g or t
cctttattcgaacgccgactcctccgtcccgacccgaaaccgaaacccgaaaacgcgatcgccaaaaaaaacgccgcgacgataacgacccctacgactcgaaaaacgaaccgaacgaaaaccgctacttaaaccgcgcgccgtccccacctcgccccgcgctaccgacgcttacaacgaaaaacgcaaccaactcgacccccganctaaattccttcactaacacaactccgactcgaccgccccacgcaaaaacactcccgcccctcgcaaactacccccgcccgccgacccgcccgccttcccctcgatatcactcaccaaaaacacacaccccaaccgacgcccctcgctcccgctcgcaaacacaacgctactcacgcctctctcgaattttatatccgctcacacgcacgttctaacacaaatctcgtccctccacacgccctccctaactcctttcccaccccactttctaaaaaaatcccaatacaacttccgcactttacttac

SEQ ID NO: 10617 - DNA, 685 bp, Artificial Sequence
  chemically treated genomic DNA (Homo sapiens) CpG-island No: 10617
tatttcgtcggtcggtttaggcgttattatttatttttattttcgattttcgggttggttttgttttcgttttaacgggatcgggtagtcgggttaggcgcggtagggcgggtagcgttcgttaattttcgttcggtcgggggcgtagtttttattaatttttggcgtttcgtttcgcgggggcgtaggaaggggtaggaagttgacgtttcgttggaagcgatcgtatggcggggaatttcggtttttttcgagattggagtagtaggaagttagggagggggcgttttcgagttcgtatttatttttcgcgcgtcgtcgtcgtcgtcgttgtgtttcgggtttttcgcgtcgatttcgtttttatggtaggtttttattttatgttttcgagttcggggggtaagtgtgggcgcgttttatggggtcgttagtttttcgtttcgtcgcgttaggtcggtttagagcgcgcggttttcgcgtttttagcgtagtttcgcgtttaggggcgttcgagtaggtaggtagcgcggttggggtttcgcgggcgttcgcgttaggtttatggttttaggagttcgggcgtcgcgttcgtttttgtttcggtttttttttgtttttattaaaaaggaagaagaagtaagaaaaagagagagagagatgattaaatttttggaggcgggtt

SEQ ID NO: 10618 - DNA, 685 bp, Artificial Sequence
  chemically treated genomic DNA (Homo sapiens) CpG-island No: 10618
aacccgcctccaaaaatttaatcatctctctctctctttttcttacttcttcttcctttttaataaaaacaaaaaaaaaccgaaacaaaaacgaacgcgacgcccgaactcctaaaaccataaacctaacgcgaacgcccgcgaaaccccaaccgcgctacctacctactcgaacgcccctaaacgcgaaactacgctaaaaacgcgaaaaccgcgcgctctaaaccgacctaacgcgacgaaacgaaaaactaacgaccccataaaacgcgcccacacttaccccccgaactcgaaaacataaaataaaaacctaccataaaaacgaaatcgacgcgaaaaacccgaaacacaacgacgacgacgacgacgcgcgaaaaataaatacgaactcgaaaacgccccctccctaacttcctactactccaatctcgaaaaaaaccgaaattccccgccatacgatcgcttccaacgaaacgtcaacttcctaccccttcctacgcccccgcgaaacgaaacgccaaaaattaataaaaactacgcccccgaccgaacgaaaattaacgaacgctacccgccctaccgcgcctaacccgactacccgatcccgttaaaacgaaaacaaaaccaacccgaaaatcgaaaataaaaataaataataacgcctaaaccgaccgacgaaata

SEQ ID NO: 10619 - DNA, 685 bp, Artificial Sequence
  chemically treated genomic DNA (Homo sapiens) CpG-island No: 10619
agttcgtttttaaaagtttgattattttttttttttttttttttgttttttttttttttttggtggaagtagaaaaggatcgaggtaggggcgagcgcggcgttcggatttttgggattatgggtttggcgcgggcgttcgcggggttttagtcgcgttgtttgtttgttcgggcgtttttgggcgcggggttgcgttgggggcgcgggggtcgcgcgttttaagtcggtttggcgcggcggggcggggggttggcggttttatggggcgcgtttatatttgtttttcgggttcgggagtatgaagtaggggtttgttatgggagcgggatcggcgcggggggttcgaggtatagcggcggcggcggcggcgcgcggggggtgagtacgaattcggggacgttttttttttagttttttgttgttttaatttcggggagggtcggggtttttcgttatgcggtcgtttttagcggaacgttagttttttgtttttttttgcgttttcgcgaggcgggacgttaagggttaataggggttgcgttttcggtcgggcgagagttggcgaacgttgttcgttttgtcgcgtttggttcggttgttcgatttcgttggggcgggggtagagttagttcgggggtcgggggtgggggtgggtggtggcgtttggatcggtcggcggggtg

SEQ ID NO: 10620 - DNA, 685 bp, Artificial Sequence
  chemically treated genomic DNA (Homo sapiens) CpG-island No: 10620
caccccgccgaccgatccaaacgccaccacccacccccacccccgacccccgaactaactctacccccgccccaacgaaatcgaacaaccgaaccaaacgcgacaaaacgaacaacgttcgccaactctcgcccgaccgaaaacgcaacccctattaacccttaacgtcccgcctcgcgaaaacgcaaaaaaaaacaaaaaactaacgttccgctaaaaacgaccgcataacgaaaaaccccgaccctccccgaaattaaaacaacaaaaaactaaaaaaaaaacgtccccgaattcgtactcaccccccgcgcgccgccgccgccgccgctatacctcgaaccccccgcgccgatcccgctcccataacaaacccctacttcatactcccgaacccgaaaaacaaatataaacgcgccccataaaaccgccaaccccccgccccgccgcgccaaaccgacttaaaacgcgcgacccccgcgcccccaacgcaaccccgcgcccaaaaacgcccgaacaaacaaacaacgcgactaaaaccccgcgaacgcccgcgccaaacccataatcccaaaaatccgaacgccgcgctcgcccctacctcgatccttttctacttccaccaaaaaaaaaaaaaaaacaaaaaaaaaaaaaaaaaaaataatcaaacttttaaaaacgaact

SEQ ID NO: 10621 - DNA, 895 bp, Artificial Sequence
  chemically treated genomic DNA (Homo sapiens) CpG-island No: 10621
ttatttatcggtgtatatatatatttttatacgtatttattttttttttaaatttagatatacgtttatatacggttttattttggggatagttacgtattttttttaggtttatacgaaacgtatttttagatatttgggtttaggcgtacgttgatattttatattcgtagaagtatgtttacggatgtttatataggtataaatgtacgttattttggttatatcgtttttatatatgtatatatttcgggtggatatacgcgcgtatatttttatttgtatatagtttttcgagagtgtttatcgtatatgtgtatatacgtatttattttttacgcgtgtatttatttttttatacgcgtatatttttaggcgcgcgtatatataggtatataatatttcgtatcgttttaggagtttttaagtatttattgggtttttacgtgcgaggttggtcggtcggtttttttttcggcgtttaacggtatttgtatttatgggttttcgtagtcgtgggcgcgggggcggggggcgaggtttttttttttaaacggggcgcgggcgcgcggagcgtagcggtatcgggaggggtatgggcgcgcgggattgcgtcgtcgattcggttcgtttgcgttcgaatttcggtagttttgcgtttacgggtttcggcgcgggtttcgagagttgggggcggtttataggtgttggggcggcggcgttcgtcgggttttttgaagttttcgttgggggcggggagggggcgttgaaggcggttttttaaattttggttgtacgcgggttcggtcgagtaaggtgtttggttttaataaattttaggaaaagttttaagtcgagagaggggaggtaggggggttgggggagttgtatagtt

SEQ ID NO: 10622 - DNA, 895 bp, Artificial Sequence
  chemically treated genomic DNA (Homo sapiens) CpG-island No: 10622
aactatacaactcccccaacccccctacctcccctctctcgacttaaaacttttcctaaaatttattaaaaccaaacaccttactcgaccgaacccgcgtacaaccaaaatttaaaaaaccgccttcaacgccccctccccgcccccaacgaaaacttcaaaaaacccgacgaacgccgccgccccaacacctataaaccgcccccaactctcgaaacccgcgccgaaacccgtaaacgcaaaactaccgaaattcgaacgcaaacgaaccgaatcgacgacgcaatcccgcgcgcccatacccctcccgataccgctacgctccgcgcgcccgcgccccgtttaaaaaaaaaaacctcgccccccgcccccgcgcccacgactacgaaaacccataaatacaaataccgttaaacgccgaaaaaaaaaccgaccgaccaacctcgcacgtaaaaacccaataaatacttaaaaactcctaaaacgatacgaaatattatatacctatatatacgcgcgcctaaaaatatacgcgtataaaaaaataaatacacgcgtaaaaaataaatacgtatatacacatatacgataaacactctcgaaaaactatatacaaataaaaatatacgcgcgtatatccacccgaaatatatacatatataaaaacgatataaccaaaataacgtacatttatacctatataaacatccgtaaacatacttctacgaatataaaatatcaacgtacgcctaaacccaaatatctaaaaatacgtttcgtataaacctaaaaaaaatacgtaactatccccaaaataaaaccgtatataaacgtatatctaaatttaaaaaaaaaataaatacgtataaaaatatatatatacaccgataaataa

SEQ ID NO: 10623 - DNA, 895 bp, Artificial Sequence
  chemically treated genomic DNA (Homo sapiens) CpG-island No: 10623
agttatgtagtttttttaatttttttattttttttttttcggtttgggattttttttaaagtttgttgaaattagatattttgttcgatcgagttcgcgtgtagttagggtttaaaaggtcgtttttagcgtttttttttcgtttttagcggagattttaaaaggttcggcgggcgtcgtcgttttagtatttatgagtcgtttttagttttcggagttcgcgtcggagttcgtggacgtagagttgtcgaagttcgagcgtaggcggatcgggtcggcggcgtagtttcgcgcgtttatgtttttttcggtgtcgttgcgtttcgcgcgttcgcgtttcgtttagggaaggggatttcgtttttcgttttcgcgtttacggttgcggggatttatgaatataaatgtcgttaggcgtcggaggaaggatcgatcggttagtttcgtacgtagggatttagtaagtgtttgggggtttttggagcggtgcgaagtgttatatgtttgtgtgtgcgcgcgtttaaaggtgtgcgcgtatggggaggtgggtatacgcgtgaggagtgaatgcgtgtgtgtatatgtgcggtgggtattttcggagaattgtgtgtaagtgagggtgtgcgcgcgtgtgtttattcggggtgtgtatatgtgtgggggcgatatggttaggatagcgtgtatttgtgtttgtgtaagtattcgtgggtatgtttttgcgagtgtagagtattagcgtgcgtttgagtttagatatttgaggatgcgtttcgtgtgaatttaggaagggtgcgtggttgtttttagaatgggatcgtgtgtgagcgtgtgtttgagtttggggaaagggtggatacgtgtgggagtgtgtgtgtgtatcggtgaataa

SEQ ID NO: 10624 - DNA, 895 bp, Artificial Sequence
  chemically treated genomic DNA (Homo sapiens) CpG-island No: 10624
ttattcaccgatacacacacacactcccacacgtatccaccctttccccaaactcaaacacacgctcacacacgatcccattctaaaaacaaccacgcacccttcctaaattcacacgaaacgcatcctcaaatatctaaactcaaacgcacgctaatactctacactcgcaaaaacatacccacgaatacttacacaaacacaaatacacgctatcctaaccatatcgcccccacacatatacacaccccgaataaacacacgcgcgcacaccctcacttacacacaattctccgaaaatacccaccgcacatatacacacacgcattcactcctcacgcgtatacccacctccccatacgcgcacacctttaaacgcgcgcacacacaaacatataacacttcgcaccgctccaaaaacccccaaacacttactaaatccctacgtacgaaactaaccgatcgatccttcctccgacgcctaacgacatttatattcataaatccccgcaaccgtaaacgcgaaaacgaaaaacgaaatccccttccctaaacgaaacgcgaacgcgcgaaacgcaacgacaccgaaaaaaacataaacgcgcgaaactacgccgccgacccgatccgcctacgctcgaacttcgacaactctacgtccacgaactccgacgcgaactccgaaaactaaaaacgactcataaatactaaaacgacgacgcccgccgaaccttttaaaatctccgctaaaaacgaaaaaaaaacgctaaaaacgaccttttaaaccctaactacacgcgaactcgatcgaacaaaatatctaatttcaacaaactttaaaaaaaatcccaaaccgaaaaaaaaaaaataaaaaaattaaaaaaactacataact

SEQ ID NO: 10625 - DNA, 907 bp, Artificial Sequence
  chemically treated genomic DNA (Homo sapiens) CpG-island No: 10625
gagagatcggcgttgttagaatagttagtcgggggtgcgggggtgcggggtttcggcgagagatcggcgttgttagaatagttagtcgggggtgcggggttttagcgagagatcggcgttgttagaatagttagtcgggggtgcggggtttcggcgagagatcggcgttgttagaatagttcgtcgggggtgcggggttttagcgagagatcggcgttgttagaatagttagtcgggggtgcggggtttcggcgagagatcggcgttgttagaatagttagtcgggggtgcgggggtgcggggtttcggcgagagatcggcgttgttagaatagttagtcgggggtgcgggggtgcggggtttcggcgagagatcggcgttgttagaatagttagtcgggggtgcggggttttagcgagagatcggcgttgttagaatagttagtcgggggtgcggggtttcggcgagagatcggcgttgttagaatagttagtcgggggtgcggggtttcggcgagagatcggcgttgttagaatagttagtcgggggtgcggggttttagcgagagatcggcgttgttagaatagttagtcgggggtgcggggttttagtgagagatcggcgttgttagaatagttagtcgggggtgcggggtttcggcgagagatcggcgttgttagaatagttagtcgggggtgcggggtttcggcgagagatcggcgttgttagaatagttagtcgggggtgcggggtttcggcgagagatcggcgttgttagaatagttagtcgggggtgcggggttttagcgagagatcggcgttgttagaatagttagtcgggggtgcggggttttagtgagagattagtgttgttagaatagttagtttgagagtagatattttcgtt

SEQ ID NO: 10626 - DNA, 907 bp, Artificial Sequence
  chemically treated genomic DNA (Homo sapiens) CpG-island No: 10626
aacgaaaatatctactctcaaactaactattctaacaacactaatctctcactaaaaccccgcacccccgactaactattctaacaacgccgatctctcgctaaaaccccgcacccccgactaactattctaacaacgccgatctctcgccgaaaccccgcacccccgactaactattctaacaacgccgatctctcgccgaaaccccgcacccccgactaactattctaacaacgccgatctctcgccgaaaccccgcacccccgactaactattctaacaacgccgatctctcactaaaaccccgcacccccgactaactattctaacaacgccgatctctcgctaaaaccccgcacccccgactaactattctaacaacgccgatctctcgccgaaaccccgcacccccgactaactattctaacaacgccgatctctcgccgaaaccccgcacccccgactaactattctaacaacgccgatctctcgctaaaaccccgcacccccgactaactattctaacaacgccgatctctcgccgaaaccccgcacccccgcacccccgactaactattctaacaacgccgatctctcgccgaaaccccgcacccccgcacccccgactaactattctaacaacgccgatctctcgccgaaaccccgcacccccgactaactattctaacaacgccgatctctcgctaaaaccccgcacccccgacgaactattctaacaacgccgatctctcgccgaaaccccgcacccccgactaactattctaacaacgccgatctctcgctaaaaccccgcacccccgactaactattctaacaacgccgatctctcgccgaaaccccgcacccccgcacccccgactaactattctaacaacgccgatctctc

SEQ ID NO: 10627 - DNA, 907 bp, Artificial Sequence
  chemically treated genomic DNA (Homo sapiens) CpG-island No: 10627
aacgggggtgtttgtttttagattgattgttttaataatattggttttttattggagtttcgtattttcgattgattgttttaatagcgtcggtttttcgttggagtttcgtattttcgattgattgttttaatagcgtcggtttttcgtcggagtttcgtattttcgattgattgttttaatagcgtcggtttttcgtcggagtttcgtattttcgattgattgttttaataacgtcggtttttcgtcggagtttcgtattttcgattgattgttttaatagcgtcggttttttattggagtttcgtattttcgattgattgttttaatagcgtcggtttttcgttggagtttcgtattttcgattgattgttttaataacgtcggtttttcgtcggagtttcgtattttcgattgattgttttaataacgtcggtttttcgtcggagtttcgtattttcgattgattgttttaataacgtcggtttttcgttggagtttcgtattttcgattgattgttttaatagcgtcggtttttcgtcggagtttcgtattttcgtattttcgattgattgttttaatagcgtcggtttttcgtcggagtttcgtattttcgtattttcgattgattgttttaataacgtcggtttttcgtcggagtttcgtattttcgattgattgttttaataacgtcggtttttcgttggagtttcgtattttcgacggattgttttaatagcgtcggtttttcgtcggagtttcgtattttcgattgattgttttaataacgtcggtttttcgttggagtttcgtattttcgattgattgttttaatagcgtcggtttttcgtcggagtttcgtattttcgtattttcgattgattgttttaatagcgtcggtttttt

SEQ ID NO: 10628 - DNA, 907 bp, Artificial Sequence
  chemically treated genomic DNA (Homo sapiens) CpG-island No: 10628
aaaaaaccgacgctattaaaacaatcaatcgaaaatacgaaaatacgaaactccgacgaaaaaccgacgctattaaaacaatcaatcgaaaatacgaaactccaacgaaaaaccgacgttattaaaacaatcaatcgaaaatacgaaactccgacgaaaaaccgacgctattaaaacaatccgtcgaaaatacgaaactccaacgaaaaaccgacgttattaaaacaatcaatcgaaaatacgaaactccgacgaaaaaccgacgttattaaaacaatcaatcgaaaatacgaaaatacgaaactccgacgaaaaaccgacgctattaaaacaatcaatcgaaaatacgaaaatacgaaactccgacgaaaaaccgacgctattaaaacaatcaatcgaaaatacgaaactccaacgaaaaaccgacgttattaaaacaatcaatcgaaaatacgaaactccgacgaaaaaccgacgttattaaaacaatcaatcgaaaatacgaaactccgacgaaaaaccgacgttattaaaacaatcaatcgaaaatacgaaactccaacgaaaaaccgacgctattaaaacaatcaatcgaaaatacgaaactccaataaaaaaccgacgctattaaaacaatcaatcgaaaatacgaaactccgacgaaaaaccgacgttattaaaacaatcaatcgaaaatacgaaactccgacgaaaaaccgacgctattaaaacaatcaatcgaaaatacgaaactccgacgaaaaaccgacgctattaaaacaatcaatcgaaaatacgaaactccaacgaaaaaccgacgctattaaaacaatcaatcgaaaatacgaaactccaataaaaaaccaatattattaaaacaatcaatctaaaaacaaacacccccgtt

SEQ ID NO: 10629 - DNA, 551 bp, Artificial Sequence
  chemically treated genomic DNA (Homo sapiens) CpG-island No: 10629
tcgagtgttggcggggaggggatgggagtagcgggtacgttcgttcgtgtttttttattttattatttcggtacgcgcgcgggtagcgttcgtagggggcgcggagggcgtataggtgggtttcgtcgggttttgttttttgtttttttttgttattcgcggaaggttatcgcgttttttttaacgcgtttttcgttcgtttttttttttttcgtgatattttatataataatttgagttaattaaaacggaagcgacgcgcgtagtcgggagtagatgttcgcgtttcgagttagcggtttttaaattaggcgtcggggcgcgcggttgtcggcgggggaagggttcgagcgtcgatttaggtcgttttttttcggcggaggcgtcgttgttgtcggtttttattaggaagtcgcgagcgttataaattgcgttagttttttcgaatatattttatggtttttttttagttagggagtcgttgttttcgcggcggggtcgcggttaggattggaaggcgtttttttggggaagagaaagtttttcggggt

SEQ ID NO: 10630 - DNA, 551 bp, Artificial Sequence
  chemically treated genomic DNA (Homo sapiens) CpG-island No: 10630
accccgaaaaactttctcttccccaaaaaaacgccttccaatcctaaccgcgaccccgccgcgaaaacaacgactccctaactaaaaaaaaaccataaaatatattcgaaaaaactaacgcaatttataacgctcgcgacttcctaataaaaaccgacaacaacgacgcctccgccgaaaaaaaacgacctaaatcgacgctcgaacccttcccccgccgacaaccgcgcgccccgacgcctaatttaaaaaccgctaactcgaaacgcgaacatctactcccgactacgcgcgtcgcttccgttttaattaactcaaattattatataaaatatcacgaaaaaaaaaaaaacgaacgaaaaacgcgttaaaaaaaacgcgataaccttccgcgaataacaaaaaaaaacaaaaaacaaaacccgacgaaacccacctatacgccctccgcgccccctacgaacgctacccgcgcgcgtaccgaaataataaaataaaaaaacacgaacgaacgtacccgctactcccatcccctccccgccaacactcga

SEQ ID NO: 10631 - DNA, 551 bp, Artificial Sequence
  chemically treated genomic DNA (Homo sapiens) CpG-island No: 10631
gtttcgaggaatttttttttttttagaggggcgttttttagttttggtcgcggtttcgtcgcgggagtagcggttttttggttggagggagattatgaaatgtgttcgaagaagttgacgtagtttgtgacgttcgcggttttttgatggggatcggtagtagcggcgttttcgtcgaggagggacgatttgagtcggcgttcgggtttttttttcgtcggtagtcgcgcgtttcggcgtttagtttgggggtcgttggttcggggcgcgagtatttgttttcggttgcgcgcgtcgttttcgttttgattagtttaggttattatataagatgttacggagaggaaaggggcgagcgagaggcgcgttggggagggcgcggtggtttttcgcgagtggtagggaggggtaggaggtaggattcggcgggatttatttgtacgtttttcgcgttttttgcgggcgttgttcgcgcgcgtgtcggggtggtggggtgggggggtacggacggacgtgttcgttgtttttatttttttttcgttaatattcgg

SEQ ID NO: 10632 - DNA, 551 bp, Artificial Sequence
  chemically treated genomic DNA (Homo sapiens) CpG-island No: 10632
ccgaatattaacgaaaaaaaaataaaaacaacgaacacgtccgtccgtacccccccaccccaccaccccgacacgcgcgcgaacaacgcccgcaaaaaacgcgaaaaacgtacaaataaatcccgccgaatcctacctcctacccctccctaccactcgcgaaaaaccaccgcgccctccccaacgcgcctctcgctcgcccctttcctctccgtaacatcttatataataacctaaactaatcaaaacgaaaacgacgcgcgcaaccgaaaacaaatactcgcgccccgaaccaacgacccccaaactaaacgccgaaacgcgcgactaccgacgaaaaaaaaacccgaacgccgactcaaatcgtccctcctcgacgaaaacgccgctactaccgatccccatcaaaaaaccgcgaacgtcacaaactacgtcaacttcttcgaacacatttcataatctccctccaaccaaaaaaccgctactcccgcgacgaaaccgcgaccaaaactaaaaaacgcccctctaaaaaaaaaaaaattcctcgaaac

SEQ ID NO: 10633 - DNA, 847 bp, Artificial Sequence
  chemically treated genomic DNA (Homo sapiens) CpG-island No: 10633
tgttcgttcggcgttcggtttcgtcgtgtttttagttttttttcgcgcgtcgttagttcggtcgcgtcgtttatcggttcgtatcgaggttaggttaggtaatttgtgatttcggggcgttaggcggttttttttcgttcgtcgggttcgtttggttttcggggtttttttttcggtttcgcggaaaatagttacgttagaaatttttttgggtcgcgtcgggcggggaagtcgtttgggttttcgcgtatcgtttttattttgttttcgagaggttacgattcgggcgggtcgcgcggggcgcgtggtgcgcgagcgcgcgcgcgtggggcggtaggtgagggagttcgcgtcggcgggggcggggcggggtagcgggggtgcgagcggcgcggggcgggggttgggtcggttcggcgggcgggcgcgaggagagtagagttcgcggcggcggcggcggcgttggcggcggcgggcgcggggcgagcgcgtcgagggggcggaggagttatcgtgggtttgtttacgtattgttgttcggttcggggtatagttcgtattttttgattggatataaattggggtatagtttttcgtcgtcgttcgttaggttttttcgagtcgtcgtcgcgtagttttcggagcgttttgtcgggtacggtttacggcggtgtttaggtttggaggggacgagtcgcggcggttgtttcgggcgggcgtgaagttaagttttcgttcggggttcgtagttttttatttgtagtggttcgattttggtaaggagaaattcgaaattttttaggtcggagatttcgaatcgtatagtttttgagggggtatttttttt

SEQ ID NO: 10634 - DNA, 847 bp, Artificial Sequence
  chemically treated genomic DNA (Homo sapiens) CpG-island No: 10634
aaaaaaaataccccctcaaaaactatacgattcgaaatctccgacctaaaaaatttcgaatttctccttaccaaaatcgaaccactacaaataaaaaactacgaaccccgaacgaaaacttaacttcacgcccgcccgaaacaaccgccgcgactcgtcccctccaaacctaaacaccgccgtaaaccgtacccgacaaaacgctccgaaaactacgcgacgacgactcgaaaaaacctaacgaacgacgacgaaaaactataccccaatttatatccaatcaaaaaatacgaactataccccgaaccgaacaacaatacgtaaacaaacccacgataactcctccgccccctcgacgcgctcgccccgcgcccgccgccgccaacgccgccgccgccgccgcgaactctactctcctcgcgcccgcccgccgaaccgacccaacccccgccccgcgccgctcgcacccccgctaccccgccccgcccccgccgacgcgaactccctcacctaccgccccacgcgcgcgcgctcgcgcaccacgcgccccgcgcgacccgcccgaatcgtaacctctcgaaaacaaaataaaaacgatacgcgaaaacccaaacgacttccccgcccgacgcgacccaaaaaaatttctaacgtaactattttccgcgaaaccgaaaaaaaaaccccgaaaaccaaacgaacccgacgaacgaaaaaaaaccgcctaacgccccgaaatcacaaattacctaacctaacctcgatacgaaccgataaacgacgcgaccgaactaacgacgcgcgaaaaaaaactaaaaacacgacgaaaccgaacgccgaacgaaca

SEQ ID NO: 10635 - DNA, 847 bp, Artificial Sequence
  chemically treated genomic DNA (Homo sapiens) CpG-island No: 10635
ggagaaggtgtttttttagaggttgtacgattcgaagttttcggtttgagaagtttcgaatttttttttgttaaggtcgggttattataggtgggagattgcgagtttcgagcgaaagtttggttttacgttcgttcggggtagtcgtcgcggttcgttttttttaggtttgggtatcgtcgtgggtcgtgttcggtaggacgtttcgggagttgcgcggcggcggttcgaggaggtttggcgggcggcggcgagaggttgtgttttagtttgtgtttaattagggagtgcgggttgtgtttcgagtcgggtagtaatgcgtaaataaatttacggtaattttttcgttttttcggcgcgttcgtttcgcgttcgtcgtcgttagcgtcgtcgtcgtcgtcgcgggttttgtttttttcgcgttcgttcgtcgggtcggtttagttttcgtttcgcgtcgttcgtattttcgttgtttcgtttcgttttcgtcggcgcgggtttttttatttatcgttttacgcgcgcgcgttcgcgtattacgcgtttcgcgcggttcgttcggatcgtggtttttcgagagtaaggtaagggcgatgcgcggggatttaggcggttttttcgttcgacgcggtttagggaagtttttggcgtggttgtttttcgcggggtcgggggggaggtttcgggagttaggcgagttcggcgggcgggagggggtcgtttggcgtttcggggttataagttgtttaatttgatttcggtgcgggtcggtgggcggcgcggtcgggttggcggcgcgcggaaaggggttggaggtacggcggggtcgggcgtcgggcgggta

SEQ ID NO: 10636 - DNA, 847 bp, Artificial Sequence
  chemically treated genomic DNA (Homo sapiens) CpG-island No: 10636
tacccgcccgacgcccgaccccgccgtacctccaacccctttccgcgcgccgccaacccgaccgcgccgcccaccgacccgcaccgaaatcaaattaaacaacttataaccccgaaacgccaaacgaccccctcccgcccgccgaactcgcctaactcccgaaacctcccccccgaccccgcgaaaaacaaccacgccaaaaacttccctaaaccgcgtcgaacgaaaaaaccgcctaaatccccgcgcatcgcccttaccttactctcgaaaaaccacgatccgaacgaaccgcgcgaaacgcgtaatacgcgaacgcgcgcgcgtaaaacgataaataaaaaaacccgcgccgacgaaaacgaaacgaaacaacgaaaatacgaacgacgcgaaacgaaaactaaaccgacccgacgaacgaacgcgaaaaaaacaaaacccgcgacgacgacgacgacgctaacgacgacgaacgcgaaacgaacgcgccgaaaaaacgaaaaaattaccgtaaatttatttacgcattactacccgactcgaaacacaacccgcactccctaattaaacacaaactaaaacacaacctctcgccgccgcccgccaaacctcctcgaaccgccgccgcgcaactcccgaaacgtcctaccgaacacgacccacgacgatacccaaacctaaaaaaaacgaaccgcgacgactaccccgaacgaacgtaaaaccaaactttcgctcgaaactcgcaatctcccacctataataacccgaccttaacaaaaaaaaattcgaaacttctcaaaccgaaaacttcgaatcgtacaacctctaaaaaaacaccttctcc

SEQ ID NO: 10637 - DNA, 794 bp, Artificial Sequence
  chemically treated genomic DNA (Homo sapiens) CpG-island No: 10637
gagttcgcgcgtaagagatgaaatggtagtattttcgcgagcgtatattagagaaattcgtcgagatttaaagcgagttcgcgcgagatgggggtgggagcgttcgcgggggtcgttttttgcgtagtcgtagcggcggcgttaattatcgggcgtattacgttttttcgcgacggtatagttgtacgttcgtgacgtcggcggttgtcgtggagagattcgttcggtttcgatcgagagttggcgttaggagtcgtagggttatagcgtgtttttgaagttgttttcgtcgttattatgagcggtcgaagtcggggtcgaaagttttttcgcgttaaaaatcggggtaaaggtcgcgttaaagttcgagttcgttttgtttcggacgacgtttcgcgcgattcggattttttatagtattagagtttcggggaagatatttaggcggtataggtgtaggttggcgcggggtggggtggtttggaagtcgttgcgttcgcgtagttttttcggttcggggaggaggtcgtttgtcggttttttttggattgtggtttcgcgttgcgggttcgagttgcgggggattacgggtaggtcgcggttaggttcggttcggggaaggtcgtatttttttcggagcgtttggtcgtagatagtgttttcgtgggaatagcgggaatcgtgggaaggtcgaaaaatgtttttcgcgttggaaatcggcgtggttttgtcgggaagaaggttttagaaatttgtagtatcgcggggagggggttttaggttatagttggtgg

SEQ ID NO: 10638 - DNA, 794 bp, Artificial Sequence
  chemically treated genomic DNA (Homo sapiens) CpG-island No: 10638
ccaccaactataacctaaaaccccctccccgcgatactacaaatttctaaaaccttcttcccgacaaaaccacgccgatttccaacgcgaaaaacatttttcgaccttcccacgattcccgctattcccacgaaaacactatctacgaccaaacgctccgaaaaaaatacgaccttccccgaaccgaacctaaccgcgacctacccgtaatcccccgcaactcgaacccgcaacgcgaaaccacaatccaaaaaaaaccgacaaacgacctcctccccgaaccgaaaaaactacgcgaacgcaacgacttccaaaccaccccaccccgcgccaacctacacctataccgcctaaatatcttccccgaaactctaatactataaaaaatccgaatcgcgcgaaacgtcgtccgaaacaaaacgaactcgaactttaacgcgacctttaccccgatttttaacgcgaaaaaactttcgaccccgacttcgaccgctcataataacgacgaaaacaacttcaaaaacacgctataaccctacgactcctaacgccaactctcgatcgaaaccgaacgaatctctccacgacaaccgccgacgtcacgaacgtacaactataccgtcgcgaaaaaacgtaatacgcccgataattaacgccgccgctacgactacgcaaaaaacgacccccgcgaacgctcccacccccatctcgcgcgaactcgctttaaatctcgacgaatttctctaatatacgctcgcgaaaatactaccatttcatctcttacgcgcgaactc

SEQ ID NO: 10639 - DNA, 794 bp, Artificial Sequence
  chemically treated genomic DNA (Homo sapiens) CpG-island No: 10639
ttattagttatgatttgaggtttttttttcgcggtgttataggtttttggggtttttttttcggtagggttacgtcggtttttaacgcggggggtatttttcggtttttttacggttttcgttgtttttacgaagatattgtttgcggttaggcgtttcgagagagatgcggtttttttcgggtcgggtttggtcgcggtttgttcgtggtttttcgtagttcgggttcgtagcgcgaggttatagtttagggggagtcggtaggcggtttttttttcgagtcggaggagttgcgcggacgtagcggtttttaggttattttatttcgcgttagtttgtatttgtgtcgtttgggtgtttttttcgagattttggtattgtgaagggttcgggtcgcgcggggcgtcgttcggagtagggcggattcgggttttggcgcggtttttgtttcggtttttggcgcgggaggattttcgatttcgatttcggtcgtttatggtggcggcggaggtagttttaaagatacgttgtgattttgcggtttttgacgttagttttcggtcgggatcgagcgggtttttttacggtaatcgtcgacgttacgaacgtataattgtatcgtcgcgagaggacgtgatgcgttcggtgattggcgtcgtcgttgcggttgcgtaggagacgattttcgcgggcgtttttatttttatttcgcgcggattcgttttaggtttcggcgagtttttttgatatgcgttcgcgggggtgttgttattttattttttgcgcgcgggttt

SEQ ID NO: 10640 - DNA, 794 bp, Artificial Sequence
  chemically treated genomic DNA (Homo sapiens) CpG-island No: 10640
aaacccgcgcgcaaaaaataaaataacaacacccccgcgaacgcatatcaaaaaaactcgccgaaacctaaaacgaatccgcgcgaaataaaaataaaaacgcccgcgaaaatcgtctcctacgcaaccgcaacgacgacgccaatcaccgaacgcatcacgtcctctcgcgacgatacaattatacgttcgtaacgtcgacgattaccgtaaaaaaacccgctcgatcccgaccgaaaactaacgtcaaaaaccgcaaaatcacaacgtatctttaaaactacctccgccgccaccataaacgaccgaaatcgaaatcgaaaatcctcccgcgccaaaaaccgaaacaaaaaccgcgccaaaacccgaatccgccctactccgaacgacgccccgcgcgacccgaacccttcacaataccaaaatctcgaaaaaaacacccaaacgacacaaatacaaactaacgcgaaataaaataacctaaaaaccgctacgtccgcgcaactcctccgactcgaaaaaaaaaccgcctaccgactccccctaaactataacctcgcgctacgaacccgaactacgaaaaaccacgaacaaaccgcgaccaaacccgacccgaaaaaaaccgcatctctctcgaaacgcctaaccgcaaacaatatcttcgtaaaaacaacgaaaaccgtaaaaaaaccgaaaaataccccccgcgttaaaaaccgacgtaaccctaccgaaaaaaaaaccccaaaaacctataacaccgcgaaaaaaaaacctcaaatcataactaataa

SEQ ID NO: 10641 - DNA, 813 bp, Artificial Sequence
  chemically treated genomic DNA (Homo sapiens) CpG-island No: 10641
  misc_feature (669)..(669): n is either a, c, g or t
cgcgcgtatgcgtgtgtgtgtgtgtgtgtgtgtgtgtgtgtgtgtgtgtgtgtgcgcgcgcgttggaagggtgtaaggtgtgcgggtcgggggagagtgcgtgtttgggtttagggttgtcgtttgcgtgtgagggtgcgagggtgtggtcgtgcgggggattgtgtagtgttttggcgtgtggggtgtgagtgtgagatttgggcggtcgcggatagcggtcgtttcggagggggaggcgttagttttgcgagattcgcgggcgtgtcggggttcgggcgtttttagtcgggaggcgtaggaggcgcggagttaatttagtcgttttgtcgtcgttcgcgcgggtcgttcgttttttcggggttttcgggtttcgggttcgcggtttcggggggcgggcggggattttcggggttcgtcggtcgttcggggggtcgaggacgtcgtttgtcgggcgtttagtagcggtttcgggttttcgcgcggcgcgcgcgttttcggaagttcggtttggggcgtattggggtcggggtagtggtcgggttcgggagttttcgtcggtcgcggagttggtgggtagcgtcgtgtggcgcgtggagcgcgcgggggtcgggggttggcgttgggagcgcgtcgtcggcgtggattgtagcgtttcggaatcgcgtntgtttttggttgttttgttttagttatagcgatcgtcgcgcgttcgggtcgcgtcgggttagggtgagagtcgtagggtcggggtcggggtcggggtaggttttgtcggggtttgagtgggattgggttattaattttttgcgg

SEQ ID NO: 10642 - DNA, 813 bp, Artificial Sequence
  chemically treated genomic DNA (Homo sapiens) CpG-island No: 10642
  misc_feature (145)..(145): n is either a, c, g or t
ccgcaaaaaattaataacccaatcccactcaaaccccgacaaaacctaccccgaccccgaccccgaccctacgactctcaccctaacccgacgcgacccgaacgcgcgacgatcgctataactaaaacaaaacaaccaaaaacanacgcgattccgaaacgctacaatccacgccgacgacgcgctcccaacgccaacccccgacccccgcgcgctccacgcgccacacgacgctacccaccaactccgcgaccgacgaaaactcccgaacccgaccactaccccgaccccaatacgccccaaaccgaacttccgaaaacgcgcgcgccgcgcgaaaacccgaaaccgctactaaacgcccgacaaacgacgtcctcgaccccccgaacgaccgacgaaccccgaaaatccccgcccgccccccgaaaccgcgaacccgaaacccgaaaaccccgaaaaaacgaacgacccgcgcgaacgacgacaaaacgactaaattaactccgcgcctcctacgcctcccgactaaaaacgcccgaaccccgacacgcccgcgaatctcgcaaaactaacgcctccccctccgaaacgaccgctatccgcgaccgcccaaatctcacactcacaccccacacgccaaaacactacacaatcccccgcacgaccacaccctcgcaccctcacacgcaaacgacaaccctaaacccaaacacgcactctcccccgacccgcacaccttacacccttccaacgcgcgcgcacacacacacacacacacacacacacacacacacacacacacgcatacgcgcg

SEQ ID NO: 10643 - DNA, 813 bp, Artificial Sequence
  chemically treated genomic DNA (Homo sapiens) CpG-island No: 10643
  misc_feature (145)..(145): n is either a, c, g or t
tcgtagggagttggtgatttagttttatttagatttcgataaggtttgtttcggtttcggtttcggttttgcggtttttattttggttcggcgcggttcgggcgcgcggcggtcgttgtggttgaggtagggtagttagaggtangcgcggtttcggggcgttgtagtttacgtcgacggcgcgtttttagcgttagttttcggttttcgcgcgttttacgcgttatacggcgttgtttattagtttcgcggtcggcgggggttttcgggttcggttattgtttcggttttagtacgttttaggtcgggttttcggagacgcgcgcgtcgcgcgggggttcggggtcgttgttaggcgttcggtagacggcgttttcgatttttcgggcggtcggcgggtttcgggggttttcgttcgtttttcggagtcgcgggttcggggttcgggggtttcgaagggacggacggttcgcgcggacggcggtaggacggttggattggtttcgcgttttttgcgtttttcggttgaaggcgttcgagtttcgatacgttcgcgagtttcgtagggttgacgttttttttttcggggcggtcgttgttcgcggtcgtttagattttatatttatattttatacgttagggtattatatagtttttcgtacgattatattttcgtatttttatacgtagacggtagttttggatttagatacgtattttttttcggttcgtatattttgtatttttttagcgcgcgcgtatatatatatatatatatatatatatatatatatatatatacgtatacgcgcg

SEQ ID NO: 10644 - DNA, 813 bp, Artificial Sequence
  chemically treated genomic DNA (Homo sapiens) CpG-island No: 10644
  misc_feature (669)..(669): n is either a, c, g or t
cgcgcgtatacgtatatatatatatatatatatatatatatatatatatatatacgcgcgcgctaaaaaaatacaaaatatacgaaccgaaaaaaaatacgtatctaaatccaaaactaccgtctacgtataaaaatacgaaaatataatcgtacgaaaaactatataataccctaacgtataaaatataaatataaaatctaaacgaccgcgaacaacgaccgccccgaaaaaaaaaacgtcaaccctacgaaactcgcgaacgtatcgaaactcgaacgccttcaaccgaaaaacgcaaaaaacgcgaaaccaatccaaccgtcctaccgccgtccgcgcgaaccgtccgtcccttcgaaacccccgaaccccgaacccgcgactccgaaaaacgaacgaaaacccccgaaacccgccgaccgcccgaaaaatcgaaaacgccgtctaccgaacgcctaacaacgaccccgaacccccgcgcgacgcgcgcgtctccgaaaacccgacctaaaacgtactaaaaccgaaacaataaccgaacccgaaaacccccgccgaccgcgaaactaataaacaacgccgtataacgcgtaaaacgcgcgaaaaccgaaaactaacgctaaaaacgcgccgtcgacgtaaactacaacgccccgaaaccgcgcntacctctaactaccctacctcaaccacaacgaccgccgcgcgcccgaaccgcgccgaaccaaaataaaaaccgcaaaaccgaaaccgaaaccgaaacaaaccttatcgaaatctaaataaaactaaatcaccaactccctacga

SEQ ID NO: 10645 - DNA, 509 bp, Artificial Sequence
  chemically treated genomic DNA (Homo sapiens) CpG-island No: 10645
  misc_feature (392)..(392): n is either a, c, g or t
  misc_feature (431)..(431): n is either a, c, g or t
  misc_feature (459)..(459): n is either a, c, g or t
  misc_feature (467)..(467): n is either a, c, g or t
  misc_feature (482)..(482): n is either a, c, g or t
  misc_feature (508)..(508): n is either a, c, g or t
cggcgttcggcgcgtttatttcgtcgggttataacgttcgtagtttttttttttttttcggtcgcgtatttacgttcggcgttcgtttatttgttttatgttgggttttgttatgtcgttttcgtcgcgtcggtttcggggggcgtagggggaggcggtttttttatgcgttttgttcgggtagttgtattcggcgatcgttaagcgtaagtagcggttggtgttagcgttcgagtttttttttcgtatcgtttcgtttcgtcggttttattttttattttatttttattattttttatttcgttcggttcgtggtagtatcgcgtatcggcgagtatacgcgtttataggtaatcgtataatcgtacgtacgtacgtgggggtatatatanttcgaatatatatataacgcgtattcgattttcgtatantttttggttagttcgtttcggtattttnttgttttngttcgttttgggggncgttgttaggggagaggagatttttng

SEQ ID NO: 10646 - DNA, 509 bp, Artificial Sequence
  chemically treated genomic DNA (Homo sapiens) CpG-island No: 10646
  misc_feature (2)..(2): n is either a, c, g or t
  misc_feature (28)..(28): n is either a, c, g or t
  misc_feature (43)..(43): n is either a, c, g or t
  misc_feature (51)..(51): n is either a, c, g or t
  misc_feature (79)..(79): n is either a, c, g or t
  misc_feature (118)..(118): n is either a, c, g or t
cnaaaaatctcctctcccctaacaacgncccccaaaacgaacnaaaacaanaaaataccgaaacgaactaaccaaaaantatacgaaaatcgaatacgcgttatatatatattcgaantatatatacccccacgtacgtacgtacgattatacgattacctataaacgcgtatactcgccgatacgcgatactaccacgaaccgaacgaaataaaaaataataaaaataaaataaaaaataaaaccgacgaaacgaaacgatacgaaaaaaaaactcgaacgctaacaccaaccgctacttacgcttaacgatcgccgaatacaactacccgaacaaaacgcataaaaaaaccgcctccccctacgccccccgaaaccgacgcgacgaaaacgacataacaaaacccaacataaaacaaataaacgaacgccgaacgtaaatacgcgaccgaaaaaaaaaaaaaaactacgaacgttataacccgacgaaataaacgcgccgaacgccg

SEQ ID NO: 10647 - DNA, 509 bp, Artificial Sequence
  chemically treated genomic DNA (Homo sapiens) CpG-island No: 10647
  misc_feature (2)..(2): n is either a, c, g or t
  misc_feature (28)..(28): n is either a, c, g or t
  misc_feature (43)..(43): n is either a, c, g or t
  misc_feature (51)..(51): n is either a, c, g or t
  misc_feature (79)..(79): n is either a, c, g or t
  misc_feature (118)..(118): n is either a, c, g or t
tnaggggtttttttttttttagtagcgntttttaggacgggtnagaatagnggggtgtcggagcgggttagttagggantgtgcgagggtcgggtgcgcgttgtgtgtgtgttcgagntgtgtgtgtttttacgtgcgtgcgtgcgattgtgcggttgtttgtgagcgcgtgtgttcgtcggtgcgcggtgttgttacgggtcgggcggggtgaagggtggtgggggtggaatggggggtggggtcggcggggcggggcggtgcggggagggggttcgagcgttgatattagtcgttatttgcgtttggcggtcgtcgggtgtagttgttcggatagggcgtatggaggggtcgtttttttttgcgtttttcggggtcggcgcggcgaggacggtatagtagggtttagtatggagtaggtgagcgggcgtcgggcgtgggtgcgcggtcgagaggggagagagagttgcgggcgttgtgattcggcgaggtgggcgcgtcgagcgtcg

SEQ ID NO: 10648 - DNA, 509 bp, Artificial Sequence
  chemically treated genomic DNA (Homo sapiens) CpG-island No: 10648
  misc_feature (392)..(392): n is either a, c, g or t
  misc_feature (431)..(431): n is either a, c, g or t
  misc_feature (459)..(459): n is either a, c, g or t
  misc_feature (467)..(467): n is either a, c, g or t
  misc_feature (482)..(482): n is either a, c, g or t
  misc_feature (508)..(508): n is either a, c, g or t
cgacgctcgacgcgcccacctcgccgaatcacaacgcccgcaactctctctcccctctcgaccgcgcacccacgcccgacgcccgctcacctactccatactaaaccctactataccgtcctcgccgcgccgaccccgaaaaacgcaaaaaaaaacgacccctccatacgccctatccgaacaactacacccgacgaccgccaaacgcaaataacgactaatatcaacgctcgaaccccctccccgcaccgccccgccccgccgaccccaccccccattccacccccaccacccttcaccccgcccgacccgtaacaacaccgcgcaccgacgaacacacgcgctcacaaacaaccgcacaatcgcacgcacgcacgtaaaaacacacacanctcgaacacacacacaacgcgcacccgaccctcgcacantccctaactaacccgctccgacaccccnctattctnacccgtcctaaaaancgctactaaaaaaaaaaaaacccctna

SEQ ID NO: 10649 - DNA, 513 bp, Artificial Sequence
  chemically treated genomic DNA (Homo sapiens) CpG-island No: 10649
  misc_feature (342)..(342): n is either a, c, g or t
  misc_feature (432)..(432): n is either a, c, g or t
tgttcgcggtcggtcgttttttcggcgtcgtcgggggattgaggcgttcgggggtttcgggggcgacggcgttaggtagcggtttttgcggtcgtttttgagttttcggcgttgtggttttcgttttagtttattgcgtcgtaaaattttagacgtcgacgttattataataaatttttcgcgtttttcgtcgttttttgcgtttgcggttgacggtcgagatgaaggagatcgttagtatttttcgggcgtacggtttttttttgggggtttacgaattttgtgtgggagataggttaggatgcggggggcgttcggattcggttttttgtcgatttcgtntttattcggtttatttttacgttacggtatttagtcgttataagttttagttaaggttagtatttacggtcgtattataaaacgtttttntttttagtttcgtgtcgtttttcgtttagagattattttcgttggtttaaatttaggtttttagtttttttttgtgaggtg

SEQ ID NO: 10650 - DNA, 513 bp, Artificial Sequence
  chemically treated genomic DNA (Homo sapiens) CpG-island No: 10650
  misc_feature (82)..(82): n is either a, c, g or t
  misc_feature (172)..(172): n is either a, c, g or t
cacctcacaaaaaaaaactaaaaacctaaatttaaaccaacgaaaataatctctaaacgaaaaacgacacgaaactaaaaanaaaaacgttttataatacgaccgtaaatactaaccttaactaaaacttataacgactaaataccgtaacgtaaaaataaaccgaataaanacgaaatcgacaaaaaaccgaatccgaacgccccccgcatcctaacctatctcccacacaaaattcgtaaacccccaaaaaaaaaccgtacgcccgaaaaatactaacgatctccttcatctcgaccgtcaaccgcaaacgcaaaaaacgacgaaaaacgcgaaaaatttattataataacgtcgacgtctaaaattttacgacgcaataaactaaaacgaaaaccacaacgccgaaaactcaaaaacgaccgcaaaaaccgctacctaacgccgtcgcccccgaaacccccgaacgcctcaatcccccgacgacgccgaaaaaacgaccgaccgcgaaca

SEQ ID NO: 10651 - DNA, 513 bp, Artificial Sequence
  chemically treated genomic DNA (Homo sapiens) CpG-island No: 10651
  misc_feature (82)..(82): n is either a, c, g or t
  misc_feature (172)..(172): n is either a, c, g or t
tattttataagaaagagttgagagtttagatttgggttagcgggggtagtttttggacggagggcggtacggggttggaggnaggagcgttttatgatgcggtcgtgggtgttggttttggttggggtttgtggcgattgggtgtcgtgacgtgggggtggatcgggtagangcggggtcggtagggggtcgagttcgggcgtttttcgtattttgatttgttttttatatagggttcgtgggtttttaagaaggagtcgtacgttcgggagatgttggcgattttttttatttcggtcgttaatcgtaagcgtaagaagcggcgggaggcgcggggggtttgttgtagtagcgtcgacgtttggggttttgcggcgtagtaggttggggcgggggttatagcgtcggggatttaggagcggtcgtaggggtcgttgtttggcgtcgtcgttttcgaggttttcggacgttttagtttttcggcggcgtcggaggagcggtcggtcgcggata

SEQ ID NO: 10652 - DNA, 513 bp, Artificial Sequence
  chemically treated genomic DNA (Homo sapiens) CpG-island No: 10652
  misc_feature (342)..(342): n is either a, c, g or t
  misc_feature (432)..(432): n is either a, c, g or t
tatccgcgaccgaccgctcctccgacgccgccgaaaaactaaaacgtccgaaaacctcgaaaacgacgacgccaaacaacgacccctacgaccgctcctaaatccccgacgctataacccccgccccaacctactacgccgcaaaaccccaaacgtcgacgctactacaacaaaccccccgcgcctcccgccgcttcttacgcttacgattaacgaccgaaataaaaaaaatcgccaacatctcccgaacgtacgactccttcttaaaaacccacgaaccctatataaaaaacaaatcaaaatacgaaaaacgcccgaactcgaccccctaccgaccccgcntctacccgatccacccccacgtcacgacacccaatcgccacaaaccccaaccaaaaccaacacccacgaccgcatcataaaacgctcctncctccaaccccgtaccgccctccgtccaaaaactacccccgctaacccaaatctaaactctcaactctttcttataaaata

SEQ ID NO: 10653 - DNA, 579 bp, Artificial Sequence
  chemically treated genomic DNA (Homo sapiens) CpG-island No: 10653
gcggggcgtcgttcgattcgttatgataagtcgatttcgcgcgtttttcgttttttcgcgcgtcggggtcgttttcgtcgaggttggggttgcggcggatttgtaggggtttagcgcgcggcgtagggcgttgattttcgcggcgatatataggtatagtttagcgggtcggtcgttattattattcgttgtagtcgtcgtagataagtcgtcgtcgtcggtgtgcggtcgttagatttcgtcgggcgtcgggttttttttattcgggtaaggcggttttgggggcgtcggtatcggcgcgcgcgttttattgtatttgcgggtttcggttttcgggagaggttttcgggggggttatttcgttttttatattaggaatttgtatattttaatagcgattatttagttcgtttattgaagtttgcggtgcgtcggggtttcgcggtaggcggcgggatttattttgcgatagttttgatttgataggtaattcgggtgagttttgttatcgtcgtttttggattcgaaattgatagtttatatttaggaagcgagagcgaggaagaaagaaatagattt

SEQ ID NO: 10654 - DNA, 579 bp, Artificial Sequence
  chemically treated genomic DNA (Homo sapiens) CpG-island No: 10654
aaatctatttctttcttcctcgctctcgcttcctaaatataaactatcaatttcgaatccaaaaacgacgataacaaaactcacccgaattacctatcaaatcaaaactatcgcaaaataaatcccgccgcctaccgcgaaaccccgacgcaccgcaaacttcaataaacgaactaaataatcgctattaaaatatacaaattcctaatataaaaaacgaaataacccccccgaaaacctctcccgaaaaccgaaacccgcaaatacaataaaacgcgcgcgccgataccgacgcccccaaaaccgccttacccgaataaaaaaaacccgacgcccgacgaaatctaacgaccgcacaccgacgacgacgacttatctacgacgactacaacgaataataataacgaccgacccgctaaactatacctatatatcgccgcgaaaatcaacgccctacgccgcgcgctaaacccctacaaatccgccgcaaccccaacctcgacgaaaacgaccccgacgcgcgaaaaaacgaaaaacgcgcgaaatcgacttatcataacgaatcgaacgacgccccgc

SEQ ID NO: 10655 - DNA, 579 bp, Artificial Sequence
  chemically treated genomic DNA (Homo sapiens) CpG-island No: 10655
aaatttgtttttttttttttcgttttcgttttttggatatagattgttaatttcggatttaaagacggcgatggtagagtttattcgggttgtttgttaaattaaggttatcgtagaataaatttcgtcgtttgtcgcgaagtttcggcgtatcgtaaattttagtgagcgaattgggtgatcgttgttgggatatgtagatttttgatgtaaaaggcggggtggttttttcgagagtttttttcgggggtcggagttcgtaggtgtagtgaggcgcgcgcgtcggtgtcggcgtttttagagtcgttttgttcgggtagagggagttcggcgttcggcggggtttggcggtcgtatatcggcggcggcggtttgtttgcggcggttgtagcggatgatggtggcggtcggttcgttgggttgtgtttgtgtgtcgtcgcggaaattagcgttttgcgtcgcgcgttgagtttttgtaggttcgtcgtagttttagtttcggcgaggacggtttcggcgcgcgggggggcggggggcgcgcggggtcggtttattatggcggatcggacggcgtttcgt

SEQ ID NO: 10656 - DNA, 579 bp, Artificial Sequence
  chemically treated genomic DNA (Homo sapiens) CpG-island No: 10656
acgaaacgccgtccgatccgccataataaaccgaccccgcgcgccccccgcccccccgcgcgccgaaaccgtcctcgccgaaactaaaactacgacgaacctacaaaaactcaacgcgcgacgcaaaacgctaatttccgcgacgacacacaaacacaacccaacgaaccgaccgccaccatcatccgctacaaccgccgcaaacaaaccgccgccgccgatatacgaccgccaaaccccgccgaacgccgaactccctctacccgaacaaaacgactctaaaaacgccgacaccgacgcgcgcgcctcactacacctacgaactccgacccccgaaaaaaactctcgaaaaaaccaccccgccttttacatcaaaaatctacatatcccaacaacgatcacccaattcgctcactaaaatttacgatacgccgaaacttcgcgacaaacgacgaaatttattctacgataaccttaatttaacaaacaacccgaataaactctaccatcgccgtctttaaatccgaaattaacaatctatatccaaaaaacgaaaacgaaaaaaaaaaaaacaaattt

SEQ ID NO: 10657 - DNA, 548 bp, Artificial Sequence
  chemically treated genomic DNA (Homo sapiens) CpG-island No: 10657
gaatttcgggttttgttttgagtttagcgtggagaggggtcgttcgagggattcgggggatagtaattttttatagacgtatacgtttcgggggtcggcgcgttgcgcgagggatgttcgtttttaggattgttcggttcgcgcgtattgtcgttttggcggcgttttgtattttttttattttcgaattagtttcgttcgcggagtattcgcgcgttttttgtttttaatttttgttgttagcggacgttatcggcgcgtttcggatttcgcgcgggcgagcgagcgaaattttttgtttgttttttttttttcgtttttcgtattcggggatggatttcgttattggggcgtcgcgggagataggttttttttttagtcggggtttcgggggcggggttataacgtcgcgttagtgaattttagttgtcggttattaggcgagatttcgtcgtttggaaatagcgacgtttcggaggattggggtcgttttttttttttgtttgtttttgtggttttttttttcgacgtattttgggaagtgtagt

SEQ ID NO: 10658 - DNA, 548 bp, Artificial Sequence
  chemically treated genomic DNA (Homo sapiens) CpG-island No: 10658
actacacttcccaaaatacgtcgaaaaaaaaaaccacaaaaacaaacaaaaaaaaaaaacgaccccaatcctccgaaacgtcgctatttccaaacgacgaaatctcgcctaataaccgacaactaaaattcactaacgcgacgttataaccccgcccccgaaaccccgactaaaaaaaaaacctatctcccgcgacgccccaataacgaaatccatccccgaatacgaaaaacgaaaaaaaaaaaacaaacaaaaaatttcgctcgctcgcccgcgcgaaatccgaaacgcgccgataacgtccgctaacaacaaaaattaaaaacaaaaaacgcgcgaatactccgcgaacgaaactaattcgaaaataaaaaaaatacaaaacgccgccaaaacgacaatacgcgcgaaccgaacaatcctaaaaacgaacatccctcgcgcaacgcgccgacccccgaaacgtatacgtctataaaaaattactatcccccgaatccctcgaacgacccctctccacgctaaactcaaaacaaaacccgaaattc

SEQ ID NO: 10659 - DNA, 548 bp, Artificial Sequence
  chemically treated genomic DNA (Homo sapiens) CpG-island No: 10659
attatattttttaggatgcgtcgggggaagaggttatagggataggtagagggagggggcggttttagtttttcggggcgtcgttgtttttaagcggcgagatttcgtttagtaatcggtagttgaggtttattagcgcggcgttgtggtttcgttttcggagtttcggttggaggaagaatttgtttttcgcggcgttttagtgacgaagtttattttcgggtgcgggaggcggggaggggagggtaggtagaggatttcgttcgttcgttcgcgcgggattcgggacgcgtcggtggcgttcgttggtagtagaggttagaggtagagagcgcgcggatgtttcgcgggcgaggttggttcgagagtgggaggagtgtagggcgtcgttagggcggtagtgcgcgcgggtcgaatagttttgagggcgggtatttttcgcgtagcgcgtcgattttcgggacgtgtgcgtttgtggggggttgttgtttttcgggtttttcgggcgatttttttttacgttgggtttagggtaggattcgggattt

SEQ ID NO: 10660 - DNA, 548 bp, Artificial Sequence
  chemically treated genomic DNA (Homo sapiens) CpG-island No: 10660
aaatcccgaatcctaccctaaacccaacgtaaaaaaaaatcgcccgaaaaacccgaaaaacaacaaccccccacaaacgcacacgtcccgaaaatcgacgcgctacgcgaaaaatacccgccctcaaaactattcgacccgcgcgcactaccgccctaacgacgccctacactcctcccactctcgaaccaacctcgcccgcgaaacatccgcgcgctctctacctctaacctctactaccaacgaacgccaccgacgcgtcccgaatcccgcgcgaacgaacgaacgaaatcctctacctaccctcccctccccgcctcccgcacccgaaaataaacttcgtcactaaaacgccgcgaaaaacaaattcttcctccaaccgaaactccgaaaacgaaaccacaacgccgcgctaataaacctcaactaccgattactaaacgaaatctcgccgcttaaaaacaacgacgccccgaaaaactaaaaccgccccctccctctacctatccctataacctcttcccccgacgcatcctaaaaaatataat

SEQ ID NO: 10661 - DNA, 812 bp, Artificial Sequence
  chemically treated genomic DNA (Homo sapiens) CpG-island No: 10661
atacgttgaggttcgggttgaggcggtcggagtcgcggttggggaagggcggaagtcggagcgggttatagggtgtgttgtatttttgcgggggtcgagttcgtagttttaggcgttttggggttacggttaggtttgggcgagttcgtagtttttagcgttttggggttacggttaggttgggtcggtttttgggtattcggtcgtcgggatattttcgtcgtcgttttatcgggttgtcggggaagtcggggtcgtcgggatcgttaggatcgtcggattgcgaggggtcgtcgatgttggcgtcgttgttgtcgttgttgttgaagaaacgttttcggttttgcggcgggaattattgcgcggtttttcggttcggtcgtcgttgttttttgtcgttcgtagttttatatgtgcggaaaagtcggtttttaggtttcgggagcgagagtcgttatggtcggtattcgttaagaggtttaaacgtaaatatcgcgagattttcgtgcgacgcggacgcgttcgtttgtcgcggggttttagttttcggttttgcgtatgcgtatttcgttagggtcggggtcgggacgggacggaaaattggcggtttggtttgtttagcgcgtcgcggttatggttttcgttttaggtttttacggtgtgtatttggagttaggagcgcgtttgtgcgtatagttcggtttaggtaagcgcggtcgtttcgagaggttaggggagggcggagggtttgaagcgggtaacgagaggttaggagattgttttttttgggttatttttgtcggttagtgtcg

SEQ ID NO: 10662 - DNA, 812 bp, Artificial Sequence
  chemically treated genomic DNA (Homo sapiens) CpG-island No: 10662
cgacactaaccgacaaaaataacccaaaaaaaacaatctcctaacctctcgttacccgcttcaaaccctccgccctcccctaacctctcgaaacgaccgcgcttacctaaaccgaactatacgcacaaacgcgctcctaactccaaatacacaccgtaaaaacctaaaacgaaaaccataaccgcgacgcgctaaacaaaccaaaccgccaattttccgtcccgtcccgaccccgaccctaacgaaatacgcatacgcaaaaccgaaaactaaaaccccgcgacaaacgaacgcgtccgcgtcgcacgaaaatctcgcgatatttacgtttaaacctcttaacgaataccgaccataacgactctcgctcccgaaacctaaaaaccgacttttccgcacatataaaactacgaacgacaaaaaacaacgacgaccgaaccgaaaaaccgcgcaataattcccgccgcaaaaccgaaaacgtttcttcaacaacaacgacaacaacgacgccaacatcgacgacccctcgcaatccgacgatcctaacgatcccgacgaccccgacttccccgacaacccgataaaacgacgacgaaaatatcccgacgaccgaatacccaaaaaccgacccaacctaaccgtaaccccaaaacgctaaaaactacgaactcgcccaaacctaaccgtaaccccaaaacgcctaaaactacgaactcgacccccgcaaaaatacaacacaccctataacccgctccgacttccgcccttccccaaccgcgactccgaccgcctcaacccgaacctcaacgtat

SEQ ID NO: 10663 - DNA, 812 bp, Artificial Sequence
  chemically treated genomic DNA (Homo sapiens) CpG-island No: 10663
cggtattggtcggtaggggtaatttaggaaaaatagttttttggtttttcgttattcgttttaggtttttcgtttttttttggtttttcgggacggtcgcgtttatttgaatcgaattgtacgtataagcgcgtttttgattttaggtgtatatcgtggaggtttgaaacgagagttatgatcgcgacgcgttgaataaattaagtcgttagtttttcgtttcgtttcggtttcggttttggcgaggtgcgtatgcgtagggtcgggagttaggatttcgcggtaggcgggcgcgttcgcgtcgtacggaagtttcgcgatgtttgcgtttgaattttttggcgggtgtcggttatggcggttttcgttttcgggatttgggagtcggttttttcgtatatatggggttgcggacggtaggagatagcggcggtcgggtcgggaagtcgcgtagtggttttcgtcgtaggatcggaggcgtttttttaatagtagcggtagtagcgacgttagtatcggcgatttttcgtagttcgacgattttgacgatttcgacgatttcgattttttcggtagttcggtgaggcggcggcgaaggtgtttcggcggtcgagtgtttaaggatcggtttagtttgatcgtgattttaaagcgttggaagttgcgagttcgtttaagtttaatcgtgattttaagacgtttggggttgcgagttcggttttcgtagaagtgtagtatattttgtggttcgtttcgattttcgtttttttttagtcgcgatttcggtcgttttagttcggattttagcgtgt

SEQ ID NO: 10664 - DNA, 812 bp, Artificial Sequence
  chemically treated genomic DNA (Homo sapiens) CpG-island No: 10664
acacgctaaaatccgaactaaaacgaccgaaatcgcgactaaaaaaaaacgaaaatcgaaacgaaccacaaaatatactacacttctacgaaaaccgaactcgcaaccccaaacgtcttaaaatcacgattaaacttaaacgaactcgcaacttccaacgctttaaaatcacgatcaaactaaaccgatccttaaacactcgaccgccgaaacaccttcgccgccgcctcaccgaactaccgaaaaaatcgaaatcgtcgaaatcgtcaaaatcgtcgaactacgaaaaatcgccgatactaacgtcgctactaccgctactattaaaaaaacgcctccgatcctacgacgaaaaccactacgcgacttcccgacccgaccgccgctatctcctaccgtccgcaaccccatatatacgaaaaaaccgactcccaaatcccgaaaacgaaaaccgccataaccgacacccgccaaaaaattcaaacgcaaacatcgcgaaacttccgtacgacgcgaacgcgcccgcctaccgcgaaatcctaactcccgaccctacgcatacgcacctcgccaaaaccgaaaccgaaacgaaacgaaaaactaacgacttaatttattcaacgcgtcgcgatcataactctcgtttcaaacctccacgatatacacctaaaatcaaaaacgcgcttatacgtacaattcgattcaaataaacgcgaccgtcccgaaaaaccaaaaaaaaacgaaaaacctaaaacgaataacgaaaaaccaaaaaactatttttcctaaattacccctaccgaccaataccg

SEQ ID NO: 10665 - DNA, 1089 bp, Artificial Sequence
  chemically treated genomic DNA (Homo sapiens) CpG-island No: 10665
tagaagatgaagtcgtaaaggtcggtgaggtcgaggatgtcggtcgtggttttcgatagcgttgatatcgaggttcggtaataatttaggacggcggcgttgtttcgtacggtcgtttcgttgatgaacggcggtttttttcgtttggttattatcgcggttatcgtattagttcgggttcggtttttcgttttttcgcggaataacgcggagttgcggagaaaattaagttataagtggcgttcggagttcggtgagttgggtttacgtcgttttttttttttggagttttcgagatttggtattagttttgggtttcggattttttaaagacgtcgaggagattgagggttcgggtcggtcgggaggtggtggcgcgtttgcgtttttcggttacggtggtttagttatttggaatacggcgtcggatatattatttagcgtttttttagacgggtagtggaagaaatgttcgcggcgttattttgttcggaagattgtcgggaggtttcgggttgcgtacgcgtttagatttcgtttcgtttttcgcgtttgcgtcgtgggcgtttcggatacgtttcgttttttgttcgtttttttgcgtacgcgtagggattttcgaaagcggagtggcgtttcggttagtgattggttggaggtttgttaattatttatgagggggcgggtcgagcggggcggtttttgttaagtagcgagggcgcgatcgcgggtattttgttgtcggtttttcggagcggcgttgggcgattagagtagggtcgagatgttttatatttcgggttagtcggttatcgtcgtggtggtgagtgcgtttgcgcgggttttttttcgttttggtttgattttatttcgtagagcgggaaacggatattttaagtaggttgatagagtatcgaattcggggtttttgcgaatcggcggtaagggttcgggttttcgttttgtcggagcgggtcgtagtttttttagttacgaaatagggatggtcgggattcgagagtttttcgagattttggatagagtttagattgcgtgcgtagggcggggagggttacggggaaaggtttg

SEQ ID NO: 10666 - DNA, 1089 bp, Artificial Sequence
  chemically treated genomic DNA (Homo sapiens) CpG-island No: 10666
caaacctttccccgtaaccctccccgccctacgcacgcaatctaaactctatccaaaatctcgaaaaactctcgaatcccgaccatccctatttcgtaactaaaaaaactacgacccgctccgacaaaacgaaaacccgaacccttaccgccgattcgcaaaaaccccgaattcgatactctatcaacctacttaaaatatccgtttcccgctctacgaaataaaatcaaaccaaaacgaaaaaaaacccgcgcaaacgcactcaccaccacgacgataaccgactaacccgaaatataaaacatctcgaccctactctaatcgcccaacgccgctccgaaaaaccgacaacaaaatacccgcgatcgcgccctcgctacttaacaaaaaccgccccgctcgacccgccccctcataaataattaacaaacctccaaccaatcactaaccgaaacgccactccgctttcgaaaatccctacgcgtacgcaaaaaaacgaacaaaaaacgaaacgtatccgaaacgcccacgacgcaaacgcgaaaaacgaaacgaaatctaaacgcgtacgcaacccgaaacctcccgacaatcttccgaacaaaataacgccgcgaacatttcttccactacccgtctaaaaaaacgctaaataatatatccgacgccgtattccaaataactaaaccaccgtaaccgaaaaacgcaaacgcgccaccacctcccgaccgacccgaaccctcaatctcctcgacgtctttaaaaaatccgaaacccaaaactaataccaaatctcgaaaactccaaaaaaaaaaaacgacgtaaacccaactcaccgaactccgaacgccacttataacttaattttctccgcaactccgcgttattccgcgaaaaaacgaaaaaccgaacccgaactaatacgataaccgcgataataaccaaacgaaaaaaaccgccgttcatcaacgaaacgaccgtacgaaacaacgccgccgtcctaaattattaccgaacctcgatatcaacgctatcgaaaaccacgaccgacatcctcgacctcaccgacctttacgacttcatcttcta

SEQ ID NO: 10667 - DNA, 1089 bp, Artificial Sequence
  chemically treated genomic DNA (Homo sapiens) CpG-island No: 10667
taggttttttttcgtggtttttttcgttttgcgtacgtagtttgggttttgtttagggtttcgggaggttttcgggtttcggttatttttgtttcgtggttgggggaattgcggttcgtttcggtaaagcggggattcgagtttttgtcgtcggttcgtaggagtttcgggttcgatgttttgttaatttgtttggggtgttcgtttttcgttttgcgaggtggggttaggttaagacgaggaggagttcgcgtaagcgtatttattattacggcggtgatcggttggttcgggatgtaggatatttcgattttgttttggtcgtttagcgtcgtttcgagaagtcggtagtagagtattcgcggtcgcgttttcgttgtttaataaaggtcgtttcgttcggttcgtttttttatgaatagttaataaatttttagttaattattggtcggagcgttatttcgttttcggaagtttttgcgcgtgcgtagaaaagcgggtagagggcggagcgtgttcggggcgtttacggcgtaggcgcggagggcggggcgggatttgggcgcgtgcgtagttcgagatttttcggtagtttttcgagtaagatggcgtcgcgggtattttttttattgttcgtttgagggaacgttaagtagtgtgttcggcgtcgtgttttaggtaattgggttatcgtggtcggggaacgtagacgcgttattatttttcggtcggttcggatttttaattttttcggcgtttttggaagattcgaggtttaggattggtgttaggtttcggaagttttagggggagggggcggcgtgaatttaatttatcgagtttcgggcgttatttgtaatttggtttttttcgtagtttcgcgttgtttcgcgagaaagcgagaggtcgagttcgggttggtgcgatggtcgcggtggtggttaagcgggaagggtcgtcgtttattagcgaggcggtcgtgcggggtaacgtcgtcgttttggattattgtcggatttcggtgttagcgttgtcgggggttacggtcggtattttcggttttatcggtttttacggttttatttttta

SEQ ID NO: 10668 - DNA, 1089 bp, Artificial Sequence
  chemically treated genomic DNA (Homo sapiens) CpG-island No: 10668
taaaaaataaaaccgtaaaaaccgataaaaccgaaaataccgaccgtaacccccgacaacgctaacaccgaaatccgacaataatccaaaacgacgacgttaccccgcacgaccgcctcgctaataaacgacgacccttcccgcttaaccaccaccgcgaccatcgcaccaacccgaactcgacctctcgctttctcgcgaaacaacgcgaaactacgaaaaaaaccaaattacaaataacgcccgaaactcgataaattaaattcacgccgccccctccccctaaaacttccgaaacctaacaccaatcctaaacctcgaatcttccaaaaacgccgaaaaaattaaaaatccgaaccgaccgaaaaataataacgcgtctacgttccccgaccacgataacccaattacctaaaacacgacgccgaacacactacttaacgttccctcaaacgaacaataaaaaaaatacccgcgacgccatcttactcgaaaaactaccgaaaaatctcgaactacgcacgcgcccaaatcccgccccgccctccgcgcctacgccgtaaacgccccgaacacgctccgccctctacccgcttttctacgcacgcgcaaaaacttccgaaaacgaaataacgctccgaccaataattaactaaaaatttattaactattcataaaaaaacgaaccgaacgaaacgacctttattaaacaacgaaaacgcgaccgcgaatactctactaccgacttctcgaaacgacgctaaacgaccaaaacaaaatcgaaatatcctacatcccgaaccaaccgatcaccgccgtaataataaatacgcttacgcgaactcctcctcgtcttaacctaaccccacctcgcaaaacgaaaaacgaacaccccaaacaaattaacaaaacatcgaacccgaaactcctacgaaccgacgacaaaaactcgaatccccgctttaccgaaacgaaccgcaattcccccaaccacgaaacaaaaataaccgaaacccgaaaacctcccgaaaccctaaacaaaacccaaactacgtacgcaaaacgaaaaaaaccacgaaaaaaaaccta

SEQ ID NO: 10669 - DNA, 1071 bp, Artificial Sequence
  chemically treated genomic DNA (Homo sapiens) CpG-island No: 10669
gtcgggtcgaggttcgcgcgtacgtgtaggaggcgttcgggtttcgttttttttttcgaagttttcgtttttttttttttcgttgttgtggattagtatggtggcgttcgatagggattttttatggtcgtattttaagtttttcgtttttttcggtttttttcgttgtgttttttcggtgaaaacgttgggttgggagtttatcgagacggttcgcggcgttatttttgtcgtcgacgcggatagggtgcgttttttgagtcgtaggttttttaggtcgtggttgagttcggttatttcgatgttgtttcgtttgtgtagttgcgcgtggcgcgcggcggtgaggggttcgttgattttttgtagcgagtgcgttacgggtaggttgtttttttggaacgtttgtatcgagtggtgtacgcgtcgcgtgatgaggtcggggttgttgttgttgatgtaaaggtggcgggataggtttggcgtgttgttggcgggtttggggggcgggtagggtgggggtggtcggtatatttgcgttcgtatgatgttgggagacgggtagttttgcgtttgtagttgcgtattggttagtttcggtacgttgatcgcgtttattacgggtcgtcgttcggtagggtaggggtagggagacgggttgtggaagttgtagtttaggttgaacgggtagtgtgcggtcgttggcgaggggagttgtgcgtgttcgcggatttcgggttggttgtagattagcgtcgcgggtttgttgtaggcgtacgagttgtcgatgttgaggtttcgtagcgagtggttttgtcgtttcgtatgtattaggtttttgttgagttgttttattatagttttatagtttggggtggggcggtaggacgggggtattacggcgttgtgtcgatgggacgggaggtagttaggttttatgacgttattttcggtgatgttagggttggacgatatcggcgagggttgtaagtagggttgaggattatttaaggagttggtgttgtgtgtattgtagatattgttattacggattcgatcgttgaggttaatttg

SEQ ID NO: 10670 - DNA, 1071 bp, Artificial Sequence
  chemically treated genomic DNA (Homo sapiens) CpG-island No: 10670
caaattaacctcaacgatcgaatccgtaataacaatatctacaatacacacaacaccaactccttaaataatcctcaaccctacttacaaccctcgccgatatcgtccaaccctaacatcaccgaaaataacgtcataaaacctaactacctcccgtcccatcgacacaacgccgtaatacccccgtcctaccgccccaccccaaactataaaactataataaaacaactcaacaaaaacctaatacatacgaaacgacaaaaccactcgctacgaaacctcaacatcgacaactcgtacgcctacaacaaacccgcgacgctaatctacaaccaacccgaaatccgcgaacacgcacaactcccctcgccaacgaccgcacactacccgttcaacctaaactacaacttccacaacccgtctccctacccctaccctaccgaacgacgacccgtaataaacgcgatcaacgtaccgaaactaaccaatacgcaactacaaacgcaaaactacccgtctcccaacatcatacgaacgcaaatataccgaccacccccaccctacccgccccccaaacccgccaacaacacgccaaacctatcccgccacctttacatcaacaacaacaaccccgacctcatcacgcgacgcgtacaccactcgatacaaacgttccaaaaaaacaacctacccgtaacgcactcgctacaaaaaatcaacgaacccctcaccgccgcgcgccacgcgcaactacacaaacgaaacaacatcgaaataaccgaactcaaccacgacctaaaaaacctacgactcaaaaaacgcaccctatccgcgtcgacgacaaaaataacgccgcgaaccgtctcgataaactcccaacccaacgttttcaccgaaaaaacacaacgaaaaaaaccgaaaaaaacgaaaaacttaaaatacgaccataaaaaatccctatcgaacgccaccatactaatccacaacaacgaaaaaaaaaaaaacgaaaacttcgaaaaaaaaaacgaaacccgaacgcctcctacacgtacgcgcgaacctcgacccgac

SEQ ID NO: 10671 - DNA, 1071 bp, Artificial Sequence
  chemically treated genomic DNA (Homo sapiens) CpG-island No: 10671
tagattgattttaacggtcggattcgtaatggtagtgtttatagtgtatatagtattaattttttaaataatttttagttttatttgtagttttcgtcgatgtcgtttaattttagtattatcgggagtgacgttatgaggtttgattatttttcgttttatcggtatagcgtcgtgatattttcgttttatcgttttattttagattatgagattgtgatgaagtagtttaataggggtttggtgtatgcggaacggtagagttattcgttgcgaaattttaatatcggtagttcgtacgtttatagtaggttcgcggcgttggtttatagttagttcgagattcgcgagtacgtatagtttttttcgttagcggtcgtatattgttcgtttagtttgagttatagtttttatagttcgtttttttatttttattttgtcgagcggcggttcgtggtgggcgcggttagcgtgtcggagttgattaatgcgtagttgtaggcgtaggattattcgttttttaatattatgcggacgtaggtgtatcggttatttttattttattcgttttttaggttcgttaatagtacgttagatttgtttcgttatttttatattagtagtagtaatttcgattttattacgcggcgcgtgtattattcggtgtaaacgttttaggaggatagtttgttcgtggcgtattcgttgtaggaggttagcgagttttttatcgtcgcgcgttacgcgtagttgtataaacggaatagtatcgaggtggtcgggtttagttacggtttggagggtttgcggtttaaggagcgtattttattcgcgtcggcggtagaggtggcgtcgcgagtcgtttcggtgggtttttagtttagcgtttttatcgagaggatatagcgagaagggtcggaggaggcggagggtttgaggtacggttataagaagtttttgtcggacgttattatgttaatttatagtagcgaggaggaggaggacgaggatttcgaggaggagagcggggttcgggcgttttttgtacgtgcgcgcgagtttcggttcggt

SEQ ID NO: 10672 - DNA, 1071 bp, Artificial Sequence
  chemically treated genomic DNA (Homo sapiens) CpG-island No: 10672
accgaaccgaaactcgcgcgcacgtacaaaaaacgcccgaaccccgctctcctcctcgaaatcctcgtcctcctcctcctcgctactataaattaacataataacgtccgacaaaaacttcttataaccgtacctcaaaccctccgcctcctccgacccttctcgctatatcctctcgataaaaacgctaaactaaaaacccaccgaaacgactcgcgacgccacctctaccgccgacgcgaataaaatacgctccttaaaccgcaaaccctccaaaccgtaactaaacccgaccacctcgatactattccgtttatacaactacgcgtaacgcgcgacgataaaaaactcgctaacctcctacaacgaatacgccacgaacaaactatcctcctaaaacgtttacaccgaataatacacgcgccgcgtaataaaatcgaaattactactactaatataaaaataacgaaacaaatctaacgtactattaacgaacctaaaaaacgaataaaataaaaataaccgatacacctacgtccgcataatattaaaaaacgaataatcctacgcctacaactacgcattaatcaactccgacacgctaaccgcgcccaccacgaaccgccgctcgacaaaataaaaataaaaaaacgaactataaaaactataactcaaactaaacgaacaatatacgaccgctaacgaaaaaaactatacgtactcgcgaatctcgaactaactataaaccaacgccgcgaacctactataaacgtacgaactaccgatattaaaatttcgcaacgaataactctaccgttccgcatacaccaaacccctattaaactacttcatcacaatctcataatctaaaataaaacgataaaacgaaaatatcacgacgctataccgataaaacgaaaaataatcaaacctcataacgtcactcccgataatactaaaattaaacgacatcgacgaaaactacaaataaaactaaaaattatttaaaaaattaatactatatacactataaacactaccattacgaatccgaccgttaaaatcaatcta

SEQ ID NO: 10673 - DNA, 702 bp, Artificial Sequence
  chemically treated genomic DNA (Homo sapiens) CpG-island No: 10673
gtttcgcggcgtttatttttcgtagcggatttaaagcggcgtcgtgcgtcgcggtggtggttttagtcgggtttgcgtttgtttttttatttttcggcggttattttagtcgtagttacgtttcgaggtcgtaaatgtttttagggtcgaggcggtttggacgaggaggagtcgtagttcgttaggagcgtttagcggaggttaggtcgcggcgtttattcgggtttatagttttcgttatttttgataatcgttcgttcgtcgagatttggttttttattttcgatcggtacgggttttattcggattttgcggttgatttcggtgtcgatttttatggttttgcggcgtgcgggaatttagtattgcgcggcgtttggtttattcggaggttgtcgcggatttttatttcgtagtcgggatattatcgttttttttttcgtttcgttttcgggtcgcgtatacggcgtattttcgtttcggtcggtattgcgcgtcggagtgaacgcgtatgcgttcgtgttcgcgtttgcgtacgttttttattcgcgaaatttgtgtttaggtaaggagggcggcggcgtgcgcgtgcgggtggttttgtagtttcgtttttcgggtatttcggggatttttcgttagtttttttgttggtttttcgtttatttattttatttttttttggatggtaagaatgaatta

SEQ ID NO: 10674 - DNA, 702 bp, Artificial Sequence
  chemically treated genomic DNA (Homo sapiens) CpG-island No: 10674
taattcattcttaccatccaaaaaaaaataaaataaataaacgaaaaaccaacaaaaaaactaacgaaaaatccccgaaatacccgaaaaacgaaactacaaaaccacccgcacgcgcacgccgccgccctccttacctaaacacaaatttcgcgaataaaaaacgtacgcaaacgcgaacacgaacgcatacgcgttcactccgacgcgcaataccgaccgaaacgaaaatacgccgtatacgcgacccgaaaacgaaacgaaaaaaaaaacgataatatcccgactacgaaataaaaatccgcgacaacctccgaataaaccaaacgccgcgcaatactaaattcccgcacgccgcaaaaccataaaaatcgacaccgaaatcaaccgcaaaatccgaataaaacccgtaccgatcgaaaataaaaaaccaaatctcgacgaacgaacgattatcaaaaataacgaaaactataaacccgaataaacgccgcgacctaacctccgctaaacgctcctaacgaactacgactcctcctcgtccaaaccgcctcgaccctaaaaacatttacgacctcgaaacgtaactacgactaaaataaccgccgaaaaataaaaaaacaaacgcaaacccgactaaaaccaccaccgcgacgcacgacgccgctttaaatccgctacgaaaaataaacgccgcgaaac

SEQ ID NO: 10675 - DNA, 702 bp, Artificial Sequence
  chemically treated genomic DNA (Homo sapiens) CpG-island No: 10675
taatttatttttattatttaagagagaataaaatgaataagcggagggttagtagagagattaacgaaaggttttcgaggtgttcgggaggcggagttgtaagattattcgtacgcgtacgtcgtcgttttttttgtttgagtataggtttcgcgggtagaaggcgtgcgtaggcgcggatacgggcgtatgcgcgtttatttcggcgcgtagtgtcggtcggggcggggatacgtcgtgtgcgcggttcgggggcggaacggaggaggaggcggtggtgtttcggttgcggggtaggagttcgcggtagttttcgggtaagttaagcgtcgcgtagtgttgagttttcgtacgtcgtagagttatggagatcggtatcgagattagtcgtaagattcgggtgaggttcgtgtcggtcgggggtgggaagttaggtttcggcgagcgggcggttgttaggagtaacggggattgtgggttcgggtggacgtcgcggtttggttttcgttggacgtttttggcgggttgcggttttttttcgtttaggtcgtttcggttttggggatatttgcggtttcggagcgtggttgcggttgaagtagtcgtcgggaaatggaaggataggcgtaggttcggttggagttattatcgcggcgtacggcgtcgttttggattcgttgcgggaggtgggcgtcgcggggt

SEQ ID NO: 10676 - DNA, 702 bp, Artificial Sequence
  chemically treated genomic DNA (Homo sapiens) CpG-island No: 10676
accccgcgacgcccacctcccgcaacgaatccaaaacgacgccgtacgccgcgataataactccaaccgaacctacgcctatccttccatttcccgacgactacttcaaccgcaaccacgctccgaaaccgcaaatatccccaaaaccgaaacgacctaaacgaaaaaaaaccgcaacccgccaaaaacgtccaacgaaaaccaaaccgcgacgtccacccgaacccacaatccccgttactcctaacaaccgcccgctcgccgaaacctaacttcccacccccgaccgacacgaacctcacccgaatcttacgactaatctcgataccgatctccataactctacgacgtacgaaaactcaacactacgcgacgcttaacttacccgaaaactaccgcgaactcctaccccgcaaccgaaacaccaccgcctcctcctccgttccgcccccgaaccgcgcacacgacgtatccccgccccgaccgacactacgcgccgaaataaacgcgcatacgcccgtatccgcgcctacgcacgccttctacccgcgaaacctatactcaaacaaaaaaaacgacgacgtacgcgtacgaataatcttacaactccgcctcccgaacacctcgaaaacctttcgttaatctctctactaaccctccgcttattcattttattctctcttaaataataaaaataaatta

SEQ ID NO: 10677 - DNA, 688 bp, Artificial Sequence
  chemically treated genomic DNA (Homo sapiens) CpG-island No: 10677
gttgttcgcgtttttttcgcgcggttgttcgtattttaattttttgaggttacgggtcgtcgtcgttttttcggattcgttcgttcggtttagggggagggacgtttgggttcggtcgtttcgttgtttcggtcgcgcgtttcgcgtcggttcgacggtttgttcgtttttttgttatttttcgtttttacggggtttttttgtgcggcgtttttcgtcggtcggttttatttttaggtttcgtttttcgtcgtcgttatcgtcggattttgtttaggggaatggtttgcgagtcgggtttttggagataggaagtgaggcgtgcgagttttatgagcgcgtcgcggttcgggttggcgtgcgggtgcggttgcggcggtcgcgcggcggggtttcgggaggcgggtcgttgaacggggcgcgcggtttttaagatgcgggagcgggagcgggagtaggtgaagggcgcgttttcggtcggcgggaggggcgggcggttggttttagcgggggggtgtgtttatttattcggatttcggagcgcgttcgcgggtttcggaaattcgtgaaaatggggtttcggcggtttagattttttagcgggagttcgaattaaagagaaaaagtgttcggttttttagggtcggtttttttttaattcggagttatttgttaaaagggagttttg

SEQ ID NO: 10678 - DNA, 688 bp, Artificial Sequence
  chemically treated genomic DNA (Homo sapiens) CpG-island No: 10678
caaaactcccttttaacaaataactccgaattaaaaaaaaaccgaccctaaaaaaccgaacactttttctctttaattcgaactcccgctaaaaaatctaaaccgccgaaaccccattttcacgaatttccgaaacccgcgaacgcgctccgaaatccgaataaataaacacacccccccgctaaaaccaaccgcccgcccctcccgccgaccgaaaacgcgcccttcacctactcccgctcccgctcccgcatcttaaaaaccgcgcgccccgttcaacgacccgcctcccgaaaccccgccgcgcgaccgccgcaaccgcacccgcacgccaacccgaaccgcgacgcgctcataaaactcgcacgcctcacttcctatctccaaaaacccgactcgcaaaccattcccctaaacaaaatccgacgataacgacgacgaaaaacgaaacctaaaaataaaaccgaccgacgaaaaacgccgcacaaaaaaaccccgtaaaaacgaaaaataacaaaaaaacgaacaaaccgtcgaaccgacgcgaaacgcgcgaccgaaacaacgaaacgaccgaacccaaacgtccctccccctaaaccgaacgaacgaatccgaaaaaacgacgacgacccgtaacctcaaaaaattaaaatacgaacaaccgcgcgaaaaaaacgcgaacaac

SEQ ID NO: 10679 - DNA, 688 bp, Artificial Sequence
  chemically treated genomic DNA (Homo sapiens) CpG-island No: 10679
tagaatttttttttggtaagtgatttcgggttaaggagaagtcgattttggaaaatcgagtattttttttttttggttcgggttttcgttaaggagtttgggtcgtcggggttttatttttacgggttttcggggttcgcgggcgcgtttcggggttcgggtgagtggatatattttttcgttggggttagtcgttcgtttttttcgtcgatcggggacgcgttttttatttgttttcgttttcgttttcgtattttgggggtcgcgcgtttcgtttagcgattcgtttttcggggtttcgtcgcgcggtcgtcgtagtcgtattcgtacgttagttcgggtcgcggcgcgtttatggggttcgtacgttttattttttgtttttaaaaattcggttcgtagattatttttttgggtagagttcggcggtggcgacggcgaggggcgaggtttggaggtgggatcggtcggcgaggagcgtcgtataaagaagtttcgtgggggcggggggtggtaggaggacggatagatcgtcggatcgacgcgggacgcgcggtcggagtagcggggcggtcgggtttaggcgtttttttttttgagtcgggcgggcggattcggggaggcggcggcggttcgtgattttagagagttggaatgcgggtagtcgcgcgggggaggcgcggatagt

SEQ ID NO: 10680 - DNA, 688 bp, Artificial Sequence
  chemically treated genomic DNA (Homo sapiens) CpG-island No: 10680
actatccgcgcctcccccgcgcgactacccgcattccaactctctaaaatcacgaaccgccgccgcctccccgaatccgcccgcccgactcaaaaaaaaaaacgcctaaacccgaccgccccgctactccgaccgcgcgtcccgcgtcgatccgacgatctatccgtcctcctaccaccccccgcccccacgaaacttctttatacgacgctcctcgccgaccgatcccacctccaaacctcgcccctcgccgtcgccaccgccgaactctacccaaaaaaataatctacgaaccgaatttttaaaaacaaaaaataaaacgtacgaaccccataaacgcgccgcgacccgaactaacgtacgaatacgactacgacgaccgcgcgacgaaaccccgaaaaacgaatcgctaaacgaaacgcgcgacccccaaaatacgaaaacgaaaacgaaaacaaataaaaaacgcgtccccgatcgacgaaaaaaacgaacgactaaccccaacgaaaaaatatatccactcacccgaaccccgaaacgcgcccgcgaaccccgaaaacccgtaaaaataaaaccccgacgacccaaactccttaacgaaaacccgaaccaaaaaaaaaaaatactcgattttccaaaatcgacttctccttaacccgaaatcacttaccaaaaaaaaattcta

SEQ ID NO: 10681 - DNA, 564 bp, Artificial Sequence
  chemically treated genomic DNA (Homo sapiens) CpG-island No: 10681
cgttacgtttttagtatttggatcgcgtttttcggttcgttacgcgcgtatatatatatatacgcgtatatatatacgtttatatttattttgcgcgtagatttcgttcgcggtttcgtttcggtttttgcgggcgttttttttggcgttttcgggcggcgggaggttgcggtttcgggtagatttgattttttcgtagttcgggcgtttcggagtcgaagttcgagtcgaggaggtggcgttcgtagtcgcgttttagtttcgtcgtcgtcggcgttaagatttagggagaggcggcgtagttcgggcgttcgggtttcgcgttgtcggcgtttcgttattttcgtcgttagcgttttattcggcgtttttcgttttttacgtttttttttttgttttttgtattttttttatttttgtttatagacgcgcgttttttttttggtgtttttttttacgatttcgcgtttttttttcggtgtttttttttcgagttttttttttcgcgtttttttttgtttttttcgttgtgttttcgttttttgggttttttgttttttttta

SEQ ID NO: 10682 - DNA, 564 bp, Artificial Sequence
  chemically treated genomic DNA (Homo sapiens) CpG-island No: 10682
taaaaaaaaacaaaaaacccaaaaaacgaaaacacaacgaaaaaaacaaaaaaaaacgcgaaaaaaaaaactcgaaaaaaaaacaccgaaaaaaaaacgcgaaatcgtaaaaaaaaacaccaaaaaaaaaacgcgcgtctataaacaaaaataaaaaaaatacaaaaaacaaaaaaaaaaacgtaaaaaacgaaaaacgccgaataaaacgctaacgacgaaaataacgaaacgccgacaacgcgaaacccgaacgcccgaactacgccgcctctccctaaatcttaacgccgacgacgacgaaactaaaacgcgactacgaacgccacctcctcgactcgaacttcgactccgaaacgcccgaactacgaaaaaatcaaatctacccgaaaccgcaacctcccgccgcccgaaaacgccaaaaaaaacgcccgcaaaaaccgaaacgaaaccgcgaacgaaatctacgcgcaaaataaatataaacgtatatatatacgcgtatatatatatatacgcgcgtaacgaaccgaaaaacgcgatccaaatactaaaaacgtaacg

SEQ ID NO: 10683 - DNA, 564 bp, Artificial Sequence
  chemically treated genomic DNA (Homo sapiens) CpG-island No: 10683
tggggaagggtaaggagtttagggagcgggggtatagcggggaaggtagagaggggcgcggggagaggggttcggggagagggtatcgggagggaaacgcggagtcgtggagaggggtattaggagagggacgcgcgtttgtgggtagaggtagaggggatgtagaagatagggagaggggcgtgaggagcgggaggcgtcggatggggcgttggcggcgggggtggcggggcgtcggtagcgcggagttcgagcgttcgggttgcgtcgtttttttttgggttttggcgtcggcggcgacggggttgagacgcggttgcgagcgttattttttcggttcgggtttcggtttcggggcgttcgggttgcgggaaaattaaatttgttcgaagtcgtagtttttcgtcgttcgggaacgttagagggggcgttcgtaggggtcggggcggggtcgcgggcggggtttgcgcgtagggtgagtgtgagcgtgtgtgtgtgcgcgtgtgtgtgtgtgtgcgcgcgtggcgggtcgggggacgcggtttagatgttggggacgtggcg

SEQ ID NO: 10684 - DNA, 564 bp, Artificial Sequence
  chemically treated genomic DNA (Homo sapiens) CpG-island No: 10684
cgccacgtccccaacatctaaaccgcgtcccccgacccgccacgcgcgcacacacacacacacgcgcacacacacacgctcacactcaccctacgcgcaaaccccgcccgcgaccccgccccgacccctacgaacgccccctctaacgttcccgaacgacgaaaaactacgacttcgaacaaatttaattttcccgcaacccgaacgccccgaaaccgaaacccgaaccgaaaaaataacgctcgcaaccgcgtctcaaccccgtcgccgccgacgccaaaacccaaaaaaaaacgacgcaacccgaacgctcgaactccgcgctaccgacgccccgccacccccgccgccaacgccccatccgacgcctcccgctcctcacgcccctctccctatcttctacatcccctctacctctacccacaaacgcgcgtccctctcctaatacccctctccacgactccgcgtttccctcccgataccctctccccgaacccctctccccgcgcccctctctaccttccccgctatacccccgctccctaaactccttacccttcccca

SEQ ID NO: 10685 - DNA, 1085 bp, Artificial Sequence
  chemically treated genomic DNA (Homo sapiens) CpG-island No: 10685
ggtcggtcgggggtttagtttgtacgatttttttcggttttcgcggttttgttgggaggtttcgatttttattcgggtttggttatttcgttttcgttcgcggttagaggtttgagtcgaggtttagcggtcgggacgggtttggatatcgtaggggttttttcgcggggtcgtcgtaaattttttttttagttttcgtggaggggtagcgttcgtttttcgttatttcggagttgtcgcggggttcggcgggttcggtcggggggcgggggaggtcgcggcgttggatttcgggtcgcggttttagtttcgtcgtacgggggtgcggttttttcgcgtcggcgtcgcgatcgcgttcggatatacgcggacgtttgggtcggagtcgtagggatacgcgggtcgcggatacgcgcgtcgtagtttttacgcgcgtcgtagttttcgcgtatattttttgtttgtcgttttacgagagggtcgtcgtcggaggtcgtttcgcgtttatttacgggtcgttcggtttcggattttagttcggttcggttttcgtttatcgtttcgcgtcgcggggaaagttgcgtttcgatttattcgtcgtttcggggcgcgtttcgtcgtcggttatcgtcgcgtttagtcgttcgcgtcgtcgtcgtcgttcgtttcgtcgcggggtcgtcgaagtcgcgtaggtcgtttaggtcgaggtcgtcgtcgcgttcgggtttcgttgcgtggtcgcgtagtcgatgtttagtatgaatggggcgtcgagcgtcgcgcggttgcggatcggtttcgttttcgtcgttcgcggagtttcgcgtcgcgcgtatgcgtcgtttagagttcgggggcggggcgggggcggggtcggcggcggtttttagagggcgttttgtttcgcgtcgcgcgtttgtaggggtttatcgcgcgtttttaaagggcgatacggttgttcgttttaattttttgggcgtcggggtcgcgcgggtagtttcgggagtttttcgttttcgagcgggttagttcgcgattttaggaatagggtttggtttagtgtgtttaggttaggagtatgg

SEQ ID NO: 10686 - DNA, 1085 bp, Artificial Sequence
  chemically treated genomic DNA (Homo sapiens) CpG-island No: 10686
ccatactcctaacctaaacacactaaaccaaaccctattcctaaaatcgcgaactaacccgctcgaaaacgaaaaactcccgaaactacccgcgcgaccccgacgcccaaaaaattaaaacgaacaaccgtatcgccctttaaaaacgcgcgataaacccctacaaacgcgcgacgcgaaacaaaacgccctctaaaaaccgccgccgaccccgcccccgccccgcccccgaactctaaacgacgcatacgcgcgacgcgaaactccgcgaacgacgaaaacgaaaccgatccgcaaccgcgcgacgctcgacgccccattcatactaaacatcgactacgcgaccacgcaacgaaacccgaacgcgacgacgacctcgacctaaacgacctacgcgacttcgacgaccccgcgacgaaacgaacgacgacgacgacgcgaacgactaaacgcgacgataaccgacgacgaaacgcgccccgaaacgacgaataaatcgaaacgcaactttccccgcgacgcgaaacgataaacgaaaaccgaaccgaactaaaatccgaaaccgaacgacccgtaaataaacgcgaaacgacctccgacgacgaccctctcgtaaaacgacaaacaaaaaatatacgcgaaaactacgacgcgcgtaaaaactacgacgcgcgtatccgcgacccgcgtatccctacgactccgacccaaacgtccgcgtatatccgaacgcgatcgcgacgccgacgcgaaaaaaccgcacccccgtacgacgaaactaaaaccgcgacccgaaatccaacgccgcgacctcccccgccccccgaccgaacccgccgaaccccgcgacaactccgaaataacgaaaaacgaacgctacccctccacgaaaactaaaaaaaaaatttacgacgaccccgcgaaaaaacccctacgatatccaaacccgtcccgaccgctaaacctcgactcaaacctctaaccgcgaacgaaaacgaaataaccaaacccgaataaaaatcgaaacctcccaacaaaaccgcgaaaaccgaaaaaaatcgtacaaactaaacccccgaccgacc

SEQ ID NO: 10687 - DNA, 1085 bp, Artificial Sequence
  chemically treated genomic DNA (Homo sapiens) CpG-island No: 10687
ttatgtttttagtttgggtatattgagttaggttttgtttttggggtcgcgggttagttcgttcgagagcggggggttttcggaattgttcgcgcggtttcggcgtttagagagttgaggcgggtagtcgtatcgttttttgaagacgcgcggtgggtttttgtaggcgcgcggcgcggggtagagcgttttttggaggtcgtcgtcggtttcgttttcgtttcgttttcgggttttgggcggcgtatgcgcgcggcgcggggtttcgcgggcggcgagagcgaggtcggttcgtagtcgcgcggcgttcggcgttttatttatgttgggtatcggttgcgcggttacgtagcggagttcgggcgcggcggcggtttcggtttgggcggtttacgcggtttcggcggtttcgcggcggggcggacggcggcggcggcgcgggcggttgggcgcggcgatggtcggcggcggggcgcgtttcggggcggcgggtgagtcggggcgtaatttttttcgcggcgcgggacggtgggcgggggtcgggtcgggttggggttcggggtcgggcggttcgtgggtgggcgcggggcggttttcggcggcggttttttcgtgaggcggtaggtagggggtgtgcgcggggattgcggcgcgcgtggggattgcggcgcgcgtgttcgcggttcgcgtgtttttgcggtttcggtttaggcgttcgcgtgtgttcgggcgcggtcgcggcgtcgacgcggagagatcgtattttcgtgcggcggggttgggatcgcggttcgggatttagcgtcgcggtttttttcgtttttcggtcgggttcgtcgagtttcgcggtagtttcggggtggcggggggcgggcgttgtttttttacggaggttggggagaaagtttgcggcggtttcgcggggaggtttttgcggtgtttaggttcgtttcggtcgttggatttcggtttagatttttggtcgcgggcgaggacggggtggttaggttcggatagggatcggagttttttagtagggtcgcgggggtcggaggaggtcgtgtaggttaagttttcggtcggtt

SEQ ID NO: 10688 - DNA, 1085 bp, Artificial Sequence
  chemically treated genomic DNA (Homo sapiens) CpG-island No: 10688
aaccgaccgaaaacttaacctacacgacctcctccgacccccgcgaccctactaaaaaactccgatccctatccgaacctaaccaccccgtcctcgcccgcgaccaaaaatctaaaccgaaatccaacgaccgaaacgaacctaaacaccgcaaaaacctccccgcgaaaccgccgcaaactttctccccaacctccgtaaaaaaacaacgcccgccccccgccaccccgaaactaccgcgaaactcgacgaacccgaccgaaaaacgaaaaaaaccgcgacgctaaatcccgaaccgcgatcccaaccccgccgcacgaaaatacgatctctccgcgtcgacgccgcgaccgcgcccgaacacacgcgaacgcctaaaccgaaaccgcaaaaacacgcgaaccgcgaacacgcgcgccgcaatccccacgcgcgccgcaatccccgcgcacaccccctacctaccgcctcacgaaaaaaccgccgccgaaaaccgccccgcgcccacccacgaaccgcccgaccccgaaccccaacccgacccgacccccgcccaccgtcccgcgccgcgaaaaaaattacgccccgactcacccgccgccccgaaacgcgccccgccgccgaccatcgccgcgcccaaccgcccgcgccgccgccgccgtccgccccgccgcgaaaccgccgaaaccgcgtaaaccgcccaaaccgaaaccgccgccgcgcccgaactccgctacgtaaccgcgcaaccgatacccaacataaataaaacgccgaacgccgcgcgactacgaaccgacctcgctctcgccgcccgcgaaaccccgcgccgcgcgcatacgccgcccaaaacccgaaaacgaaacgaaaacgaaaccgacgacgacctccaaaaaacgctctaccccgcgccgcgcgcctacaaaaacccaccgcgcgtcttcaaaaaacgatacgactacccgcctcaactctctaaacgccgaaaccgcgcgaacaattccgaaaaccccccgctctcgaacgaactaacccgcgaccccaaaaacaaaacctaactcaatatacccaaactaaaaacataa

SEQ ID NO: 10689 - DNA, 587 bp, Artificial Sequence
  chemically treated genomic DNA (Homo sapiens) CpG-island No: 10689
  misc_feature (184)..(184): n is either a, c, g or t
  misc_feature (204)..(204): n is either a, c, g or t
  misc_feature (221)..(221): n is either a, c, g or t
ggcgttggagggtgcggcgggtttgggagtagggaaggtttcgagttttagggaggcggtagcgttcggttatgttttttggagattggcggggttgcggggtcgaggggattcgcgagggagtcgcgttgcggacgcgttgagcgcgggagttcgaggggttttaggtagcggtgcgggcgtngaagtttaggggttggaggntatttgggcgtatagtngcggggcgttgagtcgggcgagacgcggggttttcggtttcgggcgcggcgtttaagcgggcgcgcggggcgtggtgtatttttgaagcggcgtaggttggcgcgggaaagcggtagggcggggcggcgcggttattggttacgcgttgggagtagggtcgcgtttcgtgtttttttttcgatagtttttattcgttttattttttttaagtagagtaatttcgcggatagcggagttcgtttagtatggatgttttaggtaattattttcgatttgttttttttttcgtatgtaagcgttttttgcgtggattttaacgaagattttttttggtttagatcgaggggtggaggaggtggagagag

SEQ ID NO: 10690 - DNA, 587 bp, Artificial Sequence
  chemically treated genomic DNA (Homo sapiens) CpG-island No: 10690
  misc_feature (367)..(367): n is either a, c, g or t
  misc_feature (384)..(384): n is either a, c, g or t
  misc_feature (404)..(404): n is either a, c, g or t
ctctctccacctcctccacccctcgatctaaaccaaaaaaaatcttcgttaaaatccacgcaaaaaacgcttacatacgaaaaaaaaaacaaatcgaaaataattacctaaaacatccatactaaacgaactccgctatccgcgaaattactctacttaaaaaaaataaaacgaataaaaactatcgaaaaaaaaacacgaaacgcgaccctactcccaacgcgtaaccaataaccgcgccgccccgccctaccgctttcccgcgccaacctacgccgcttcaaaaatacaccacgccccgcgcgcccgcttaaacgccgcgcccgaaaccgaaaaccccgcgtctcgcccgactcaacgccccgcnactatacgcccaaatancctccaacccctaaacttcnacgcccgcaccgctacctaaaacccctcgaactcccgcgctcaacgcgtccgcaacgcgactccctcgcgaatcccctcgaccccgcaaccccgccaatctccaaaaaacataaccgaacgctaccgcctccctaaaactcgaaaccttccctactcccaaacccgccgcaccctccaacgcc

SEQ ID NO: 10691 - DNA, 587 bp, Artificial Sequence
  chemically treated genomic DNA (Homo sapiens) CpG-island No: 10691
  misc_feature (367)..(367): n is either a, c, g or t
  misc_feature (384)..(384): n is either a, c, g or t
  misc_feature (404)..(404): n is either a, c, g or t
ttttttttattttttttatttttcgatttggattagggagagttttcgttaaaatttacgtagaaggcgtttgtatgcggaggggagggtaggtcgggggtggttatttggaatatttatgttgggcgagtttcgttgttcgcgaagttgttttgtttagagaaaatgaggcgagtgggagttgtcgggaggaggatacggagcgcgattttgtttttagcgcgtggttaataatcgcgtcgtttcgttttgtcgttttttcgcgttagtttgcgtcgttttaggggtgtattacgtttcgcgcgttcgtttaggcgtcgcgttcgggatcgggaatttcgcgtttcgttcggtttagcgtttcgtngttgtgcgtttaggtgntttttaatttttgggttttngcgttcgtatcgttgtttggggtttttcgagttttcgcgtttagcgcgttcgtagcgcggttttttcgcgggttttttcggtttcgtagtttcgttagtttttagagggtatagtcgagcgttgtcgtttttttaggattcggaattttttttgtttttaagttcgtcgtattttttaacgtt

SEQ ID NO: 10692 - DNA, 587 bp, Artificial Sequence
  chemically treated genomic DNA (Homo sapiens) CpG-island No: 10692
  misc_feature (184)..(184): n is either a, c, g or t
  misc_feature (204)..(204): n is either a, c, g or t
  misc_feature (221)..(221): n is either a, c, g or t
aacgttaaaaaatacgacgaacttaaaaacaaaaaaaattccgaatcctaaaaaaacgacaacgctcgactataccctctaaaaactaacgaaactacgaaaccgaaaaaacccgcgaaaaaaccgcgctacgaacgcgctaaacgcgaaaactcgaaaaaccccaaacaacgatacgaacgcnaaaacccaaaaattaaaaancacctaaacgcacaacnacgaaacgctaaaccgaacgaaacgcgaaattcccgatcccgaacgcgacgcctaaacgaacgcgcgaaacgtaatacacccctaaaacgacgcaaactaacgcgaaaaaacgacaaaacgaaacgacgcgattattaaccacgcgctaaaaacaaaatcgcgctccgtatcctcctcccgacaactcccactcgcctcattttctctaaacaaaacaacttcgcgaacaacgaaactcgcccaacataaatattccaaataaccacccccgacctaccctcccctccgcatacaaacgccttctacgtaaattttaacgaaaactctccctaatccaaatcgaaaaataaaaaaaataaaaaaaa

SEQ ID NO: 10693 - DNA, 586 bp, Artificial Sequence
  chemically treated genomic DNA (Homo sapiens) CpG-island No: 10693
  misc_feature (10)..(11): n is either a, c, g or t
  misc_feature (87)..(87): n is either a, c, g or t
  misc_feature (172)..(172): n is either a, c, g or t
  misc_feature (185)..(185): n is either a, c, g or t
  misc_feature (216)..(216): n is either a, c, g or t
  misc_feature (559)..(559): n is either a, c, g or t
  misc_feature (575)..(575): n is either a, c, g or t
ggggacgaannggttttcggaggttgttgcgagtttcgcgcgttttttcgcgttttttcgcgtcgttcgcgtcggcgtcggtttttnattttcgcgcgtcgttttttattagtttcgatgtaggcgttcggtcgggggttattcgggttgcggttgatgatgttcgggcgtncggggggcgttgncgcgagtcgggcggttgcggattttgtttgnggggtggcgttggttttgttgttgttgttattgttcgtttgttgtttcgtgcgggcgtagaacgatacggagtttatcgtgttggagggtaagtgtttggtggtgtgcgattttagttcgtcggcggacggcgtcgttattttttttttaggtattttcgtgcgtttcggtagcgttaaggtggtttttttcgttacgcggagtattaattacgagtcgttcgagatgagtaatcgtattatgattatttatttcgattaggttagtcgtcggtttgtttatttcgtttttagttcggggagaggggcggggatttgcgcgcgcgggttggggtttaggtttntttggacgtggagttntttaggttttg

SEQ ID NO: 10694 - DNA, 586 bp, Artificial Sequence
  chemically treated genomic DNA (Homo sapiens) CpG-island No: 10694
  misc_feature (12)..(12): n is either a, c, g or t
  misc_feature (28)..(28): n is either a, c, g or t
  misc_feature (371)..(371): n is either a, c, g or t
  misc_feature (402)..(402): n is either a, c, g or t
  misc_feature (415)..(415): n is either a, c, g or t
  misc_feature (500)..(500): n is either a, c, g or t
  misc_feature (576)..(577): n is either a, c, g or t
caaaacctaaanaactccacgtccaaanaaacctaaaccccaacccgcgcgcgcaaatccccgcccctctccccgaactaaaaacgaaataaacaaaccgacgactaacctaatcgaaataaataatcataatacgattactcatctcgaacgactcgtaattaatactccgcgtaacgaaaaaaaccaccttaacgctaccgaaacgcacgaaaatacctaaaaaaaaaataacgacgccgtccgccgacgaactaaaatcgcacaccaccaaacacttaccctccaacacgataaactccgtatcgttctacgcccgcacgaaacaacaaacgaacaataacaacaacaacaaaaccaacgccaccccncaaacaaaatccgcaaccgcccgactcgcgncaacgccccccgnacgcccgaacatcatcaaccgcaacccgaataacccccgaccgaacgcctacatcgaaactaataaaaaacgacgcgcgaaaatnaaaaaccgacgccgacgcgaacgacgcgaaaaaacgcgaaaaaacgcgcgaaactcgcaacaacctccgaaaaccnnttcgtcccc

SEQ ID NO: 10695 - DNA, 586 bp, Artificial Sequence
  chemically treated genomic DNA (Homo sapiens) CpG-island No: 10695
  misc_feature (12)..(12): n is either a, c, g or t
  misc_feature (28)..(28): n is either a, c, g or t
  misc_feature (371)..(371): n is either a, c, g or t
  misc_feature (402)..(402): n is either a, c, g or t
  misc_feature (415)..(415): n is either a, c, g or t
  misc_feature (500)..(500): n is either a, c, g or t
  misc_feature (576)..(577): n is either a, c, g or t
tagagtttgggnaattttacgtttaagnaagtttgaattttagttcgcgcgcgtaggttttcgttttttttttcgggttgggggcggggtgggtaggtcgacggttgatttggtcgaaatagatggttatggtgcggttgtttatttcggacggttcgtggttggtgtttcgcgtggcggagaaggttattttggcgttgtcggagcgtacggagatgtttagggaggaggtgacggcgtcgttcgtcgacgggttggagtcgtatattattaggtatttgttttttagtacgatgggtttcgtgtcgttttgcgttcgtacggggtagtaggcgggtagtagtagtaatagtagggttagcgttattttntaggtaggattcgtagtcgttcggttcgcgntagcgtttttcgngcgttcgggtattattagtcgtagttcgagtggttttcggtcgggcgtttgtatcgggattggtgggaggcggcgcgcgggggtnggaggtcggcgtcggcgcgagcggcgcggaagggcgcgaaggaacgcgcggagttcgtagtagttttcgggggttnnttcgttttt

SEQ ID NO: 10696 - DNA, 586 bp, Artificial Sequence
  chemically treated genomic DNA (Homo sapiens) CpG-island No: 10696
  misc_feature (10)..(11): n is either a, c, g or t
  misc_feature (87)..(87): n is either a, c, g or t
  misc_feature (172)..(172): n is either a, c, g or t
  misc_feature (185)..(185): n is either a, c, g or t
  misc_feature (216)..(216): n is either a, c, g or t
  misc_feature (559)..(559): n is either a, c, g or t
  misc_feature (575)..(575): n is either a, c, g or t
aaaaacgaannaacccccgaaaactactacgaactccgcgcgttccttcgcgcccttccgcgccgctcgcgccgacgccgacctccnacccccgcgcgccgcctcccaccaatcccgatacaaacgcccgaccgaaaaccactcgaactacgactaataatacccgaacgcncgaaaaacgctancgcgaaccgaacgactacgaatcctacctanaaaataacgctaaccctactattactactactacccgcctactaccccgtacgaacgcaaaacgacacgaaacccatcgtactaaaaaacaaatacctaataatatacgactccaacccgtcgacgaacgacgccgtcacctcctccctaaacatctccgtacgctccgacaacgccaaaataaccttctccgccacgcgaaacaccaaccacgaaccgtccgaaataaacaaccgcaccataaccatctatttcgaccaaatcaaccgtcgacctacccaccccgcccccaacccgaaaaaaaaaacgaaaacctacgcgcgcgaactaaaattcaaacttncttaaacgtaaaattncccaaactcta

SEQ ID NO: 10697 - DNA, 1003 bp, Artificial Sequence
  chemically treated genomic DNA (Homo sapiens) CpG-island No: 10697
tcggagagtttaattgtcgcgtttcgtcgtagtttttgtttgcgcggtcgattgtaataggatgttggggttttaggcgttcgtttcgagttttgggcgacgagaaagagttaatgaggagcgagggtaaaatcgggtgtagtaaattcgaaaagggggcgaggaggttcgcgaagagagcgggggaggaggcggggaggggcgaggaggggcggggagggtcgagcgaggaggaggcggttttgggggtcgggcggcgcgtttgatagaggaggggaagtttgggggcgtaagcgtcgtagtcgaggggtcggcgcggggaggcgggcgttaggcgggggtttgtagggtcgtcgcgcgtgacgtagcgtcgggtagggcgttattagttgtcgggtcgcggcgagggacgcgcggcgatagcggacggcgttgttcgggtcgggatagtagtagtcggcggtcgcgcgtaggattcgagggtttttagttatcgttttcgttagcgtcgcgtttcgttatagggcggtatgagtttattcgcggtcgtagttttagcgttttgttttttcgtttgggcggttcggttgcggtgacggttttcgttgttcgattgggggttatgaagtcgagttcggtcgggacggcgaaggagttggagttttcggcgtcggttcgaggcgagtagcgtacggcggagttcgaggggcgttggcgggagaagggcgaggtagatatcgagcggtagcgtattcgggagcggtaggaggttacgttggtcgggttggcggagttggagtatttgcgttagcgttaagagttgttggttaggggcgttttgcgcggcgtcgggggtgcgggagtcgttgcgtttcgcgttggggagttattgggggaggcggcgtagcgtagtcgtttggaggagaagtttttggaggagaatattttgttgttaagaaagtaattggtaggtcgtgttcgaagggtggagtatcggttggtt

SEQ ID NO: 10698 - DNA, 1003 bp, Artificial Sequence
  chemically treated genomic DNA (Homo sapiens) CpG-island No: 10698
aaccaaccgatactccacccttcgaacacgacctaccaattactttcttaacaacaaaatattctcctccaaaaacttctcctccaaacgactacgctacgccgcctcccccaataactccccaacgcgaaacgcaacgactcccgcacccccgacgccgcgcaaaacgcccctaaccaacaactcttaacgctaacgcaaatactccaactccgccaacccgaccaacgtaacctcctaccgctcccgaatacgctaccgctcgatatctacctcgcccttctcccgccaacgcccctcgaactccgccgtacgctactcgcctcgaaccgacgccgaaaactccaactccttcgccgtcccgaccgaactcgacttcataacccccaatcgaacaacgaaaaccgtcaccgcaaccgaaccgcccaaacgaaaaaacaaaacgctaaaactacgaccgcgaataaactcataccgccctataacgaaacgcgacgctaacgaaaacgataactaaaaaccctcgaatcctacgcgcgaccgccgactactactatcccgacccgaacaacgccgtccgctatcgccgcgcgtccctcgccgcgacccgacaactaataacgccctacccgacgctacgtcacgcgcgacgaccctacaaacccccgcctaacgcccgcctccccgcgccgacccctcgactacgacgcttacgcccccaaacttcccctcctctatcaaacgcgccgcccgacccccaaaaccgcctcctcctcgctcgaccctccccgcccctcctcgcccctccccgcctcctcccccgctctcttcgcgaacctcctcgcccccttttcgaatttactacacccgattttaccctcgctcctcattaactctttctcgtcgcccaaaactcgaaacgaacgcctaaaaccccaacatcctattacaatcgaccgcgcaaacaaaaactacgacgaaacgcgacaattaaactctccga

SEQ ID NO: 10699 - DNA, 1003 bp, Artificial Sequence
  chemically treated genomic DNA (Homo sapiens) CpG-island No: 10699
gattagtcggtgttttatttttcgggtacgatttattaattgtttttttagtagtaagatgtttttttttaagaattttttttttaggcgattgcgttgcgtcgttttttttagtagttttttagcgcggggcgtagcggttttcgtattttcggcgtcgcgtagggcgtttttgattagtagtttttggcgttggcgtaggtattttagtttcgttagttcggttagcgtggttttttgtcgttttcgggtgcgttgtcgttcggtgtttgtttcgtttttttttcgttagcgtttttcgggtttcgtcgtgcgttgttcgtttcgggtcggcgtcggaggttttagttttttcgtcgtttcggtcggattcggttttatggtttttagtcgggtagcgagagtcgttatcgtagtcgggtcgtttaggcggaggagtagggcgttagggttgcggtcgcgggtgggtttatgtcgttttgtggcggggcgcggcgttggcggggacggtggttagaagttttcgagttttgcgcgcgatcgtcggttgttgttgtttcggttcgggtagcgtcgttcgttgtcgtcgcgcgtttttcgtcgcggttcggtagttgataacgttttgttcggcgttacgttacgcgcggcggttttgtaaattttcgtttggcgttcgttttttcgcgtcggtttttcggttgcgacgtttgcgtttttaggtttttttttttttgttaggcgcgtcgttcggtttttagagtcgtttttttttcgttcggtttttttcgttttttttcgttttttttcgttttttttttcgtttttttcgcgggttttttcgtttttttttcgggtttattgtattcgattttgttttcgttttttattggttttttttcgtcgtttaaagttcggggcgagcgtttggagttttagtattttgttatagtcggtcgcgtaggtaggggttgcgacgggacgcggtagttgggtttttcgg

SEQ ID NO: 10700 - DNA, 1003 bp, Artificial Sequence
  chemically treated genomic DNA (Homo sapiens) CpG-island No: 10700
ccgaaaaacccaactaccgcgtcccgtcgcaacccctacctacgcgaccgactataacaaaatactaaaactccaaacgctcgccccgaactttaaacgacgaaaaaaaaccaataaaaaacgaaaacaaaatcgaatacaataaacccgaaaaaaaaacgaaaaaacccgcgaaaaaaacgaaaaaaaaaacgaaaaaaaacgaaaaaaaacgaaaaaaaccgaacgaaaaaaaaacgactctaaaaaccgaacgacgcgcctaacaaaaaaaaaaaaacctaaaaacgcaaacgtcgcaaccgaaaaaccgacgcgaaaaaacgaacgccaaacgaaaatttacaaaaccgccgcgcgtaacgtaacgccgaacaaaacgttatcaactaccgaaccgcgacgaaaaacgcgcgacgacaacgaacgacgctacccgaaccgaaacaacaacaaccgacgatcgcgcgcaaaactcgaaaacttctaaccaccgtccccgccaacgccgcgccccgccacaaaacgacataaacccacccgcgaccgcaaccctaacgccctactcctccgcctaaacgacccgactacgataacgactctcgctacccgactaaaaaccataaaaccgaatccgaccgaaacgacgaaaaaactaaaacctccgacgccgacccgaaacgaacaacgcacgacgaaacccgaaaaacgctaacgaaaaaaaaacgaaacaaacaccgaacgacaacgcacccgaaaacgacaaaaaaccacgctaaccgaactaacgaaactaaaatacctacgccaacgccaaaaactactaatcaaaaacgccctacgcgacgccgaaaatacgaaaaccgctacgccccgcgctaaaaaactactaaaaaaaacgacgcaacgcaatcgcctaaaaaaaaaattcttaaaaaaaaacatcttactactaaaaaaacaattaataaatcgtacccgaaaaataaaacaccgactaatc

SEQ ID NO: 10701 - DNA, 764 bp, Artificial Sequence
  chemically treated genomic DNA (Homo sapiens) CpG-island No: 10701
ggtcgcgtcggtttattgtatggttattaggtcgcgaaggtattgcgttacgttacgcgaggggttgagacgacgtagtagtcgtcggcggtggtttcgtattagggtatacgcgtttaggtttttggtcgtttcgaaggcgcggaagcggatttatatgtcgcggcggggtttttagttgcgttcgaagtagtttacgaaggcggttgggtcgtgggcgtggagttcggttagcgtttcgtcgtaggttgcgggcgacgacgcgttagttaggcggtataggcgcgattataggttcgggttttcgcggtcggcgtcgtttagtttttgcgttttgttgaagagcgtttttaggttttgcgcgcggtagatttgtacgcgcgcgtagggtagtagttggcgtattgtaggtaattgcgtcgttatttcgggttcggcggtgaggtagcgtacgcggtttttgacgtttggcgcgttttgtagtagcgacgcgagcgcgaagcgtagtaggttcggtgtgttcgggcgcgttacgtagtaggtagtttggcgcgtacggttcgagtcgtttacgtatagtacggttagtagatttagcgcgttttgtagtttcggtagtcggtttattagtagtatgcgagggaagcgtcgtagtagcgttttggtgcgcgacgttaggaagaatatcgtttttattatagtttggttttttacgaatattagttttatttgcgggcgggggtagggaggtaaggaaagaggtt

SEQ ID NO: 10702 - DNA, 764 bp, Artificial Sequence
  chemically treated genomic DNA (Homo sapiens) CpG-island No: 10702
aacctctttccttacctccctacccccgcccgcaaataaaactaatattcgtaaaaaaccaaactataataaaaacgatattcttcctaacgtcgcgcaccaaaacgctactacgacgcttccctcgcatactactaataaaccgactaccgaaactacaaaacgcgctaaatctactaaccgtactatacgtaaacgactcgaaccgtacgcgccaaactacctactacgtaacgcgcccgaacacaccgaacctactacgcttcgcgctcgcgtcgctactacaaaacgcgccaaacgtcaaaaaccgcgtacgctacctcaccgccgaacccgaaataacgacgcaattacctacaatacgccaactactaccctacgcgcgcgtacaaatctaccgcgcgcaaaacctaaaaacgctcttcaacaaaacgcaaaaactaaacgacgccgaccgcgaaaacccgaacctataatcgcgcctataccgcctaactaacgcgtcgtcgcccgcaacctacgacgaaacgctaaccgaactccacgcccacgacccaaccgccttcgtaaactacttcgaacgcaactaaaaaccccgccgcgacatataaatccgcttccgcgccttcgaaacgaccaaaaacctaaacgcgtataccctaatacgaaaccaccgccgacgactactacgtcgtctcaacccctcgcgtaacgtaacgcaataccttcgcgacctaataaccatacaataaaccgacgcgacc

SEQ ID NO: 10703 - DNA, 764 bp, Artificial Sequence
  chemically treated genomic DNA (Homo sapiens) CpG-island No: 10703
gatttttttttttgtttttttgttttcgttcgtaggtgaagttggtgttcgtggaggattaggttgtggtggagacggtgttttttttgacgtcgcgtattagggcgttgttgcggcgtttttttcgtatgttgttggtggatcggttgtcggggttgtagggcgcgttggatttgttggtcgtgttgtgcgtggacggttcgggtcgtgcgcgttaggttgtttgttgcgtggcgcgttcgggtatatcgagtttgttgcgtttcgcgttcgcgtcgttgttgtagagcgcgttagacgttaagggtcgcgtgcgttgttttatcgtcgggttcgaggtggcggcgtagttgtttgtagtgcgttagttgttgttttgcgcgcgcgtgtagatttgtcgcgcgtagggtttggagacgttttttagtaaggcgtaggagttgggcggcgtcggtcgcgaggattcgggtttgtggtcgcgtttgtgtcgtttggttggcgcgtcgtcgttcgtagtttacgacgaggcgttggtcgagttttacgtttacggtttagtcgttttcgtggattatttcgagcgtaattgggagtttcgtcgcgatatgtgggttcgttttcgcgttttcgaggcggttagagatttggacgcgtgtgttttggtgcgaggttatcgtcggcgattgttgcgtcgttttagtttttcgcgtggcgtggcgtagtgttttcgcgatttggtggttatgtagtgggtcgacgcggtt

SEQ ID NO: 10704 - DNA, 764 bp, Artificial Sequence
  chemically treated genomic DNA (Homo sapiens) CpG-island No: 10704
aaccgcgtcgacccactacataaccaccaaatcgcgaaaacactacgccacgccacgcgaaaaactaaaacgacgcaacaatcgccgacgataacctcgcaccaaaacacacgcgtccaaatctctaaccgcctcgaaaacgcgaaaacgaacccacatatcgcgacgaaactcccaattacgctcgaaataatccacgaaaacgactaaaccgtaaacgtaaaactcgaccaacgcctcgtcgtaaactacgaacgacgacgcgccaaccaaacgacacaaacgcgaccacaaacccgaatcctcgcgaccgacgccgcccaactcctacgccttactaaaaaacgtctccaaaccctacgcgcgacaaatctacacgcgcgcgcaaaacaacaactaacgcactacaaacaactacgccgccacctcgaacccgacgataaaacaacgcacgcgacccttaacgtctaacgcgctctacaacaacgacgcgaacgcgaaacgcaacaaactcgatatacccgaacgcgccacgcaacaaacaacctaacgcgcacgacccgaaccgtccacgcacaacacgaccaacaaatccaacgcgccctacaaccccgacaaccgatccaccaacaacatacgaaaaaaacgccgcaacaacgccctaatacgcgacgtcaaaaaaaacaccgtctccaccacaacctaatcctccacgaacaccaacttcacctacgaacgaaaacaaaaaaacaaaaaaaaaaatc

SEQ ID NO: 10705 - DNA, 537 bp, Artificial Sequence
  chemically treated genomic DNA (Homo sapiens) CpG-island No: 10705
tttcggttttttgttagggagttatcgcggtcgtagagggtcgaaaggtgttcgtacgtatttgttttttcgttttttttcgaggagtttttgaggatttgtgttttttagaagtggggaaagttcgtttaaggcgtcggtgttgacggtggcgggattgtcgggttcgttgtggaatcgtttttcgttagagttgcgggttgatgacggttttcgcgggggcgggaagcggtttaggttgttttcgtcggtttgcggcggcgagtttggaagcgcggtttattcgtgcgcgggttattcggggttgtgtttcgcgcgattgtgtgtgtaggaaataagtaggaaatattttaaaatagaatgaagtgttatgttgagggtcgcggacgtcgcgagtgttgtgggaatgtgggttaaggtggagagttatggtggcgcgtgttataggtttaggggttaggaagaagtttaatcgtggaggcggtatttgaggagggttttgaacgttgggtaggtttttgttcgatagagatggag

SEQ ID NO: 10706 - DNA, 537 bp, Artificial Sequence
  chemically treated genomic DNA (Homo sapiens) CpG-island No: 10706
ctccatctctatcgaacaaaaacctacccaacgttcaaaaccctcctcaaataccgcctccacgattaaacttcttcctaacccctaaacctataacacgcgccaccataactctccaccttaacccacattcccacaacactcgcgacgtccgcgaccctcaacataacacttcattctattttaaaatatttcctacttatttcctacacacacaatcgcgcgaaacacaaccccgaataacccgcgcacgaataaaccgcgcttccaaactcgccgccgcaaaccgacgaaaacaacctaaaccgcttcccgcccccgcgaaaaccgtcatcaacccgcaactctaacgaaaaacgattccacaacgaacccgacaatcccgccaccgtcaacaccgacgccttaaacgaactttccccacttctaaaaaacacaaatcctcaaaaactcctcgaaaaaaaacgaaaaaacaaatacgtacgaacacctttcgaccctctacgaccgcgataactccctaacaaaaaaccgaaa

SEQ ID NO: 10707 - DNA, 537 bp, Artificial Sequence
  chemically treated genomic DNA (Homo sapiens) CpG-island No: 10707
ttttatttttatcgagtaaaagtttgtttagcgtttaagattttttttagatgtcgtttttacgattaggtttttttttgatttttgagtttgtaatacgcgttattataattttttattttagtttatatttttatagtattcgcgacgttcgcggtttttaatatggtattttattttattttagggtattttttgtttgttttttgtatatatagtcgcgcgaggtatagtttcgagtgattcgcgtacgagtggatcgcgtttttagattcgtcgtcgtaggtcggcgagggtagtttaagtcgtttttcgttttcgcggggatcgttattagttcgtagttttagcgggaggcggttttatagcgagttcggtagtttcgttatcgttagtatcggcgttttgggcgagttttttttatttttgggaggtataaatttttaggggtttttcgagaggaaacgagggagtagatgcgtgcggatatttttcggttttttgcggtcgcggtagttttttggtagaaaatcggaa

SEQ ID NO: 10708 - DNA, 537 bp, Artificial Sequence
  chemically treated genomic DNA (Homo sapiens) CpG-island No: 10708
ttccgattttctaccaaaaaactaccgcgaccgcaaaaaaccgaaaaatatccgcacgcatctactccctcgtttcctctcgaaaaacccctaaaaatttatacctcccaaaaataaaaaaaactcgcccaaaacgccgatactaacgataacgaaactaccgaactcgctataaaaccgcctcccgctaaaactacgaactaataacgatccccgcgaaaacgaaaaacgacttaaactaccctcgccgacctacgacgacgaatctaaaaacgcgatccactcgtacgcgaatcactcgaaactatacctcgcgcgactatatatacaaaaaacaaacaaaaaataccctaaaataaaataaaataccatattaaaaaccgcgaacgtcgcgaatactataaaaatataaactaaaataaaaaattataataacgcgtattacaaactcaaaaatcaaaaaaaaacctaatcgtaaaaacgacatctaaaaaaaatcttaaacgctaaacaaacttttactcgataaaaataaaa

SEQ ID NO: 10709 - DNA, 660 bp, Artificial Sequence
  chemically treated genomic DNA (Homo sapiens) CpG-island No: 10709
ggagggtgtatttttaggaggcggcgggtgttttcgtcggttttagcgttcgggcggagggtagggaggggagcggcgttgcgaggaatggtgtttatttcgggtcggagtttttcgtttttcgtcggagaggaggaggcggtagcggcggcggtatggagtcgggggagggcggcggtggtagcgttcggtttgtttgttttcgcggcggtagtagtagtagtcgtcgtcgtcgtcgtcgttgtatgaatttttgtattacggttgtttttcgcgtgtagcgtatttagcggcgggcgagcgggcggtttaagaggtaggcggaggtagtagcggcggcggcggcgatcggagttttcgtcggtttcgtttcgtagtcggattatatcgatatttttcggttcggttgtttcggttcggggggcgttaggaggttgtggttcggggtggagagttttaacggttggagtagtataggacgtgtttcgcggaggaaattggttgtacgttatgagttttgtttttattcggttgtcgttcgggtggggggggggtaatgtgtaagggtgggggtgtttaaagggtcgttagcgtcggggtggggtttcgtacgtggggttgaggcggggcggggttttggtaggtggtgttttggggtgg

SEQ ID NO: 10710 - DNA, 660 bp, Artificial Sequence
  chemically treated genomic DNA (Homo sapiens) CpG-island No: 10710
ccaccccaaaacaccacctaccaaaaccccgccccgcctcaaccccacgtacgaaaccccaccccgacgctaacgaccctttaaacacccccacccttacacattaccccccccccacccgaacgacaaccgaataaaaacaaaactcataacgtacaaccaatttcctccgcgaaacacgtcctatactactccaaccgttaaaactctccaccccgaaccacaacctcctaacgccccccgaaccgaaacaaccgaaccgaaaaatatcgatataatccgactacgaaacgaaaccgacgaaaactccgatcgccgccgccgccgctactacctccgcctacctcttaaaccgcccgctcgcccgccgctaaatacgctacacgcgaaaaacaaccgtaatacaaaaattcatacaacgacgacgacgacgacgactactactactaccgccgcgaaaacaaacaaaccgaacgctaccaccgccgccctcccccgactccataccgccgccgctaccgcctcctcctctccgacgaaaaacgaaaaactccgacccgaaataaacaccattcctcgcaacgccgctcccctccctaccctccgcccgaacgctaaaaccgacgaaaacacccgccgcctcctaaaaatacaccctcc

SEQ ID NO: 10711 - DNA, 660 bp, Artificial Sequence
  chemically treated genomic DNA (Homo sapiens) CpG-island No: 10711
ttattttagggtattatttattagggtttcgtttcgttttagttttacgtgcggggttttatttcggcgttagcggttttttaaatatttttatttttatatattattttttttttattcggacggtagtcgaatagggataaaatttatggcgtatagttagtttttttcgcggagtacgttttgtgttgttttagtcgttggggttttttatttcgggttatagttttttggcgtttttcgggtcgaggtagtcgggtcgaggagtgtcggtgtggttcggttacggggcggggtcggcgggagtttcggtcgtcgtcgtcgtcgttgttgttttcgtttgttttttgggtcgttcgttcgttcgtcgttgggtgcgttgtacgcggggggtagtcgtggtgtagaggtttatgtagcggcggcggcggcggcggttgttgttgttgtcgtcgcggaggtagatagatcgggcgttgttatcgtcgttttttttcggttttatgtcgtcgtcgttgtcgttttttttttttcggcgaggggcggggggtttcggttcggggtgggtattatttttcgtagcgtcgtttttttttttgtttttcgttcgggcgttggagtcggcgagggtattcgtcgttttttaggagtgtatttttt

SEQ ID NO: 10712 - DNA, 660 bp, Artificial Sequence
  chemically treated genomic DNA (Homo sapiens) CpG-island No: 10712
aaaaaatacactcctaaaaaacgacgaataccctcgccgactccaacgcccgaacgaaaaacaaaaaaaaaaacgacgctacgaaaaataatacccaccccgaaccgaaaccccccgcccctcgccgaaaaaaaaaaaacgacaacgacgacgacataaaaccgaaaaaaaacgacgataacaacgcccgatctatctacctccgcgacgacaacaacaacaaccgccgccgccgccgccgctacataaacctctacaccacgactaccccccgcgtacaacgcacccaacgacgaacgaacgaacgacccaaaaaacaaacgaaaacaacaacgacgacgacgacgaccgaaactcccgccgaccccgccccgtaaccgaaccacaccgacactcctcgacccgactacctcgacccgaaaaacgccaaaaaactataacccgaaataaaaaaccccaacgactaaaacaacacaaaacgtactccgcgaaaaaaactaactatacgccataaattttatccctattcgactaccgtccgaataaaaaaaaaataatatataaaaataaaaatatttaaaaaaccgctaacgccgaaataaaaccccgcacgtaaaactaaaacgaaacgaaaccctaataaataataccctaaaataa

SEQ ID NO: 10713 - DNA, 562 bp, Artificial Sequence
  chemically treated genomic DNA (Homo sapiens) CpG-island No: 10713
ttcgtttttttgtttggttttcgtttttttcgtcgtcgggtcggttttttcgttcgagtcgtcgtataagcggaatttgtattattttttttattcgttgtttgtaggtttcgcgttgttgcgtttggtcgttttttatttggggttttttttcgtgtggttttgttagcgtttttttcgcgtttttatggtagttaagaggagtttcggggtcgcgttagtatttgtttcggtttcggttcggcgtcggtgtcggcggcgaggtcgagcgcgttcgagttttttataaataggttttcgagtatatttttattgttttgcgtatcgatgaggatgagaaaggtaattagggggttgggggagggggcggcggcgtcgggaagaaggcggtggggtcgtcgggggagggtaatatttgcgttttttttttgcgggaggggacggtgtattttcggaattgatatgtttcgggagattgttttttcgtaggtcggagttttattttttagtatttttaaaattttttttttttagggtattgtagttgtcgattttgttttag

SEQ ID NO: 10714 - DNA, 562 bp, Artificial Sequence
  chemically treated genomic DNA (Homo sapiens) CpG-island No: 10714
ctaaaacaaaatcgacaactacaataccctaaaaaaaaaaaattttaaaaatactaaaaaataaaactccgacctacgaaaaaacaatctcccgaaacatatcaattccgaaaatacaccgtcccctcccgcaaaaaaaaaacgcaaatattaccctcccccgacgaccccaccgccttcttcccgacgccgccgccccctcccccaaccccctaattacctttctcatcctcatcgatacgcaaaacaataaaaatatactcgaaaacctatttataaaaaactcgaacgcgctcgacctcgccgccgacaccgacgccgaaccgaaaccgaaacaaatactaacgcgaccccgaaactcctcttaactaccataaaaacgcgaaaaaaacgctaacaaaaccacacgaaaaaaaaccccaaataaaaaacgaccaaacgcaacaacgcgaaacctacaaacaacgaataaaaaaaataatacaaattccgcttatacgacgactcgaacgaaaaaaccgacccgacgacgaaaaaaacgaaaaccaaacaaaaaaacgaa

SEQ ID NO: 10715 - DNA, 562 bp, Artificial Sequence
  chemically treated genomic DNA (Homo sapiens) CpG-island No: 10715
ttgaaataaagtcgatagttatagtgttttgaaagggagaggttttaagaatattagaagatgaggtttcgatttacgggaaagtagtttttcggggtatattaatttcgggggtgtatcgttttttttcgtagaaaagggacgtaggtgttgttttttttcggcgattttatcgtttttttttcggcgtcgtcgtttttttttttagttttttagttattttttttatttttatcgatgcgtagggtaatggagatgtattcgaaggtttgtttgtggaagattcggacgcgttcggtttcgtcgtcggtatcggcgtcgggtcgaggtcgaggtaggtgttggcgcggtttcggagttttttttggttgttatgagggcgcgggagaagcgttggtagagttatacgaagaggagttttaggtggaaggcgattaaacgtagtagcgcgaagtttataaatagcgggtaggagaaatagtataggtttcgtttatgcggcgattcgggcggaggggtcggttcggcggcgggaggggcgggggttaggtaagggggcgga

SEQ ID NO: 10716 - DNA, 562 bp, Artificial Sequence
  chemically treated genomic DNA (Homo sapiens) CpG-island No: 10716
tccgcccccttacctaacccccgcccctcccgccgccgaaccgacccctccgcccgaatcgccgcataaacgaaacctatactatttctcctacccgctatttataaacttcgcgctactacgtttaatcgccttccacctaaaactcctcttcgtataactctaccaacgcttctcccgcgccctcataacaaccaaaaaaaactccgaaaccgcgccaacacctacctcgacctcgacccgacgccgataccgacgacgaaaccgaacgcgtccgaatcttccacaaacaaaccttcgaatacatctccattaccctacgcatcgataaaaataaaaaaaataactaaaaaactaaaaaaaaaaacgacgacgccgaaaaaaaaacgataaaatcgccgaaaaaaaacaacacctacgtcccttttctacgaaaaaaaacgatacacccccgaaattaatataccccgaaaaactactttcccgtaaatcgaaacctcatcttctaatattcttaaaacctctccctttcaaaacactataactatcgactttatttcaa

SEQ ID NO: 10717 - DNA, 776 bp, Artificial Sequence
  chemically treated genomic DNA (Homo sapiens) CpG-island No: 10717
tttcgttatagtttatgatttaattgcgacgatatcgttagagtatttttattatattcgaagattcgttcgttataagtcgttttcggttagtttttttttaatatttggtttaaattgcgatgatgtgtttagaagtttttcgggcgacgtggttatcgtatcgtattttgagttatgggcgtcggcgagatttatatatttcgtcgttcggttagtattaggtttcgggtgtcgtcggttgtgtttcgatatttcgcgttaagcgagtacggcgcggttaagattggattggggcgtcggttttcgatggttttcggttttcgttcggatttcgggtcggtttggagtcgtttgagcgagagtcgttcgtcgcgatatatttgttttgtcgtttcgtcgaggtcggggttcgttcgtcgttttcgcgttggtttcgttcgttcgagtttcggatttttggttttcgtttgttatcgcgtcgatagtcgttttagcgttcgcggttcgggtagcgtttgcggttcggttcggtcgcggaagggttaatgcggcgcgcgttttttcggttttttcgttcgtttttcggttttttttcgtttgtcgcgcgttcgtagtatcgtttttttttttttttatttcgttttatcgcgcgcgttcgatttttttattggttgagtcgcgtcgagtgtttttttaacgttagtttttcgttttgttaaggagtttttgggattcgcgcgtttagaagagggggaagggatttttaggtaggg

SEQ ID NO: 10718 - DNA, 776 bp, Artificial Sequence
  chemically treated genomic DNA (Homo sapiens) CpG-island No: 10718
ccctacctaaaaatcccttccccctcttctaaacgcgcgaatcccaaaaactccttaacaaaacgaaaaactaacgttaaaaaaacactcgacgcgactcaaccaataaaaaaatcgaacgcgcgcgataaaacgaaataaaaaaaaaaaaaaacgatactacgaacgcgcgacaaacgaaaaaaaaccgaaaaacgaacgaaaaaaccgaaaaaacgcgcgccgcattaacccttccgcgaccgaaccgaaccgcaaacgctacccgaaccgcgaacgctaaaacgactatcgacgcgataacaaacgaaaaccaaaaatccgaaactcgaacgaacgaaaccaacgcgaaaacgacgaacgaaccccgacctcgacgaaacgacaaaacaaatatatcgcgacgaacgactctcgctcaaacgactccaaaccgacccgaaatccgaacgaaaaccgaaaaccatcgaaaaccgacgccccaatccaatcttaaccgcgccgtactcgcttaacgcgaaatatcgaaacacaaccgacgacacccgaaacctaatactaaccgaacgacgaaatatataaatctcgccgacgcccataactcaaaatacgatacgataaccacgtcgcccgaaaaacttctaaacacatcatcgcaatttaaaccaaatattaaaaaaaaactaaccgaaaacgacttataacgaacgaatcttcgaatataataaaaatactctaacgatatcgtcgcaattaaatcataaactataacgaaa

SEQ ID NO: 10719 - DNA, 776 bp, Artificial Sequence
  chemically treated genomic DNA (Homo sapiens) CpG-island No: 10719
ttttgtttaagggtttttttttttttttttgggcgcgcgagttttaggggttttttggtagagcgaggggttggcgttgggggagtattcggcgcggtttagttaatgggaaggtcgggcgcgcgcggtggggcgggatgggggggggagagggcggtgttgcgggcgcgcggtaggcgggagggggtcgggaggcgggcgaaggagtcggaggggcgcgcgtcgtattaattttttcgcggtcgggtcgagtcgtaggcgttgttcgagtcgcgggcgttggagcggttgtcggcgcggtggtaggcgggagttaggagttcggggttcgggcgggcggagttagcgcggggacggcggacgggtttcggtttcggcggggcggtaagataggtgtgtcgcggcgggcggttttcgtttaggcggttttaggtcggttcggggttcgagcggggatcgggagttatcgaggatcggcgttttagtttagttttggtcgcgtcgtgttcgtttggcgcggggtgtcgggatatagtcggcggtattcgaagtttagtgttggtcgggcggcgaggtgtgtgggtttcgtcggcgtttatggtttaggatgcggtgcgatggttacgtcgttcgagaaatttttggatatattatcgtagtttaggttaagtattggggaggggttgatcgggagcggtttgtggcgggcgaattttcgagtgtgataggggtgttttggcggtgtcgtcgtagttgagttatgagttgtggcggga

SEQ ID NO: 10720 - DNA, 776 bp, Artificial Sequence
  chemically treated genomic DNA (Homo sapiens) CpG-island No: 10720
tcccgccacaactcataactcaactacgacgacaccgccaaaacacccctatcacactcgaaaattcgcccgccacaaaccgctcccgatcaacccctccccaatacttaacctaaactacgataatatatccaaaaatttctcgaacgacgtaaccatcgcaccgcatcctaaaccataaacgccgacgaaacccacacacctcgccgcccgaccaacactaaacttcgaataccgccgactatatcccgacaccccgcgccaaacgaacacgacgcgaccaaaactaaactaaaacgccgatcctcgataactcccgatccccgctcgaaccccgaaccgacctaaaaccgcctaaacgaaaaccgcccgccgcgacacacctatcttaccgccccgccgaaaccgaaacccgtccgccgtccccgcgctaactccgcccgcccgaaccccgaactcctaactcccgcctaccaccgcgccgacaaccgctccaacgcccgcgactcgaacaacgcctacgactcgacccgaccgcgaaaaaattaatacgacgcgcgcccctccgactccttcgcccgcctcccgaccccctcccgcctaccgcgcgcccgcaacaccgccctctcccccccccatcccgccccaccgcgcgcgcccgaccttcccattaactaaaccgcgccgaatactcccccaacgccaacccctcgctctaccaaaaaacccctaaaactcgcgcgcccaaaaaaaaaaaaaaaaacccttaaacaaaa

SEQ ID NO: 10721 - DNA, 592 bp, Artificial Sequence
  chemically treated genomic DNA (Homo sapiens) CpG-island No: 10721
tttcgcgtttatttttattagggttcgttttaatttcgtcgtttcgtagatttacgtgtaggatattttgaggacggagttggttgcggaggtgtatcgcgtgttgtgtttcgagcggggttatatgtttgtttgcggcgatgttattatggtaattaacgttttgtagatcgtgtagcgtattttggcgacggagggcgatatggagttggacgaggtcggcgacgttatcggcgtgttgcgggtgcggaggggcgggtcgggtttgagcgtgcggggtttttgttaaggttttcgagtcgggttttgatttattgtgttttttttcgataggattagtaacgttattacgaagatattttcgggtttacgttgcgtatttaggaggtgataagtcgtatacgtatttagagtttttttttgtaggagcgttagttgcggggcgtagtgttttgggcgttcgattttttcggtttagatattaatagtttttgagagtcgtttggtttttttttttagtttcgggagagcggttgttcgatttaggttcgttcgattaggattagtttcgtttttttttttttgaggtggt

SEQ ID NO: 10722 - DNA, 592 bp, Artificial Sequence
  chemically treated genomic DNA (Homo sapiens) CpG-island No: 10722
accacctcaaaaaaaaaaaaacgaaactaatcctaatcgaacgaacctaaatcgaacaaccgctctcccgaaactaaaaaaaaaaaccaaacgactctcaaaaactattaatatctaaaccgaaaaaatcgaacgcccaaaacactacgccccgcaactaacgctcctacaaaaaaaaactctaaatacgtatacgacttatcacctcctaaatacgcaacgtaaacccgaaaatatcttcgtaataacgttactaatcctatcgaaaaaaaacacaataaatcaaaacccgactcgaaaaccttaacaaaaaccccgcacgctcaaacccgacccgcccctccgcacccgcaacacgccgataacgtcgccgacctcgtccaactccatatcgccctccgtcgccaaaatacgctacacgatctacaaaacgttaattaccataataacatcgccgcaaacaaacatataaccccgctcgaaacacaacacgcgatacacctccgcaaccaactccgtcctcaaaatatcctacacgtaaatctacgaaacgacgaaattaaaacgaaccctaataaaaataaacgcgaaa

SEQ ID NO: 10723 - DNA, 592 bp, Artificial Sequence
  chemically treated genomic DNA (Homo sapiens) CpG-island No: 10723
attattttaagaggggaggagcggggttgattttggtcgggcggatttgagtcgggtagtcgttttttcggaattggaagggaaagttaggcggtttttaggggttgttggtgtttgagtcgggagggtcgaacgtttagggtattgcgtttcgtaattgacgtttttgtaaggaaaagttttgggtgcgtatgcggtttgttattttttgggtgcgtagcgtgagttcgaaaatgttttcgtggtagcgttgttgattttgtcggaaaagagtatagtggattagaattcgattcggagattttagtaggaatttcgtacgtttaggttcggttcgttttttcgtattcgtagtacgtcgatgacgtcgtcggtttcgtttagttttatgtcgtttttcgtcgttaggatgcgttgtacggtttgtaggacgttggttgttatggtaatatcgtcgtagataaatatgtggtttcgttcgaggtatagtacgcggtgtattttcgtagttagtttcgtttttaggatgttttgtacgtaggtttgcggggcggcggggttagggcgggttttggtgggggtgggcgcgggg

SEQ ID NO: 10724 - DNA, 592 bp, Artificial Sequence
  chemically treated genomic DNA (Homo sapiens) CpG-island No: 10724
ccccgcgcccacccccaccaaaacccgccctaaccccgccgccccgcaaacctacgtacaaaacatcctaaaaacgaaactaactacgaaaatacaccgcgtactatacctcgaacgaaaccacatatttatctacgacgatattaccataacaaccaacgtcctacaaaccgtacaacgcatcctaacgacgaaaaacgacataaaactaaacgaaaccgacgacgtcatcgacgtactacgaatacgaaaaaacgaaccgaacctaaacgtacgaaattcctactaaaatctccgaatcgaattctaatccactatactcttttccgacaaaatcaacaacgctaccacgaaaacattttcgaactcacgctacgcacccaaaaaataacaaaccgcatacgcacccaaaacttttccttacaaaaacgtcaattacgaaacgcaataccctaaacgttcgaccctcccgactcaaacaccaacaacccctaaaaaccgcctaactttcccttccaattccgaaaaaacgactacccgactcaaatccgcccgaccaaaatcaaccccgctcctcccctcttaaaataat

SEQ ID NO: 10725 - DNA, 927 bp, Artificial Sequence
  chemically treated genomic DNA (Homo sapiens) CpG-island No: 10725
gggattgatagcgtcgcgtagggggttcgaggcgggacgtggggattttacgttttttacgcgcgttttacggcgtgttcgttaatataggcgagggtaagggtgcgttatttaagtaagggggacggtggcgttcgggttgagtagcggcgagcggtaatcgagagtggggggttgttttagcggtatatattttcggcgaaatagtttcgcggtttttggaaagtgtttcggacgggttgagggcgttttttcgtttgcgaggagatataaaggtaagagcgggtgagcgattagggtcgggatttttcgggggtggtcgcggtgtttttttattttcgagttcgagttgttgttttggtttttcgattcgttgattagggacgatttgatttcgtttaggttcgttgcgtcgaggcgaatcgttgttcggtttttgtttttcgtttttttcgttttggaaggggattagttcgtcgttcgtttcgaggtcgtttttttcgtcggtcgtttcgcgttaggagcgtcgtttttttcgttgacgtcgtcgtcgtcgtcgttttcgtcgtcgagttggggtatggtggggtcgcggtcggggcgtacgttttcggagtttttagtcgttcgcgttttgttcggttcggttcggcgtttttttcgttcgtttgcgggatattggcgttatcgtcgtaataaagtttgatagggcgtggttcgcgggaagcggcgcggcgttgttcggtcggggcgtaggcggttcggttcgggttttttcggtagcgtcgagtttagggttttttaattcgttatcgtcgtcgtttgtttcgtcggggcgttttagtttttggttcgtcggggaggggcgagcggggagggagggaggagggatcgtcgggttgggtaggggggtcggagggaggagtt

SEQ ID NO: 10726 - DNA, 927 bp, Artificial Sequence
  chemically treated genomic DNA (Homo sapiens) CpG-island No: 10726
aactcctccctccgacccccctacccaacccgacgatccctcctccctccctccccgctcgcccctccccgacgaaccaaaaactaaaacgccccgacgaaacaaacgacgacgataacgaattaaaaaaccctaaactcgacgctaccgaaaaaacccgaaccgaaccgcctacgccccgaccgaacaacgccgcgccgcttcccgcgaaccacgccctatcaaactttattacgacgataacgccaatatcccgcaaacgaacgaaaaaaacgccgaaccgaaccgaacaaaacgcgaacgactaaaaactccgaaaacgtacgccccgaccgcgaccccaccataccccaactcgacgacgaaaacgacgacgacgacgacgtcaacgaaaaaaacgacgctcctaacgcgaaacgaccgacgaaaaaaacgacctcgaaacgaacgacgaactaatccccttccaaaacgaaaaaaacgaaaaacaaaaaccgaacaacgattcgcctcgacgcaacgaacctaaacgaaatcaaatcgtccctaatcaacgaatcgaaaaaccaaaacaacaactcgaactcgaaaataaaaaaacaccgcgaccacccccgaaaaatcccgaccctaatcgctcacccgctcttacctttatatctcctcgcaaacgaaaaaacgccctcaacccgtccgaaacactttccaaaaaccgcgaaactatttcgccgaaaatatataccgctaaaacaaccccccactctcgattaccgctcgccgctactcaacccgaacgccaccgtcccccttacttaaataacgcacccttaccctcgcctatattaacgaacacgccgtaaaacgcgcgtaaaaaacgtaaaatccccacgtcccgcctcgaaccccctacgcgacgctatcaatccc

SEQ ID NO: 10727 - DNA, 927 bp, Artificial Sequence
  chemically treated genomic DNA (Homo sapiens) CpG-island No: 10727
ggttttttttttcggtttttttgtttagttcggcggtttttttttttttttttttcgttcgttttttttcggcgggttaggggttgggacgtttcggcggagtaggcggcggcggtggcgagttggggagttttaggttcggcgttgtcggaggggttcgagtcgagtcgtttgcgtttcggtcgggtagcgtcgcgtcgtttttcgcgggttacgttttgttaaattttgttgcggcggtagcgttagtgtttcgtaagcgggcgggaggggcgtcgggtcgggtcgggtagggcgcgggcggttaggggtttcgagagcgtgcgtttcggtcgcggttttattatgttttagttcggcggcgggggcggcggcggcggcggcgttagcgggggaggcggcgtttttagcgcggggcggtcggcggaggggacgatttcggggcgaacgacgagttgatttttttttaggacgaggggggcgaggagtaggagtcgagtagcgattcgtttcggcgtagcggatttagacgaggttaagtcgtttttggttaacgagtcggagaattagagtagtagttcggattcggaggtaaggaagtatcgcggttattttcgggggatttcggttttggtcgtttattcgtttttgtttttgtgttttttcgtaggcggagaggcgtttttagttcgttcgggatattttttagaagtcgcgggattatttcgtcgaaggtatgtgtcgttgggatagttttttattttcgattatcgttcgtcgttgtttagttcgggcgttatcgttttttttgtttgggtgacgtatttttgttttcgtttatattggcggatacgtcgtggggcgcgcgtggggggcgtgggatttttacgtttcgtttcgagttttttgcgcggcgttgttagtttt

SEQ ID NO: 10728 - DNA, 927 bp, Artificial Sequence
  chemically treated genomic DNA (Homo sapiens) CpG-island No: 10728
aaaactaacaacgccgcgcaaaaaactcgaaacgaaacgtaaaaatcccacgccccccacgcgcgccccacgacgtatccgccaatataaacgaaaacaaaaatacgtcacccaaacaaaaaaaacgataacgcccgaactaaacaacgacgaacgataatcgaaaataaaaaactatcccaacgacacataccttcgacgaaataatcccgcgacttctaaaaaatatcccgaacgaactaaaaacgcctctccgcctacgaaaaaacacaaaaacaaaaacgaataaacgaccaaaaccgaaatcccccgaaaataaccgcgatacttccttacctccgaatccgaactactactctaattctccgactcgttaaccaaaaacgacttaacctcgtctaaatccgctacgccgaaacgaatcgctactcgactcctactcctcgcccccctcgtcctaaaaaaaaatcaactcgtcgttcgccccgaaatcgtcccctccgccgaccgccccgcgctaaaaacgccgcctcccccgctaacgccgccgccgccgccgcccccgccgccgaactaaaacataataaaaccgcgaccgaaacgcacgctctcgaaacccctaaccgcccgcgccctacccgacccgacccgacgcccctcccgcccgcttacgaaacactaacgctaccgccgcaacaaaatttaacaaaacgtaacccgcgaaaaacgacgcgacgctacccgaccgaaacgcaaacgactcgactcgaacccctccgacaacgccgaacctaaaactccccaactcgccaccgccgccgcctactccgccgaaacgtcccaacccctaacccgccgaaaaaaaacgaacgaaaaaaaaaaaaaaaaaaaccgccgaactaaacaaaaaaaccgaaaaaaaaaacc

SEQ ID NO: 10729 - DNA, 637 bp, Artificial Sequence
  chemically treated genomic DNA (Homo sapiens) CpG-island No: 10729
gggttggaggcgtcgagtatcgagcgtcgtcgggagtcgagcgtcggtcgcggagtttttgcgatttcgttaggattcgaatagagttcgggggcggcgggtcggagtcggggacgcgggtatacgttcgttcgtataagttacggcggattttttcgaggcggaatttttacgtcgagcgaggtaagaatcgcggcgttttcggaattagggcgggtttggcgtttcgagcggttttcgcgtcggattttttcggttgcgcgttttgttcgtcgtagtttagtcggggtcggcgttttttttcgttcgtcgttcgttttttttattttttggttttttttcgggcgattcgcgttttttgggttttttttttttttttttcgttcgcgttttttgcgttttttttttgcgttcgtttcgtcgtttttttcgtcgtttaattttttttttaattcgcgttcgggagttggcgaggcggcggcggttttttagtgagtttcgggagggataggttcggggcgaaggcgcgaggttcgcggttttttggattggggaggagggcgggagtgggcggcgaggtgggatgcgttgtgtgtgttatgtgtgtgtgttgtattttattttatgtttttttggt

SEQ ID NO: 10730 - DNA, 637 bp, Artificial Sequence
  chemically treated genomic DNA (Homo sapiens) CpG-island No: 10730
accaaaaaaacataaaataaaatacaacacacacacataacacacacaacgcatcccacctcgccgcccactcccgccctcctccccaatccaaaaaaccgcgaacctcgcgccttcgccccgaacctatccctcccgaaactcactaaaaaaccgccgccgcctcgccaactcccgaacgcgaattaaaaaaaaaattaaacgacgaaaaaaacgacgaaacgaacgcaaaaaaaaaacgcaaaaaacgcgaacgaaaaaaaaaaaaaaaaaacccaaaaaacgcgaatcgcccgaaaaaaaaccaaaaaataaaaaaaacgaacgacgaacgaaaaaaaacgccgaccccgactaaactacgacgaacaaaacgcgcaaccgaaaaaatccgacgcgaaaaccgctcgaaacgccaaacccgccctaattccgaaaacgccgcgattcttacctcgctcgacgtaaaaattccgcctcgaaaaaatccgccgtaacttatacgaacgaacgtatacccgcgtccccgactccgacccgccgcccccgaactctattcgaatcctaacgaaatcgcaaaaactccgcgaccgacgctcgactcccgacgacgctcgatactcgacgcctccaaccc

SEQ ID NO: 10731 - DNA, 637 bp, Artificial Sequence
  chemically treated genomic DNA (Homo sapiens) CpG-island No: 10731
attaaaaagatatggagtggaatgtaatatatatatataatatatataacgtattttatttcgtcgtttattttcgtttttttttttagtttaggaaatcgcgggtttcgcgttttcgtttcgggtttgtttttttcgggatttattgaggagtcgtcgtcgtttcgttagttttcgagcgcgagttggaggaaaagttgggcggcgggaagagcggcgggacgagcgtagggagggggcgtaggagacgcggacggagggaagggaggggagatttaagaggcgcggatcgttcgggagggagttaggaggtgaaaggggcgggcggcgagcggagggaggcgtcggtttcggttgggttgcggcgggtaaagcgcgtagtcgggaggattcggcgcgggggtcgttcgggacgttaagttcgttttagtttcgggggcgtcgcggtttttatttcgttcggcgtggaggtttcgtttcgggagagttcgtcgtggtttgtgcgagcgggcgtgtgttcgcgttttcggtttcggttcgtcgttttcgggttttgttcgggttttggcggggtcgtaagagtttcgcggtcggcgttcgattttcggcggcgttcggtgttcggcgtttttagttt

SEQ ID NO: 10732 - DNA, 637 bp, Artificial Sequence
  chemically treated genomic DNA (Homo sapiens) CpG-island No: 10732
aaactaaaaacgccgaacaccgaacgccgccgaaaatcgaacgccgaccgcgaaactcttacgaccccgccaaaacccgaacaaaacccgaaaacgacgaaccgaaaccgaaaacgcgaacacacgcccgctcgcacaaaccacgacgaactctcccgaaacgaaacctccacgccgaacgaaataaaaaccgcgacgcccccgaaactaaaacgaacttaacgtcccgaacgacccccgcgccgaatcctcccgactacgcgctttacccgccgcaacccaaccgaaaccgacgcctccctccgctcgccgcccgcccctttcacctcctaactccctcccgaacgatccgcgcctcttaaatctcccctcccttccctccgtccgcgtctcctacgccccctccctacgctcgtcccgccgctcttcccgccgcccaacttttcctccaactcgcgctcgaaaactaacgaaacgacgacgactcctcaataaatcccgaaaaaaacaaacccgaaacgaaaacgcgaaacccgcgatttcctaaactaaaaaaaaaaacgaaaataaacgacgaaataaaatacgttatatatattatatatatatattacattccactccatatctttttaat

SEQ ID NO: 10733 - DNA, 1553 bp, Artificial Sequence
  chemically treated genomic DNA (Homo sapiens) CpG-island No: 10733
tttttttcgtttttattttgggttttttaggataaatgttttttacgtttttcgatgcgaaggtttggtcgcgagtagtcgcggttttcggtacgtgacggttacggagtcgtcgcggtttttcgcggttggggggtattcggggatgcggcgggcgttgacgtcgttttttcggttatttataagttttcgggtcgtagtagagtaggaagaggcgcgcggggtcggcgtttgtcggggaggtcgaggcgttttttcggcgagtcggcgtcgtcggtcgggttttttattgtttgtaatcgggggagggggattattcgatagtttagtcggggttgagagggagacgacgttaaggcggttttgtatcgttttcggttttttaaatgtagattttatcggaatcggagtttttttttgatagtcgtaggacgggagacggtcgaggggtcgtttggattgtttcgttttcgcgcggtgatttatcggggatcgtgcgagggtcgtttttaatttttaagagttagagagtcgagttattttgaggagcgtcgtatgaggttggttgcgcgttgttttttaattagttttattgaacgcgtcgattttagttttatttttcgggttttatttttttacgtttttttcggtttttcggggtgttttgtgtgttatttttttacgtatagttttttttcgtttttcgtttttcggttttttcgttcggtttttttagtcgtttagacgttagttgtcgcgggcgtttttggttcgcgttttcgtttttttcgtttcgtcgattcgtcgtttttttcggagttttagcgtttcgaattagggattgtatttttcggtagcgcgcggttcgcggttaatgaggggttgaggatttggcggcggcggcgtttcgagagtcggggtgggggggttttgtgcgcggcggcggcgggagaggcggcggcggcggttagtacggaggcggaggtcgagggggttgtgtataggtcgtcgcggagaggcgtgcgaatttcgagtcgagcgtcgaggatcgtgttatttaggtcgggttgttagcgtaggtttttttttggtagtagcggcggcgcggcgattttcgtttttcggttttttttttttattttatttttcgagttttttttttttcgtagtacgttcggttcggttcgtcgtggttttttttagtgtcggtcgttatggagaggcgttcgcgcggggaaaatttagttcggggattttatgcggtttagttcggtttcgtttttttttcgcgcggttttagcggttgttcgtattttagttttatttcgggttttcgtgttttttttgtgatcgtattgatacggtcggggggttagaatggaataaattgaaggtaaagtgcgtgtgcgtgtgtgtatgtgtgtgtgtgtgtgtgtgtgtgtgtgcgcgcgcgtgtgtagtgttaggaagggttgaggagggaacgacggggagggggcgatttagggatggagcgttagattttaggaggaatggaaggggaagcgggtggt

SEQ ID NO: 10734 - DNA, 1553 bp, Artificial Sequence
  chemically treated genomic DNA (Homo sapiens) CpG-island No: 10734
accacccgcttccccttccattcctcctaaaatctaacgctccatccctaaatcgccccctccccgtcgttccctcctcaacccttcctaacactacacacgcgcgcgcacacacacacacacacacacacacacatacacacacgcacacgcactttaccttcaatttattccattctaaccccccgaccgtatcaatacgatcacaaaaaaaacacgaaaacccgaaataaaactaaaatacgaacaaccgctaaaaccgcgcgaaaaaaaaacgaaaccgaactaaaccgcataaaatccccgaactaaattttccccgcgcgaacgcctctccataacgaccgacactaaaaaaaaccacgacgaaccgaaccgaacgtactacgaaaaaaaaaaaactcgaaaaataaaataaaaaaaaaaaaccgaaaaacgaaaatcgccgcgccgccgctactaccaaaaaaaaacctacgctaacaacccgacctaaataacacgatcctcgacgctcgactcgaaattcgcacgcctctccgcgacgacctatacacaaccccctcgacctccgcctccgtactaaccgccgccgccgcctctcccgccgccgccgcgcacaaaacccccccaccccgactctcgaaacgccgccgccgccaaatcctcaacccctcattaaccgcgaaccgcgcgctaccgaaaaatacaatccctaattcgaaacgctaaaactccgaaaaaaacgacgaatcgacgaaacgaaaaaaacgaaaacgcgaaccaaaaacgcccgcgacaactaacgtctaaacgactaaaaaaaccgaacgaaaaaaccgaaaaacgaaaaacgaaaaaaaactatacgtaaaaaaataacacacaaaacaccccgaaaaaccgaaaaaaacgtaaaaaaataaaacccgaaaaataaaactaaaatcgacgcgttcaataaaactaattaaaaaacaacgcgcaaccaacctcatacgacgctcctcaaaataactcgactctctaactcttaaaaattaaaaacgaccctcgcacgatccccgataaatcaccgcgcgaaaacgaaacaatccaaacgacccctcgaccgtctcccgtcctacgactatcaaaaaaaaactccgattccgataaaatctacatttaaaaaaccgaaaacgatacaaaaccgccttaacgtcgtctccctctcaaccccgactaaactatcgaataatccccctcccccgattacaaacaataaaaaacccgaccgacgacgccgactcgccgaaaaaacgcctcgacctccccgacaaacgccgaccccgcgcgcctcttcctactctactacgacccgaaaacttataaataaccgaaaaaacgacgtcaacgcccgccgcatccccgaataccccccaaccgcgaaaaaccgcgacgactccgtaaccgtcacgtaccgaaaaccgcgactactcgcgaccaaaccttcgcatcgaaaaacgtaaaaaacatttatcctaaaaaacccaaaataaaaacgaaaaaaa

SEQ ID NO: 10735 - DNA, 1553 bp, Artificial Sequence
  chemically treated genomic DNA (Homo sapiens) CpG-island No: 10735
gttattcgtttttttttttattttttttggggtttggcgttttatttttaggtcgtttttttttcgtcgttttttttttagttttttttagtattatatacgcgcgcgtatatatatatatatatatatatatatatatatatacgtatacgtattttatttttagtttgttttattttaatttttcggtcgtgttagtgcgattataggagagatacggaggttcggagtggggttggggtgcgggtagtcgttggggtcgcgcgaggaggaggcggaatcgagttaggtcgtatgaaattttcgggttagatttttttcgcgcggacgtttttttatggcggtcggtattgaggagagttacggcgggtcgggtcgggcgtgttgcgggaagaggaaggttcgggaggtgggatgggaaggggaggtcgagggacgggggtcgtcgcgtcgtcgttgttgttagagaggagtttgcgttggtagttcggtttgggtagtacggttttcggcgttcggttcggaattcgtacgttttttcgcggcgatttgtgtatagttttttcggttttcgttttcgtgttggtcgtcgtcgtcgtttttttcgtcgtcgtcgcgtataaagtttttttatttcgattttcggggcgtcgtcgtcgttaaatttttagttttttattggtcgcgggtcgcgcgttgtcgggaaatgtagtttttggttcgggacgttggggtttcggaggaagcggcgagtcggcggggcggagggggcgggagcgcgaattaggaacgttcgcggtagttagcgtttggacgattagggagatcgggcgagagggtcgaggaacgagggacggggagggattgtacgtgggagagtgatatataaaatatttcgggaagtcggaggaggcgtggaaaggtggggttcgggaggtaaaattgggatcggcgcgtttagtgaggttgattaaagaataacgcgtaattagttttatacggcgttttttagggtgattcggttttttagtttttaagggttagaagcgattttcgtacggttttcggtgggttatcgcgcgagggcggggtagtttaggcgatttttcggtcgtttttcgttttacggttgttagggaagggtttcggtttcggtagggtttgtatttggaaagtcgggggcgatgtaagatcgttttggcgtcgttttttttttagtttcggttgagttgtcggatggtttttttttttcggttgtaagtagtaggagattcggtcggcggcgtcggttcgtcgagggagcgtttcgattttttcggtaggcgtcggtttcgcgcgtttttttttgttttgttgcggttcggaggtttgtgggtaatcgggaggacgacgttagcgttcgtcgtattttcgggtgttttttagtcgcgggggatcgcgacggtttcgtgatcgttacgtgtcggaggtcgcggttgttcgcggttagattttcgtatcgagggacgtgagggatatttgttttagagggtttaagataagaacgagaggaa

SEQ ID NO: 10736 - DNA, 1553 bp, Artificial Sequence
  chemically treated genomic DNA (Homo sapiens) CpG-island No: 10736
ttcctctcgttcttatcttaaaccctctaaaacaaatatccctcacgtccctcgatacgaaaatctaaccgcgaacaaccgcgacctccgacacgtaacgatcacgaaaccgtcgcgatcccccgcgactaaaaaacacccgaaaatacgacgaacgctaacgtcgtcctcccgattacccacaaacctccgaaccgcaacaaaacaaaaaaaaacgcgcgaaaccgacgcctaccgaaaaaatcgaaacgctccctcgacgaaccgacgccgccgaccgaatctcctactacttacaaccgaaaaaaaaaaaccatccgacaactcaaccgaaactaaaaaaaaaacgacgccaaaacgatcttacatcgcccccgactttccaaatacaaaccctaccgaaaccgaaacccttccctaacaaccgtaaaacgaaaaacgaccgaaaaatcgcctaaactaccccgccctcgcgcgataacccaccgaaaaccgtacgaaaatcgcttctaacccttaaaaactaaaaaaccgaatcaccctaaaaaacgccgtataaaactaattacgcgttattctttaatcaacctcactaaacgcgccgatcccaattttacctcccgaaccccacctttccacgcctcctccgacttcccgaaatattttatatatcactctcccacgtacaatccctccccgtccctcgttcctcgaccctctcgcccgatctccctaatcgtccaaacgctaactaccgcgaacgttcctaattcgcgctcccgccccctccgccccgccgactcgccgcttcctccgaaaccccaacgtcccgaaccaaaaactacatttcccgacaacgcgcgacccgcgaccaataaaaaactaaaaatttaacgacgacgacgccccgaaaatcgaaataaaaaaactttatacgcgacgacgacgaaaaaaacgacgacgacgaccaacacgaaaacgaaaaccgaaaaaactatacacaaatcgccgcgaaaaaacgtacgaattccgaaccgaacgccgaaaaccgtactacccaaaccgaactaccaacgcaaactcctctctaacaacaacgacgacgcgacgacccccgtccctcgacctccccttcccatcccacctcccgaaccttcctcttcccgcaacacgcccgacccgacccgccgtaactctcctcaataccgaccgccataaaaaaacgtccgcgcgaaaaaaatctaacccgaaaatttcatacgacctaactcgattccgcctcctcctcgcgcgaccccaacgactacccgcaccccaaccccactccgaacctccgtatctctcctataatcgcactaacacgaccgaaaaattaaaataaaacaaactaaaaataaaatacgtatacgtatatatatatatatatatatatatatatatatatacgcgcgcgtatataatactaaaaaaaactaaaaaaaaaacgacgaaaaaaaaacgacctaaaaataaaacgccaaaccccaaaaaaaataaaaaaaaaaacgaataac

SEQ ID NO: 10737 - DNA, 1415 bp, Artificial Sequence
  chemically treated genomic DNA (Homo sapiens) CpG-island No: 10737
ttttcgagcgagttagggacgggagtaggtacgtatagtcgcgtaagtgtatgaaatgacgattttagaagggcgtttagggatatgggtttggtagtttcgagcggaggtcgttaggtagtcgtttttttcggaattcggtttttcgtagtgttttcggttgcggcgtttttgggtcgagcgttggagtcgttttgggtaattttttcgagcgcggtcggtttattttcgtcggattgcgcggggcgagggtttcgttattgcgcgtaggttcgcggatggtaattcggggtttttattgcgggtgatttcgggatattacgggtttttacggaggtcgggttaggggagagttttggttgtgggatttcgcgtgattagggcgtagggcgtcgggtttttagtttatttggcggcgtagggaggggcgttcggtagggcgggtgcgtagtatgagttttagtcgtttgtcgttttattttagtcgggcggacgggcgggagtcgggggcggggaattcggagcgtcgtttcgttagcgcgtttcgttcgtgggagaggaggggttgtagcgtagcggattattggaggcgtagtacggtcgtcgtcgtcgttgtcggtgttggagatcgcggttcggtgtaggcggcgtttatgtttttttttttttattagttcgcgcgttagttcgtttgtcggggtcggtttttcgttttttgtttttcgtcgtagtcgcgtagtcgtcgtagagttcgcggcgttatcgttcgttttttaggtaggtgttttagttgtaaagggattgtttggggcgggcgttaaggtgttcgtatcgcggttcgggggtattgtgcgttttcggcgggtcgaggatttcgagggacgcgtgggtgggtagtcgtagtttcgggtttttaggatatcgtcgtttttttggaggcgttttcggtcgatagttcgggttatagggaagtgggggcggcggtgttagtttattttcgcggtcgggatgggagggggcgtttgtatcgcggtttcggtttgtcgttttttttttttttcgttgttagggaatttcggtcgtttgttattagcgttcgtattttttcgcgcgggtcggcgttttgtttttcgtaggttgtttggggattgaagtaggggtagggagaaggattgatgtaattgttagcggaaaatcgaatcggcgcgggtgagagcgtcgcgttcgcgagagttaacgtttacgtcgtattttttagggaatcggggaagtcgagaggagcggttggggaagttgtgtattgggttttattgtgcgcgtgtattgcggattgttttcgcggggtatttttgtttattcgttgttggcgtttttgtagttttttcggtagttttcgtttattttttcggttaggg

SEQ ID NO: 10738 - DNA, 1415 bp, Artificial Sequence
  chemically treated genomic DNA (Homo sapiens) CpG-island No: 10738
ccctaaccgaaaaaataaacgaaaactaccgaaaaaactacaaaaacgccaacaacgaataaacaaaaataccccgcgaaaacaatccgcaatacacgcgcacaataaaacccaatacacaacttccccaaccgctcctctcgacttccccgattccctaaaaaatacgacgtaaacgttaactctcgcgaacgcgacgctctcacccgcgccgattcgattttccgctaacaattacatcaatccttctccctacccctacttcaatccccaaacaacctacgaaaaacaaaacgccgacccgcgcgaaaaaatacgaacgctaataacaaacgaccgaaattccctaacaacgaaaaaaaaaaaaaacgacaaaccgaaaccgcgatacaaacgccccctcccatcccgaccgcgaaaataaactaacaccgccgcccccacttccctataacccgaactatcgaccgaaaacgcctccaaaaaaacgacgatatcctaaaaacccgaaactacgactacccacccacgcgtccctcgaaatcctcgacccgccgaaaacgcacaatacccccgaaccgcgatacgaacaccttaacgcccgccccaaacaatccctttacaactaaaacacctacctaaaaaacgaacgataacgccgcgaactctacgacgactacgcgactacgacgaaaaacaaaaaacgaaaaaccgaccccgacaaacgaactaacgcgcgaactaataaaaaaaaaaaaacataaacgccgcctacaccgaaccgcgatctccaacaccgacaacgacgacgacgaccgtactacgcctccaataatccgctacgctacaacccctcctctcccacgaacgaaacgcgctaacgaaacgacgctccgaattccccgcccccgactcccgcccgtccgcccgactaaaataaaacgacaaacgactaaaactcatactacgcacccgccctaccgaacgcccctccctacgccgccaaataaactaaaaacccgacgccctacgccctaatcacgcgaaatcccacaaccaaaactctcccctaacccgacctccgtaaaaacccgtaatatcccgaaatcacccgcaataaaaaccccgaattaccatccgcgaacctacgcgcaataacgaaaccctcgccccgcgcaatccgacgaaaataaaccgaccgcgctcgaaaaaattacccaaaacgactccaacgctcgacccaaaaacgccgcaaccgaaaacactacgaaaaaccgaattccgaaaaaaacgactacctaacgacctccgctcgaaactaccaaacccatatccctaaacgcccttctaaaatcgtcatttcatacacttacgcgactatacgtacctactcccgtccctaactcgctcgaaaa

SEQ ID NO: 10739 - DNA, 1415 bp, Artificial Sequence
  chemically treated genomic DNA (Homo sapiens) CpG-island No: 10739
ttttggtcgggggagtggacggaggttgtcgggagggttgtaggggcgttagtagcgggtgggtaggggtgtttcgcgagggtagttcgtagtgtacgcgtataataaaatttaatgtataatttttttagtcgtttttttcggttttttcgattttttgaaaggtgcggcgtaggcgttagttttcgcgggcgcggcgtttttattcgcgtcggttcggtttttcgttgataattatattagtttttttttttgtttttgttttaatttttaggtagtttgcggggagtagggcgtcggttcgcgcgagggaatgcgagcgttagtggtaggcggtcggaattttttggtaacgagggggagggagggcggtaaatcgggatcgcgatatagacgtttttttttatttcggtcgcgagaatgggttgatatcgtcgtttttatttttttgtagttcgggttatcggtcgggggcgtttttagggggacggcgatgttttggggattcgaagttgcggttgtttatttacgcgtttttcggggttttcggttcgtcggaggcgtataatgttttcgggtcgcgatgcgggtattttggcgttcgttttaagtaatttttttgtagttaggatatttatttggagggcgagcggtggcgtcgcggattttgcggcggttgcgcggttgcgacgggaggtaggaggcggagagtcggtttcggtaggcggattggcgcgcgggttagtggaggagaggaggtatgggcgtcgtttgtatcgagtcgcgatttttagtatcgatagcggcggcggcgatcgtgttgcgtttttagtggttcgttgcgttgtagtttttttttttttacgggcggggcgcgttggcggggcggcgtttcgggtttttcgttttcggttttcgttcgttcgttcggttggagtggagcggtaagcggttggggtttatgttgcgtattcgttttatcgggcgtttttttttgcgtcgttagatgggttaaggattcggcgttttgcgttttggttacgcggggttttatagttagggtttttttttggttcggttttcgtgggaattcgtggtgtttcgagattattcgtagtggaaatttcgagttgttattcgcgggtttgcgcgtagtagcggagttttcgtttcgcgtagttcggcggaggtgagtcggtcgcgttcgggagggttgtttagaacggttttagcgttcggtttaggagcgtcgtagtcgggagtattgcgggagatcgaatttcgaaaggaacggttgtttggcggttttcgttcggggttgttaaatttatgtttttgggcgtttttttgaggtcgttattttatatatttacgcgattgtgcgtgtttgttttcgtttttgattcgttcgggag

SEQ ID NO: 10740 - DNA, 1415 bp, Artificial Sequence
  chemically treated genomic DNA (Homo sapiens) CpG-island No: 10740
ctcccgaacgaatcaaaaacgaaaacaaacacgcacaatcgcgtaaatatataaaataacgacctcaaaaaaacgcccaaaaacataaatttaacaaccccgaacgaaaaccgccaaacaaccgttcctttcgaaattcgatctcccgcaatactcccgactacgacgctcctaaaccgaacgctaaaaccgttctaaacaaccctcccgaacgcgaccgactcacctccgccgaactacgcgaaacgaaaactccgctactacgcgcaaacccgcgaataacaactcgaaatttccactacgaataatctcgaaacaccacgaattcccacgaaaaccgaaccaaaaaaaaaccctaactataaaaccccgcgtaaccaaaacgcaaaacgccgaatccttaacccatctaacgacgcaaaaaaaaacgcccgataaaacgaatacgcaacataaaccccaaccgcttaccgctccactccaaccgaacgaacgaacgaaaaccgaaaacgaaaaacccgaaacgccgccccgccaacgcgccccgcccgtaaaaaaaaaaaaactacaacgcaacgaaccactaaaaacgcaacacgatcgccgccgccgctatcgatactaaaaatcgcgactcgatacaaacgacgcccatacctcctctcctccactaacccgcgcgccaatccgcctaccgaaaccgactctccgcctcctacctcccgtcgcaaccgcgcaaccgccgcaaaatccgcgacgccaccgctcgccctccaaataaatatcctaactacaaaaaaattacttaaaacgaacgccaaaatacccgcatcgcgacccgaaaacattatacgcctccgacgaaccgaaaaccccgaaaaacgcgtaaataaacaaccgcaacttcgaatccccaaaacatcgccgtccccctaaaaacgcccccgaccgataacccgaactacaaaaaaataaaaacgacgatatcaacccattctcgcgaccgaaataaaaaaaaacgtctatatcgcgatcccgatttaccgccctccctccccctcgttaccaaaaaattccgaccgcctaccactaacgctcgcattccctcgcgcgaaccgacgccctactccccgcaaactacctaaaaattaaaacaaaaacaaaaaaaaaaactaatataattatcaacgaaaaaccgaaccgacgcgaataaaaacgccgcgcccgcgaaaactaacgcctacgccgcacctttcaaaaaatcgaaaaaaccgaaaaaaacgactaaaaaaattatacattaaattttattatacgcgtacactacgaactaccctcgcgaaacacccctacccacccgctactaacgcccctacaaccctcccgacaacctccgtccactcccccgaccaaaa

SEQ ID NO: 10741 - DNA, 535 bp, Artificial Sequence
  chemically treated genomic DNA (Homo sapiens) CpG-island No: 10741
ttagatagtcgttttttagtgtgatttttttttttagttgtatttttcggcggaggttttttttttagttcggattttttcgggcggttttcgtagtttttattttcgggttttcgtcgtttttgttttattatagtacgattttcgttatataggttcgttttttttttcgatagttaatcgcgcgcgatttcgtttttttcgttgggttcggggcgttagagtttcgagtgttaggggagttgaattttgcgtttttttttaggttgcggcgagataatttttagagtttcgcgtttcggtttcgggtagttatggattcgtaggaattgaaggtgagcgggtgagcgagtgagcggtgagcgggcgggcgggcggagtttttttgcggttttttggttcgggggcgcggagggagttcgggtggtttcgttaggtcgttgtttttttgcggtgtttcggttgttcgggttgcggggtgggtttgtagtttttgtttacggtcggttttcgcgggttttgttggggaagttta

SEQ ID NO: 10742 - DNA, 535 bp, Artificial Sequence
  chemically treated genomic DNA (Homo sapiens) CpG-island No: 10742
taaacttccccaacaaaacccgcgaaaaccgaccgtaaacaaaaactacaaacccaccccgcaacccgaacaaccgaaacaccgcaaaaaaacaacgacctaacgaaaccacccgaactccctccgcgcccccgaaccaaaaaaccgcaaaaaaactccgcccgcccgcccgctcaccgctcactcgctcacccgctcaccttcaattcctacgaatccataactacccgaaaccgaaacgcgaaactctaaaaattatctcgccgcaacctaaaaaaaaacgcaaaattcaactcccctaacactcgaaactctaacgccccgaacccaacgaaaaaaacgaaatcgcgcgcgattaactatcgaaaaaaaaaacgaacctatataacgaaaatcgtactataataaaacaaaaacgacgaaaacccgaaaataaaaactacgaaaaccgcccgaaaaaatccgaactaaaaaaaaaacctccgccgaaaaatacaactaaaaaaaaaaatcacactaaaaaacgactatctaa

SEQ ID NO: 10743 - DNA, 535 bp, Artificial Sequence
  chemically treated genomic DNA (Homo sapiens) CpG-island No: 10743
tgggtttttttagtagggttcgcggagatcggtcgtgagtagaggttgtaggtttatttcgtaattcgagtagtcggggtatcgtagggaaatagcggtttagcgaagttattcgagtttttttcgcgttttcgggttaaaaggtcgtaaaggaatttcgttcgttcgttcgtttatcgtttattcgtttattcgtttatttttaatttttgcgagtttatggttgttcgaggtcgggacgcggggttttggggattgtttcgtcgtagtttaaaggaagacgtagaatttagtttttttagtattcggagttttagcgtttcgggtttagcgggaggggcggggtcgcgcgcgattggttgtcggagggagaggcgggtttgtgtggcggggatcgtgttgtaatggagtaggggcggcggggattcggaggtgagggttgcgagggtcgttcgggagggttcgggttgggaaaagggttttcgtcggagagtgtagttggaaaaggaggttatattgggaaacggttgtttga

SEQ ID NO: 10744 - DNA, 535 bp, Artificial Sequence
  chemically treated genomic DNA (Homo sapiens) CpG-island No: 10744
tcaaacaaccgtttcccaatataacctccttttccaactacactctccgacgaaaacccttttcccaacccgaaccctcccgaacgaccctcgcaaccctcacctccgaatccccgccgcccctactccattacaacacgatccccgccacacaaacccgcctctccctccgacaaccaatcgcgcgcgaccccgcccctcccgctaaacccgaaacgctaaaactccgaatactaaaaaaactaaattctacgtcttcctttaaactacgacgaaacaatccccaaaaccccgcgtcccgacctcgaacaaccataaactcgcaaaaattaaaaataaacgaataaacgaataaacgataaacgaacgaacgaacgaaattcctttacgaccttttaacccgaaaacgcgaaaaaaactcgaataacttcgctaaaccgctatttccctacgataccccgactactcgaattacgaaataaacctacaacctctactcacgaccgatctccgcgaaccctactaaaaaaaccca

SEQ ID NO: 10745 - DNA, 710 bp, Artificial Sequence
  chemically treated genomic DNA (Homo sapiens) CpG-island No: 10745
ggcgtaacgtttcgtcgttggcgcgggggtggagatttgtatgtgcgaagtcgggaagagggggaattatttttcgaaaatttcggtcgtcgtttttttaggtcgggagagtcggttcgcgcgtttttaaaagttttttagcggtcggttttttttacgttattcgtattttttcgttcgtttttgaattttaaattatattcggaagaataatttggaggagggggattttttaggagttagcggtttttttacgttgttagtcgttatttttcggttatcgtcgttttttgcgttttcgaagtttattttaagttttcgttttttcgatttttttttaagttagtcgtcgtagtagcgtcgggggcgtatgcgtgggggtcggcggggagcgtgcgcggggataggtaggggcggggcgttgggggcggtcgcgcgcgcggcggtcgcgaggtcgtttcgtttacgtttcgggtgagggttgttgcgtcgggtttacgttagtcgcgggaaatttttttttcgttaggttgttcgtttttcggttgggttagtattcggtttttttcgtttcgttttttgtttttggttttcgtacggtggacggcgacgttgggtgattcggggtgtaagaatttaggggttgggaaggtgtgagtcgtaaatttagcggagggcgggaagaaggaggaggtttttagggtggtcgg

SEQ ID NO: 10746 - DNA, 710 bp, Artificial Sequence
  chemically treated genomic DNA (Homo sapiens) CpG-island No: 10746
ccgaccaccctaaaaacctcctccttcttcccgccctccgctaaatttacgactcacaccttcccaacccctaaattcttacaccccgaatcacccaacgtcgccgtccaccgtacgaaaaccaaaaacaaaaaacgaaacgaaaaaaaccgaatactaacccaaccgaaaaacgaacaacctaacgaaaaaaaaatttcccgcgactaacgtaaacccgacgcaacaaccctcacccgaaacgtaaacgaaacgacctcgcgaccgccgcgcgcgcgaccgcccccaacgccccgcccctacctatccccgcgcacgctccccgccgacccccacgcatacgcccccgacgctactacgacgactaacttaaaaaaaaatcgaaaaaacgaaaacttaaaataaacttcgaaaacgcaaaaaacgacgataaccgaaaaataacgactaacaacgtaaaaaaaccgctaactcctaaaaaatccccctcctccaaattattcttccgaatataatttaaaattcaaaaacgaacgaaaaaatacgaataacgtaaaaaaaaccgaccgctaaaaaacttttaaaaacgcgcgaaccgactctcccgacctaaaaaaacgacgaccgaaattttcgaaaaataattccccctcttcccgacttcgcacatacaaatctccacccccgcgccaacgacgaaacgttacgcc

SEQ ID NO: 10747 - DNA, 710 bp, Artificial Sequence
  chemically treated genomic DNA (Homo sapiens) CpG-island No: 10747
tcgattattttagaggtttttttttttttttcgtttttcgttgggtttgcggtttatatttttttaatttttgaatttttgtatttcgggttatttagcgtcgtcgtttatcgtacgggagttaggggtagggggcggagcggggagagtcgagtgttggtttagtcgagaggcgagtagtttggcgggaggggaatttttcgcggttgacgtaggttcgacgtagtaatttttattcggagcgtgggcggggcgatttcgcggtcgtcgcgcgcgcgatcgtttttagcgtttcgtttttgtttgttttcgcgtacgtttttcgtcggtttttacgtatacgttttcggcgttgttgcggcggttggtttgggagggggtcgagggagcgggagtttggggtgggtttcgggagcgtagggaacggcggtagtcgggaggtgacggttagtagcgtgagaaggtcgttggtttttgagaaattttttttttttaggttgttttttcgagtgtggtttaaagtttaggagcgggcgggagggtgcggatgacgtagagagggtcggtcgttggggagtttttgggggcgcgcgggtcgattttttcggtttgggagggcgacggtcggggttttcgagaggtggtttttttttttttcgatttcgtatatgtaaatttttattttcgcgttagcggcgggacgttgcgtt

SEQ ID NO: 10748 - DNA, 710 bp, Artificial Sequence
  chemically treated genomic DNA (Homo sapiens) CpG-island No: 10748
aacgcaacgtcccgccgctaacgcgaaaataaaaatttacatatacgaaatcgaaaaaaaaaaaaaccacctctcgaaaaccccgaccgtcgccctcccaaaccgaaaaaatcgacccgcgcgcccccaaaaactccccaacgaccgaccctctctacgtcatccgcaccctcccgcccgctcctaaactttaaaccacactcgaaaaaacaacctaaaaaaaaaaaatttctcaaaaaccaacgaccttctcacgctactaaccgtcacctcccgactaccgccgttccctacgctcccgaaacccaccccaaactcccgctccctcgaccccctcccaaaccaaccgccgcaacaacgccgaaaacgtatacgtaaaaaccgacgaaaaacgtacgcgaaaacaaacaaaaacgaaacgctaaaaacgatcgcgcgcgcgacgaccgcgaaatcgccccgcccacgctccgaataaaaattactacgtcgaacctacgtcaaccgcgaaaaattcccctcccgccaaactactcgcctctcgactaaaccaacactcgactctccccgctccgccccctacccctaactcccgtacgataaacgacgacgctaaataacccgaaatacaaaaattcaaaaattaaaaaaatataaaccgcaaacccaacgaaaaacgaaaaaaaaaaaaaaacctctaaaataatcga

SEQ ID NO: 10749 - DNA, 875 bp, Artificial Sequence
  chemically treated genomic DNA (Homo sapiens) CpG-island No: 10749
agtcgttagttttttggtcgcgtagttttcgcggacggtcgggcgcgatgtattttcgtagaagaggcgttgcggcggcgaggattggtcggcgcgattcgagtgcgcgcgttttatcgttatttttattcgtttgttagtcggttttttcggtcgtcgttatgtttttttttttttttttttttagggagacgtacgaggaggatcgggagtacgagagttaggttaagcgttttaagatcgaggagggggagatcgattattcggtcgaggaaggcgagaatcgtcgggaagcgacgtttcggggcggggcgatggcggcggcggcggcgcgagttttttttagtcggtaataaagcgcggtttttttgttcgttgtgtttggttgtttttcgggaagtagggtttcggtgcggggtttttcgtttgttttagttagtttttttcgttgcgtcgattcgtttggggaagcgtttatttttttttttggggttcgtattttggtttttatttgtttttcgtatttcgattgcgaattcggcgtcgttttggtcgtaggtttcgtagcgagtttattgtcgggttttgaatttggggagggtcgcggcgcggcggcggcggcggggaggcgtcgttttcgttttggggggtttcgcggttcggggagttttttgttagtttaatttttcgggttcggggttagcgtcgggattatcggttttttttagtttttttgttcgtagtagtcgcgcgttggttattatttcgggatggttgcgtcggttttatcgggagtttttttcgtttcggttttatggagattcgtaattaaataatagattatgttttggcgtttatatgttagtttttttgaa

SEQ ID NO: 10750 - DNA, 875 bp, Artificial Sequence
  chemically treated genomic DNA (Homo sapiens) CpG-island No: 10750
ttcaaaaaaactaacatataaacgccaaaacataatctattatttaattacgaatctccataaaaccgaaacgaaaaaaactcccgataaaaccgacgcaaccatcccgaaataataaccaacgcgcgactactacgaacaaaaaaactaaaaaaaaccgataatcccgacgctaaccccgaacccgaaaaattaaactaacaaaaaactccccgaaccgcgaaaccccccaaaacgaaaacgacgcctccccgccgccgccgccgcgccgcgaccctccccaaattcaaaacccgacaataaactcgctacgaaacctacgaccaaaacgacgccgaattcgcaatcgaaatacgaaaaacaaataaaaaccaaaatacgaaccccaaaaaaaaaaataaacgcttccccaaacgaatcgacgcaacgaaaaaaactaactaaaacaaacgaaaaaccccgcaccgaaaccctacttcccgaaaaacaaccaaacacaacgaacaaaaaaaccgcgctttattaccgactaaaaaaaactcgcgccgccgccgccgccatcgccccgccccgaaacgtcgcttcccgacgattctcgccttcctcgaccgaataatcgatctccccctcctcgatcttaaaacgcttaacctaactctcgtactcccgatcctcctcgtacgtctccctaaaaaaaaaaaaaaaaaaaaacataacgacgaccgaaaaaaccgactaacaaacgaataaaaataacgataaaacgcgcgcactcgaatcgcgccgaccaatcctcgccgccgcaacgcctcttctacgaaaatacatcgcgcccgaccgtccgcgaaaactacgcgaccaaaaaactaacgact

SEQ ID NO: 10751 - DNA, 875 bp, Artificial Sequence
  chemically treated genomic DNA (Homo sapiens) CpG-island No: 10751
tttaagggaattagtatgtgaacgttaaggtataatttgttatttaattacgggtttttataggatcgaggcggagagagttttcggtagaatcgacgtaattatttcgggatggtgattaacgcgcggttgttgcgggtagagggattgaagagaatcggtggtttcgacgttggtttcgagttcgaggagttaaattaataaagagtttttcgagtcgcgaaattttttagagcggaagcgacgttttttcgtcgtcgtcgtcgcgtcgcgattttttttaagtttagggttcggtagtggattcgttgcggggtttgcggttaggacggcgtcgggttcgtagtcgggatgcgggaaataggtagaggttagaatacgagttttaaagagaagagtgggcgtttttttaaacgggtcggcgtagcggaaaaggttaattgaagtaagcgggaggtttcgtatcgaggttttgtttttcggggagtagttaggtatagcggataggggggtcgcgttttgttatcggttgagagaagttcgcgtcgtcgtcgtcgttatcgtttcgtttcggggcgtcgtttttcggcggttttcgtttttttcggtcgagtagtcgattttttttttttcggttttgagacgtttggtttggttttcgtattttcggtttttttcgtacgtttttttgggggaggaagaggaggaggatatggcggcggtcggagggatcggttggtaggcgggtgggggtggcggtggggcgcgcgtattcggatcgcgtcggttagttttcgtcgtcgtagcgttttttttgcgagggtatatcgcgttcggtcgttcgcggggattgcgcggttaggagattggcggtt

SEQ ID NO: 10752 - DNA, 875 bp, Artificial Sequence
  chemically treated genomic DNA (Homo sapiens) CpG-island No: 10752
aaccgccaatctcctaaccgcgcaatccccgcgaacgaccgaacgcgatataccctcgcaaaaaaaacgctacgacgacgaaaactaaccgacgcgatccgaatacgcgcgccccaccgccacccccacccgcctaccaaccgatccctccgaccgccgccatatcctcctcctcttcctcccccaaaaaaacgtacgaaaaaaaccgaaaatacgaaaaccaaaccaaacgtctcaaaaccgaaaaaaaaaaaatcgactactcgaccgaaaaaaacgaaaaccgccgaaaaacgacgccccgaaacgaaacgataacgacgacgacgacgcgaacttctctcaaccgataacaaaacgcgacccccctatccgctatacctaactactccccgaaaaacaaaacctcgatacgaaacctcccgcttacttcaattaaccttttccgctacgccgacccgtttaaaaaaacgcccactcttctctttaaaactcgtattctaacctctacctatttcccgcatcccgactacgaacccgacgccgtcctaaccgcaaaccccgcaacgaatccactaccgaaccctaaacttaaaaaaaatcgcgacgcgacgacgacgacgaaaaaacgtcgcttccgctctaaaaaatttcgcgactcgaaaaactctttattaatttaactcctcgaactcgaaaccaacgtcgaaaccaccgattctcttcaatccctctacccgcaacaaccgcgcgttaatcaccatcccgaaataattacgtcgattctaccgaaaactctctccgcctcgatcctataaaaacccgtaattaaataacaaattataccttaacgttcacatactaattcccttaaa

SEQ ID NO: 10753 - DNA, 626 bp, Artificial Sequence
  chemically treated genomic DNA (Homo sapiens) CpG-island No: 10753
ttgtggttggggtcggttaagtcgaatatcggttatacgtaagcggcggcgggtgtggttggtgtgattaagatggtgatggcgatgcggtacgggtagttgttacgtacgttgtacgtggaatcgtcgttcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgagggtttttgggttgggcggatcggatttgggggggtttgggggtcggatcggggttggtgttttcgggttaggtgggtta

SEQ ID NO: 10754 - DNA, 626 bp, Artificial Sequence
  chemically treated genomic DNA (Homo sapiens) CpG-island No: 10754
taacccacctaacccgaaaacaccaaccccgatccgacccccaaacccccccaaatccgatccgcccaacccaaaaaccctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgaacgacgattccacgtacaacgtacgtaacaactacccgtaccgcatcgccatcaccatcttaatcacaccaaccacacccgccgccgcttacgtataaccgatattcgacttaaccgaccccaaccacaa

SEQ ID NO: 10755 - DNA, 626 bp, Artificial Sequence
  chemically treated genomic DNA (Homo sapiens) CpG-island No: 10755
tggtttatttggttcggaaatattaatttcgattcggtttttaagtttttttagattcggttcgtttaatttagaagtttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggacggcgattttacgtgtaacgtgcgtggtagttgttcgtgtcgtatcgttattattattttgattatattagttatattcgtcgtcgtttgcgtatgatcgatgttcgatttgatcgattttaattataa

SEQ ID NO: 10756 - DNA, 626 bp, Artificial Sequence
  chemically treated genomic DNA (Homo sapiens) CpG-island No: 10756
ttataattaaaatcgatcaaatcgaacatcgatcatacgcaaacgacgacgaatataactaatataatcaaaataataataacgatacgacacgaacaactaccacgcacgttacacgtaaaatcgccgtccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaaacttctaaattaaacgaaccgaatctaaaaaaacttaaaaaccgaatcgaaattaatatttccgaaccaaataaacca

SEQ ID NO: 10757 - DNA, 743 bp, Artificial Sequence
  chemically treated genomic DNA (Homo sapiens) CpG-island No: 10757
  misc_feature (219)..(219): n is either a, c, g or t
  misc_feature (346)..(346): n is either a, c, g or t
  misc_feature (568)..(568): n is either a, c, g or t
tattttgttttcgggttttaagcggcggtttgtattggttagcgtttttggttttgcggtaggcgtttgggcgtttcgagaatgggcgtcgacgtttgggaggtcgtagagatttgtacgggtttggggatttacgggtggttttcgcggcgcggtagcggttaggcgcggaagtttttttggtattgggtttcgcgttcgaagggagcgtcggagggnttggtattcgttgcgcggtcggtagttgggttcgggtcgttgtattttttaggttcggtaattttgtcgtattatcgagttcgcggggtcggaggtggagtcggagtttaggttcgggttcggtttngtttcggtcggggttcgtcgtcggttcgcgttcgtcggtaggtttaggcgttggtttcgttgttcgggtaattgtatttaattcgttttgggttggttgcgtttttatggtaatcgcgcgcgtcgaggggggcgcgagcgtcggttgcgtttgttgttgcggcggcggtggttgcggcggggcgttcgggtgttcggtggttttcgagtatttggtgaaaanttagcggtatagcgatgttcgttttgtttaattggttttagaagcgggcgatgtagtaggttttcgtgatgtacggttacgttatgatgttagttgaaaagtcggttttttttttttttttgtggttttaaagtaagtttttataatttttttttagttttcgattttgatcggt

SEQ ID NO: 10758 - DNA, 743 bp, Artificial Sequence
  chemically treated genomic DNA (Homo sapiens) CpG-island No: 10758
  misc_feature (176)..(176): n is either a, c, g or t
  misc_feature (398)..(398): n is either a, c, g or t
  misc_feature (525)..(525): n is either a, c, g or t
accgatcaaaatcgaaaactaaaaaaaaattataaaaacttactttaaaaccacaaaaaaaaaaaaaaaaccgacttttcaactaacatcataacgtaaccgtacatcacgaaaacctactacatcgcccgcttctaaaaccaattaaacaaaacgaacatcgctataccgctaanttttcaccaaatactcgaaaaccaccgaacacccgaacgccccgccgcaaccaccgccgccgcaacaacaaacgcaaccgacgctcgcgcccccctcgacgcgcgcgattaccataaaaacgcaaccaacccaaaacgaattaaatacaattacccgaacaacgaaaccaacgcctaaacctaccgacgaacgcgaaccgacgacgaaccccgaccgaaacnaaaccgaacccgaacctaaactccgactccacctccgaccccgcgaactcgataatacgacaaaattaccgaacctaaaaaatacaacgacccgaacccaactaccgaccgcgcaacgaataccaanccctccgacgctcccttcgaacgcgaaacccaataccaaaaaaacttccgcgcctaaccgctaccgcgccgcgaaaaccacccgtaaatccccaaacccgtacaaatctctacgacctcccaaacgtcgacgcccattctcgaaacgcccaaacgcctaccgcaaaaccaaaaacgctaaccaatacaaaccgccgcttaaaacccgaaaacaaaata

SEQ ID NO: 10759 - DNA, 743 bp, Artificial Sequence
  chemically treated genomic DNA (Homo sapiens) CpG-island No: 10759
  misc_feature (176)..(176): n is either a, c, g or t
  misc_feature (398)..(398): n is either a, c, g or t
  misc_feature (525)..(525): n is either a, c, g or t
gtcggttaggatcggaggttgaaggaagattatagagatttgttttagaattataagaagaaagaggaggtcggttttttagttagtattatggcgtggtcgtgtattacgagggtttgttgtatcgttcgtttttggaattagttggataaagcggatatcgttgtgtcgttggntttttattaagtattcggaggttatcgagtattcgggcgtttcgtcgtagttatcgtcgtcgtagtagtaggcgtagtcggcgttcgcgtttttttcggcgcgcgcggttgttatagagacgtagttagtttagggcgagttggatgtagttgttcgggtaacggggttagcgtttgggtttatcggcgagcgcgagtcggcggcgggtttcggtcggagtngggtcgggttcgggtttgggtttcggttttattttcggtttcgcggattcggtgatgcggtaggattatcgagtttggaaggtgtagcggttcgagtttagttgtcggtcgcgtagcgaatattagntttttcgacgtttttttcgagcgcgagatttagtattagaaggattttcgcgtttggtcgttgtcgcgtcgcggggattattcgtggatttttaagttcgtgtagatttttgcggttttttaggcgtcggcgtttattttcggggcgtttaagcgtttgtcgtagagttaggagcgttggttagtgtaggtcgtcgtttgaggttcgggagtaggatg

SEQ ID NO: 10760 - DNA, 743 bp, Artificial Sequence
  chemically treated genomic DNA (Homo sapiens) CpG-island No: 10760
  misc_feature (219)..(219): n is either a, c, g or t
  misc_feature (346)..(346): n is either a, c, g or t
  misc_feature (568)..(568): n is either a, c, g or t
catcctactcccgaacctcaaacgacgacctacactaaccaacgctcctaactctacgacaaacgcttaaacgccccgaaaataaacgccgacgcctaaaaaaccgcaaaaatctacacgaacttaaaaatccacgaataatccccgcgacgcgacaacgaccaaacgcgaaaatccttctaatactaaatctcgcgctcgaaaaaaacgtcgaaaaanctaatattcgctacgcgaccgacaactaaactcgaaccgctacaccttccaaactcgataatcctaccgcatcaccgaatccgcgaaaccgaaaataaaaccgaaacccaaacccgaacccgacccnactccgaccgaaacccgccgccgactcgcgctcgccgataaacccaaacgctaaccccgttacccgaacaactacatccaactcgccctaaactaactacgtctctataacaaccgcgcgcgccgaaaaaaacgcgaacgccgactacgcctactactacgacgacgataactacgacgaaacgcccgaatactcgataacctccgaatacttaataaaaanccaacgacacaacgatatccgctttatccaactaattccaaaaacgaacgatacaacaaaccctcgtaatacacgaccacgccataatactaactaaaaaaccgacctcctctttcttcttataattctaaaacaaatctctataatcttccttcaacctccgatcctaaccgac

SEQ ID NO: 10761 - DNA, 607 bp, Artificial Sequence
  chemically treated genomic DNA (Homo sapiens) CpG-island No: 10761
  misc_feature (1)..(1): n is either a, c, g or t
  misc_feature (59)..(59): n is either a, c, g or t
  misc_feature (125)..(125): n is either a, c, g or t
  misc_feature (299)..(299): n is either a, c, g or t
  misc_feature (354)..(354): n is either a, c, g or t
  misc_feature (495)..(495): n is either a, c, g or t
  misc_feature (523)..(523): n is either a, c, g or t
  misc_feature (536)..(536): n is either a, c, g or t
  misc_feature (598)..(598): n is either a, c, g or t
nagtcggagttagttcgttttttttttttagcgagtattcggggagagttgttttaggnagagtttgtagagtttttcgattatcggtcgtaaacgtttttgggagcgtagtttgttgcgagcgntcgaagggtgagacgtacggcgttttcgagttttcggcgagggtgtttgggacgcgtttttttttgcggttgcggcggcgtatagatttcggtcgagcgaggcgacgtgaggagaggtggttataggtttaagttatggcgtagagaaggggtcgggcggtgtggtcgtagggnttcgcggatcgggttcgagttttttttttgtcggcgttatagtgtagtcggttantttagtagggttgggaggttattatttttagcggagatcgagtattgttgttttcgtcgttgttcgcgaggatgtagtagtcgtcgtcgttatcgtttttttttttgggaagcgattttatttttttttgtagttttcggnttttcgtcgttgttcgcgaatgatgttngtagtcgttgttngtcgtcgtttttgtttttgttgtagggaagcggttttatttttttatgttgtttagtagtgnagaaaaaaa

SEQ ID NO: 10762 - DNA, 607 bp, Artificial Sequence
  chemically treated genomic DNA (Homo sapiens) CpG-island No: 10762
  misc_feature (10)..(10): n is either a, c, g or t
  misc_feature (72)..(72): n is either a, c, g or t
  misc_feature (85)..(85): n is either a, c, g or t
  misc_feature (113)..(113): n is either a, c, g or t
  misc_feature (254)..(254): n is either a, c, g or t
  misc_feature (309)..(309): n is either a, c, g or t
  misc_feature (483)..(483): n is either a, c, g or t
  misc_feature (549)..(549): n is either a, c, g or t
  misc_feature (607)..(607): n is either a, c, g or t
tttttttctncactactaaacaacataaaaaaataaaaccgcttccctacaacaaaaacaaaaacgacgacnaacaacgactacnaacatcattcgcgaacaacgacgaaaanccgaaaactacaaaaaaaaataaaatcgcttcccaaaaaaaaaaacgataacgacgacgactactacatcctcgcgaacaacgacgaaaacaacaatactcgatctccgctaaaaataataacctcccaaccctactaaantaaccgactacactataacgccgacaaaaaaaaaactcgaacccgatccgcgaanccctacgaccacaccgcccgaccccttctctacgccataacttaaacctataaccacctctcctcacgtcgcctcgctcgaccgaaatctatacgccgccgcaaccgcaaaaaaaaacgcgtcccaaacaccctcgccgaaaactcgaaaacgccgtacgtctcacccttcgancgctcgcaacaaactacgctcccaaaaacgtttacgaccgataatcgaaaaactctacaaactctncctaaaacaactctccccgaatactcgctaaaaaaaaaaaacgaactaactccgactn

SEQ ID NO: 10763 - DNA, 607 bp, Artificial Sequence
  chemically treated genomic DNA (Homo sapiens) CpG-island No: 10763
  misc_feature (10)..(10): n is either a, c, g or t
  misc_feature (72)..(72): n is either a, c, g or t
  misc_feature (85)..(85): n is either a, c, g or t
  misc_feature (113)..(113): n is either a, c, g or t
  misc_feature (254)..(254): n is either a, c, g or t
  misc_feature (309)..(309): n is either a, c, g or t
  misc_feature (483)..(483): n is either a, c, g or t
  misc_feature (549)..(549): n is either a, c, g or t
  misc_feature (607)..(607): n is either a, c, g or t
tttttttttntattgttgagtagtataaaagggtggggtcgtttttttgtagtaaaagtagaggcggcggtnggtagcggttgtnagtattattcgcgggtagcggcggagantcgagagttgtagaaaagggtggggtcgttttttaggagaagaggcggtggcggcggcggttgttgtattttcgcgggtagcggcggaggtagtaatgttcggttttcgttggaggtgatggttttttagttttgttaggntggtcggttgtattatgacgtcggtaggaaggagattcgagttcggttcgcgganttttgcggttatatcgttcggttttttttttgcgttatggtttaagtttgtggttatttttttttacgtcgtttcgttcgatcgaggtttgtgcgtcgtcgtagtcgtagggaggggcgcgttttagatattttcgtcggggattcgggaacgtcgtgcgttttatttttcggncgttcgtagtagattgcgtttttaaaggcgtttgcgatcggtaatcgagggattttatagattttntttaggatagtttttttcgggtgttcgttgagggaggagggcgaattagtttcggttn

SEQ ID NO: 10764 - DNA, 607 bp, Artificial Sequence
  chemically treated genomic DNA (Homo sapiens) CpG-island No: 10764
  misc_feature (1)..(1): n is either a, c, g or t
  misc_feature (59)..(59): n is either a, c, g or t
  misc_feature (125)..(125): n is either a, c, g or t
  misc_feature (299)..(299): n is either a, c, g or t
  misc_feature (354)..(354): n is either a, c, g or t
  misc_feature (495)..(495): n is either a, c, g or t
  misc_feature (523)..(523): n is either a, c, g or t
  misc_feature (536)..(536): n is either a, c, g or t
  misc_feature (598)..(598): n is either a, c, g or t
naaccgaaactaattcgccctcctccctcaacgaacacccgaaaaaaactatcctaaanaaaatctataaaatccctcgattaccgatcgcaaacgcctttaaaaacgcaatctactacgaacgnccgaaaaataaaacgcacgacgttcccgaatccccgacgaaaatatctaaaacgcgcccctccctacgactacgacgacgcacaaacctcgatcgaacgaaacgacgtaaaaaaaaataaccacaaacttaaaccataacgcaaaaaaaaaaccgaacgatataaccgcaaaantccgcgaaccgaactcgaatctccttcctaccgacgtcataatacaaccgaccancctaacaaaactaaaaaaccatcacctccaacgaaaaccgaacattactacctccgccgctacccgcgaaaatacaacaaccgccgccgccaccgcctcttctcctaaaaaacgaccccacccttttctacaactctcgantctccgccgctacccgcgaataatactnacaaccgctaccnaccgccgcctctacttttactacaaaaaaacgaccccacccttttatactactcaacaatanaaaaaaaaa

SEQ ID NO: 10765 - DNA, 627 bp, Artificial Sequence
  chemically treated genomic DNA (Homo sapiens) CpG-island No: 10765
gatatcggggtttttttcgtttattttcgttagggtattattttttttatcggttcgatttcgcgtttcgaggtttcgcggggttaggttgtacgggaggcggagttcggagttcggagttcggggcggggtcggagatgagtttgtaggcggggggttgtgcgagtgcgcggggacgggggttgttgttttcgagtcgagagttttggtagcggggttttgtgggcggagacgttttttcgagtttgggtattttcggagtgggattttcgggtcggagtttcgtcgtcggtttatttagttttagcgggtcgtttttgtttttgggtcgggtggggagttttttattttagagatttttcgattttttgtttttcgcggcgtaggggcgttttttttgcggcgtcgcggggtcgttttttttttttttcgggcggttgtagtaggggcgcgggagttcgcggattgcggggttgcggtcgtttttgttttgtgagttttcgtagttgggaagaaaaaggagaggagggaagagggaaaggtggggaaggggacgtcgcgggagattgggaagtggttgtcgtagggaggagttaggtttcgagtgaagtttgtttgtaagaaggg

SEQ ID NO: 10766 - DNA, 627 bp, Artificial Sequence
  chemically treated genomic DNA (Homo sapiens) CpG-island No: 10766
cccttcttacaaacaaacttcactcgaaacctaactcctccctacgacaaccacttcccaatctcccgcgacgtccccttccccacctttccctcttccctcctctcctttttcttcccaactacgaaaactcacaaaacaaaaacgaccgcaaccccgcaatccgcgaactcccgcgcccctactacaaccgcccgaaaaaaaaaaaaaacgaccccgcgacgccgcaaaaaaaacgcccctacgccgcgaaaaacaaaaaatcgaaaaatctctaaaataaaaaactccccacccgacccaaaaacaaaaacgacccgctaaaactaaataaaccgacgacgaaactccgacccgaaaatcccactccgaaaatacccaaactcgaaaaaacgtctccgcccacaaaaccccgctaccaaaactctcgactcgaaaacaacaacccccgtccccgcgcactcgcacaaccccccgcctacaaactcatctccgaccccgccccgaactccgaactccgaactccgcctcccgtacaacctaaccccgcgaaacctcgaaacgcgaaatcgaaccgataaaaaaaataataccctaacgaaaataaacgaaaaaaaccccgatatc

SEQ ID NO: 10767 - DNA, 627 bp, Artificial Sequence
  chemically treated genomic DNA (Homo sapiens) CpG-island No: 10767
ttttttttataagtaggttttattcgaggtttagtttttttttgcggtagttattttttagtttttcgcggcgtttttttttttattttttttttttttttttttttttttttttttttagttgcgggaatttataaagtaggggcgatcgtaatttcgtagttcgcgggttttcgcgtttttgttgtagtcgttcggggaggggagaggacggtttcgcggcgtcgtagaaagggcgtttttacgtcgcgaggggtagggagtcggggggtttttggaatgggaggttttttattcggtttagaggtaaaggcgattcgttgaaattggatgggtcggcggcggaatttcgattcgagagttttatttcgaagatgtttaggttcgggagggcgttttcgtttatagagtttcgttattagggttttcggttcggaaatagtagttttcgttttcgcgtattcgtatagtttttcgtttgtaggtttattttcggtttcgtttcgggtttcgggtttcgggtttcgtttttcgtgtagtttggtttcgcgagatttcgggacgcgggatcgggtcggtgggaaggatagtgttttggcgagggtgggcgaaagaggtttcggtatt

SEQ ID NO: 10768 - DNA, 627 bp, Artificial Sequence
  chemically treated genomic DNA (Homo sapiens) CpG-island No: 10768
aataccgaaacctctttcgcccaccctcgccaaaacactatccttcccaccgacccgatcccgcgtcccgaaatctcgcgaaaccaaactacacgaaaaacgaaacccgaaacccgaaacccgaaacgaaaccgaaaataaacctacaaacgaaaaactatacgaatacgcgaaaacgaaaactactatttccgaaccgaaaaccctaataacgaaactctataaacgaaaacgccctcccgaacctaaacatcttcgaaataaaactctcgaatcgaaattccgccgccgacccatccaatttcaacgaatcgcctttacctctaaaccgaataaaaaacctcccattccaaaaaccccccgactccctacccctcgcgacgtaaaaacgccctttctacgacgccgcgaaaccgtcctctcccctccccgaacgactacaacaaaaacgcgaaaacccgcgaactacgaaattacgatcgcccctactttataaattcccgcaactaaaaaaaaaaaaaaaaaaaaaaaaaaaaaaaaaataaaaaaaaaaacgccgcgaaaaactaaaaaataactaccgcaaaaaaaaactaaacctcgaataaaacctacttataaaaaaaa

SEQ ID NO: 10769 - DNA, 533 bp, Artificial Sequence
  chemically treated genomic DNA (Homo sapiens) CpG-island No: 10769
  misc_feature (87)..(87): n is either a, c, g or t
  misc_feature (338)..(338): n is either a, c, g or t
  misc_feature (360)..(360): n is either a, c, g or t
gtttcgtagggttttttcgttttttttattttttcgcgtatttttagattgttcggcgttttttcgggtcgtacgtacgtaggcgtnttttcgttttttatttgggtcgggttgggttagcgtcgggacgtgattttcgttttcgagtcgcgatacgattttatttttagttcgtttttttgttttcgggatttatatatggtagtttttatttttttttgttcgtttcgagaaatttttggaaagttggaaacgttttcggagggcgttttagtttcgttaaaaaaagttaaagattttttttaaaattttttcggttttcggtttttttttttgtncggcgtttttcggtttttgggnttttattgtttttttcggcggttcgggttgcggggcgtcgggagtttttacggggattagcgtgttttttagagtgcgagtttttttttatttttaggttttttgtataagttagtttatttcgaatcgtacgtttttttaggcgttttttttttcgtaggggttttgtttta

SEQ ID NO: 10770 - DNA, 533 bp, Artificial Sequence
  chemically treated genomic DNA (Homo sapiens) CpG-island No: 10770
  misc_feature (174)..(174): n is either a, c, g or t
  misc_feature (196)..(196): n is either a, c, g or t
  misc_feature (447)..(447): n is either a, c, g or t
taaaacaaaacccctacgaaaaaaaaaacgcctaaaaaaacgtacgattcgaaataaactaacttatacaaaaaacctaaaaataaaaaaaaactcgcactctaaaaaacacgctaatccccgtaaaaactcccgacgccccgcaacccgaaccgccgaaaaaaacaataaaancccaaaaaccgaaaaacgccgnacaaaaaaaaaaaccgaaaaccgaaaaaattttaaaaaaaatctttaactttttttaacgaaactaaaacgccctccgaaaacgtttccaactttccaaaaatttctcgaaacgaacaaaaaaaaataaaaactaccatatataaatcccgaaaacaaaaaaacgaactaaaaataaaatcgtatcgcgactcgaaaacgaaaatcacgtcccgacgctaacccaacccgacccaaataaaaaacgaaaanacgcctacgtacgtacgacccgaaaaaacgccgaacaatctaaaaatacgcgaaaaaataaaaaaaacgaaaaaaccctacgaaac

SEQ ID NO: 10771 - DNA, 533 bp, Artificial Sequence
  chemically treated genomic DNA (Homo sapiens) CpG-island No: 10771
  misc_feature (174)..(174): n is either a, c, g or t
  misc_feature (196)..(196): n is either a, c, g or t
  misc_feature (447)..(447): n is either a, c, g or t
tggggtagagtttttgcggggaaaggggcgtttgaaaggacgtgcgattcggagtgggttagtttatgtagagagtttgggggtgggaggaagttcgtattttgaaggatacgttgattttcgtggggattttcggcgtttcgtagttcgggtcgtcgagggaggtagtaggantttaggggtcgggaggcgtcgngtagagggaggggtcgggggtcggggaggttttgagggaggtttttggttttttttggcggagttggggcgtttttcggaagcgtttttaattttttagaagtttttcgggacgggtaggagggggtggggattgttatatatagatttcgggagtaggggagcgggttaagagtagaatcgtgtcgcggttcgagagcgagagttacgtttcggcgttagtttagttcgatttaggtgaggggcgggagnacgtttgcgtgcgtgcggttcgggggagcgtcgagtaatttgggggtgcgcgagggagtaagaagggcgaggggattttgcgaagt

SEQ ID NO: 10772 - DNA, 533 bp, Artificial Sequence
  chemically treated genomic DNA (Homo sapiens) CpG-island No: 10772
  misc_feature (87)..(87): n is either a, c, g or t
  misc_feature (338)..(338): n is either a, c, g or t
  misc_feature (360)..(360): n is either a, c, g or t
acttcgcaaaatcccctcgcccttcttactccctcgcgcacccccaaattactcgacgctcccccgaaccgcacgcacgcaaacgtnctcccgcccctcacctaaatcgaactaaactaacgccgaaacgtaactctcgctctcgaaccgcgacacgattctactcttaacccgctcccctactcccgaaatctatatataacaatccccaccccctcctacccgtcccgaaaaacttctaaaaaattaaaaacgcttccgaaaaacgccccaactccgccaaaaaaaaccaaaaacctccctcaaaacctccccgacccccgacccctccctctacncgacgcctcccgacccctaaantcctactacctccctcgacgacccgaactacgaaacgccgaaaatccccacgaaaatcaacgtatccttcaaaatacgaacttcctcccacccccaaactctctacataaactaacccactccgaatcgcacgtcctttcaaacgcccctttccccgcaaaaactctacccca

SEQ ID NO: 10773 - DNA, 798 bp, Artificial Sequence
  chemically treated genomic DNA (Homo sapiens) CpG-island No: 10773
gagattcgcgggattcgttaattggtttgagttaggaatataattagtgtttagttatcgatatttcggcggtcgggagtttttcgttttttgttagttttagacgtacgtgataaattagatcggagtttggcgcgcgtttttgtttttcggttcgggtttttttagtcgggtttcgaggtttatcgttcgttttatatttatttcgtagagttggtttcgttaattgtagagtcgtcgggggtcgggtttagttggatgggcgtcggtttttttttgggtattttggattcgggtaacgcgtttttaatttcggggggagggtagtatttttcgttttttttcgttgcgttgtttcgcgttcgttgcgtaggattaagttcgggtcgcgggtttcggggttgtttttagcgggtgcgtttcgcgcggtttcgttagcgtcgaggggtcggtagcggttttagtggattttcgttttattcgttcgggattcggtttcgcgcgtagagagtcgaaaggttgttttgtaggagcggagcgggttgaacgtgcggttcggtagttcgggatttttttttttttttttttttaattaattagttttttcggttcgggcggtatagtcgcgcgcgtattagagtttagttttagtttttgtcggggaaagtgtcgtcgtcgtcgtgtttttagtcgttttgcgaagcggttttgggagggattggaggtcgggggaggggcggggaaggggaagtttcgttttttattcgggatgcggcgttttttatatttttattcggt

SEQ ID NO: 10774 - DNA, 798 bp, Artificial Sequence
  chemically treated genomic DNA (Homo sapiens) CpG-island No: 10774
accgaataaaaatataaaaaacgccgcatcccgaataaaaaacgaaacttccccttccccgcccctcccccgacctccaatccctcccaaaaccgcttcgcaaaacgactaaaaacacgacgacgacgacactttccccgacaaaaactaaaactaaactctaatacgcgcgcgactataccgcccgaaccgaaaaaactaattaattaaaaaaaaaaaaaaaaaaaaatcccgaactaccgaaccgcacgttcaacccgctccgctcctacaaaacaacctttcgactctctacgcgcgaaaccgaatcccgaacgaataaaacgaaaatccactaaaaccgctaccgacccctcgacgctaacgaaaccgcgcgaaacgcacccgctaaaaacaaccccgaaacccgcgacccgaacttaatcctacgcaacgaacgcgaaacaacgcaacgaaaaaaaacgaaaaatactaccctccccccgaaattaaaaacgcgttacccgaatccaaaatacccaaaaaaaaaccgacgcccatccaactaaacccgacccccgacgactctacaattaacgaaaccaactctacgaaataaatataaaacgaacgataaacctcgaaacccgactaaaaaaacccgaaccgaaaaacaaaaacgcgcgccaaactccgatctaatttatcacgtacgtctaaaactaacaaaaaacgaaaaactcccgaccgccgaaatatcgataactaaacactaattatattcctaactcaaaccaattaacgaatcccgcgaatctc

SEQ ID NO: 10775 - DNA, 798 bp, Artificial Sequence
  chemically treated genomic DNA (Homo sapiens) CpG-island No: 10775
gtcgagtgggagtgtggaaagcgtcgtatttcgggtgggaggcgaggttttttttttttcgtttttttttcggtttttagttttttttagggtcgtttcgtagagcggttaggagtacggcggcggcggtatttttttcggtaggagttggagttgggttttggtgcgcgcgcggttgtgtcgttcgagtcggagggattggttggttgagagagagagaggaagggaatttcgggttgtcgaatcgtacgtttagttcgtttcgtttttgtagggtagtttttcggttttttgcgcgcgaagtcgagtttcgggcgggtggggcgggggtttattgagatcgttatcggtttttcggcgttgacgggatcgcgcggggcgtattcgttgaaggtagtttcggggttcgcggttcggatttggttttgcgtagcgggcgcggggtagcgtagcgggaggaagcgagaggtgttgtttttttttcggagttggaagcgcgttattcgggtttaaaatgtttaagaagaagtcgacgtttatttagttgaattcggttttcgacggttttgtagttaacgggattagttttgcggagtaagtatggggcgggcggtgaatttcggggttcggttggggaggttcgagtcggggagtaggagcgcgcgttaggtttcgatttggtttgttacgtacgtttggggttggtagggggcgagaaattttcggtcgtcgaggtatcggtgattaagtattgattgtgtttttgatttagattagttagcggatttcgcgggtttt

SEQ ID NO: 10776 - DNA, 798 bp, Artificial Sequence
  chemically treated genomic DNA (Homo sapiens) CpG-island No: 10776
aaaacccgcgaaatccgctaactaatctaaatcaaaaacacaatcaatacttaatcaccgatacctcgacgaccgaaaatttctcgccccctaccaaccccaaacgtacgtaacaaaccaaatcgaaacctaacgcgcgctcctactccccgactcgaacctccccaaccgaaccccgaaattcaccgcccgccccatacttactccgcaaaactaatcccgttaactacaaaaccgtcgaaaaccgaattcaactaaataaacgtcgacttcttcttaaacattttaaacccgaataacgcgcttccaactccgaaaaaaaaacaacacctctcgcttcctcccgctacgctaccccgcgcccgctacgcaaaaccaaatccgaaccgcgaaccccgaaactaccttcaacgaatacgccccgcgcgatcccgtcaacgccgaaaaaccgataacgatctcaataaacccccgccccacccgcccgaaactcgacttcgcgcgcaaaaaaccgaaaaactaccctacaaaaacgaaacgaactaaacgtacgattcgacaacccgaaattcccttcctctctctctctcaaccaaccaatccctccgactcgaacgacacaaccgcgcgcgcaccaaaacccaactccaactcctaccgaaaaaaataccgccgccgccgtactcctaaccgctctacgaaacgaccctaaaaaaaactaaaaaccgaaaaaaaaacgaaaaaaaaaaaacctcgcctcccacccgaaatacgacgctttccacactcccactcgac

SEQ ID NO: 10777 - DNA, 931 bp, Artificial Sequence
  chemically treated genomic DNA (Homo sapiens) CpG-island No: 10777
ttgtttcgcgtgtatttacgggaggattcgtagacgttattgtttttttgcgtgtttcggttattttcgggcggtttgtagcggtgcgcggggtggttggggttacgtgtagagttgttcgcggacgcggaatagtagcggtgaagtttttcggttcggcgaattcgtcgtgtttattgttcgtttcggttgtcgtcgttttagtcgtagtcgttgtttcgtcgtcgggggagaggtagtttattgttttttttcgcggcgaaggtgaggagttgtttcggttcggttcgcggggagtttcgggagtcgtacggtgagagcgtaatttagttggcggagttgggggaagttttgtgatttgaggaggggtcgggatcggacgcggttcgttttttgcggtcgtttcggtggcggggttttagaggagggtcggaggttgcgcggggttttaggggcgggcggtacggatgggtagtcgggcggcgcggggattttagttttgcggattttttttttttgcgtattatttttttttcgtattgtttgtttggggttcgcgcgttttttatttcgtagtttaatttgggggtcgtcgtcgtttttcggatggggggcgtttcggcggcggatggtttcgaatttttgttcgggttttcgggttggcgtttggggcggatttattttttttttggggcggcggtcgcggtgtggagttcgcgtcgcgaataagtgttgcgggcgcgagggagcggtttttcggggtcgacgcggacggtaaatttgttcggcgcgttcgtttgttggggttttttcgttgtttttcgggcgcggttcggttgaaattgcgatcgtcggaggcgagcggtttttggattcgtgtagtcggtttatttgtagttatattttgagattaaatatttttttttttttt

SEQ ID NO: 10778 - DNA, 931 bp, Artificial Sequence
  chemically treated genomic DNA (Homo sapiens) CpG-island No: 10778
aaaaaaaaaaaaaatatttaatctcaaaatataactacaaataaaccgactacacgaatccaaaaaccgctcgcctccgacgatcgcaatttcaaccgaaccgcgcccgaaaaacaacgaaaaaaccccaacaaacgaacgcgccgaacaaatttaccgtccgcgtcgaccccgaaaaaccgctccctcgcgcccgcaacacttattcgcgacgcgaactccacaccgcgaccgccgccccaaaaaaaaaataaatccgccccaaacgccaacccgaaaacccgaacaaaaattcgaaaccatccgccgccgaaacgccccccatccgaaaaacgacgacgacccccaaattaaactacgaaataaaaaacgcgcgaaccccaaacaaacaatacgaaaaaaaaataatacgcaaaaaaaaaaaatccgcaaaactaaaatccccgcgccgcccgactacccatccgtaccgcccgcccctaaaaccccgcgcaacctccgaccctcctctaaaaccccgccaccgaaacgaccgcaaaaaacgaaccgcgtccgatcccgacccctcctcaaatcacaaaacttcccccaactccgccaactaaattacgctctcaccgtacgactcccgaaactccccgcgaaccgaaccgaaacaactcctcaccttcgccgcgaaaaaaaacaataaactacctctcccccgacgacgaaacaacgactacgactaaaacgacgacaaccgaaacgaacaataaacacgacgaattcgccgaaccgaaaaacttcaccgctactattccgcgtccgcgaacaactctacacgtaaccccaaccaccccgcgcaccgctacaaaccgcccgaaaataaccgaaacacgcaaaaaaacaataacgtctacgaatcctcccgtaaatacacgcgaaacaa

SEQ ID NO: 10779 - DNA, 931 bp, Artificial Sequence
  chemically treated genomic DNA (Homo sapiens) CpG-island No: 10779
aaaaaaaaaaaaaatgtttagttttaaagtatagttgtaagtggatcggttgtacgggtttagaggtcgttcgttttcgacggtcgtagttttagtcgggtcgcgttcgagaaatagcggagaggttttagtaggcgggcgcgtcggataggtttatcgttcgcgtcggtttcggggaatcgttttttcgcgttcgtagtatttgttcgcggcgcggattttatatcgcggtcgtcgttttaggggaggagtgagttcgttttaggcgttaattcggggattcgggtaagggttcggggttattcgtcgtcggggcgttttttattcggaaagcggcgacggtttttaagttgggttgcggagtgggaggcgcgcgagttttaagtagataatgcgggagaagggtgatgcgtagggaggaggggttcgtaaagttgaggttttcgcgtcgttcggttatttattcgtgtcgttcgtttttgaagtttcgcgtagttttcgatttttttttggggtttcgttatcggagcggtcgtaggggacgggtcgcgttcgatttcgatttttttttaaattataaaattttttttaatttcgttaattaagttgcgtttttatcgtgcggttttcggggtttttcgcgggtcgagtcgagatagttttttattttcgtcgcggagaaagataataggttgtttttttttcggcggcggagtagcggttgcggttaaagcggcggtaatcgaggcgagtaatgggtacggcggattcgtcgagtcgaggggttttatcgttgttgtttcgcgttcgcgaatagttttgtacgtagttttagttatttcgcgtatcgttataagtcgttcgggggtggtcggggtacgtaagaaggtagtaacgtttgcgagttttttcgtgagtatacgcggagtaa

SEQ ID NO: 10780 - DNA, 931 bp, Artificial Sequence
  chemically treated genomic DNA (Homo sapiens) CpG-island No: 10780
ttactccgcgtatactcacgaaaaaactcgcaaacgttactaccttcttacgtaccccgaccacccccgaacgacttataacgatacgcgaaataactaaaactacgtacaaaactattcgcgaacgcgaaacaacaacgataaaacccctcgactcgacgaatccgccgtacccattactcgcctcgattaccgccgctttaaccgcaaccgctactccgccgccgaaaaaaaaacaacctattatctttctccgcgacgaaaataaaaaactatctcgactcgacccgcgaaaaaccccgaaaaccgcacgataaaaacgcaacttaattaacgaaattaaaaaaaattttataatttaaaaaaaaatcgaaatcgaacgcgacccgtcccctacgaccgctccgataacgaaaccccaaaaaaaaatcgaaaactacgcgaaacttcaaaaacgaacgacacgaataaataaccgaacgacgcgaaaacctcaactttacgaacccctcctccctacgcatcacccttctcccgcattatctacttaaaactcgcgcgcctcccactccgcaacccaacttaaaaaccgtcgccgctttccgaataaaaaacgccccgacgacgaataaccccgaacccttacccgaatccccgaattaacgcctaaaacgaactcactcctcccctaaaacgacgaccgcgatataaaatccgcgccgcgaacaaatactacgaacgcgaaaaaacgattccccgaaaccgacgcgaacgataaacctatccgacgcgcccgcctactaaaacctctccgctatttctcgaacgcgacccgactaaaactacgaccgtcgaaaacgaacgacctctaaacccgtacaaccgatccacttacaactatactttaaaactaaacatttttttttttttt

SEQ ID NO: 10781 - DNA, 689 bp, Artificial Sequence
  chemically treated genomic DNA (Homo sapiens) CpG-island No: 10781
gttgcgggttaagtttcgcgtttcgtttttaggtttcgttatgtaggaggtaggtgcgcgtttatcgttttcgtagcgtagttatttttagcggtagtttagcggtttttagcgcgtttagttacgtttatagcgtgcggtttaagtgcgtatagagcgttaagtttagcgcgttttaggcgttcgttttgtattttacgcgcggttttagcggtttcgggttcgaaggtcgcgcgttagtgggcggggacggttattaggttatttaggttttagcgtagtgcgcgtaggagttttagggattcgtttaggtgttgggcgattagtagtaggtcgaagcgcgcggttatcgtttgtattttcggggttaagaggcgcgttgttattttataaggcgcgcggcgcgttgtggtcgaagtttaagtttaaggttatgaggttgtggttatggtgtttgtcgggtcgtttggggtcgtagaaggcgtaggaagtggcgtaggattcgggtttcgacgaagggagaggtcgttttgtagaaagcggattttaggacgagggttgggtttcgtagggtggtgaaggaggtgtcgcggggtaggatgcgtcgtatttgggcggggaagggtttgtgtgtttacgagggcggttggttttggggacgttttaagggttttaagggtagtagtcgt

SEQ ID NO: 10782 - DNA, 689 bp, Artificial Sequence
  chemically treated genomic DNA (Homo sapiens) CpG-island No: 10782
acgactactacccttaaaacccttaaaacgtccccaaaaccaaccgccctcgtaaacacacaaacccttccccgcccaaatacgacgcatcctaccccgcgacacctccttcaccaccctacgaaacccaaccctcgtcctaaaatccgctttctacaaaacgacctctcccttcgtcgaaacccgaatcctacgccacttcctacgccttctacgaccccaaacgacccgacaaacaccataaccacaacctcataaccttaaacttaaacttcgaccacaacgcgccgcgcgccttataaaataacaacgcgcctcttaaccccgaaaatacaaacgataaccgcgcgcttcgacctactactaatcgcccaacacctaaacgaatccctaaaactcctacgcgcactacgctaaaacctaaataacctaataaccgtccccgcccactaacgcgcgaccttcgaacccgaaaccgctaaaaccgcgcgtaaaatacaaaacgaacgcctaaaacgcgctaaacttaacgctctatacgcacttaaaccgcacgctataaacgtaactaaacgcgctaaaaaccgctaaactaccgctaaaaataactacgctacgaaaacgataaacgcgcacctacctcctacataacgaaacctaaaaacgaaacgcgaaacttaacccgcaac

SEQ ID NO: 10783 - DNA, 689 bp, Artificial Sequence
  chemically treated genomic DNA (Homo sapiens) CpG-island No: 10783
gcgattgttgtttttggagtttttggagcgtttttagagttagtcgttttcgtgggtatataggttttttttcgtttagatgcgacgtattttgtttcgcgatattttttttattattttgcgggatttagttttcgttttggagttcgttttttataagacggttttttttttcgtcggagttcggattttgcgttattttttgcgttttttacgattttaggcggttcgataggtattatggttataattttatggttttggatttaggtttcgattataacgcgtcgcgcgttttgtagggtggtaacgcgttttttggtttcgggggtgtaagcggtggtcgcgcgtttcgatttgttgttgatcgtttagtatttggacgagtttttggggtttttgcgcgtattgcgttggggtttggatgatttggtggtcgttttcgtttattggcgcgcggttttcgggttcggagtcgttggagtcgcgcgtggagtgtagggcgagcgtttagaacgcgttggatttggcgttttgtgcgtatttgaatcgtacgttgtgggcgtggttgggcgcgttgggggtcgttgggttgtcgttggaggtggttgcgttgcgggagcggtgggcgcgtatttgttttttgtatggcgaggtttgggggcggggcgcggagtttgattcgtagt

SEQ ID NO: 10784 - DNA, 689 bp, Artificial Sequence
  chemically treated genomic DNA (Homo sapiens) CpG-island No: 10784
actacgaatcaaactccgcgccccgcccccaaacctcgccatacaaaaaacaaatacgcgcccaccgctcccgcaacgcaaccacctccaacgacaacccaacgacccccaacgcgcccaaccacgcccacaacgtacgattcaaatacgcacaaaacgccaaatccaacgcgttctaaacgctcgccctacactccacgcgcgactccaacgactccgaacccgaaaaccgcgcgccaataaacgaaaacgaccaccaaatcatccaaaccccaacgcaatacgcgcaaaaaccccaaaaactcgtccaaatactaaacgatcaacaacaaatcgaaacgcgcgaccaccgcttacacccccgaaaccaaaaaacgcgttaccaccctacaaaacgcgcgacgcgttataatcgaaacctaaatccaaaaccataaaattataaccataatacctatcgaaccgcctaaaatcgtaaaaaacgcaaaaaataacgcaaaatccgaactccgacgaaaaaaaaaaccgtcttataaaaaacgaactccaaaacgaaaactaaatcccgcaaaataataaaaaaaatatcgcgaaacaaaatacgtcgcatctaaacgaaaaaaaacctatatacccacgaaaacgactaactctaaaaacgctccaaaaactccaaaaacaacaatcgc

SEQ ID NO: 10785 - DNA, 573 bp, Artificial Sequence
  chemically treated genomic DNA (Homo sapiens) CpG-island No: 10785
tttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggggtgttattgggtttcgatcgagcgtgtaggagtttcggtgagacgtttgtttacggttagtatcgaggttttttttatttagattcgttttttttttagattatttgtagttaggt

SEQ ID NO: 10786 - DNA, 573 bp, Artificial Sequence
  chemically treated genomic DNA (Homo sapiens) CpG-island No: 10786
acctaactacaaataatctaaaaaaaaaacgaatctaaataaaaaaaacctcgatactaaccgtaaacaaacgtctcaccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaacccaataacaccccgaaactcctacacgctcgatcgaaa

SEQ ID NO: 10787 - DNA, 573 bp, Artificial Sequence
  chemically treated genomic DNA (Homo sapiens) CpG-island No: 10787
gtttggttgtaggtggtttgagggagaagcgggtttgggtagagggagtttcggtattgatcgtgggtaggcgttttatcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcggggtttagtggtatttcgaagtttttatacgttcggtcgggg

SEQ ID NO: 10788 - DNA, 573 bp, Artificial Sequence
  chemically treated genomic DNA (Homo sapiens) CpG-island No: 10788
ccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgaaataccactaaaccccgaccgaacgtataaaaacttcgataaaacgcctacccacgatcaataccgaaactccctctacccaaacccgcttctccctcaaaccacctacaaccaaac

SEQ ID NO: 10789 - DNA, 808 bp, Artificial Sequence
  chemically treated genomic DNA (Homo sapiens) CpG-island No: 10789
ttcgtttcgatttgcgggtcgcgttttcgcgagttgtttgcgggcgcgttgggagtcggttcggggagatgcgagcgtagggagatgcgttttgtttcgggcgtagcgggtaagttgtcgtattttttatttttgttgtttggtttggggttaggagagcggtaattcggggtcggtttcggagttggatatattcggcgttttcggggttagggtttgcgggttttcggcgttgcgttttttcgattcgtttttcgcggcgttcgggtcgcgttttgcggtagttatcgagttgagggtagggcgttttagcgtttttggtttcggtttcgtttcgtagcggtcgtatttcgaggttcggtttcgtatagttgtagtcggtgtttttcggttaagttttcgtttggcgttttcggttttagtttcggtcgttcgtcgttgatttttttttgcgcgcggttgagtcgtttttggacgtttttggcgaagatgttcgttttgatgtcggttatggttgcgggttcggggagttgcgaagagtagagcgcgtagcggggttggcggcggcgcggaggagcgggaggaggagcgggaggaggaggagagggtcgagtaagggaggagcgggagaagcggcggggagtcgcggagcgcggaggggtgagggcggggcgcggcggcgggattagtttaaagcgatagagcgggggcgggatgcgtcgggattggttgtgatatggggagaaggggcgggggaagaaagagaaagaggttaagaaaaagagagggaaaagttagaagttagatt

SEQ ID NO: 10790 - DNA, 808 bp, Artificial Sequence
  chemically treated genomic DNA (Homo sapiens) CpG-island No: 10790
aatctaacttctaacttttccctctctttttcttaacctctttctctttcttcccccgccccttctccccatatcacaaccaatcccgacgcatcccgcccccgctctatcgctttaaactaatcccgccgccgcgccccgccctcacccctccgcgctccgcgactccccgccgcttctcccgctcctcccttactcgaccctctcctcctcctcccgctcctcctcccgctcctccgcgccgccgccaaccccgctacgcgctctactcttcgcaactccccgaacccgcaaccataaccgacatcaaaacgaacatcttcgccaaaaacgtccaaaaacgactcaaccgcgcgcaaaaaaaaatcaacgacgaacgaccgaaactaaaaccgaaaacgccaaacgaaaacttaaccgaaaaacaccgactacaactatacgaaaccgaacctcgaaatacgaccgctacgaaacgaaaccgaaaccaaaaacgctaaaacgccctaccctcaactcgataactaccgcaaaacgcgacccgaacgccgcgaaaaacgaatcgaaaaaacgcaacgccgaaaacccgcaaaccctaaccccgaaaacgccgaatatatccaactccgaaaccgaccccgaattaccgctctcctaaccccaaaccaaacaacaaaaataaaaaatacgacaacttacccgctacgcccgaaacaaaacgcatctccctacgctcgcatctccccgaaccgactcccaacgcgcccgcaaacaactcgcgaaaacgcgacccgcaaatcgaaacgaa

SEQ ID NO: 10791 - DNA, 808 bp, Artificial Sequence
  chemically treated genomic DNA (Homo sapiens) CpG-island No: 10791
aatttggtttttggttttttttttttttttttttggttttttttttttttttttttcgttttttttttttatgttatagttagtttcgacgtatttcgttttcgttttgtcgttttaagttggtttcgtcgtcgcgtttcgtttttattttttcgcgtttcgcggtttttcgtcgtttttttcgttttttttttgttcggtttttttttttttttttcgttttttttttcgttttttcgcgtcgtcgttagtttcgttgcgcgttttgtttttcgtagtttttcggattcgtagttatggtcgatattaagacgggtattttcgttaagaacgtttagaagcgatttaatcgcgcgtaggaaaaggttagcggcgggcggtcggggttggggtcggggacgttaggcgggggtttggtcggagggtatcggttgtagttgtgcggggtcgagtttcggggtgcggtcgttgcggagcggggtcggggttagggacgttgggacgttttgtttttagttcggtgattgtcgtaaggcgcgattcgggcgtcgcggggagcgggtcgggaggacgtagcgtcggggattcgtagattttggtttcggagacgtcggatatgtttagtttcggagtcggtttcgggttgtcgtttttttggttttaagttaggtaatagaagtaggaggtgcggtagtttgttcgttgcgttcggagtagagcgtatttttttgcgttcgtattttttcgggtcggtttttagcgcgttcgtaggtagttcgcggggacgcggttcgtagatcggggcggg

SEQ ID NO: 10792 - DNA, 808 bp, Artificial Sequence
  chemically treated genomic DNA (Homo sapiens) CpG-island No: 10792
cccgccccgatctacgaaccgcgtccccgcgaactacctacgaacgcgctaaaaaccgacccgaaaaaatacgaacgcaaaaaaatacgctctactccgaacgcaacgaacaaactaccgcacctcctacttctattacctaacttaaaaccaaaaaaacgacaacccgaaaccgactccgaaactaaacatatccgacgtctccgaaaccaaaatctacgaatccccgacgctacgtcctcccgacccgctccccgcgacgcccgaatcgcgccttacgacaatcaccgaactaaaaacaaaacgtcccaacgtccctaaccccgaccccgctccgcaacgaccgcaccccgaaactcgaccccgcacaactacaaccgataccctccgaccaaacccccgcctaacgtccccgaccccaaccccgaccgcccgccgctaaccttttcctacgcgcgattaaatcgcttctaaacgttcttaacgaaaatacccgtcttaatatcgaccataactacgaatccgaaaaactacgaaaaacaaaacgcgcaacgaaactaacgacgacgcgaaaaaacgaaaaaaaaaacgaaaaaaaaaaaaaaaaaccgaacaaaaaaaaaacgaaaaaaacgacgaaaaaccgcgaaacgcgaaaaaataaaaacgaaacgcgacgacgaaaccaacttaaaacgacaaaacgaaaacgaaatacgtcgaaactaactataacataaaaaaaaaaaacgaaaaaaaaaaaaaaaaaaaaccaaaaaaaaaaaaaaaaaaaaccaaaaaccaaatt

SEQ ID NO: 10793 - DNA, 504 bp, Artificial Sequence
  chemically treated genomic DNA (Homo sapiens) CpG-island No: 10793
gttgtcgacgttcgttatggttcggtcggtcgggtaggggtttcgtagcgagattagcggcgtttgcggttttttttacggcggagtgagtagttcggggttcggcggcgaattttttttcggtcgcgtcgcgttgttatttttagtttcgtcgcgcgttggtagttgagcgtttggagataatagcggggatttaatgttaatagttaaagcgttaggagttcgggggaggtaggagtcgtcgcgattgttttatttttaagtcgagttttagaggcggcgagaggagtgttaggaagggaggacgcgcgttcgagcgcgtggacggggttgatcggtgggcgcggagatttttgtttggttacgttattttttgttagtcgcggatttcgcgcgttataggaacgtttgttttttattttatttttttttttcgtttttggtggttggggggatttggggatttaagggaatggttgaattggcgtcgtgcgttttttagat

SEQ ID NO: 10794 - DNA, 504 bp, Artificial Sequence
  chemically treated genomic DNA (Homo sapiens) CpG-island No: 10794
atctaaaaaacgcacgacgccaattcaaccattcccttaaatccccaaatccccccaaccaccaaaaacgaaaaaaaaaaataaaataaaaaacaaacgttcctataacgcgcgaaatccgcgactaacaaaaaataacgtaaccaaacaaaaatctccgcgcccaccgatcaaccccgtccacgcgctcgaacgcgcgtcctcccttcctaacactcctctcgccgcctctaaaactcgacttaaaaataaaacaatcgcgacgactcctacctcccccgaactcctaacgctttaactattaacattaaatccccgctattatctccaaacgctcaactaccaacgcgcgacgaaactaaaaataacaacgcgacgcgaccgaaaaaaaattcgccgccgaaccccgaactactcactccgccgtaaaaaaaaccgcaaacgccgctaatctcgctacgaaacccctacccgaccgaccgaaccataacgaacgtcgacaac

SEQ ID NO: 10795 - DNA, 504 bp, Artificial Sequence
  chemically treated genomic DNA (Homo sapiens) CpG-island No: 10795
atttagaagacgtacgacgttaatttagttatttttttgggtttttaaatttttttagttattagagacggaaggagaaggtgaagtggaaaatagacgtttttgtggcgcgcgggattcgcggttgatagagagtagcgtggttaggtagggattttcgcgtttatcggttagtttcgtttacgcgttcgggcgcgcgttttttttttttgatatttttttcgtcgtttttggaattcggtttggagatggggtagtcgcgacggtttttgtttttttcgagtttttagcgttttagttgttgatattgggttttcgttgttgtttttaggcgtttagttgttagcgcgcggcggggttgagagtgatagcgcggcgcggtcgggggaggattcgtcgtcgagtttcgggttgtttatttcgtcgtgggggggatcgtagacgtcgttggtttcgttgcgaggtttttgttcggtcggtcgagttatgacggacgtcggtaat

SEQ ID NO: 10796 - DNA, 504 bp, Artificial Sequence
  chemically treated genomic DNA (Homo sapiens) CpG-island No: 10796
attaccgacgtccgtcataactcgaccgaccgaacaaaaacctcgcaacgaaaccaacgacgtctacgatcccccccacgacgaaataaacaacccgaaactcgacgacgaatcctcccccgaccgcgccgcgctatcactctcaaccccgccgcgcgctaacaactaaacgcctaaaaacaacaacgaaaacccaatatcaacaactaaaacgctaaaaactcgaaaaaaacaaaaaccgtcgcgactaccccatctccaaaccgaattccaaaaacgacgaaaaaaatatcaaaaaaaaaaaacgcgcgcccgaacgcgtaaacgaaactaaccgataaacgcgaaaatccctacctaaccacgctactctctatcaaccgcgaatcccgcgcgccacaaaaacgtctattttccacttcaccttctccttccgtctctaataactaaaaaaatttaaaaacccaaaaaaataactaaattaacgtcgtacgtcttctaaat

SEQ ID NO: 10797 - DNA, 715 bp, Artificial Sequence
  chemically treated genomic DNA (Homo sapiens) CpG-island No: 10797
tttttcgcgttttttcggtagagacgtttcgtaggttcgattgttttaggcgtaatcgttttcgcgcgggggatttgttacgttttcggtttttttagaaacgggcggtttgtttttgtttcgaaaatggggacggggagagggggttgcgcgttttttatttaagatttttgtatttttttttttcgtcgtttttttcgttcgttttcgtcggttttcgtttttcgtcggatttattttggttcgcgttcgcgttggtggcggtggagttttcgtagtttatcgcgtagtcggtcggggaagtcgcgtttcggagttttcggtcgcgggttttgggggcggagatttagacgaagggcggcgtatttcgagcgggaggttgacggggtcgcgaggggttaggaatcgagtgggggtcgtttttttttatcgtcgggagacgcggttcggggcgtagcgggttgcgggttgtcgggcggaaattattcggtatttttcgtttcggtttcgtttcgttcggggattcgtcggatttattcgtcgttttagtaatttcggtattggttaatttttagttttttgcgcgtttcgcggtcggttattggtcgttattacgaggggcgggagtttaaagtgggtttcggggcgagggagcggtaaggggcgtggtcggcgtagcggggtgggggtgtttatttgtttatttttagtattt

SEQ ID NO: 10798 - DNA, 715 bp, Artificial Sequence
  chemically treated genomic DNA (Homo sapiens) CpG-island No: 10798
aaatactaaaaataaacaaataaacacccccaccccgctacgccgaccacgccccttaccgctccctcgccccgaaacccactttaaactcccgcccctcgtaataacgaccaataaccgaccgcgaaacgcgcaaaaaactaaaaattaaccaataccgaaattactaaaacgacgaataaatccgacgaatccccgaacgaaacgaaaccgaaacgaaaaataccgaataatttccgcccgacaacccgcaacccgctacgccccgaaccgcgtctcccgacgataaaaaaaaacgacccccactcgattcctaacccctcgcgaccccgtcaacctcccgctcgaaatacgccgcccttcgtctaaatctccgcccccaaaacccgcgaccgaaaactccgaaacgcgacttccccgaccgactacgcgataaactacgaaaactccaccgccaccaacgcgaacgcgaaccaaaataaatccgacgaaaaacgaaaaccgacgaaaacgaacgaaaaaaacgacgaaaaaaaaaaatacaaaaatcttaaataaaaaacgcgcaaccccctctccccgtccccattttcgaaacaaaaacaaaccgcccgtttctaaaaaaaccgaaaacgtaacaaatcccccgcgcgaaaacgattacgcctaaaacaatcgaacctacgaaacgtctctaccgaaaaaacgcgaaaaa

SEQ ID NO: 10799 - DNA, 715 bp, Artificial Sequence
  chemically treated genomic DNA (Homo sapiens) CpG-island No: 10799
ggatgttgagggtgggtaggtgggtatttttatttcgttgcgtcggttacgttttttgtcgttttttcgtttcggggtttattttaaattttcgtttttcgtaataacgattaatggtcgatcgcgaagcgcgtaggaggttggggattggttagtgtcgaggttgttggggcgacgggtgggttcggcgggttttcgggcggggcggggtcggggcgaggggtgtcgggtggttttcgttcggtagttcgtagttcgttgcgtttcgggtcgcgtttttcggcggtgggagggggcggtttttattcggtttttggtttttcgcggtttcgttagtttttcgttcggggtgcgtcgtttttcgtttgggttttcgtttttaggattcgcggtcgagagtttcggagcgcggttttttcggtcggttgcgcgatgggttgcgggaattttatcgttattagcgcgggcgcgggttaaggtgagttcggcgggaggcgggggtcggcgggggcgggcgggagaggcggcgggaaggaagggtgtagggattttgggtggggggcgcgtagtttttttttttcgtttttattttcgggataggagtagatcgttcgtttttggaaagatcgaaagcgtggtaagtttttcgcgcgggggcggttgcgtttggagtagtcgagtttgcggggcgtttttgtcgagggagcgcggggag

SEQ ID NO: 10800 - DNA, 715 bp, Artificial Sequence
  chemically treated genomic DNA (Homo sapiens) CpG-island No: 10800
ctccccgcgctccctcgacaaaaacgccccgcaaactcgactactccaaacgcaaccgcccccgcgcgaaaaacttaccacgctttcgatctttccaaaaacgaacgatctactcctatcccgaaaataaaaacgaaaaaaaaaaactacgcgccccccacccaaaatccctacacccttccttcccgccgcctctcccgcccgcccccgccgacccccgcctcccgccgaactcaccttaacccgcgcccgcgctaataacgataaaattcccgcaacccatcgcgcaaccgaccgaaaaaaccgcgctccgaaactctcgaccgcgaatcctaaaaacgaaaacccaaacgaaaaacgacgcaccccgaacgaaaaactaacgaaaccgcgaaaaaccaaaaaccgaataaaaaccgccccctcccaccgccgaaaaacgcgacccgaaacgcaacgaactacgaactaccgaacgaaaaccacccgacacccctcgccccgaccccgccccgcccgaaaacccgccgaacccacccgtcgccccaacaacctcgacactaaccaatccccaacctcctacgcgcttcgcgatcgaccattaatcgttattacgaaaaacgaaaatttaaaataaaccccgaaacgaaaaaacgacaaaaaacgtaaccgacgcaacgaaataaaaatacccacctacccaccctcaacatcc

SEQ ID NO: 10801 - DNA, 574 bp, Artificial Sequence
  chemically treated genomic DNA (Homo sapiens) CpG-island No: 10801
  misc_feature (548)..(548): n is either a, c, g or t
  misc_feature (553)..(553): n is either a, c, g or t
  misc_feature (556)..(556): n is either a, c, g or t
  misc_feature (570)..(570): n is either a, c, g or t
gcgaggcggggcggggttgggtcggttgttcgtataaagagagttagcgagttagttcgcggattaggtatttcgggtcgttgggggtcgggcggggcggggcgaggtagggaatatttatttagtagtagtacgttttttttcgtagggagtttggagcgcgagcgggtggagatttcgttgaggatgtaggatttaacgggaagtaaggcgtacggtgaggtcggaggtcggagtcgtagcgcgggagggacggattcggtttcggcgcgtcggggatggggttgtcgggaacgtagtggtcgggttcggcgtcgagttttagcgggtacgggatttcgaggcgttcgcgtaaggtcgggggagttagcgggggttgagggagaggtggagtcgttattaaaggttttgttcgttttcgtcgtcgtttgtcgcggcgttatcgttgttcgacgttataaacgttgtttaaggggtcgttagtgtaagtcgaggataatttcggcggagaagaatcgaaggagtcgatgataaattggtgtttagtngggtnttntgtaaagcgagtanatta

SEQ ID NO: 10802 - DNA, 574 bp, Artificial Sequence
  chemically treated genomic DNA (Homo sapiens) CpG-island No: 10802
  misc_feature (5)..(5): n is either a, c, g or t
  misc_feature (19)..(19): n is either a, c, g or t
  misc_feature (22)..(22): n is either a, c, g or t
  misc_feature (27)..(27): n is either a, c, g or t
taatntactcgctttacanaanacccnactaaacaccaatttatcatcgactccttcgattcttctccgccgaaattatcctcgacttacactaacgaccccttaaacaacgtttataacgtcgaacaacgataacgccgcgacaaacgacgacgaaaacgaacaaaacctttaataacgactccacctctccctcaacccccgctaactcccccgaccttacgcgaacgcctcgaaatcccgtacccgctaaaactcgacgccgaacccgaccactacgttcccgacaaccccatccccgacgcgccgaaaccgaatccgtccctcccgcgctacgactccgacctccgacctcaccgtacgccttacttcccgttaaatcctacatcctcaacgaaatctccacccgctcgcgctccaaactccctacgaaaaaaaacgtactactactaaataaatattccctacctcgccccgccccgcccgacccccaacgacccgaaatacctaatccgcgaactaactcgctaactctctttatacgaacaaccgacccaaccccgccccgcctcgc

SEQ ID NO: 10803 - DNA, 574 bp, Artificial Sequence
  chemically treated genomic DNA (Homo sapiens) CpG-island No: 10803
  misc_feature (5)..(5): n is either a, c, g or t
  misc_feature (19)..(19): n is either a, c, g or t
  misc_feature (22)..(22): n is either a, c, g or t
  misc_feature (27)..(27): n is either a, c, g or t
taatntattcgttttgtanggnatttnattgagtattagtttattatcggttttttcggttttttttcgtcgggattattttcgatttatattggcggttttttgggtaacgtttatagcgtcgggtaacggtggcgtcgcggtaggcgacgacgaggacgggtagaatttttggtaacgattttattttttttttagttttcgttggttttttcggttttgcgcggacgtttcgggatttcgtgttcgttggagttcggcgtcgggttcggttattgcgttttcggtagttttattttcggcgcgtcgaggtcgggttcgtttttttcgcgttgcggtttcggttttcggttttatcgtacgttttgtttttcgttaggttttgtatttttagcgaggtttttattcgttcgcgttttaagttttttgcggggaagaacgtgttattgttgggtaagtgttttttgtttcgtttcgtttcgttcggtttttagcggttcggggtatttggttcgcgggttagttcgttggttttttttgtgcggatagtcggtttagtttcgtttcgtttcgt

SEQ ID NO: 10804 - DNA, 574 bp, Artificial Sequence
  chemically treated genomic DNA (Homo sapiens) CpG-island No: 10804
  misc_feature (548)..(548): n is either a, c, g or t
  misc_feature (553)..(553): n is either a, c, g or t
  misc_feature (556)..(556): n is either a, c, g or t
  misc_feature (570)..(570): n is either a, c, g or t
acgaaacgaaacgaaactaaaccgactatccgcacaaaaaaaaccaacgaactaacccgcgaaccaaataccccgaaccgctaaaaaccgaacgaaacgaaacgaaacaaaaaacacttacccaacaataacacgttcttccccgcaaaaaacttaaaacgcgaacgaataaaaacctcgctaaaaatacaaaacctaacgaaaaacaaaacgtacgataaaaccgaaaaccgaaaccgcaacgcgaaaaaaacgaacccgacctcgacgcgccgaaaataaaactaccgaaaacgcaataaccgaacccgacgccgaactccaacgaacacgaaatcccgaaacgtccgcgcaaaaccgaaaaaaccaacgaaaactaaaaaaaaaataaaatcgttaccaaaaattctacccgtcctcgtcgtcgcctaccgcgacgccaccgttacccgacgctataaacgttacccaaaaaaccgccaatataaatcgaaaataatcccgacgaaaaaaaaccgaaaaaaccgataataaactaatactcaatnaaatnccntacaaaacgaatanatta

SEQ ID NO: 10805 - DNA, 733 bp, Artificial Sequence
  chemically treated genomic DNA (Homo sapiens) CpG-island No: 10805
  misc_feature (525)..(525): n is either a, c, g or t
  misc_feature (626)..(626): n is either a, c, g or t
  misc_feature (665)..(665): n is either a, c, g or t
  misc_feature (668)..(668): n is either a, c, g or t
gcgcgttatttcgagagttagcggcgaggaagttttttcgttattttttcggagttcggaaaatttaaatacgtatttgcgtatttttagttagatacgtatttttacgcgcgttcggttttcgttttttcgagacgagttcgtaatagtcgtggttagatttacgggtgggtgcgggagtcggatgcgttgcgaggagtcgtcgcgttcggattttttttttattattatatatattttttgattttatttttttttgaagtttgggggacggggagattttttaagtttcgatttgttttgcgtcgcgcgcgtgtcgtttcgttttttcggttttgttttggcggtcgatggtttttcgtttttcgtttgcgcgtagtttttttttcgagttttttgcgttttatttttgtttcgtcgagacgattttttggagttagcgagtcgaggcggcgtgcgtttcgagtggggattacggcggtggcggcggcgtcgggagtcgaggagtttgttagttgtcgcggngtcgcggttatttgttgttttcgttttttttcgttttcgtttttcgttttttttttttttagataacgtcgcgttcggaaatttagatttttttttttttntggttttcgacgagtttttttttttatttgtgggagttncgntttgtttacggagaattgagtgatatatacgggttttttgggagtcgtttcggaaataaagttat

SEQ ID NO: 10806 - DNA, 733 bp, Artificial Sequence
  chemically treated genomic DNA (Homo sapiens) CpG-island No: 10806
  misc_feature (66)..(66): n is either a, c, g or t
  misc_feature (69)..(69): n is either a, c, g or t
  misc_feature (108)..(108): n is either a, c, g or t
  misc_feature (209)..(209): n is either a, c, g or t
ataactttatttccgaaacgactcccaaaaaacccgtatatatcactcaattctccgtaaacaaancgnaactcccacaaataaaaaaaaaaactcgtcgaaaaccanaaaaaaaaaaaaatctaaatttccgaacgcgacgttatctaaaaaaaaaaaaaacgaaaaacgaaaacgaaaaaaaacgaaaacaacaaataaccgcgacnccgcgacaactaacaaactcctcgactcccgacgccgccgccaccgccgtaatccccactcgaaacgcacgccgcctcgactcgctaactccaaaaaatcgtctcgacgaaacaaaaataaaacgcaaaaaactcgaaaaaaaaactacgcgcaaacgaaaaacgaaaaaccatcgaccgccaaaacaaaaccgaaaaaacgaaacgacacgcgcgcgacgcaaaacaaatcgaaacttaaaaaatctccccgtcccccaaacttcaaaaaaaaataaaatcaaaaaatatatataataataaaaaaaaaatccgaacgcgacgactcctcgcaacgcatccgactcccgcacccacccgtaaatctaaccacgactattacgaactcgtctcgaaaaaacgaaaaccgaacgcgcgtaaaaatacgtatctaactaaaaatacgcaaatacgtatttaaattttccgaactccgaaaaaataacgaaaaaacttcctcgccgctaactctcgaaataacgcgc

SEQ ID NO: 10807 - DNA, 733 bp, Artificial Sequence
  chemically treated genomic DNA (Homo sapiens) CpG-island No: 10807
  misc_feature (66)..(66): n is either a, c, g or t
  misc_feature (69)..(69): n is either a, c, g or t
  misc_feature (108)..(108): n is either a, c, g or t
  misc_feature (209)..(209): n is either a, c, g or t
atggttttgttttcggagcgatttttaagaagttcgtgtgtgttatttagtttttcgtggataagncgnagtttttataggtggggaggggggttcgtcgagggttanaaagaagaaggaatttaagttttcgagcgcgacgttgtttgaaaagaagggaggcgggaggcgggggcgagggaaggcggaggtagtaaatgatcgcgatntcgcggtaattggtaaatttttcggttttcggcgtcgtcgttatcgtcgtggtttttattcgaagcgtacgtcgtttcggttcgttggttttagggagtcgtttcggcgggataggaatagagcgtagggagttcgggaggaaggttgcgcgtaagcgagggacggagagttatcggtcgttaggatagggtcggagggacgaggcgatacgcgcgcgacgtaggataaatcggagtttgggaaattttttcgttttttaagttttagaggggggtaaaattagaaaatgtgtgtgatggtgggagagagattcgggcgcggcgatttttcgtagcgtattcggttttcgtatttattcgtggatttggttacggttgttgcggattcgtttcgggaaagcggaggtcgagcgcgcgtaggggtgcgtgtttggttgggggtgcgtaggtgcgtgtttgaatttttcgggtttcgagggggtggcgggagagttttttcgtcgttgattttcggggtaacgcgt

SEQ ID NO: 10808 - DNA, 733 bp, Artificial Sequence
  chemically treated genomic DNA (Homo sapiens) CpG-island No: 10808
  misc_feature (525)..(525): n is either a, c, g or t
  misc_feature (626)..(626): n is either a, c, g or t
  misc_feature (665)..(665): n is either a, c, g or t
  misc_feature (668)..(668): n is either a, c, g or t
acgcgttaccccgaaaatcaacgacgaaaaaactctcccgccaccccctcgaaacccgaaaaattcaaacacgcacctacgcacccccaaccaaacacgcacccctacgcgcgctcgacctccgctttcccgaaacgaatccgcaacaaccgtaaccaaatccacgaataaatacgaaaaccgaatacgctacgaaaaatcgccgcgcccgaatctctctcccaccatcacacacattttctaattttacccccctctaaaacttaaaaaacgaaaaaatttcccaaactccgatttatcctacgtcgcgcgcgtatcgcctcgtccctccgaccctatcctaacgaccgataactctccgtccctcgcttacgcgcaaccttcctcccgaactccctacgctctattcctatcccgccgaaacgactccctaaaaccaacgaaccgaaacgacgtacgcttcgaataaaaaccacgacgataacgacgacgccgaaaaccgaaaaatttaccaattaccgcganatcgcgatcatttactacctccgccttccctcgcccccgcctcccgcctcccttcttttcaaacaacgtcgcgctcgaaaacttaaattccttcttctttntaaccctcgacgaacccccctccccacctataaaaactncgncttatccacgaaaaactaaataacacacacgaacttcttaaaaatcgctccgaaaacaaaaccat

SEQ ID NO: 10809 - DNA, 512 bp, Artificial Sequence
  chemically treated genomic DNA (Homo sapiens) CpG-island No: 10809
  misc_feature (160)..(160): n is either a, c, g or t
  misc_feature (262)..(262): n is either a, c, g or t
  misc_feature (336)..(336): n is either a, c, g or t
  misc_feature (353)..(355): n is either a, c, g or t
  misc_feature (388)..(388): n is either a, c, g or t
ttttcgcgcgcgtttattttcgttcgcgcgcgtatttcgcgtatatatttattcgcgtatatacgcgcgtatatacgtattttcgggcgagggtcgggtcgtcgcgagtatagcgtgtaatcgttatataataaataataatagattttttcgtttcggnattagttttcggagtttagttagcgtcggtggcggcggcggcggcggtagaggcgcgggtagtattcggttcggggcgtatttcggttcgattttttatttnttcggagggtttttttttcgcgttacgtatttcgttggggtattttagggttttcgagcgggacgggttttttnttgcgttcgttcggggnnnttgggttttttttttttttttttttttttcganattcgaaaaaaaaataataggtcgcgaagagttaatcggtgcgggggggagtgtatttttgtggtgggtttttacgaaattttttgtggaaataacggttttagaaaaaaaatgtatggtatag

SEQ ID NO: 10810 - DNA, 512 bp, Artificial Sequence
  chemically treated genomic DNA (Homo sapiens) CpG-island No: 10810
  misc_feature (125)..(125): n is either a, c, g or t
  misc_feature (158)..(160): n is either a, c, g or t
  misc_feature (177)..(177): n is either a, c, g or t
  misc_feature (251)..(251): n is either a, c, g or t
  misc_feature (353)..(353): n is either a, c, g or t
ctataccatacattttttttctaaaaccgttatttccacaaaaaatttcgtaaaaacccaccacaaaaatacactcccccccgcaccgattaactcttcgcgacctattatttttttttcgaatntcgaaaaaaaaaaaaaaaaaaaaaaaacccaannnccccgaacgaacgcaanaaaaaacccgtcccgctcgaaaaccctaaaataccccaacgaaatacgtaacgcgaaaaaaaaaccctccgaanaaataaaaaatcgaaccgaaatacgccccgaaccgaatactacccgcgcctctaccgccgccgccgccgccaccgacgctaactaaactccgaaaactaatnccgaaacgaaaaaatctattattatttattatataacgattacacgctatactcgcgacgacccgaccctcgcccgaaaatacgtatatacgcgcgtatatacgcgaataaatatatacgcgaaatacgcgcgcgaacgaaaataaacgcgcgcgaaaa

SEQ ID NO: 10811 - DNA, 512 bp, Artificial Sequence
  chemically treated genomic DNA (Homo sapiens) CpG-island No: 10811
  misc_feature (125)..(125): n is either a, c, g or t
  misc_feature (158)..(160): n is either a, c, g or t
  misc_feature (177)..(177): n is either a, c, g or t
  misc_feature (251)..(251): n is either a, c, g or t
  misc_feature (353)..(353): n is either a, c, g or t
ttgtgttatgtattttttttttgaagtcgttgtttttataggggatttcgtaaggatttattataaaaatatattttttttcgtatcggttggtttttcgcggtttattatttttttttcggatntcgggggaagggagagagaagggggggtttagnnntttcgggcgaacgtaangagggattcgtttcgttcgggggttttgaagtgttttagcggggtgcgtaacgcggagaggggatttttcgggnaggtaaagggtcgggtcggggtgcgtttcgggtcgggtgttgttcgcgtttttgtcgtcgtcgtcgtcgttatcggcgttggttgggtttcggaagttagtntcggagcggaggaatttattgttatttattgtgtggcggttgtacgttgtattcgcggcggttcggttttcgttcgggagtgcgtgtgtgcgcgcgtgtgtgcgcgagtaagtgtgtgcgcggggtgcgcgcgcgggcgggagtgggcgcgcgcgggga

SEQ ID NO: 10812 - DNA, 512 bp, Artificial Sequence
  chemically treated genomic DNA (Homo sapiens) CpG-island No: 10812
  misc_feature (160)..(160): n is either a, c, g or t
  misc_feature (262)..(262): n is either a, c, g or t
  misc_feature (336)..(336): n is either a, c, g or t
  misc_feature (353)..(355): n is either a, c, g or t
  misc_feature (388)..(388): n is either a, c, g or t
tccccgcgcgcgcccactcccgcccgcgcgcgcaccccgcgcacacacttactcgcgcacacacgcgcgcacacacgcactcccgaacgaaaaccgaaccgccgcgaatacaacgtacaaccgccacacaataaataacaataaattcctccgctccganactaacttccgaaacccaaccaacgccgataacgacgacgacgacgacaaaaacgcgaacaacacccgacccgaaacgcaccccgacccgaccctttacctncccgaaaaatcccctctccgcgttacgcaccccgctaaaacacttcaaaacccccgaacgaaacgaatccctcnttacgttcgcccgaaannnctaaacccccccttctctctcccttcccccganatccgaaaaaaaaataataaaccgcgaaaaaccaaccgatacgaaaaaaaatatatttttataataaatccttacgaaatcccctataaaaacaacgacttcaaaaaaaaaatacataacacaa

SEQ ID NO: 10813 - DNA, 522 bp, Artificial Sequence
  chemically treated genomic DNA (Homo sapiens) CpG-island No: 10813
tttttcgttttttttcggtatcggagtaggaggattacggggtttcgttttacgtatttttttgttttttaacgggcgtttttatgtttcgtttcgggaatcgttttttaagtcgaggatttggtttggggtttgcgttagggagatagtgggtgaggggggcgggggggaggagggaggaggtagggagagcgatttcgtttcgtagttagcgtgagtttatttttgggttgaggtttgaagtggtaggagtggaaagttgatcgtttagtttcggttagtggtcggatcgtatatgtaatttagacggtgtaaaatattgttcggagtaaattaatcgggggttacgtttgcgggtagtatttttttatttgaggaaggttttagtatttcgcgttttgggttttcgcggaggttggttataggtcgggaaattagttcgagggagatgcggatttaatatttatatttaggttaagacggagttttcgatttaagaagtgtttttttaaggttgttttt

SEQ ID NO: 10814 - DNA, 522 bp, Artificial Sequence
  chemically treated genomic DNA (Homo sapiens) CpG-island No: 10814
aaaaacaaccttaaaaaaacacttcttaaatcgaaaactccgtcttaacctaaatataaatattaaatccgcatctccctcgaactaatttcccgacctataaccaacctccgcgaaaacccaaaacgcgaaatactaaaaccttcctcaaataaaaaaatactacccgcaaacgtaacccccgattaatttactccgaacaatattttacaccgtctaaattacatatacgatccgaccactaaccgaaactaaacgatcaactttccactcctaccacttcaaacctcaacccaaaaataaactcacgctaactacgaaacgaaatcgctctccctacctcctccctcctcccccccgcccccctcacccactatctccctaacgcaaaccccaaaccaaatcctcgacttaaaaaacgattcccgaaacgaaacataaaaacgcccgttaaaaaacaaaaaaatacgtaaaacgaaaccccgtaatcctcctactccgataccgaaaaaaaacgaaaaa

SEQ ID NO: 10815 - DNA, 522 bp, Artificial Sequence
  chemically treated genomic DNA (Homo sapiens) CpG-island No: 10815
ggagatagttttaaggaggtattttttaaatcgagggtttcgttttaatttagatgtggatgttaagttcgtatttttttcgggttgatttttcgatttgtagttagttttcgcgagagtttagggcgcgaggtgttgggattttttttaggtggagagatgttgttcgtagacgtgattttcggttggtttgtttcgggtaatattttgtatcgtttaaattatatgtgcgattcggttattggtcggagttgggcgattagttttttatttttgttattttagattttagtttagggatgagtttacgttaattgcgaaacgaaatcgttttttttgtttttttttttttttttttcgttttttttatttattatttttttgacgtagattttaagttaaattttcggtttggaggacgattttcggagcgaggtatgaaggcgttcgttgggaggtagaggggtgcgtgaagcggggtttcgtggtttttttgtttcggtgtcggagggagacggagaa

SEQ ID NO: 10816 - DNA, 522 bp, Artificial Sequence
  chemically treated genomic DNA (Homo sapiens) CpG-island No: 10816
ttctccgtctccctccgacaccgaaacaaaaaaaccacgaaaccccgcttcacgcacccctctacctcccaacgaacgccttcatacctcgctccgaaaatcgtcctccaaaccgaaaatttaacttaaaatctacgtcaaaaaaataataaataaaaaaaacgaaaaaaaaaaaaaaaaaaacaaaaaaaacgatttcgtttcgcaattaacgtaaactcatccctaaactaaaatctaaaataacaaaaataaaaaactaatcgcccaactccgaccaataaccgaatcgcacatataatttaaacgatacaaaatattacccgaaacaaaccaaccgaaaatcacgtctacgaacaacatctctccacctaaaaaaaatcccaacacctcgcgccctaaactctcgcgaaaactaactacaaatcgaaaaatcaacccgaaaaaaatacgaacttaacatccacatctaaattaaaacgaaaccctcgatttaaaaaatacctccttaaaactatctcc

SEQ ID NO: 10817 - DNA, 575 bp, Artificial Sequence
  chemically treated genomic DNA (Homo sapiens) CpG-island No: 10817
cgaaaatcggcggttcgtcgttggtgtagcgtacgtcggaggtgtttttttggatgagcgtttggacgaaagtaagcgattgttcgagcgcgtaagtgtttttggaataagtgtttaggattcgcgcgtttagcgttacgttgggtagtaggttgggattattgttgatttggtttagggcgtagagtatcgtttttagtttgtggatttcgtttttttttttgatgtcgtcgtagggtatttcgttgggatttttggcgtgtacggggaatagtttttcgagggtgacgtttttttcgattcggattgagtgcggggcgtatattttttggtcgcgcgtcgtcgtcgttagcgcgtataggagtatttttagtacgtagtaggggaattttattaaagttaggacgcggagtagtttttttagttggattatgttgtttcggttgttgcggtggcggcggcggcgttggagggaacggtggtgggttcgtcgaggttcgggttttttagggcgagttttttcgggaaagtttaggggtttttgtaggtacggagggtgggggaattcggggagg

SEQ ID NO: 10818 - DNA, 575 bp, Artificial Sequence
  chemically treated genomic DNA (Homo sapiens) CpG-island No: 10818
cctccccgaattcccccaccctccgtacctacaaaaacccctaaactttcccgaaaaaactcgccctaaaaaacccgaacctcgacgaacccaccaccgttccctccaacgccgccgccgccaccgcaacaaccgaaacaacataatccaactaaaaaaactactccgcgtcctaactttaataaaattcccctactacgtactaaaaatactcctatacgcgctaacgacgacgacgcgcgaccaaaaaatatacgccccgcactcaatccgaatcgaaaaaaacgtcaccctcgaaaaactattccccgtacacgccaaaaatcccaacgaaataccctacgacgacatcaaaaaaaaaaacgaaatccacaaactaaaaacgatactctacgccctaaaccaaatcaacaataatcccaacctactacccaacgtaacgctaaacgcgcgaatcctaaacacttattccaaaaacacttacgcgctcgaacaatcgcttactttcgtccaaacgctcatccaaaaaaacacctccgacgtacgctacaccaacgacgaaccgccgattttcg

SEQ ID NO: 10819 - DNA, 575 bp, Artificial Sequence
  chemically treated genomic DNA (Homo sapiens) CpG-island No: 10819
ttttttcggatttttttatttttcgtgtttgtaggagtttttgggttttttcggaggagttcgttttgaagggttcggatttcggcgagtttattatcgttttttttagcgtcgtcgtcgttatcgtagtagtcggagtagtatggtttagttgaggaagttgtttcgcgttttgattttgatgaagtttttttgttgcgtgttggaggtgtttttgtgcgcgttggcggcggcggcgcgcggttaggagatgtacgtttcgtatttaattcggatcgagggggacgttattttcggggggttgtttttcgtgtacgttaagggttttagcggagtgttttgcggcgatattaagagggaaaacgggatttataggttggaagcgatgttttacgttttggattagattaatagtgattttaatttattgtttaacgtgacgttgggcgcgcggattttggatatttgttttagggatatttacgcgttcgaatagtcgtttattttcgtttaggcgtttatttagaaggatattttcgacgtgcgttgtattaacggcgaatcgtcggttttcg

SEQ ID NO: 10820 - DNA, 575 bp, Artificial Sequence
  chemically treated genomic DNA (Homo sapiens) CpG-island No: 10820
cgaaaaccgacgattcgccgttaatacaacgcacgtcgaaaatatccttctaaataaacgcctaaacgaaaataaacgactattcgaacgcgtaaatatccctaaaacaaatatccaaaatccgcgcgcccaacgtcacgttaaacaataaattaaaatcactattaatctaatccaaaacgtaaaacatcgcttccaacctataaatcccgttttccctcttaatatcgccgcaaaacactccgctaaaacccttaacgtacacgaaaaacaaccccccgaaaataacgtccccctcgatccgaattaaatacgaaacgtacatctcctaaccgcgcgccgccgccgccaacgcgcacaaaaacacctccaacacgcaacaaaaaaacttcatcaaaatcaaaacgcgaaacaacttcctcaactaaaccatactactccgactactacgataacgacgacgacgctaaaaaaaacgataataaactcgccgaaatccgaacccttcaaaacgaactcctccgaaaaaacccaaaaactcctacaaacacgaaaaataaaaaaatccgaaaaaa

SEQ ID NO: 10821 - DNA, 815 bp, Artificial Sequence
  chemically treated genomic DNA (Homo sapiens) CpG-island No: 10821
gattagtatcgattttatcgttttcggcgaggtatttttagttttcgggaatgagaaatgtgttcgttatagtaggggtttataggaatgaagggcgtcggcgttgcgtaggtttaatagtttttcgcgttttcgttttcggtttcggtttagttcggttttttttttttcgttttggtagagtggcgttattagggggcgaaaaattcgacgagtatgaggttcgtagatttcgtgtaggagatgcgattttcgaagttgtcgttcgtgagttcggaggtagcggcgaggcgggtcgcggtaagaagtagcgttatattcgggaatagcgttaggcggcggaggcgtatggcggcgaggtggggtggggacggtcggaagggtcgcggttcggttgggattgcggaggtcgggcgcgcgattataaatcggttgtttgcgttggcgcgtttggtttaggggatttgtagtcggaggttttaatttttaaattcggttcgggtcgttgtgtggtagtcgttgattggttgcgcgtcgttttcgttcggcgggcgggattagttggttatcgttgagtggtcggagagcggggcggggcggggtttaagcggcgagtggttgggcgagcgttgtttcgtatggttttgggttgtgggtaggggttagggtcgggtttcggggtgagtcgaaatttgggggtcgagcggggcggggaatggggcgtagtgaggttgggagtcggttttgagttcgttttgtataggggtagttaggttcggggtatttgagttggaggcggaagcgtgaaataagga

SEQ ID NO: 10822 - DNA, 815 bp, Artificial Sequence
  chemically treated genomic DNA (Homo sapiens) CpG-island No: 10822
tccttatttcacgcttccgcctccaactcaaataccccgaacctaactacccctatacaaaacgaactcaaaaccgactcccaacctcactacgccccattccccgccccgctcgacccccaaatttcgactcaccccgaaacccgaccctaacccctacccacaacccaaaaccatacgaaacaacgctcgcccaaccactcgccgcttaaaccccgccccgccccgctctccgaccactcaacgataaccaactaatcccgcccgccgaacgaaaacgacgcgcaaccaatcaacgactaccacacaacgacccgaaccgaatttaaaaattaaaacctccgactacaaatcccctaaaccaaacgcgccaacgcaaacaaccgatttataatcgcgcgcccgacctccgcaatcccaaccgaaccgcgacccttccgaccgtccccaccccacctcgccgccatacgcctccgccgcctaacgctattcccgaatataacgctacttcttaccgcgacccgcctcgccgctacctccgaactcacgaacgacaacttcgaaaatcgcatctcctacacgaaatctacgaacctcatactcgtcgaatttttcgccccctaataacgccactctaccaaaacgaaaaaaaaaaaaccgaactaaaccgaaaccgaaaacgaaaacgcgaaaaactattaaacctacgcaacgccgacgcccttcattcctataaacccctactataacgaacacatttctcattcccgaaaactaaaaatacctcgccgaaaacgataaaatcgatactaatc

SEQ ID NO: 10823 - DNA, 815 bp, Artificial Sequence
  chemically treated genomic DNA (Homo sapiens) CpG-island No: 10823
tttttattttacgttttcgtttttagtttaggtgtttcgagtttggttatttttatgtaagacgagtttagggtcggtttttagttttattgcgttttatttttcgtttcgttcgatttttaggtttcggtttatttcgggattcggttttagtttttatttatagtttaggattatgcggagtaacgttcgtttagttattcgtcgtttaggtttcgtttcgtttcgtttttcggttatttagcggtaattagttggtttcgttcgtcggacgaaggcgacgcgtagttaattagcggttgttatatagcggttcgagtcgggtttgggggttgggattttcggttgtaggttttttgggttagacgcgttagcgtaggtagtcggtttgtggtcgcgcgttcgattttcgtagttttagtcgagtcgcgattttttcggtcgtttttattttatttcgtcgttatgcgttttcgtcgtttagcgttgttttcgggtgtggcgttgttttttgtcgcggttcgtttcgtcgttgttttcgaatttacggacgataatttcgagagtcgtattttttatacgggatttgcgggttttatgttcgtcgggtttttcgttttttgatgacgttattttgttaaggcgggggaagaagggtcgggttgggtcggggtcgggggcgagggcgcggggaattgttgggtttacgtagcgtcggcgttttttatttttgtgggtttttgttgtggcgggtatattttttattttcgggagttggaggtgtttcgtcgagagcggtggagtcggtgttgatt

SEQ ID NO: 10824 - DNA, 815 bp, Artificial Sequence
  chemically treated genomic DNA (Homo sapiens) CpG-island No: 10824
aatcaacaccgactccaccgctctcgacgaaacacctccaactcccgaaaataaaaaatatacccgccacaacaaaaacccacaaaaataaaaaacgccgacgctacgtaaacccaacaattccccgcgccctcgcccccgaccccgacccaacccgacccttcttcccccgccttaacaaaataacgtcatcaaaaaacgaaaaacccgacgaacataaaacccgcaaatcccgtataaaaaatacgactctcgaaattatcgtccgtaaattcgaaaacaacgacgaaacgaaccgcgacaaaaaacaacgccacacccgaaaacaacgctaaacgacgaaaacgcataacgacgaaataaaataaaaacgaccgaaaaaatcgcgactcgactaaaactacgaaaatcgaacgcgcgaccacaaaccgactacctacgctaacgcgtctaacccaaaaaacctacaaccgaaaatcccaacccccaaacccgactcgaaccgctatataacaaccgctaattaactacgcgtcgccttcgtccgacgaacgaaaccaactaattaccgctaaataaccgaaaaacgaaacgaaacgaaacctaaacgacgaataactaaacgaacgttactccgcataatcctaaactataaataaaaactaaaaccgaatcccgaaataaaccgaaacctaaaaatcgaacgaaacgaaaaataaaacgcaataaaactaaaaaccgaccctaaactcgtcttacataaaaataaccaaactcgaaacacctaaactaaaaacgaaaacgtaaaataaaaa

SEQ ID NO: 10825 - DNA, 690 bp, Artificial Sequence
  chemically treated genomic DNA (Homo sapiens) CpG-island No: 10825
tatcgttaggtatagtttaggttttagtattaggttggagatatcgatatagcgttcgtgttttatttatttttcgtttttcgttatcggacgagaataggttaatttcgtatttatcgttttgtaaagttgttttgttagcgtaatgttttttttgttgttaatatcgcgatcgacgttgattattagacgggttttgtcgagatcgacgttgttgttttggcgcgtttgggttgtcgtgcgggtaatcgttatagtcggagtttgttattttacggtgtgcgtttcgttagtgcgtgacgcgtttggttgagtcgtatcgaacgtgtcgttgttgatggttagtatcgtatacggcgtggtaatgcgtttttcgttaatcgttagattatcgtaaattatgtgttttattgtcgttttatcgttttgtacgttgacggtgttggtatcgttagatatcgtcgttttaaggcgataatttagttttgtcgttagtaatttgtcgcgacgggtgtttggtagtagtattaggtcgtttgcgtcgtgttggcgaatagtgttagttatgatatcggcgtattttcgattattcgatcgttcggtttgtcgtttaatttttagatatgattagcgtcgagttggattgtttgtgcgtcgtcggtattattgaggataaaggtgttgatttga

SEQ ID NO: 10826 - DNA, 690 bp, Artificial Sequence
  chemically treated genomic DNA (Homo sapiens) CpG-island No: 10826
tcaaatcaacacctttatcctcaataataccgacgacgcacaaacaatccaactcgacgctaatcatatctaaaaattaaacgacaaaccgaacgatcgaataatcgaaaatacgccgatatcataactaacactattcgccaacacgacgcaaacgacctaatactactaccaaacacccgtcgcgacaaattactaacgacaaaactaaattatcgccttaaaacgacgatatctaacgataccaacaccgtcaacgtacaaaacgataaaacgacaataaaacacataatttacgataatctaacgattaacgaaaaacgcattaccacgccgtatacgatactaaccatcaacaacgacacgttcgatacgactcaaccaaacgcgtcacgcactaacgaaacgcacaccgtaaaataacaaactccgactataacgattacccgcacgacaacccaaacgcgccaaaacaacaacgtcgatctcgacaaaacccgtctaataatcaacgtcgatcgcgatattaacaacaaaaaaaacattacgctaacaaaacaactttacaaaacgataaatacgaaattaacctattctcgtccgataacgaaaaacgaaaaataaataaaacacgaacgctatatcgatatctccaacctaatactaaaacctaaactatacctaacgata

SEQ ID NO: 10827 - DNA, 690 bp, Artificial Sequence
  chemically treated genomic DNA (Homo sapiens) CpG-island No: 10827
ttaaattaatatttttgtttttaatgatgtcgacggcgtataggtaatttagttcggcgttaattatgtttggaaattaaacggtaaatcggacgatcggatgatcgaagatacgtcggtgttatggttgatattattcgttagtacggcgtagacggtttggtgttgttgttaaatattcgtcgcggtaaattattggcggtaaaattgggttatcgttttaaagcggcggtgtttaacgatgttagtatcgttagcgtataggacggtaaagcgatagtgaaatatatggtttacggtggtttggcgattggcgaagaacgtattgttacgtcgtatgcggtattgattattagtagcggtacgttcgatgcggtttagttagacgcgttacgtattggcgaaacgtatatcgtggagtggtaggtttcggttgtggcgattattcgtacggtaatttaggcgcgttagagtaatagcgtcgatttcgataaagttcgtttggtggttagcgtcggtcgcggtattggtagtaaagagaatattgcgttggtagaatagttttgtaaggcgataggtgcggagttggtttgttttcgttcggtggcggaaaacgaaaaatggatggagtacgaacgttatgtcggtatttttaatttgatgttgaaatttgaattgtatttggcggtg

SEQ ID NO: 10828 - DNA, 690 bp, Artificial Sequence
  chemically treated genomic DNA (Homo sapiens) CpG-island No: 10828
caccgccaaatacaattcaaatttcaacatcaaattaaaaataccgacataacgttcgtactccatccatttttcgttttccgccaccgaacgaaaacaaaccaactccgcacctatcgccttacaaaactattctaccaacgcaatattctctttactaccaataccgcgaccgacgctaaccaccaaacgaactttatcgaaatcgacgctattactctaacgcgcctaaattaccgtacgaataatcgccacaaccgaaacctaccactccacgatatacgtttcgccaatacgtaacgcgtctaactaaaccgcatcgaacgtaccgctactaataatcaataccgcatacgacgtaacaatacgttcttcgccaatcgccaaaccaccgtaaaccatatatttcactatcgctttaccgtcctatacgctaacgatactaacatcgttaaacaccgccgctttaaaacgataacccaattttaccgccaataatttaccgcgacgaatatttaacaacaacaccaaaccgtctacgccgtactaacgaataatatcaaccataacaccgacgtatcttcgatcatccgatcgtccgatttaccgtttaatttccaaacataattaacgccgaactaaattacctatacgccgtcgacatcattaaaaacaaaaatattaatttaa

SEQ ID NO: 10829 - DNA, 1705 bp, Artificial Sequence
  chemically treated genomic DNA (Homo sapiens) CpG-island No: 10829
gtcgtcgtcgtcgtcggagtgtaggttgttgttttcgtttagtatcgtgttttcgtcgttttggaagtttacgttgggttcgtcgatttcgatttcggtagtatttgataggttgtttttagtcgacgaggaggtagttgggtttacgaagtttacgcggaagcggtttttggttttttcgttgtttttagtcggttcgttttcgtcgttggttttttcgttcgcgggggtttgtttggttttcgttttagtattagtcgtcgtcgttgtcgtcgtcgtcgtcgtcgtcgtagtagcggttcgttcggcgttttcggaaattaggtttatttggaaacggttttggttcggggtgggttttaagggtttgtttagttcgttttcggtcgtcgcggggtttttatcgcggatttcgtcgtcgtttcggttcgcgggcgtagtatttttcggtatcgagggtatagtcgtgtcgggtagttttattttggttgcggttagcgtagcggttgacggcgttttttcgatttcggttagtttcggggcgtcggaggagggcgtcgtgggtcgcggttttatagttgttcgattttcggcggaattgtagagttcggcggacgttttcggtagtacgttttttatatttttggtcggcggtggttatagtcgtaagattaggtgagagagttttttttttcgtcgtttgcgggtcgtcgttagtttggacggttatagaggttatcggtagtcgagcgagcgcgcgagtgtggcgggcgcggggcgggtttcgttgtttaaagtttcggcggggttgcggcggcggcggtttcggtagtagtacgcgggaggcggggtcggaggttttttcgttttttagttcgtttattcgcggtttcgtagcggcgcgcggttgacgtttttttagcgattcggtttttcgcggtttttgcgcgattttacgtaaaagcgtttcgtgcgaagagcgcggttagttagttcgtaaagggtttcgggtagtgcgggtagtacgaacggcgcgatcggggagtaggcgcggttacgtttcgttttagtgatgtcgtcgggaggattttcgcgcggttattttttttttcgtcgttttttttttacgtttttatttttttttttcgtcgcgttttgcggcgaaaaggagcgggtttttaggttattttttttttttttatttaggggtcgcgcgttagtggatttgtagtttaggtaacggggttgcggacggcgcgcgtgttttgtttcgttttacgtcggtagttgatgttttcgcggtagttgttattttagcgttttagttacggttttagaggttttcgtacgttggtttttttttttttttttcgttttggtgaattcgtagtatttgggttgagttcgaaatttcgcgagatgttgtaggcgttagtgcggttttttattaggcgcgtggtattcgaggtcgggtcggagtcgtaggttagtcgcgattttttcgggcgatgttgggggtttttcggtcggggtcgtagtcgttttcggagtcgcgggcgaggtgcgttttttagtttggtttgttttgggttttgattcgtcgtcgcgaattttcgttcgtaatttcgggtttgaatttggaggagggaggattttttttgtgtagttttcgagcggtagatttattttgttaggtagatttaga

SEQ ID NO: 10830 - DNA, 1705 bp, Artificial Sequence
  chemically treated genomic DNA (Homo sapiens) CpG-island No: 10830
tctaaatctacctaacaaaataaatctaccgctcgaaaactacacaaaaaaaatcctccctcctccaaattcaaacccgaaattacgaacgaaaattcgcgacgacgaatcaaaacccaaaacaaaccaaactaaaaaacgcacctcgcccgcgactccgaaaacgactacgaccccgaccgaaaaacccccaacatcgcccgaaaaaatcgcgactaacctacgactccgacccgacctcgaataccacgcgcctaataaaaaaccgcactaacgcctacaacatctcgcgaaatttcgaactcaacccaaatactacgaattcaccaaaacgaaaaaaaaaaaaaaaaaccaacgtacgaaaacctctaaaaccgtaactaaaacgctaaaataacaactaccgcgaaaacatcaactaccgacgtaaaacgaaacaaaacacgcgcgccgtccgcaaccccgttacctaaactacaaatccactaacgcgcgacccctaaataaaaaaaaaaaaaataacctaaaaacccgctccttttcgccgcaaaacgcgacgaaaaaaaaaaataaaaacgtaaaaaaaaaacgacgaaaaaaaaaataaccgcgcgaaaatcctcccgacgacatcactaaaacgaaacgtaaccgcgcctactccccgatcgcgccgttcgtactacccgcactacccgaaaccctttacgaactaactaaccgcgctcttcgcacgaaacgcttttacgtaaaatcgcgcaaaaaccgcgaaaaaccgaatcgctaaaaaaacgtcaaccgcgcgccgctacgaaaccgcgaataaacgaactaaaaaacgaaaaaacctccgaccccgcctcccgcgtactactaccgaaaccgccgccgccgcaaccccgccgaaactttaaacaacgaaacccgccccgcgcccgccacactcgcgcgctcgctcgactaccgataacctctataaccgtccaaactaacgacgacccgcaaacgacgaaaaaaaaaactctctcacctaatcttacgactataaccaccgccgaccaaaaatataaaaaacgtactaccgaaaacgtccgccgaactctacaattccgccgaaaatcgaacaactataaaaccgcgacccacgacgccctcctccgacgccccgaaactaaccgaaatcgaaaaaacgccgtcaaccgctacgctaaccgcaaccaaaataaaactacccgacacgactataccctcgataccgaaaaatactacgcccgcgaaccgaaacgacgacgaaatccgcgataaaaaccccgcgacgaccgaaaacgaactaaacaaacccttaaaacccaccccgaaccaaaaccgtttccaaataaacctaatttccgaaaacgccgaacgaaccgctactacgacgacgacgacgacgacgacaacgacgacgactaatactaaaacgaaaaccaaacaaacccccgcgaacgaaaaaaccaacgacgaaaacgaaccgactaaaaacaacgaaaaaaccaaaaaccgcttccgcgtaaacttcgtaaacccaactacctcctcgtcgactaaaaacaacctatcaaatactaccgaaatcgaaatcgacgaacccaacgtaaacttccaaaacgacgaaaacacgatactaaacgaaaacaacaacctacactccgacgacgacgacgac

SEQ ID NO: 10831 - DNA, 1705 bp, Artificial Sequence
  chemically treated genomic DNA (Homo sapiens) CpG-island No: 10831
tttaggtttgtttggtagggtgagtttatcgttcgaaagttgtatagaggaaatttttttttttttaggtttaggttcggagttacgagcggagattcgcggcggcgggttagagtttagagtaaattaggttggggaacgtatttcgttcgcggtttcggaagcggttgcggtttcgatcggaaagtttttagtatcgttcgaaggaatcgcggttggtttgcggtttcggttcggtttcgggtattacgcgtttagtgggaagtcgtattgacgtttgtagtatttcgcgagatttcgggtttagtttaagtattgcgagtttattaaagcggggggaaaaaaaaaaagttagcgtgcgagagtttttgaagtcgtggttggggcgttggggtggtagttgtcgcgggagtattagttatcggcgtgaggcgaggtagggtacgcgcgtcgttcgtagtttcgttgtttgggttgtaggtttattgacgcgcggtttttgggtggagagaggggaggtggtttgggagttcgttttttttcgtcgtagagcgcggcgggggagggaggtgaaggcgtgggaggaaggcggcggaagaggaggtagtcgcgcggagattttttcggcgatattattgaggcggagcgtagtcgcgtttgtttttcgatcgcgtcgttcgtgttgttcgtattgttcgaggttttttgcggattggttggtcgcgtttttcgtacggggcgtttttgcgtggggtcgcgtaggagtcgcggagggtcggatcgttgagggagcgttagtcgcgcgtcgttgcgggatcgcgggtgggcgggttgaggggcggaggagttttcggtttcgtttttcgcgtgttgttgtcggagtcgtcgtcgtcgtagtttcgtcgaggttttaaatagcggggttcgtttcgcgttcgttatattcgcgcgttcgttcggttgtcggtggtttttgtggtcgtttaggttagcggcggttcgtaggcggcggggagaaagatttttttatttggttttgcggttgtggttatcgtcggttaggggtgtggagggcgtgttgtcggagacgttcgtcgggttttgtagtttcgtcgggggtcgggtagttatggagtcgcggtttacggcgttttttttcggcgtttcgggattggtcggggtcggggagacgtcgttagtcgttgcgttggtcgtagttagggtggaattgttcggtacggttgtgttttcggtgtcggaggatgttgcgttcgcgagtcgggacggcggcggggttcgcgatgagggtttcgcggcggtcggggacgggttgggtagatttttggggtttatttcgagttagagtcgtttttaggtggatttggttttcgagaacgtcgggcgggtcgttgttgcggcggcggcggcggcggcggtagcggcggcggttggtgttggggcgggggttaagtagattttcgcggacggggaagttagcggcgagagcgagtcggttaaaggtagcgaggaagttaagggtcgttttcgcgtgaatttcgtggatttagttgttttttcgtcggttgaagatagtttgttagatgttgtcggggtcggagtcgacgggtttaacgtgagtttttagaacggcggggatacggtgttgagcgagggtagtagtttgtatttcggcggcggcggcggt

SEQ ID NO: 10832 - DNA, 1705 bp, Artificial Sequence
  chemically treated genomic DNA (Homo sapiens) CpG-island No: 10832
accgccgccgccgccgaaatacaaactactaccctcgctcaacaccgtatccccgccgttctaaaaactcacgttaaacccgtcgactccgaccccgacaacatctaacaaactatcttcaaccgacgaaaaaacaactaaatccacgaaattcacgcgaaaacgacccttaacttcctcgctacctttaaccgactcgctctcgccgctaacttccccgtccgcgaaaatctacttaacccccgccccaacaccaaccgccgccgctaccgccgccgccgccgccgccgcaacaacgacccgcccgacgttctcgaaaaccaaatccacctaaaaacgactctaactcgaaataaaccccaaaaatctacccaacccgtccccgaccgccgcgaaaccctcatcgcgaaccccgccgccgtcccgactcgcgaacgcaacatcctccgacaccgaaaacacaaccgtaccgaacaattccaccctaactacgaccaacgcaacgactaacgacgtctccccgaccccgaccaatcccgaaacgccgaaaaaaaacgccgtaaaccgcgactccataactacccgacccccgacgaaactacaaaacccgacgaacgtctccgacaacacgccctccacacccctaaccgacgataaccacaaccgcaaaaccaaataaaaaaatctttctccccgccgcctacgaaccgccgctaacctaaacgaccacaaaaaccaccgacaaccgaacgaacgcgcgaatataacgaacgcgaaacgaaccccgctatttaaaacctcgacgaaactacgacgacgacgactccgacaacaacacgcgaaaaacgaaaccgaaaactcctccgcccctcaacccgcccacccgcgatcccgcaacgacgcgcgactaacgctccctcaacgatccgaccctccgcgactcctacgcgaccccacgcaaaaacgccccgtacgaaaaacgcgaccaaccaatccgcaaaaaacctcgaacaatacgaacaacacgaacgacgcgatcgaaaaacaaacgcgactacgctccgcctcaataatatcgccgaaaaaatctccgcgcgactacctcctcttccgccgccttcctcccacgccttcacctccctcccccgccgcgctctacgacgaaaaaaaacgaactcccaaaccacctcccctctctccacccaaaaaccgcgcgtcaataaacctacaacccaaacaacgaaactacgaacgacgcgcgtaccctacctcgcctcacgccgataactaatactcccgcgacaactaccaccccaacgccccaaccacgacttcaaaaactctcgcacgctaactttttttttttccccccgctttaataaactcgcaatacttaaactaaacccgaaatctcgcgaaatactacaaacgtcaatacgacttcccactaaacgcgtaatacccgaaaccgaaccgaaaccgcaaaccaaccgcgattccttcgaacgatactaaaaactttccgatcgaaaccgcaaccgcttccgaaaccgcgaacgaaatacgttccccaacctaatttactctaaactctaacccgccgccgcgaatctccgctcgtaactccgaacctaaacctaaaaaaaaaaaaatttcctctatacaactttcgaacgataaactcaccctaccaaacaaacctaaa

SEQ ID NO: 10833 - DNA, 609 bp, Artificial Sequence
  chemically treated genomic DNA (Homo sapiens) CpG-island No: 10833
cggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtaaagtgggcgtgaaagaaagtaattaacgatggtgttttgacggggtcgagttttgtttggataacggagagagattgcgtgtaacgttcgcgtttgattgttgtgatcgtgaaggattggattgggcgggttattatcggcgggtttaatagtggaataatattaggtcgttatgttgggaagcgggggaattttcgttttggtaataaatttttcggcgttttttaatggaggtggttgatcgataaaggggttattgttattcgggttaatgataataa

SEQ ID NO: 10834 - DNA, 609 bp, Artificial Sequence
  chemically treated genomic DNA (Homo sapiens) CpG-island No: 10834
ttattatcattaacccgaataacaataacccctttatcgatcaaccacctccattaaaaaacgccgaaaaatttattaccaaaacgaaaattcccccgcttcccaacataacgacctaatattattccactattaaacccgccgataataacccgcccaatccaatccttcacgatcacaacaatcaaacgcgaacgttacacgcaatctctctccgttatccaaacaaaactcgaccccgtcaaaacaccatcgttaattactttctttcacgcccactttacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccg

SEQ ID NO: 10835 - DNA, 609 bp, Artificial Sequence
  chemically treated genomic DNA (Homo sapiens) CpG-island No: 10835
ttgttattattagttcgggtagtaataatttttttatcggttagttatttttattgaagaacgtcgaaaaatttgttgttaaaacgggggttttttcgttttttagtatgacggtttggtattgttttattgttaaattcgtcggtagtggttcgtttagtttagttttttacgattataatagttaagcgcgaacgttatacgtagttttttttcgttatttaagtagaattcgatttcgttagagtattatcgttgattgtttttttttacgtttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcg

SEQ ID NO: 10836 - DNA, 609 bp, Artificial Sequence
  chemically treated genomic DNA (Homo sapiens) CpG-island No: 10836
cgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaacgtaaaaaaaaacaatcaacgataatactctaacgaaatcgaattctacttaaataacgaaaaaaaactacgtataacgttcgcgcttaactattataatcgtaaaaaactaaactaaacgaaccactaccgacgaatttaacaataaaacaataccaaaccgtcatactaaaaaacgaaaaaacccccgttttaacaacaaatttttcgacgttcttcaataaaaataactaaccgataaaaaaattattactacccgaactaataataacaa

SEQ ID NO: 10837 - DNA, 523 bp, Artificial Sequence
  chemically treated genomic DNA (Homo sapiens) CpG-island No: 10837
ggtaaatggtatcgcggttttgtcggttttcggtacgttggttagtaaaattcgtgcgttttagttttatttcgggatgacgggttataacgggattattgttcgtttgtagtaggtaattagtgatttcggcgttgacggtatttttttggatatggatacgtcgggtggaatggtgttcggggcgtttgattgcgtcgatattattgttcgtatgcgcgatattaaatttatttgggcgttggttaatgatatgaattgtagtgtaggttagtttattgttagttcggtatcgcgacggttggttatataaacggttagaatcggttttattggggttatgatggcgtatagtaattatggcgttgcgtttaaaattaacggcgttgaggttacgttgatttatagcggcgatcgtaaggtcgacggtaatttttacgaaaagttttcgaaagatgtgcgtgttgatttttagacgcgtatcgatgttattcgttagatgtttgtcgaaaaggttttcgtt

SEQ ID NO: 10838 - DNA, 523 bp, Artificial Sequence
  chemically treated genomic DNA (Homo sapiens) CpG-island No: 10838
aacgaaaaccttttcgacaaacatctaacgaataacatcgatacgcgtctaaaaatcaacacgcacatctttcgaaaacttttcgtaaaaattaccgtcgaccttacgatcgccgctataaatcaacgtaacctcaacgccgttaattttaaacgcaacgccataattactatacgccatcataaccccaataaaaccgattctaaccgtttatataaccaaccgtcgcgataccgaactaacaataaactaacctacactacaattcatatcattaaccaacgcccaaataaatttaatatcgcgcatacgaacaataatatcgacgcaatcaaacgccccgaacaccattccacccgacgtatccatatccaaaaaaataccgtcaacgccgaaatcactaattacctactacaaacgaacaataatcccgttataacccgtcatcccgaaataaaactaaaacgcacgaattttactaaccaacgtaccgaaaaccgacaaaaccgcgataccatttacc

SEQ ID NO: 10839 - DNA, 523 bp, Artificial Sequence
  chemically treated genomic DNA (Homo sapiens) CpG-island No: 10839
agcggaaattttttcggtaaatatttgacgagtggtatcgatacgcgtttggaaattagtacgtatatttttcggaagtttttcgtaagggttgtcgtcgattttgcgatcgtcgttgtaaattagcgtgattttaacgtcgttagttttgagcgtagcgttatagttattgtgcgttattatgattttaatggagtcggttttggtcgtttgtgtgattagtcgtcgcgatgtcgaattggtaataagttgatttgtattgtagtttatgttattggttagcgtttagatgggtttgatatcgcgtatacgggtaataatgtcggcgtagttaaacgtttcggatattattttattcggcgtatttatatttagaagaatgtcgttaacgtcggggttattgattgtttgttgtaggcgagtaatgatttcgttgtaattcgttatttcggaataaggttgaagcgtacgggttttattgattagcgtgtcggaaatcggtaagatcgcgatattatttgtt

SEQ ID NO: 10840 - DNA, 523 bp, Artificial Sequence
  chemically treated genomic DNA (Homo sapiens) CpG-island No: 10840
aacaaataatatcgcgatcttaccgatttccgacacgctaatcaataaaacccgtacgcttcaaccttattccgaaataacgaattacaacgaaatcattactcgcctacaacaaacaatcaataaccccgacgttaacgacattcttctaaatataaatacgccgaataaaataatatccgaaacgtttaactacgccgacattattacccgtatacgcgatatcaaacccatctaaacgctaaccaataacataaactacaatacaaatcaacttattaccaattcgacatcgcgacgactaatcacacaaacgaccaaaaccgactccattaaaatcataataacgcacaataactataacgctacgctcaaaactaacgacgttaaaatcacgctaatttacaacgacgatcgcaaaatcgacgacaacccttacgaaaaacttccgaaaaatatacgtactaatttccaaacgcgtatcgataccactcgtcaaatatttaccgaaaaaatttccgct

SEQ ID NO: 10841 - DNA, 556 bp, Artificial Sequence
  chemically treated genomic DNA (Homo sapiens) CpG-island No: 10841
cgcgatttttacgtttaggtttcgttttcgcggtttttgttttcgtttcgtttttcgtagagggcgcgttttgggagcggcgggggacgcggttggtttttcggtttgcggggtggcggcgtcggggttgcgggcgttttggttggattcgtattgttttttagtgtcgcgcggagttagggcgtcgggttttttcgtttgatgttatcgtcgtgtagttagtttagaagcggtttattgaaagtagatttttttcggcgttcgttgggcggaggacgcgtcgcggttcgtagattcgagcgagttgggtatcgtcgggcgttttcggtttgttcgttttttttttttcgtcgttttttcgcgagttcggttaggcgcgtttgacgtggattattaaatttggagttgtcgtttcgttttttttttttttttttttttttttgataggcgagcgagcgattcggtgtaggtaggagacgtgttgtcgggttgggttgttcgggggagatgatttttcgttaggagggcgtttttgggaagaagattacgggggaag

SEQ ID NO: 10842 - DNA, 556 bp, Artificial Sequence
  chemically treated genomic DNA (Homo sapiens) CpG-island No: 10842
cttcccccgtaatcttcttcccaaaaacgccctcctaacgaaaaatcatctcccccgaacaacccaacccgacaacacgtctcctacctacaccgaatcgctcgctcgcctatcaaaaaaaaaaaaaaaaaaaaaaaaaacgaaacgacaactccaaatttaataatccacgtcaaacgcgcctaaccgaactcgcgaaaaaacgacgaaaaaaaaaaaacgaacaaaccgaaaacgcccgacgatacccaactcgctcgaatctacgaaccgcgacgcgtcctccgcccaacgaacgccgaaaaaaatctactttcaataaaccgcttctaaactaactacacgacgataacatcaaacgaaaaaacccgacgccctaactccgcgcgacactaaaaaacaatacgaatccaaccaaaacgcccgcaaccccgacgccgccaccccgcaaaccgaaaaaccaaccgcgtcccccgccgctcccaaaacgcgccctctacgaaaaacgaaacgaaaacaaaaaccgcgaaaacgaaacctaaacgtaaaaatcgcg

SEQ ID NO: 10843 - DNA, 556 bp, Artificial Sequence
  chemically treated genomic DNA (Homo sapiens) CpG-island No: 10843
tttttttcgtggttttttttttagaggcgtttttttggcgaggagttatttttttcgggtagtttagttcggtagtacgttttttgtttgtatcgagtcgttcgttcgtttgttagagggaggaggaggaggagaggggacgaggcggtagttttaagtttaatggtttacgttaggcgcgtttggtcgggttcgcgggggagcggcggggaggagggggcgggtaggtcgggggcgttcggcggtgtttagttcgttcgggtttgcggatcgcggcgcgtttttcgtttagcgagcgtcgaagagggtttgtttttaatgagtcgtttttgggttgattgtacggcggtgatattaggcgggggagttcggcgttttgatttcgcgcggtattagggggtaatgcgggtttagttaaggcgttcgtagtttcgacgtcgttatttcgtaagtcgggaagttagtcgcgtttttcgtcgtttttagggcgcgttttttgcggggggcggggcgggggtaggggtcgcgagggcgggatttgggcgtggagatcgcg

SEQ ID NO: 10844 - DNA, 556 bp, Artificial Sequence
  chemically treated genomic DNA (Homo sapiens) CpG-island No: 10844
cgcgatctccacgcccaaatcccgccctcgcgacccctacccccgccccgccccccgcaaaaaacgcgccctaaaaacgacgaaaaacgcgactaacttcccgacttacgaaataacgacgtcgaaactacgaacgccttaactaaacccgcattaccccctaataccgcgcgaaatcaaaacgccgaactcccccgcctaatatcaccgccgtacaatcaacccaaaaacgactcattaaaaacaaaccctcttcgacgctcgctaaacgaaaaacgcgccgcgatccgcaaacccgaacgaactaaacaccgccgaacgcccccgacctacccgccccctcctccccgccgctcccccgcgaacccgaccaaacgcgcctaacgtaaaccattaaacttaaaactaccgcctcgtcccctctcctcctcctcctccctctaacaaacgaacgaacgactcgatacaaacaaaaaacgtactaccgaactaaactacccgaaaaaaataactcctcgccaaaaaaacgcctctaaaaaaaaaaccacgaaaaaaa

SEQ ID NO: 10845 - DNA, 612 bp, Artificial Sequence
  chemically treated genomic DNA (Homo sapiens) CpG-island No: 10845
gtggttcgtagcggttggtatacgtggtgttagcggcggataaggataagtacgcgttagtagtttcgttaatattgcgatagcgttgttttcgcggtttttattcggttaaaatagcgttacggtgttttacgtttgacggatgaattgcgtgtttagggttatttttttaacgtaaaaatcgtggcggtaagtttgcgtcgttagggattgagggtaaaggtttttcggaagtttagttcggttagttatcgcgtatacggtttgtttgtgttagaaaatttgttggagtaggatttttacgttagtggttcgaattagaagtgggtaggagatattacgtatttacgtatagatgaaggttggttgtatttggtaatggttattgatttgtggttacgtgtcgttattggttggttaatgtcgttacgtatgacggcgtaattggtttgcgatgttttgtagatggcgttgtggcggcgtaagacgttttcgaacgttatcgtttatacggatcggggaggttagtattgtttagtaaattattaggcgtaattgaagcggtataatttgcgtggaagtatgagcgtaaaaggttgttgttacgataat

SEQ ID NO: 10846 - DNA, 612 bp, Artificial Sequence
  chemically treated genomic DNA (Homo sapiens) CpG-island No: 10846
attatcgtaacaacaaccttttacgctcatacttccacgcaaattataccgcttcaattacgcctaataatttactaaacaatactaacctccccgatccgtataaacgataacgttcgaaaacgtcttacgccgccacaacgccatctacaaaacatcgcaaaccaattacgccgtcatacgtaacgacattaaccaaccaataacgacacgtaaccacaaatcaataaccattaccaaatacaaccaaccttcatctatacgtaaatacgtaatatctcctacccacttctaattcgaaccactaacgtaaaaatcctactccaacaaattttctaacacaaacaaaccgtatacgcgataactaaccgaactaaacttccgaaaaacctttaccctcaatccctaacgacgcaaacttaccgccacgatttttacgttaaaaaaataaccctaaacacgcaattcatccgtcaaacgtaaaacaccgtaacgctattttaaccgaataaaaaccgcgaaaacaacgctatcgcaatattaacgaaactactaacgcgtacttatccttatccgccgctaacaccacgtataccaaccgctacgaaccac

SEQ ID NO: 10847 - DNA, 612 bp, Artificial Sequence
  chemically treated genomic DNA (Homo sapiens) CpG-island No: 10847
attatcgtagtagtaattttttgcgtttatatttttacgtagattatgtcgttttagttgcgtttaataatttgttgaatagtattggttttttcggttcgtgtgaacgataacgttcgggggcgttttacgtcgttatagcgttatttgtagggtatcgtaggttagttgcgtcgttatgcgtggcgatattgattagttaataacggtacgtgattataggttaatgattattgttagatatagttagtttttatttgtacgtaagtacgtgatgttttttgtttatttttggttcgggttattggcgtaaaaattttgttttaatagattttttgatataggtaggtcgtgtgcgcggtagttgatcgggttgaattttcgggaggtttttgtttttagtttttgacggcgtaggtttgtcgttacggtttttacgttaaaggggtaattttgagtacgtagtttattcgttaggcgtggggtatcgtaacgttgttttgatcgggtaaaagtcgcgaggataacgttgtcgtagtgttggcggaattgttgacgcgtgtttatttttgttcgtcgttgatattacgtatattagtcgttgcgggttat

SEQ ID NO: 10848 - DNA, 612 bp, Artificial Sequence
  chemically treated genomic DNA (Homo sapiens) CpG-island No: 10848
ataacccgcaacgactaatatacgtaatatcaacgacgaacaaaaataaacacgcgtcaacaattccgccaacactacgacaacgttatcctcgcgacttttacccgatcaaaacaacgttacgataccccacgcctaacgaataaactacgtactcaaaattacccctttaacgtaaaaaccgtaacgacaaacctacgccgtcaaaaactaaaaacaaaaacctcccgaaaattcaacccgatcaactaccgcgcacacgacctacctatatcaaaaaatctattaaaacaaaatttttacgccaataacccgaaccaaaaataaacaaaaaacatcacgtacttacgtacaaataaaaactaactatatctaacaataatcattaacctataatcacgtaccgttattaactaatcaatatcgccacgcataacgacgcaactaacctacgataccctacaaataacgctataacgacgtaaaacgcccccgaacgttatcgttcacacgaaccgaaaaaaccaatactattcaacaaattattaaacgcaactaaaacgacataatctacgtaaaaatataaacgcaaaaaattactactacgataat

SEQ ID NO: 10849 - DNA, 662 bp, Artificial Sequence
  chemically treated genomic DNA (Homo sapiens) CpG-island No: 10849
ggagttaggttgtttttcgcggtcgtgtatcgtatacgttatatttacgtcgcgttgtacgtaatttcgcgaggtttttttacgttttcgtttaaaaattttttggattaggcgacgtgtatagttggttttttttaatcgtttatgtttcgttcgttaggggggattaagttttagacgaaaatttttcgtggttcgtcgattcgtcgattgtcggtatcgcgttaattttatagttcggtatcgtagtataggcgcggtgttttaaggattcgtaggacggtaggattcgtcggttaggggttcgttacgcgggttaggtttgtttcgttataaatgcgttttttgggattatttttatgtgcgacggggaaagaaattcgtttcgtttcgtatcgtggcgcgtttttttttttcgtttttatttttcgttcggtcgtttcgtcgcgaatattcgttcgttttaaggattcgtcgcggggcgttgcgcgtcggttgtttgtcgtttttttttttcgttatgttttttttatcggttttcgtcgggcggggtcgtcgtcgtttcgcgtttatacggcggttttcgttcggcgtttttaagatgagtattttttgttttaaataagataagggtgatatgattattatatttaatgttatta

SEQ ID NO: 10850 - DNA, 662 bp, Artificial Sequence
  chemically treated genomic DNA (Homo sapiens) CpG-island No: 10850
taataacattaaatataataatcatatcacccttatcttatttaaaacaaaaaatactcatcttaaaaacgccgaacgaaaaccgccgtataaacgcgaaacgacgacgaccccgcccgacgaaaaccgataaaaaaaacataacgaaaaaaaaaaacgacaaacaaccgacgcgcaacgccccgcgacgaatccttaaaacgaacgaatattcgcgacgaaacgaccgaacgaaaaataaaaacgaaaaaaaaaaacgcgccacgatacgaaacgaaacgaatttctttccccgtcgcacataaaaataatcccaaaaaacgcatttataacgaaacaaacctaacccgcgtaacgaacccctaaccgacgaatcctaccgtcctacgaatccttaaaacaccgcgcctatactacgataccgaactataaaattaacgcgataccgacaatcgacgaatcgacgaaccacgaaaaattttcgtctaaaacttaatcccccctaacgaacgaaacataaacgattaaaaaaaaccaactatacacgtcgcctaatccaaaaaatttttaaacgaaaacgtaaaaaaacctcgcgaaattacgtacaacgcgacgtaaatataacgtatacgatacacgaccgcgaaaaacaacctaactcc

SEQ ID NO: 10851 - DNA, 662 bp, Artificial Sequence
  chemically treated genomic DNA (Homo sapiens) CpG-island No: 10851
taatgatattaaatatggtggttatgttatttttgttttgtttagagtaagaggtatttattttgggggcgtcgagcggaagtcgtcgtatggacgcgaagcggcggcggtttcgttcggcgggggtcggtagggagagtatggcggggggggggggcggtaagtaatcgacgcgtagcgtttcgcggcgagtttttggggcgggcgagtattcgcggcggggcggtcgggcggagggtggaagcgaggggagagggcgcgttacggtgcggggcgaggcgagttttttttttcgtcgtatatggaagtggttttaaggggcgtatttgtagcggggtaggtttggttcgcgtggcgggtttttggtcggcgggttttatcgttttgcgggtttttggggtatcgcgtttatattacggtatcgaattgtgaggttagcgcggtgtcggtagtcggcgagtcggcgagttacgggggattttcgtttgggatttgattttttttagcgagcggggtatgagcggttggggggggttaattatgtacgtcgtttagtttagaggatttttgaacgggggcgtgggagagtttcgcgaggttgcgtatagcgcgacgtaggtgtggcgtgtacggtgtacggtcgcgggaggtagtttagtttt

SEQ ID NO: 10852 - DNA, 662 bp, Artificial Sequence
  chemically treated genomic DNA (Homo sapiens) CpG-island No: 10852
aaaactaaactacctcccgcgaccgtacaccgtacacgccacacctacgtcgcgctatacgcaacctcgcgaaactctcccacgcccccgttcaaaaatcctctaaactaaacgacgtacataattaaccccccccaaccgctcataccccgctcgctaaaaaaaatcaaatcccaaacgaaaatcccccgtaactcgccgactcgccgactaccgacaccgcgctaacctcacaattcgataccgtaatataaacgcgataccccaaaaacccgcaaaacgataaaacccgccgaccaaaaacccgccacgcgaaccaaacctaccccgctacaaatacgccccttaaaaccacttccatatacgacgaaaaaaaaaactcgcctcgccccgcaccgtaacgcgccctctcccctcgcttccaccctccgcccgaccgccccgccgcgaatactcgcccgccccaaaaactcgccgcgaaacgctacgcgtcgattacttaccgccccccccccccgccatactctccctaccgacccccgccgaacgaaaccgccgccgcttcgcgtccatacgacgacttccgctcgacgcccccaaaataaatacctcttactctaaacaaaacaaaaataacataaccaccatatttaatatcatta

SEQ ID NO: 10853 - DNA, 536 bp, Artificial Sequence
  chemically treated genomic DNA (Homo sapiens) CpG-island No: 10853
ggaggtagcgcgggatacggaaggtggaacggggcggtatttttcggagaaagttggcgattatttgttcgaaggggttttgtatatttggtgtatatttatcgagatttttattttcgcgcgtcgcggtttcgcgtatcggttacgttttcgcgagtttagagttgtttagggttcgtagaggttcggaggcgtttatattcggatagttatatgggcgtggttttttttttcgttttttaaattttcgaaattttattggttattcggagaacgcgtagtcggttacgtttacgtttttattgttagagttcggggtttgggttatagagcgcgggaggcgttggagcgtttttagagtattcggggttcgcggtttttacgttggcggcgttagagcggttttggtgttttttcgcggcgcgtttgtcgagaaaagtttttttgtttgggagttattacgtttcgtttaggaaatttggattttgggtttatgcgtttatggtattatcgtttggattatagaataagtcgtg

SEQ ID NO: 10854 - DNA, 536 bp, Artificial Sequence
  chemically treated genomic DNA (Homo sapiens) CpG-island No: 10854
cacgacttattctataatccaaacgataataccataaacgcataaacccaaaatccaaatttcctaaacgaaacgtaataactcccaaacaaaaaaacttttctcgacaaacgcgccgcgaaaaaacaccaaaaccgctctaacgccgccaacgtaaaaaccgcgaaccccgaatactctaaaaacgctccaacgcctcccgcgctctataacccaaaccccgaactctaacaataaaaacgtaaacgtaaccgactacgcgttctccgaataaccaataaaatttcgaaaatttaaaaaacgaaaaaaaaaaccacgcccatataactatccgaatataaacgcctccgaacctctacgaaccctaaacaactctaaactcgcgaaaacgtaaccgatacgcgaaaccgcgacgcgcgaaaataaaaatctcgataaatatacaccaaatatacaaaaccccttcgaacaaataatcgccaactttctccgaaaaataccgccccgttccaccttccgtatcccgcgctacctcc

SEQ ID NO: 10855 - DNA, 536 bp, Artificial Sequence
  chemically treated genomic DNA (Homo sapiens) CpG-island No: 10855
tacggtttattttgtgatttaggcggtgatattataaacgtataagtttaaggtttaggttttttgggcggggcgtgatggtttttaggtagagaagtttttttcggtaggcgcgtcgcgggagggtattagggtcgttttggcgtcgttagcgtggagatcgcgggtttcgggtgttttgggagcgttttagcgtttttcgcgttttgtaatttaggtttcggattttggtagtaggggcgtgggcgtggtcgattgcgcgtttttcgagtggttaataaagtttcgaaagtttgaaaagcggaggaaaaggttacgtttatgtggttgttcgagtgtgggcgttttcgggtttttgcgagttttgggtagttttgagttcgcggaggcgtggtcggtgcgcggggtcgcggcgcgcggggatgggggtttcggtggatgtgtattaggtgtataagattttttcgagtaggtggtcgttagtttttttcgaaaggtatcgtttcgttttatttttcgtatttcgcgttgttttt

SEQ ID NO: 10856 - DNA, 536 bp, Artificial Sequence
  chemically treated genomic DNA (Homo sapiens) CpG-island No: 10856
aaaaacaacgcgaaatacgaaaaataaaacgaaacgatacctttcgaaaaaaactaacgaccacctactcgaaaaaatcttatacacctaatacacatccaccgaaacccccatccccgcgcgccgcgaccccgcgcaccgaccacgcctccgcgaactcaaaactacccaaaactcgcaaaaacccgaaaacgcccacactcgaacaaccacataaacgtaaccttttcctccgcttttcaaactttcgaaactttattaaccactcgaaaaacgcgcaatcgaccacgcccacgcccctactaccaaaatccgaaacctaaattacaaaacgcgaaaaacgctaaaacgctcccaaaacacccgaaacccgcgatctccacgctaacgacgccaaaacgaccctaataccctcccgcgacgcgcctaccgaaaaaaacttctctacctaaaaaccatcacgccccgcccaaaaaacctaaaccttaaacttatacgtttataatatcaccgcctaaatcacaaaataaaccgta

SEQ ID NO: 10857 - DNA, 601 bp, Artificial Sequence
  chemically treated genomic DNA (Homo sapiens) CpG-island No: 10857
gagttggttcggaggaggagtcgtaggcggtatcgttgttagtcggagagaagcgcgggtcgcggtattttttcgttattcgtttttggacgtttttcgttcgcgttttagtttagagtcggtttttttttcggaaggaaacgatttttgtcgggtcgttttcggtttgtagcgtcgacgtttttttttttttttttttttagtttttgtttttcgttttatttttcgtttcgtttcgttttttcgttggtttttcgatattcgtgtttgggggttttattggttttttttcggcgtttaggtttcgttgattttatcggcggagttcgggttcgggagtttttagtaagttcgttgttgttttatcgtgtttttttttttcggtttatagtcgggtacgttttggcgtgatttttattattttgtttcgttttaggttcgttagggcgttatttttcgcgtttttcgttttttttacgttgtttttatcgttgttatttcgcgttttttttttttagtcggttatttgttaggaaattaaacgttttattttagtatttttttttttagtttaattttttttttatttgtatcgtttatt

SEQ ID NO: 10858 - DNA, 601 bp, Artificial Sequence
  chemically treated genomic DNA (Homo sapiens) CpG-island No: 10858
aataaacgatacaaataaaaaaaaaattaaactaaaaaaaaaaatactaaaataaaacgtttaatttcctaacaaataaccgactaaaaaaaaaaaacgcgaaataacaacgataaaaacaacgtaaaaaaaacgaaaaacgcgaaaaataacgccctaacgaacctaaaacgaaacaaaataataaaaatcacgccaaaacgtacccgactataaaccgaaaaaaaaaaacacgataaaacaacaacgaacttactaaaaactcccgaacccgaactccgccgataaaatcaacgaaacctaaacgccgaaaaaaaaccaataaaacccccaaacacgaatatcgaaaaaccaacgaaaaaacgaaacgaaacgaaaaataaaacgaaaaacaaaaactaaaaaaaaaaaaaaaaaaaaacgtcgacgctacaaaccgaaaacgacccgacaaaaatcgtttccttccgaaaaaaaaaccgactctaaactaaaacgcgaacgaaaaacgtccaaaaacgaataacgaaaaaataccgcgacccgcgcttctctccgactaacaacgataccgcctacgactcctcctccgaaccaactc

SEQ ID NO: 10859 - DNA, 601 bp, Artificial Sequence
  chemically treated genomic DNA (Homo sapiens) CpG-island No: 10859
ggtggacgatgtaggtaggagggaagttaggttgggaggagaggtgttgggatgggacgtttggttttttgataagtgatcgattagagagagaaggcgcggagtggtagcggtaagaataacgtggaaaggacggaaaacgcgaagagtggcgttttggcggatttggggcggggtagagtggtaagggttacgttaggacgtattcggttgtgggtcgggggaggagagtacggtgggatagtaacgaatttgttgggggttttcggattcgagtttcgtcgatgaggttagcggagtttaggcgtcgggaggaggttagtagagtttttagatacgagtgtcgggaggttagcggaggggcgggacgggacgggaaatgggacgaagagtaagagttgggggaggagggaagagggggcgtcggcgttgtaagtcggaggcggttcgatagggatcgttttttttcggagaggaggtcggttttggattgaggcgcggacggggggcgtttaagggcgggtgacggggaaatatcgcggttcgcgttttttttcggttggtagcggtgtcgtttgcggtttttttttcgggttagttt

SEQ ID NO: 10860 - DNA, 601 bp, Artificial Sequence
  chemically treated genomic DNA (Homo sapiens) CpG-island No: 10860
aaactaacccgaaaaaaaaaccgcaaacgacaccgctaccaaccgaaaaaaaacgcgaaccgcgatatttccccgtcacccgcccttaaacgccccccgtccgcgcctcaatccaaaaccgacctcctctccgaaaaaaaacgatccctatcgaaccgcctccgacttacaacgccgacgccccctcttccctcctcccccaactcttactcttcgtcccatttcccgtcccgtcccgcccctccgctaacctcccgacactcgtatctaaaaactctactaacctcctcccgacgcctaaactccgctaacctcatcgacgaaactcgaatccgaaaacccccaacaaattcgttactatcccaccgtactctcctcccccgacccacaaccgaatacgtcctaacgtaacccttaccactctaccccgccccaaatccgccaaaacgccactcttcgcgttttccgtcctttccacgttattcttaccgctaccactccgcgccttctctctctaatcgatcacttatcaaaaaaccaaacgtcccatcccaacacctctcctcccaacctaacttccctcctacctacatcgtccacc

SEQ ID NO: 10861 - DNA, 571 bp, Artificial Sequence
  chemically treated genomic DNA (Homo sapiens) CpG-island No: 10861
cgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtatatgacgttatgttgggagatttttattgatattggcggtaagttgattgtttagaaggaggttaaaat

SEQ ID NO: 10862 - DNA, 571 bp, Artificial Sequence
  chemically treated genomic DNA (Homo sapiens) CpG-island No: 10862
attttaacctccttctaaacaatcaacttaccgccaatatcaataaaaatctcccaacataacgtcatatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacg

SEQ ID NO: 10863 - DNA, 571 bp, Artificial Sequence
  chemically treated genomic DNA (Homo sapiens) CpG-island No: 10863
gttttagtttttttttggataattagtttatcgttagtattaatggggattttttagtatgacgttatgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcg

SEQ ID NO: 10864 - DNA, 571 bp, Artificial Sequence
  chemically treated genomic DNA (Homo sapiens) CpG-island No: 10864
cgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacataacgtcatactaaaaaatccccattaatactaacgataaactaattatccaaaaaaaaactaaaac

SEQ ID NO: 10865 - DNA, 560 bp, Artificial Sequence
  chemically treated genomic DNA (Homo sapiens) CpG-island No: 10865
gttttcgttatcggcggtacgcgtattttttttgattggttggtgattgagtgtagcgttaatttcggcgagatatttttggatcggatgatcgcgatggtggaaggcgtatagcgacgtaaaacgtcgaacgaaattgttttgattattttgttgattgttttgattatcgtttttttattggtaatcgttacgttgtggtcgtttttcgcgtggggcggtaatgtagttagcgtaacggtattggtggcgttgttggtttgtttgattttaattattattggcggtttgttgttagcgatcggcgttttcgggatgagtcggatgttatgcgcgaatgtgattgttattagcggacgtgtagtttaagcggtaggtgacgttgacgttttgttattggataaaatcggtattattatattcggtaatcgttaggcggtcggatttattttcgcgtatggcgtggatgaaaaatacgttggtttaacgtcgtataattggttttttttggttgatgaaatcgtcggaaaggtcgtatttttttgatttttttttaataa

SEQ ID NO: 10866 - DNA, 560 bp, Artificial Sequence
  chemically treated genomic DNA (Homo sapiens) CpG-island No: 10866
ttattaaaaaaaaatcaaaaaaatacgacctttccgacgatttcatcaaccaaaaaaaaccaattatacgacgttaaaccaacgtatttttcatccacgccatacgcgaaaataaatccgaccgcctaacgattaccgaatataataataccgattttatccaataacaaaacgtcaacgtcacctaccgcttaaactacacgtccgctaataacaatcacattcgcgcataacatccgactcatcccgaaaacgccgatcgctaacaacaaaccgccaataataattaaaatcaaacaaaccaacaacgccaccaataccgttacgctaactacattaccgccccacgcgaaaaacgaccacaacgtaacgattaccaataaaaaaacgataatcaaaacaatcaacaaaataatcaaaacaatttcgttcgacgttttacgtcgctatacgccttccaccatcgcgatcatccgatccaaaaatatctcgccgaaattaacgctacactcaatcaccaaccaatcaaaaaaaatacgcgtaccgccgataacgaaaac

SEQ ID NO: 10867 - DNA, 560 bp, Artificial Sequence
  chemically treated genomic DNA (Homo sapiens) CpG-island No: 10867
ttgttgggaaagaattaaaaaaatgcggttttttcggcggttttattagttaggagaagttagttgtgcggcgttaggttagcgtattttttatttacgttatgcgcggggataaattcgatcgtttgacggttatcgagtgtgatggtgtcggttttatttagtagtagaacgttaacgttatttgtcgtttaaattgtacgttcgttggtggtaattatattcgcgtatagtattcggtttatttcggggacgtcgatcgttgataataggtcgttaatagtggttgggattagatagattagtagcgttattagtatcgttacgttgattgtattatcgttttacgcggaaaacggttatagcgtggcggttgttagtaaaaagacgatagttagggtaattagtagaatggttagggtaatttcgttcggcgttttgcgtcgttgtgcgttttttattatcgcgattattcgatttagaaatgtttcgtcggggttaacgttatatttaattattagttagttagaaagaatacgcgtgtcgtcggtgacggaggt

SEQ ID NO: 10868 - DNA, 560 bp, Artificial Sequence
  chemically treated genomic DNA (Homo sapiens) CpG-island No: 10868
acctccgtcaccgacgacacgcgtattctttctaactaactaataattaaatataacgttaaccccgacgaaacatttctaaatcgaataatcgcgataataaaaaacgcacaacgacgcaaaacgccgaacgaaattaccctaaccattctactaattaccctaactatcgtctttttactaacaaccgccacgctataaccgttttccgcgtaaaacgataatacaatcaacgtaacgatactaataacgctactaatctatctaatcccaaccactattaacgacctattatcaacgatcgacgtccccgaaataaaccgaatactatacgcgaatataattaccaccaacgaacgtacaatttaaacgacaaataacgttaacgttctactactaaataaaaccgacaccatcacactcgataaccgtcaaacgatcgaatttatccccgcgcataacgtaaataaaaaatacgctaacctaacgccgcacaactaacttctcctaactaataaaaccgccgaaaaaaccgcatttttttaattctttcccaacaa

SEQ ID NO: 10869 - DNA, 753 bp, Artificial Sequence
  chemically treated genomic DNA (Homo sapiens) CpG-island No: 10869
ggagcgcgttattttgtcgaaattatcgtttttgcgttcggattgcgttattattggcgaaacgacgttattataatcggtacgcgtatataaaggttatatttttaacgttattcgtatttacggttagtcggggtattttatcgaattagtaggcggaagttaatttatcgaattaacgtattatcgggattgagcgggattatacgtagttttgcgttaacgcgtgcgtaaagtatttgttaggaaataatgttagcgtggtgttttatttgattgatgatgatgttatcgttcgttcgtacgttgttgttgttttagttattggcgattagattgatttttttcgtcgtgtcgcggacgaatattagttttttcgtcgaacgggtattaataaatagcgatgttcgtttgcgtacgttttttattttgtcggtcgtttgggcgtttaaggtatgaatattacgatgtatcgtcgcgtagttatgacgataaaattcggtttcggcgttaattatttggttcggtttttgcgtattggcggcgttgtcgagataagttagcggtaaatcgtttattttacgcgaaagtatcggaaagtcggttcgtattttgtcgacggaaaaaattattttgtattttttggtagtcgttgatcgattttggttagtatttgttgtttaagttttttattacgtagtgttttcgttagttcggtagttaaggcgtaaatgattattttgttgggtattt

SEQ ID NO: 10870 - DNA, 753 bp, Artificial Sequence
  chemically treated genomic DNA (Homo sapiens) CpG-island No: 10870
aaatacccaacaaaataatcatttacgccttaactaccgaactaacgaaaacactacgtaataaaaaacttaaacaacaaatactaaccaaaatcgatcaacgactaccaaaaaatacaaaataattttttccgtcgacaaaatacgaaccgactttccgatactttcgcgtaaaataaacgatttaccgctaacttatctcgacaacgccgccaatacgcaaaaaccgaaccaaataattaacgccgaaaccgaattttatcgtcataactacgcgacgatacatcgtaatattcataccttaaacgcccaaacgaccgacaaaataaaaaacgtacgcaaacgaacatcgctatttattaatacccgttcgacgaaaaaactaatattcgtccgcgacacgacgaaaaaaatcaatctaatcgccaataactaaaacaacaacaacgtacgaacgaacgataacatcatcatcaatcaaataaaacaccacgctaacattatttcctaacaaatactttacgcacgcgttaacgcaaaactacgtataatcccgctcaatcccgataatacgttaattcgataaattaacttccgcctactaattcgataaaataccccgactaaccgtaaatacgaataacgttaaaaatataacctttatatacgcgtaccgattataataacgtcgtttcgccaataataacgcaatccgaacgcaaaaacgataatttcgacaaaataacgcgctcc

SEQ ID NO: 10871 - DNA, 753 bp, Artificial Sequence
  chemically treated genomic DNA (Homo sapiens) CpG-island No: 10871
ggatgtttagtaagatgattatttacgttttggttgtcgaattgacggaagtattgcgtgatgaggggtttaaatagtaggtgttggttagaatcggttaacggttgttaggaggtgtaagatgatttttttcgtcgataaagtgcgggtcgatttttcggtgttttcgcgtgaggtaaacggtttgtcgttggtttatttcgatagcgtcgttagtgcgtagaaatcgagttaggtgattgacgtcgaggtcgagttttatcgttatggttacgcggcggtgtatcgtggtatttatattttaagcgtttaggcgatcgataaaatggagaacgtgcgtaagcgggtatcgttgtttattaatgttcgttcggcggaagagttggtgttcgttcgcggtacgacggaagggattaatttggtcgttaatagttggggtaatagtaacgtgcgggcgggcgataatattattattagttagatggagtattacgttaatattgttttttggtagatgttttgcgtacgcgttggcgtagagttgcgtgtgatttcgtttaatttcgatggtacgttggttcgataggttaattttcgtttgttgattcgatggagtgtttcgattggtcgtgaatacggatggcgttagagatatgatttttatgtgcgcgtatcggttgtagtgacgtcgtttcgttaatgatggcgtaattcgggcgtaggggcggtagtttcggtaaaataacgcgtttt

SEQ ID NO: 10872 - DNA, 753 bp, Artificial Sequence
  chemically treated genomic DNA (Homo sapiens) CpG-island No: 10872
aaaacgcgttattttaccgaaactaccgcccctacgcccgaattacgccatcattaacgaaacgacgtcactacaaccgatacgcgcacataaaaatcatatctctaacgccatccgtattcacgaccaatcgaaacactccatcgaatcaacaaacgaaaattaacctatcgaaccaacgtaccatcgaaattaaacgaaatcacacgcaactctacgccaacgcgtacgcaaaacatctaccaaaaaacaatattaacgtaatactccatctaactaataataatattatcgcccgcccgcacgttactattaccccaactattaacgaccaaattaatcccttccgtcgtaccgcgaacgaacaccaactcttccgccgaacgaacattaataaacaacgatacccgcttacgcacgttctccattttatcgatcgcctaaacgcttaaaatataaataccacgatacaccgccgcgtaaccataacgataaaactcgacctcgacgtcaatcacctaactcgatttctacgcactaacgacgctatcgaaataaaccaacgacaaaccgtttacctcacgcgaaaacaccgaaaaatcgacccgcactttatcgacgaaaaaaatcatcttacacctcctaacaaccgttaaccgattctaaccaacacctactatttaaacccctcatcacgcaatacttccgtcaattcgacaaccaaaacgtaaataatcatcttactaaacatcc

SEQ ID NO: 10873 - DNA, 817 bp, Artificial Sequence
  chemically treated genomic DNA (Homo sapiens) CpG-island No: 10873
tgggtcgggcgtacgatgttcgcggtgttggggaaattcggtcggattagtttttgcgatgggcggcggggcggtttagcgttttttggttttggtggatcggtttttaggtattcgaagggacgtggggtttggtaaattgggtggggttcgcgcggggtgcggggagtttgcggttttttggtataggggtggggtcgtagacgtcgtgagtgtgtagcgcgtgtgagtgtgcgggggcgtgttttttcgtgtgcgcgcgtcgtgcgttcgttggggaggtgcggggattcggcgattcggagcgtttttttcgcggtgtcgcggtgcggaagtcggggcgcgttggcgcgtacgttcgttcgtttttttttttggtcgttgttttcgtatcgcggggaagcgggtttggaggtttttttgagaagtagtttttttcggtcggcggtatttttggttgcgtgttcggtcgcgtttagggtgcgattgttcgggttagatagtattttagggcgagtttcggcggtttgatttcgtcgatttttttcgttttggttgtaattcgcgtgcgaggtcgttcgcgtttttcgagtgtttgtcggtgtagtgggggtggattggtcggttgtggtcgtgtgtgcgcgtgtggattggggttcggttcgagttagaagtttaagcggtagatgtcgggtattgttattttcgttttatttgtcgcgggtggattttggggtaggtgggaagcggaggagaggggtttcgaggcgggtggtagttagatttttagtaacgcggttttattgtgaagttgtta

SEQ ID NO: 10874 - DNA, 817 bp, Artificial Sequence
  chemically treated genomic DNA (Homo sapiens) CpG-island No: 10874
taacaacttcacaataaaaccgcgttactaaaaatctaactaccacccgcctcgaaacccctctcctccgcttcccacctaccccaaaatccacccgcgacaaataaaacgaaaataacaatacccgacatctaccgcttaaacttctaactcgaaccgaaccccaatccacacgcgcacacacgaccacaaccgaccaatccacccccactacaccgacaaacactcgaaaaacgcgaacgacctcgcacgcgaattacaaccaaaacgaaaaaaatcgacgaaatcaaaccgccgaaactcgccctaaaatactatctaacccgaacaatcgcaccctaaacgcgaccgaacacgcaaccaaaaataccgccgaccgaaaaaaactacttctcaaaaaaacctccaaacccgcttccccgcgatacgaaaacaacgaccaaaaaaaaaaacgaacgaacgtacgcgccaacgcgccccgacttccgcaccgcgacaccgcgaaaaaaacgctccgaatcgccgaatccccgcacctccccaacgaacgcacgacgcgcgcacacgaaaaaacacgcccccgcacactcacacgcgctacacactcacgacgtctacgaccccacccctataccaaaaaaccgcaaactccccgcaccccgcgcgaaccccacccaatttaccaaaccccacgtcccttcgaatacctaaaaaccgatccaccaaaaccaaaaaacgctaaaccgccccgccgcccatcgcaaaaactaatccgaccgaatttccccaacaccgcgaacatcgtacgcccgaccca

SEQ ID NO: 10875 - DNA, 817 bp, Artificial Sequence
  chemically treated genomic DNA (Homo sapiens) CpG-island No: 10875
tggtagttttataatggggtcgcgttgttggaggtttgattgttattcgtttcgaaatttttttttttcgttttttatttgttttaaagtttattcgcgataggtggggcgagggtggtaatgttcgatatttgtcgtttaagtttttggttcggatcgggttttaatttatacgcgtatatacggttatagtcggttagtttatttttattgtatcggtagatattcggagggcgcgggcggtttcgtacgcgggttgtaattaggacgaggagggtcggcgagattagatcgtcggggttcgttttgaggtgttatttgattcgggtagtcgtattttgagcgcggtcgggtacgtagttaaaggtgtcgtcggtcggggaaagttattttttaaaggggtttttaggttcgttttttcgcggtgcgggaatagcggttaagggagggagcgagcgagcgtgcgcgttaacgcgtttcgattttcgtatcgcggtatcgcgggagaggcgtttcgggtcgtcgagttttcgtatttttttagcgagcgtacgacgcgcgtatacgggggggtacgttttcgtatatttatacgcgttgtatatttacggcgtttgcggttttatttttgtgttagggaatcgtaagtttttcgtatttcgcgcgggttttatttagtttattagattttacgttttttcgggtgtttgggaatcggtttattaaggttaagggacgttgggtcgtttcgtcgtttatcgtagaagttggttcggtcgggtttttttagtatcgcgggtatcgtgcgttcggttta

SEQ ID NO: 10876 - DNA, 817 bp, Artificial Sequence
  chemically treated genomic DNA (Homo sapiens) CpG-island No: 10876
taaaccgaacgcacgatacccgcgatactaaaaaaacccgaccgaaccaacttctacgataaacgacgaaacgacccaacgtcccttaaccttaataaaccgattcccaaacacccgaaaaaacgtaaaatctaataaactaaataaaacccgcgcgaaatacgaaaaacttacgattccctaacacaaaaataaaaccgcaaacgccgtaaatatacaacgcgtataaatatacgaaaacgtacccccccgtatacgcgcgtcgtacgctcgctaaaaaaatacgaaaactcgacgacccgaaacgcctctcccgcgataccgcgatacgaaaatcgaaacgcgttaacgcgcacgctcgctcgctccctcccttaaccgctattcccgcaccgcgaaaaaacgaacctaaaaacccctttaaaaaataactttccccgaccgacgacacctttaactacgtacccgaccgcgctcaaaatacgactacccgaatcaaataacacctcaaaacgaaccccgacgatctaatctcgccgaccctcctcgtcctaattacaacccgcgtacgaaaccgcccgcgccctccgaatatctaccgatacaataaaaataaactaaccgactataaccgtatatacgcgtataaattaaaacccgatccgaaccaaaaacttaaacgacaaatatcgaacattaccaccctcgccccacctatcgcgaataaactttaaaacaaataaaaaacgaaaaaaaaaaatttcgaaacgaataacaatcaaacctccaacaacgcgaccccattataaaactacca

SEQ ID NO: 10877 - DNA, 603 bp, Artificial Sequence
  chemically treated genomic DNA (Homo sapiens) CpG-island No: 10877
agggtatttataatattagttacggtaattataattattgtttgatcgttttttagtaggcgattttcgatagttgtcgttaagtggtttttttcggtattaggtttttcgttgaacgtaaaatttgtatattcggttattagtttattagcgatggatttcgtttgatttaacgcgtatcgttgtttttcgttttgtatttgggtaattcgaaaacgagtatttgcggtgtaatggttggatgttagagggattgtagaattttttttattcgtaagttgacgattttgacgggttgatttttttatagacgttttttggttttcggaaagttggtattcgcgttagttcggtaacggttttaaaatgtcgtcgtttaggtgtgacgcggtcgagtttaggagacgatgaagttggcggcgtgtttcgatgtgggtgagatgcgggtgatcgaggtgaggtttgggatgttcgcgaggagtcgggaaggaataggtgtgtgagtaggagacgtgcgtgtggtagatattttgtggcgcgttatgagtttattcggtatcggggatttttagagtttattttaattttttttttaatttaatt

SEQ ID NO: 10878 - DNA, 603 bp, Artificial Sequence
  chemically treated genomic DNA (Homo sapiens) CpG-island No: 10878
aattaaattaaaaaaaaaattaaaataaactctaaaaatccccgataccgaataaactcataacgcgccacaaaatatctaccacacgcacgtctcctactcacacacctattccttcccgactcctcgcgaacatcccaaacctcacctcgatcacccgcatctcacccacatcgaaacacgccgccaacttcatcgtctcctaaactcgaccgcgtcacacctaaacgacgacattttaaaaccgttaccgaactaacgcgaataccaactttccgaaaaccaaaaaacgtctataaaaaaatcaacccgtcaaaatcgtcaacttacgaataaaaaaaattctacaatccctctaacatccaaccattacaccgcaaatactcgttttcgaattacccaaatacaaaacgaaaaacaacgatacgcgttaaatcaaacgaaatccatcgctaataaactaataaccgaatatacaaattttacgttcaacgaaaaacctaataccgaaaaaaaccacttaacgacaactatcgaaaatcgcctactaaaaaacgatcaaacaataattataattaccgtaactaatattataaataccct

SEQ ID NO: 10879 - DNA, 603 bp, Artificial Sequence
  chemically treated genomic DNA (Homo sapiens) CpG-island No: 10879
agttaagttgaagaagaggttggagtagattttagagattttcggtatcgagtaagtttatgacgcgttataaagtgtttattatacgtacgttttttatttatatatttattttttttcggtttttcgcgaatattttaggttttatttcggttattcgtattttatttatatcggaatacgtcgttaattttatcgttttttagattcggtcgcgttatatttaagcggcgatattttaagatcgttatcggattggcgcgagtgttaatttttcgaaggttaggaaacgtttgtgaggagattaattcgttagaatcgttagtttgcgggtggaaaaaattttgtaatttttttggtatttagttattgtatcgtaaatgttcgttttcgaattatttaggtgtagaacgaagggtagcgatacgcgttgagttaggcgaaatttatcgttgatgaattgatgatcgggtgtataaattttgcgtttagcggaaaatttggtatcgggaagaattatttagcggtagttatcgggaatcgtttgttgaaagacggttagatagtgattgtggttatcgtggttgatgttatgagtgtttt

SEQ ID NO: 10880 - DNA, 603 bp, Artificial Sequence
  chemically treated genomic DNA (Homo sapiens) CpG-island No: 10880
aaaacactcataacatcaaccacgataaccacaatcactatctaaccgtctttcaacaaacgattcccgataactaccgctaaataattcttcccgataccaaattttccgctaaacgcaaaatttatacacccgatcatcaattcatcaacgataaatttcgcctaactcaacgcgtatcgctacccttcgttctacacctaaataattcgaaaacgaacatttacgatacaataactaaataccaaaaaaattacaaaattttttccacccgcaaactaacgattctaacgaattaatctcctcacaaacgtttcctaaccttcgaaaaattaacactcgcgccaatccgataacgatcttaaaatatcgccgcttaaatataacgcgaccgaatctaaaaaacgataaaattaacgacgtattccgatataaataaaatacgaataaccgaaataaaacctaaaatattcgcgaaaaaccgaaaaaaaataaatatataaataaaaaacgtacgtataataaacactttataacgcgtcataaacttactcgataccgaaaatctctaaaatctactccaacctcttcttcaacttaact

SEQ ID NO: 10881 - DNA, 529 bp, Artificial Sequence
  chemically treated genomic DNA (Homo sapiens) CpG-island No: 10881
aacggagagtgtcggtagcgttttaacgttttgcgtgtcgtaaacggtgttagaaatgtttagttcgttaaggttcgtgatcgtaacgatatcgttagttttcgttagatcggtttcgatacgttttagatcgaggtggtttagtattttatcgattttcgcgttgcgggttttgttttcgttatcgatgatagtgatttgttggttcggttttattttatcgcgtttgatgcggttaatgtcgataacgttaatatagttgttgtaatcgagttgagaaatttgtatttggaacggatcgttaaggttaacgttcggcgtaggaacgtggttaataatcgtttggtatagcggggttatgtttttcgttatattttcgtggtttagattcgcgatatcgtttagcgtagaagcgtaaacgatcgggaagtttagttgttcgtcggtcgcgtcgaggttaacgaatagatcgaatatttgatttataaattaattaaggacgcgcggtaaggggtttaaattttgttgt

SEQ ID NO: 10882 - DNA, 529 bp, Artificial Sequence
  chemically treated genomic DNA (Homo sapiens) CpG-island No: 10882
acaacaaaatttaaaccccttaccgcgcgtccttaattaatttataaatcaaatattcgatctattcgttaacctcgacgcgaccgacgaacaactaaacttcccgatcgtttacgcttctacgctaaacgatatcgcgaatctaaaccacgaaaatataacgaaaaacataaccccgctataccaaacgattattaaccacgttcctacgccgaacgttaaccttaacgatccgttccaaatacaaatttctcaactcgattacaacaactatattaacgttatcgacattaaccgcatcaaacgcgataaaataaaaccgaaccaacaaatcactatcatcgataacgaaaacaaaacccgcaacgcgaaaatcgataaaatactaaaccacctcgatctaaaacgtatcgaaaccgatctaacgaaaactaacgatatcgttacgatcacgaaccttaacgaactaaacatttctaacaccgtttacgacacgcaaaacgttaaaacgctaccgacactctccgtt

SEQ ID NO: 10883 - DNA, 529 bp, Artificial Sequence
  chemically treated genomic DNA (Homo sapiens) CpG-island No: 10883
ataataaagtttgaattttttgtcgcgcgtttttaattggtttgtgaattaggtattcgatttgttcgttaatttcgacgcgatcgacgagtagttggatttttcgatcgtttacgtttttgcgttgaacggtatcgcgggtttggattacgaagatatggcggaagatatgatttcgttgtattaggcgattgttgattacgtttttgcgtcggacgttgattttgacggttcgttttagatgtagattttttagttcgattataatagttatgttggcgttatcggtattggtcgtattaagcgcggtaaagtgaagtcgaattagtaggttattattatcgatagcgaaggtaaaattcgtaacgcgaaagtcggtaaagtgttgggttatttcggtttggaacgtatcgaaatcgatttggcggaagttggcgatatcgttgcgattacgggttttggcgaattgaatatttttgatatcgtttgcgatacgtaaaacgttgaagcgttgtcggtatttttcgtt

SEQ ID NO: 10884 - DNA, 529 bp, Artificial Sequence
  chemically treated genomic DNA (Homo sapiens) CpG-island No: 10884
aacgaaaaataccgacaacgcttcaacgttttacgtatcgcaaacgatatcaaaaatattcaattcgccaaaacccgtaatcgcaacgatatcgccaacttccgccaaatcgatttcgatacgttccaaaccgaaataacccaacactttaccgactttcgcgttacgaattttaccttcgctatcgataataataacctactaattcgacttcactttaccgcgcttaatacgaccaataccgataacgccaacataactattataatcgaactaaaaaatctacatctaaaacgaaccgtcaaaatcaacgtccgacgcaaaaacgtaatcaacaatcgcctaatacaacgaaatcatatcttccgccatatcttcgtaatccaaacccgcgataccgttcaacgcaaaaacgtaaacgatcgaaaaatccaactactcgtcgatcgcgtcgaaattaacgaacaaatcgaatacctaattcacaaaccaattaaaaacgcgcgacaaaaaattcaaactttattat

SEQ ID NO: 10885 - DNA, 1017 bp, Artificial Sequence
  chemically treated genomic DNA (Homo sapiens) CpG-island No: 10885
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtggtttacgattatagtagtttagcgcgaacgtgatacgtagttttttttcgttattataagagaatttgaattcgttaggaggatatcgttgattgtttttttttagggttattttgtttgtatgtgttcgtttcgatgggcggtaaagaagtttttcggtaagtaataagggatgaacgagtcggttcggggatttttagagtttgttagggcgaatcgagaatgtattttgcgaggcgcgatcgaatttatgatatttcggtttcggtaaggcgcgaatggtgtgttttatagtagttgtttaacgttttggtttttatagaattacgtttcgatttgttaatcgggagtcggttatattttttagtaaacggttttttagttcgttaatttttattttgagatcggtgttgtatgagtttattatcggcggaatattaatattattcgcgatcgttagataattgcgtatttcgtgttgcgggcgtttaagcgttaaacgttggtttgtttttatcggtaatcgtagtcggtttagacggtattattatttagtcgcgtttcgtaatcggtattcgttagagtaaattatttattagttttggatttaatagttaattgatcgagcgtgattttaagcgcggggggaattggcggtaatatttattagttagtttagtaatggtaacggggggtatattaagtgcgtcgaagtgggtgatattcgatttggggaaaatcgttgaggtcggtattttttagaagtggtataaatggtcgtacgaataattttcgggatattttcgttttt

SEQ ID NO: 10886 - DNA, 1017 bp, Artificial Sequence
  chemically treated genomic DNA (Homo sapiens) CpG-island No: 10886
aaaaacgaaaatatcccgaaaattattcgtacgaccatttataccacttctaaaaaataccgacctcaacgattttccccaaatcgaatatcacccacttcgacgcacttaatataccccccgttaccattactaaactaactaataaatattaccgccaattccccccgcgcttaaaatcacgctcgatcaattaactattaaatccaaaactaataaataatttactctaacgaataccgattacgaaacgcgactaaataataataccgtctaaaccgactacgattaccgataaaaacaaaccaacgtttaacgcttaaacgcccgcaacacgaaatacgcaattatctaacgatcgcgaataatattaatattccgccgataataaactcatacaacaccgatctcaaaataaaaattaacgaactaaaaaaccgtttactaaaaaatataaccgactcccgattaacaaatcgaaacgtaattctataaaaaccaaaacgttaaacaactactataaaacacaccattcgcgccttaccgaaaccgaaatatcataaattcgatcgcgcctcgcaaaatacattctcgattcgccctaacaaactctaaaaatccccgaaccgactcgttcatcccttattacttaccgaaaaacttctttaccgcccatcgaaacgaacacatacaaacaaaataaccctaaaaaaaaacaatcaacgatatcctcctaacgaattcaaattctcttataataacgaaaaaaaactacgtatcacgttcgcgctaaactactataatcgtaaaccactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 10887 - DNA, 1017 bp, Artificial Sequence
  chemically treated genomic DNA (Homo sapiens) CpG-island No: 10887
aaagacgggaatatttcgaagattattcgtgcggttatttatattatttttgaagaatgtcggttttaacggttttttttaagtcgggtattatttatttcggcgtatttgatatgtttttcgttattattgttaaattaattggtgggtattatcgttaatttttttcgcgtttgagattacgttcggttagttaattgttgagtttaaaattgatgggtggtttgttttgacgggtgtcggttgcgaagcgcggttggatgataatgtcgtttggatcggttgcgattgtcgatgaaagtaggttagcgtttaacgtttaaacgttcgtagtacgggatgcgtagttatttggcggtcgcgggtggtattgatgtttcgtcggtaatgggtttatgtagtatcgattttaaagtggggattggcgggttggaaggtcgtttattgaaggatgtgatcgattttcgattggtaaatcgaagcgtgattttatggaagttagggcgttaaatagttgttgtggggtatattattcgcgttttgtcggggtcggaatattatgagttcgatcgcgtttcgtaggatgtattttcggttcgttttggtagattttagagattttcggatcggttcgtttattttttgttgtttatcgaaaaatttttttatcgtttatcgaaacgggtatatataggtagagtggttttgaaagaaagtaattagcgatgtttttttgacgggtttaagtttttttgtgataacggagagagattgcgtgttacgttcgcgttggattgttgtgatcgtgagttattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 10888 - DNA, 1017 bp, Artificial Sequence
  chemically treated genomic DNA (Homo sapiens) CpG-island No: 10888
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaataactcacgatcacaacaatccaacgcgaacgtaacacgcaatctctctccgttatcacaaaaaaacttaaacccgtcaaaaaaacatcgctaattactttctttcaaaaccactctacctatatatacccgtttcgataaacgataaaaaaatttttcgataaacaacaaaaaataaacgaaccgatccgaaaatctctaaaatctaccaaaacgaaccgaaaatacatcctacgaaacgcgatcgaactcataatattccgaccccgacaaaacgcgaataatataccccacaacaactatttaacgccctaacttccataaaatcacgcttcgatttaccaatcgaaaatcgatcacatccttcaataaacgaccttccaacccgccaatccccactttaaaatcgatactacataaacccattaccgacgaaacatcaataccacccgcgaccgccaaataactacgcatcccgtactacgaacgtttaaacgttaaacgctaacctactttcatcgacaatcgcaaccgatccaaacgacattatcatccaaccgcgcttcgcaaccgacacccgtcaaaacaaaccacccatcaattttaaactcaacaattaactaaccgaacgtaatctcaaacgcgaaaaaaattaacgataatacccaccaattaatttaacaataataacgaaaaacatatcaaatacgccgaaataaataatacccgacttaaaaaaaaccgttaaaaccgacattcttcaaaaataatataaataaccgcacgaataatcttcgaaatattcccgtcttt

SEQ ID NO: 10889 - DNA, 710 bp, Artificial Sequence
  chemically treated genomic DNA (Homo sapiens) CpG-island No: 10889
attggtcggataatagggttgtttagtggcgtatacgtgtatcgtattagtggcgtagcgggtatgtttttcgggtatgtcgggtcgtgtattagttatatcgtcgaaaggcggatatttttgtcggggtcgtattcggtatcgggtagtgtgtcggggaacgttgaggttgagagagggcgggaattgttagaagaagatagcgaagaggtgcgggtttttttcgtacgttgcgtttgcgtggttagtattagacggaattttcgttcggtatcgttcgttacgtcggtgattttttcggttaggttatcggcggttttacgtcggtacgttagcgttcgttcgaagcggttcgttatttcggtaagtattcggtacggcggtagcggcgttggtagtacgtttttagtattcggtattcgtttagattattttagtatttattacggtttttgtgcgttgttggtcgttaggtaaagatgcgggtttaatcggatattcggcggtagcgttttttatagtcgcgttagcgtatggtcgttcggttgtgttgtttttattatcgcggtatagttatattgatttattgcggttgtatatcgtttttttcggtagtagcggtttaaagtgaatgtttcgttcgtcgttgtttttgagtattagttcgttattacgtagttttaaagcggatatagaaggcgtttttgtta

SEQ ID NO: 10890 - DNA, 710 bp, Artificial Sequence
  chemically treated genomic DNA (Homo sapiens) CpG-island No: 10890
taacaaaaacgccttctatatccgctttaaaactacgtaataacgaactaatactcaaaaacaacgacgaacgaaacattcactttaaaccgctactaccgaaaaaaacgatatacaaccgcaataaatcaatataactataccgcgataataaaaacaacacaaccgaacgaccatacgctaacgcgactataaaaaacgctaccgccgaatatccgattaaacccgcatctttacctaacgaccaacaacgcacaaaaaccgtaataaatactaaaataatctaaacgaataccgaatactaaaaacgtactaccaacgccgctaccgccgtaccgaatacttaccgaaataacgaaccgcttcgaacgaacgctaacgtaccgacgtaaaaccgccgataacctaaccgaaaaaatcaccgacgtaacgaacgataccgaacgaaaattccgtctaatactaaccacgcaaacgcaacgtacgaaaaaaacccgcacctcttcgctatcttcttctaacaattcccgccctctctcaacctcaacgttccccgacacactacccgataccgaatacgaccccgacaaaaatatccgcctttcgacgatataactaatacacgacccgacatacccgaaaaacatacccgctacgccactaatacgatacacgtatacgccactaaacaaccctattatccgaccaat

SEQ ID NO: 10891 - DNA, 710 bp, Artificial Sequence
  chemically treated genomic DNA (Homo sapiens) CpG-island No: 10891
taatagaagcgttttttatattcgttttaaagttacgtgatgacgaattgatatttaagaataacggcgggcggagtatttattttgagtcgttgttgtcgggggaggcggtgtatagtcgtaatgagttaatgtggttgtgtcgcggtggtaaaggtagtatagtcggacggttatacgttggcgcggttgtggggggcgttgtcgtcggatattcggttaagttcgtatttttatttggcgattaatagcgtataggggtcgtggtggatattggggtggtttgagcgggtgtcgggtgttgaggacgtattgttagcgtcgttgtcgtcgtatcgggtgtttatcgggatggcggatcgtttcgggcggacgttgacgtatcggcgtgaggtcgtcggtgatttggtcggggaaattatcggcgtgacggacggtgtcgggcgggagtttcgtttggtgttgattacgtaggcgtagcgtgcggaagaggttcgtattttttcgttatttttttttgatagttttcgtttttttttagttttagcgtttttcgatatattgttcggtatcgaatacggtttcgataggggtattcgtttttcggcggtgtggttgatgtacgattcggtatattcggagagtatgttcgttgcgttattggtgcggtatacgtatacgttattgaataattttattgttcggttaat

SEQ ID NO: 10892 - DNA, 710 bp, Artificial Sequence
  chemically treated genomic DNA (Homo sapiens) CpG-island No: 10892
attaaccgaacaataaaattattcaataacgtatacgtataccgcaccaataacgcaacgaacatactctccgaatataccgaatcgtacatcaaccacaccgccgaaaaacgaatacccctatcgaaaccgtattcgataccgaacaatatatcgaaaaacgctaaaactaaaaaaaaacgaaaactatcaaaaaaaaataacgaaaaaatacgaacctcttccgcacgctacgcctacgtaatcaacaccaaacgaaactcccgcccgacaccgtccgtcacgccgataatttccccgaccaaatcaccgacgacctcacgccgatacgtcaacgtccgcccgaaacgatccgccatcccgataaacacccgatacgacgacaacgacgctaacaatacgtcctcaacacccgacacccgctcaaaccaccccaatatccaccacgacccctatacgctattaatcgccaaataaaaatacgaacttaaccgaatatccgacgacaacgccccccacaaccgcgccaacgtataaccgtccgactatactacctttaccaccgcgacacaaccacattaactcattacgactatacaccgcctcccccgacaacaacgactcaaaataaatactccgcccgccgttattcttaaatatcaattcgtcatcacgtaactttaaaacgaatataaaaaacgcttctatta

SEQ ID NO: 10893 - DNA, 1215 bp, Artificial Sequence
  chemically treated genomic DNA (Homo sapiens) CpG-island No: 10893
cgtgtcgcgtacgtttacgtttattcgcgttgttttagagtattattcgcgttgggttatttatcgattatgtttgaacgtaagaggcggagcgacgggtttttttttttatttgatggttgttggatcgttcgttttacgtattttttttgtttcggaggcgtcgatattcgttttttagtgtatcgggagtagaaattcggtagacgcgcgggtaattcgggttaagcgttattttttagtttttcgcgtttcggagtcgcgttttcgaggggttcgggatatttatttttgagcgcgtttatgagtgatttttcgtttttgatgagttttttgatgaatttgttggttttgtttagttttgtttcgtgcgatttgagcgtttttcggaagtgcggattatcgaggtagtagtcgttgaattcgagcgttgggagttttatggtgcgcgcggcgtttagtcggggggcgcgttttcgtcggggttcgggtcgttcgtcgtttagagtatttacgcggcgggatttcggtcggttttttcgacggtcgtcggttttataggtgtggcgttggtttatttcgcgcgcggtgttcgtcggcgcgtaagattttcgaatcgagttcggattcggtcgaggtgttgttgtttcgggcgcgggtaacggagcggatcgcgagtaggaaacgtagcgcggattcgtagcggcgtcgggaagcgagcgagcgggcgagcgagtgtagacgtcgttttttcgtttttttcgttagttagttttcggtagtttcgagcgtttttttatagtagtttcggtcgtttcgtcggtgtttgggtcgttcgaatttgttagcgatgatttaattttcgtcgggttaattagcgtatttttttttgttcgatttttaggtcgttcgaggacgttcggttttttcgcggttttgatttaattaaaggggtttggaggtagggtttgcggttgggggcgtggttttcgttaacgtttaggttcgtagcgtaaatttcgtttttttttgtttttttagcgttgtagatttcgaaatttaggggtgagcgttgttgtgtattcgttttcgttattttgttcgtttgttttagttcgaattcgagttacgtatggcgagtttgttggttttgggggtcgaagagtttcgatgtgttaagtatgaaaaatttggggattagggttgtagtttatt

SEQ ID NO: 10894 - DNA, 1215 bp, Artificial Sequence
  chemically treated genomic DNA (Homo sapiens) CpG-island No: 10894
aataaactacaaccctaatccccaaatttttcatacttaacacatcgaaactcttcgacccccaaaaccaacaaactcgccatacgtaactcgaattcgaactaaaacaaacgaacaaaataacgaaaacgaatacacaacaacgctcacccctaaatttcgaaatctacaacgctaaaaaaacaaaaaaaaacgaaatttacgctacgaacctaaacgttaacgaaaaccacgcccccaaccgcaaaccctacctccaaacccctttaattaaatcaaaaccgcgaaaaaaccgaacgtcctcgaacgacctaaaaatcgaacaaaaaaaaatacgctaattaacccgacgaaaattaaatcatcgctaacaaattcgaacgacccaaacaccgacgaaacgaccgaaactactataaaaaaacgctcgaaactaccgaaaactaactaacgaaaaaaacgaaaaaacgacgtctacactcgctcgcccgctcgctcgcttcccgacgccgctacgaatccgcgctacgtttcctactcgcgatccgctccgttacccgcgcccgaaacaacaacacctcgaccgaatccgaactcgattcgaaaatcttacgcgccgacgaacaccgcgcgcgaaataaaccaacgccacacctataaaaccgacgaccgtcgaaaaaaccgaccgaaatcccgccgcgtaaatactctaaacgacgaacgacccgaaccccgacgaaaacgcgccccccgactaaacgccgcgcgcaccataaaactcccaacgctcgaattcaacgactactacctcgataatccgcacttccgaaaaacgctcaaatcgcacgaaacaaaactaaacaaaaccaacaaattcatcaaaaaactcatcaaaaacgaaaaatcactcataaacgcgctcaaaaataaatatcccgaacccctcgaaaacgcgactccgaaacgcgaaaaactaaaaaataacgcttaacccgaattacccgcgcgtctaccgaatttctactcccgatacactaaaaaacgaatatcgacgcctccgaaacaaaaaaaatacgtaaaacgaacgatccaacaaccatcaaataaaaaaaaaaacccgtcgctccgcctcttacgttcaaacataatcgataaataacccaacgcgaataatactctaaaacaacgcgaataaacgtaaacgtacgcgacacg

SEQ ID NO: 10895 - DNA, 1215 bp, Artificial Sequence
  chemically treated genomic DNA (Homo sapiens) CpG-island No: 10895
ggtgaattgtagttttagtttttaggttttttatgtttggtatatcgaggtttttcggtttttaggattagtagattcgttatgcgtggttcggattcgggttggagtaggcgggtaaggtagcgggggcgggtgtatagtaacgtttatttttaggtttcggggtttgtaacgttgggagggtaagaggaggcggagtttgcgttgcggatttaggcgttggcgagggttacgtttttagtcgtagattttgtttttaggtttttttgattggattaagatcgcggaagggtcgggcgttttcgggcggtttgagggtcgggtaggggagggtgcgttgattggttcggcggggattaagttatcgttagtaggttcgagcggtttagatatcggcggggcggtcgaggttgttgtgagagggcgttcgaggttgtcgagagttagttagcgaaggaggcggggaggcggcgtttgtattcgttcgttcgttcgttcgtttttcggcgtcgttgcgggttcgcgttgcgttttttgttcgcgattcgtttcgttgttcgcgttcggaatagtagtatttcggtcgggttcgagttcggttcgggagttttgcgcgtcggcggatatcgcgcgcggagtgagttagcgttatatttgtggagtcggcggtcgtcgggggagtcggtcggggtttcgtcgcgtgagtgttttgggcggcgggcggttcgggtttcggcggaggcgcgtttttcggttgggcgtcgcgcgtattatggggtttttagcgttcgagtttagcgattgttgtttcgatagttcgtattttcgagagacgtttaagtcgtacgaagtagagttggataagattaataaatttattaaggagtttattaaggacgggaagttatttataagcgcgtttaagagtgagtgtttcgagtttttcgggaacgcggtttcgggacgcgaggaattgggaggtggcgtttagttcgggttgttcgcgcgtttgtcgggtttttgttttcggtatattgggggacgggtgtcgacgttttcgaggtaggaaggatacgtaaagcgggcgatttagtaattattagatgaagagagagattcgtcgtttcgttttttgcgtttaggtatggtcggtaggtgatttagcgcgggtggtgttttggggtagcgcgggtgggcgtgggcgtgcgcggtacg

SEQ ID NO: 10896 - DNA, 1215 bp, Artificial Sequence
  chemically treated genomic DNA (Homo sapiens) CpG-island No: 10896
cgtaccgcgcacgcccacgcccacccgcgctaccccaaaacaccacccgcgctaaatcacctaccgaccatacctaaacgcaaaaaacgaaacgacgaatctctctcttcatctaataattactaaatcgcccgctttacgtatccttcctacctcgaaaacgtcgacacccgtcccccaatataccgaaaacaaaaacccgacaaacgcgcgaacaacccgaactaaacgccacctcccaattcctcgcgtcccgaaaccgcgttcccgaaaaactcgaaacactcactcttaaacgcgcttataaataacttcccgtccttaataaactccttaataaatttattaatcttatccaactctacttcgtacgacttaaacgtctctcgaaaatacgaactatcgaaacaacaatcgctaaactcgaacgctaaaaaccccataatacgcgcgacgcccaaccgaaaaacgcgcctccgccgaaacccgaaccgcccgccgcccaaaacactcacgcgacgaaaccccgaccgactcccccgacgaccgccgactccacaaatataacgctaactcactccgcgcgcgatatccgccgacgcgcaaaactcccgaaccgaactcgaacccgaccgaaatactactattccgaacgcgaacaacgaaacgaatcgcgaacaaaaaacgcaacgcgaacccgcaacgacgccgaaaaacgaacgaacgaacgaacgaatacaaacgccgcctccccgcctccttcgctaactaactctcgacaacctcgaacgccctctcacaacaacctcgaccgccccgccgatatctaaaccgctcgaacctactaacgataacttaatccccgccgaaccaatcaacgcaccctcccctacccgaccctcaaaccgcccgaaaacgcccgacccttccgcgatcttaatccaatcaaaaaaacctaaaaacaaaatctacgactaaaaacgtaaccctcgccaacgcctaaatccgcaacgcaaactccgcctcctcttaccctcccaacgttacaaaccccgaaacctaaaaataaacgttactatacacccgcccccgctaccttacccgcctactccaacccgaatccgaaccacgcataacgaatctactaatcctaaaaaccgaaaaacctcgatataccaaacataaaaaacctaaaaactaaaactacaattcacc

SEQ ID NO: 10897 - DNA, 539 bp, Artificial Sequence
  chemically treated genomic DNA (Homo sapiens) CpG-island No: 10897
  misc_feature (322)..(322): n is either a, c, g or t
ggttggattgatcgtcgcgtttcgttattcggatttcgggttttcgttttttttcggggattaggttagagaagtcggcgggattcgagtcgatttcgttcgtagcgtagcggatagggagcgagcgaggagggagggagtagcggcgttcggatttatcgtgattcgcgggatgttttttttgttttggtaggatatggtggcggtggtggttgtagcggttggtttttttttttttttttttgtttcggttcgttcgcgttttttttagcgtatagcgtttcgagattaggtggagtgaatggtgcgttggtcgcgtcgncgttttcgttcgttttcgtttttttttcgggttttcgcggcggttgttagagataatagtaaattttttcggttttttttttattttcgtttttttacgtatatttttttttattcgcgtttacgttcgggttttggtttttttttttttttgttgcgttagttgggattttataagataagaatggttgatttgcgattttttttttttttttttt

SEQ ID NO: 10898 - DNA, 539 bp, Artificial Sequence
  chemically treated genomic DNA (Homo sapiens) CpG-island No: 10898
  misc_feature (218)..(218): n is either a, c, g or t
aaaaaaaaaaaaaaaaaaatcgcaaatcaaccattcttatcttataaaatcccaactaacgcaacaaaaaaaaaaaaaaaccaaaacccgaacgtaaacgcgaataaaaaaaaatatacgtaaaaaaacgaaaataaaaaaaaaaccgaaaaaatttactattatctctaacaaccgccgcgaaaacccgaaaaaaaaacgaaaacgaacgaaaacgncgacgcgaccaacgcaccattcactccacctaatctcgaaacgctatacgctaaaaaaaacgcgaacgaaccgaaacaaaaaaaaaaaaaaaaaaaccaaccgctacaaccaccaccgccaccatatcctaccaaaacaaaaaaaacatcccgcgaatcacgataaatccgaacgccgctactccctccctcctcgctcgctccctatccgctacgctacgaacgaaatcgactcgaatcccgccgacttctctaacctaatccccgaaaaaaaacgaaaacccgaaatccgaataacgaaacgcgacgatcaatccaacc

SEQ ID NO: 10899 - DNA, 539 bp, Artificial Sequence
  chemically treated genomic DNA (Homo sapiens) CpG-island No: 10899
  misc_feature (218)..(218): n is either a, c, g or t
aagagagaagagggaggagtcgtagattagttatttttgttttatggggttttagttggcgtagtaaaagaaaaaaaaaattaaaattcgggcgtgaacgcgggtgaaggagggtgtgcgtgggggggcgggggtgaaagggggatcggggagatttattattgtttttggtagtcgtcgcgggagttcgggaggggggcggaggcgggcggaggcgncggcgcggttagcgtattatttattttatttgatttcggggcgttgtgcgttgaggaaggcgcgggcgagtcggagtagaagaaggagggagggagttagtcgttgtagttattatcgttattatgttttattaaggtaagaagaatatttcgcggattacggtgagttcgggcgtcgttgtttttttttttttcgttcgttttttgttcgttgcgttgcgggcggggtcggttcggatttcgtcggtttttttggtttggttttcggggagggacggagattcggggttcgggtggcggagcgcggcggttagtttagtt

SEQ ID NO: 10900 - DNA, 539 bp, Artificial Sequence
  chemically treated genomic DNA (Homo sapiens) CpG-island No: 10900
  misc_feature (322)..(322): n is either a, c, g or t
aactaaactaaccgccgcgctccgccacccgaaccccgaatctccgtccctccccgaaaaccaaaccaaaaaaaccgacgaaatccgaaccgaccccgcccgcaacgcaacgaacaaaaaacgaacgaaaaaaaaaaaaacaacgacgcccgaactcaccgtaatccgcgaaatattcttcttaccttaataaaacataataacgataataactacaacgactaactccctccctccttcttctactccgactcgcccgcgccttcctcaacgcacaacgccccgaaatcaaataaaataaataatacgctaaccgcgccgncgcctccgcccgcctccgcccccctcccgaactcccgcgacgactaccaaaaacaataataaatctccccgatccccctttcacccccgcccccccacgcacaccctccttcacccgcgttcacgcccgaattttaattttttttttcttttactacgccaactaaaaccccataaaacaaaaataactaatctacgactcctccctcttctctctt

SEQ ID NO: 10901 - DNA, 756 bp, Artificial Sequence
  chemically treated genomic DNA (Homo sapiens) CpG-island No: 10901
tgcgacgcgatgggggaggggagggaggtcgtgggaagcggtcggggggcgcggggatgggaaggggtcgggcgggcggcgtggttattttaggttgcggattttttttttggggagcggcgttgtcggcgggcgggtttcgtaatttttcggttttttcgttcgttttttcgtttttttcgggcggcggcgggggtcggtacggtacggtttatagcggcggtttttttgcgtcgagtttcggatgttgtttttggggaggcggaggtagcggtagcggtagcggttcggttcgtacggttattatcgttcgcggtagtaggcgttcgcgggtcgagttttttagtagtcggcgtcggcgtcggcggcggcggcggcggcggttatggttttttgcgtttgtttttttcgttttcggcgttttgcggcggtcgcggttcgattttcgtattttgcgtttgcgcgcggtttagttagcgcggcgcgtttttttcgcgcgcgttcgcgtttatttataatcgcgttcgcggagtgtttttcgtatcgttttcggtgcgtgggcgggagatataagtttagttaagtttatatagttcggttcgggtggttatggagaggcgtattgtagagatatttggacgcgtattgtgataggcgttattttgatatacgtgtttttttatttttaaatattacgggtcgtaagcgtttatatttatatttatttgtagggattacgtgggagaatttgaaggg

SEQ ID NO: 10902 - DNA, 756 bp, Artificial Sequence
  chemically treated genomic DNA (Homo sapiens) CpG-island No: 10902
cccttcaaattctcccacgtaatccctacaaataaatataaatataaacgcttacgacccgtaatatttaaaaataaaaaaacacgtatatcaaaataacgcctatcacaatacgcgtccaaatatctctacaatacgcctctccataaccacccgaaccgaactatataaacttaactaaacttatatctcccgcccacgcaccgaaaacgatacgaaaaacactccgcgaacgcgattataaataaacgcgaacgcgcgcgaaaaaaacgcgccgcgctaactaaaccgcgcgcaaacgcaaaatacgaaaatcgaaccgcgaccgccgcaaaacgccgaaaacgaaaaaaacaaacgcaaaaaaccataaccgccgccgccgccgccgccgacgccgacgccgactactaaaaaactcgacccgcgaacgcctactaccgcgaacgataataaccgtacgaaccgaaccgctaccgctaccgctacctccgcctccccaaaaacaacatccgaaactcgacgcaaaaaaaccgccgctataaaccgtaccgtaccgacccccgccgccgcccgaaaaaaacgaaaaaacgaacgaaaaaaccgaaaaattacgaaacccgcccgccgacaacgccgctccccaaaaaaaaaatccgcaacctaaaataaccacgccgcccgcccgaccccttcccatccccgcgccccccgaccgcttcccacgacctccctcccctcccccatcgcgtcgca

SEQ ID NO: 10903 - DNA, 756 bp, Artificial Sequence
  chemically treated genomic DNA (Homo sapiens) CpG-island No: 10903
ttttttaaatttttttacgtggtttttgtaggtgagtgtgggtgtgagcgtttgcggttcgtggtgtttgggagtgagagagtacgtgtgttagaatggcgtttgttatagtgcgcgtttaggtgtttttgtagtacgtttttttatagttattcgagtcgggttgtatgggtttggttaggtttatgtttttcgtttacgtatcgaaggcggtgcggaaagtatttcgcgggcgcgattgtgagtgagcgcgggcgcgcgcgggaggggcgcgtcgcgttggttgggtcgcgcgtaggcgtagagtgcggaagtcgggtcgcggtcgtcgtagagcgtcgggggcgggaggagtaaacgtaggaggttatggtcgtcgtcgtcgtcgtcgtcgacgtcggcgtcggttgttaaggggttcggttcgcgagcgtttgttgtcgcggacgatggtgatcgtacgggtcgggtcgttgtcgttgtcgttgttttcgtttttttagaagtaatattcgaggttcggcgtagaagagtcgtcgttgtgagtcgtgtcgtatcggttttcgtcgtcgttcgaggagaacgggagggcgggcgagagagtcggggagttgcggagttcgttcgtcggtagcgtcgttttttagggagggagttcgtagtttgaggtgattacgtcgttcgttcggtttttttttattttcgcgtttttcggtcgttttttacggtttttttttttttttttatcgcgtcgta

SEQ ID NO: 10904 - DNA, 756 bp, Artificial Sequence
  chemically treated genomic DNA (Homo sapiens) CpG-island No: 10904
tacgacgcgataaaaaaaaaaaaaaaaaccgtaaaaaacgaccgaaaaacgcgaaaataaaaaaaaaccgaacgaacgacgtaatcacctcaaactacgaactccctccctaaaaaacgacgctaccgacgaacgaactccgcaactccccgactctctcgcccgccctcccgttctcctcgaacgacgacgaaaaccgatacgacacgactcacaacgacgactcttctacgccgaacctcgaatattacttctaaaaaaacgaaaacaacgacaacgacaacgacccgacccgtacgatcaccatcgtccgcgacaacaaacgctcgcgaaccgaaccccttaacaaccgacgccgacgtcgacgacgacgacgacgacgaccataacctcctacgtttactcctcccgcccccgacgctctacgacgaccgcgacccgacttccgcactctacgcctacgcgcgacccaaccaacgcgacgcgcccctcccgcgcgcgcccgcgctcactcacaatcgcgcccgcgaaatactttccgcaccgccttcgatacgtaaacgaaaaacataaacctaaccaaacccatacaacccgactcgaataactataaaaaaacgtactacaaaaacacctaaacgcgcactataacaaacgccattctaacacacgtactctctcactcccaaacaccacgaaccgcaaacgctcacacccacactcacctacaaaaaccacgtaaaaaaatttaaaaaa

SEQ ID NO: 10905 - DNA, 504 bp, Artificial Sequence
  chemically treated genomic DNA (Homo sapiens) CpG-island No: 10905
ggatagtttttatagttaattaaggatagagtcggtggttttttttcggaggagatcggaagttggtttcggttgtagaggggaaggcggttattagtgtaaagttagagttgaggtaagtgggcggtaacggtttggggtcgtcgtttgtgtgcgtttttttttttcggatttcgtagttttttttgtgttgggttgggaattggggaggtatggttgagttcggtttttaaaggcggtttttcgtttttttttttcgagttttttcgagagtgcggttttttcgagagcgcggaggtttcggggtggatagtttggaggagggggttttaagcgtggtagtttcggggtttttttcgtgttgggacgtcgagtcggagtggaggttgggagatttggcgtttagttttcgcgtcgttgtttttttaagttgtgtggttttgggcgagttatttgtttttttcggttttttgtaatatgagagtagttttttttgtttttttt

SEQ ID NO: 10906 - DNA, 504 bp, Artificial Sequence
  chemically treated genomic DNA (Homo sapiens) CpG-island No: 10906
aaaaaaaacaaaaaaaactactctcatattacaaaaaaccgaaaaaaacaaataactcgcccaaaaccacacaacttaaaaaaacaacgacgcgaaaactaaacgccaaatctcccaacctccactccgactcgacgtcccaacacgaaaaaaaccccgaaactaccacgcttaaaaccccctcctccaaactatccaccccgaaacctccgcgctctcgaaaaaaccgcactctcgaaaaaactcgaaaaaaaaaaacgaaaaaccgcctttaaaaaccgaactcaaccatacctccccaattcccaacccaacacaaaaaaaactacgaaatccgaaaaaaaaaaacgcacacaaacgacgaccccaaaccgttaccgcccacttacctcaactctaactttacactaataaccgccttcccctctacaaccgaaaccaacttccgatctcctccgaaaaaaaaccaccgactctatccttaattaactataaaaactatcc

SEQ ID NO: 10907 - DNA, 504 bp, Artificial Sequence
  chemically treated genomic DNA (Homo sapiens) CpG-island No: 10907
aggaagggtagggagggttatttttatgttataaagagtcggagagggtaaatgattcgtttaaggttatatagtttagaaaaatagcggcgcggggattagacgttaggttttttaatttttatttcggttcggcgttttaatacggaggaagtttcgagattgttacgtttagagtttttttttttaggttgtttatttcgaggttttcgcgttttcggagagatcgtattttcggagagattcgggagagaaagacgaaagatcgtttttggaggtcgaatttagttatgtttttttagtttttagtttagtatagaggaagttgcggggttcggaagaaaaaaacgtatataggcggcggttttaaatcgttgtcgtttatttattttagttttggttttatattggtagtcgtttttttttttgtagtcgaaattaattttcggtttttttcgggaagaagttatcgattttgtttttgattggttgtaagagttgttt

SEQ ID NO: 10908 - DNA, 504 bp, Artificial Sequence
  chemically treated genomic DNA (Homo sapiens) CpG-island No: 10908
aaacaactcttacaaccaatcaaaaacaaaatcgataacttcttcccgaaaaaaaccgaaaattaatttcgactacaaaaaaaaaaacgactaccaatataaaaccaaaactaaaataaataaacgacaacgatttaaaaccgccgcctatatacgtttttttcttccgaaccccgcaacttcctctatactaaactaaaaactaaaaaaacataactaaattcgacctccaaaaacgatctttcgtctttctctcccgaatctctccgaaaatacgatctctccgaaaacgcgaaaacctcgaaataaacaacctaaaaaaaaaaactctaaacgtaacaatctcgaaacttcctccgtattaaaacgccgaaccgaaataaaaattaaaaaacctaacgtctaatccccgcgccgctatttttctaaactatataaccttaaacgaatcatttaccctctccgactctttataacataaaaataaccctccctacccttcct

SEQ ID NO: 10909 - DNA, 549 bp, Artificial Sequence
  chemically treated genomic DNA (Homo sapiens) CpG-island No: 10909
ttttttacgtattatttttattgttatgtcgataaatttcgggagtaaagggggtacgatttttttcgcgtttttgcgggttgaaggcgggtattaaagtatgtagttttaagttttttttgtagaagtcgcgttttttattcggttcggggtagagggggcgcgagagagtaagtgggcgggcgttttatttttcgtattttttttaggttttggcgtatagggtgggagcgttgcgttgcgtcgcgtgcgtatcgcggttcgtttgtcgtttgttttttgttttagttgggttatttttcgggttgtcggtggagggttaagaggcgttaacgttacgttgtttcggttttttagcgggttttgtttttttttttaaggcggcggcggttgagggcggagttttttaaatggtttggttagatgcggtaggtttgttgtttacgttgtcgtcgtcgttattggagaagggtcggtgtagtagttatagcgaagtagtagtagtagtagcgagaggagtagtagtagtagtagtagtagtacgagagt

SEQ ID NO: 10910 - DNA, 549 bp, Artificial Sequence
  chemically treated genomic DNA (Homo sapiens) CpG-island No: 10910
actctcgtactactactactactactactactcctctcgctactactactactacttcgctataactactacaccgacccttctccaataacgacgacgacaacgtaaacaacaaacctaccgcatctaaccaaaccatttaaaaaactccgccctcaaccgccgccgccttaaaaaaaaaaacaaaacccgctaaaaaaccgaaacaacgtaacgttaacgcctcttaaccctccaccgacaacccgaaaaataacccaactaaaacaaaaaacaaacgacaaacgaaccgcgatacgcacgcgacgcaacgcaacgctcccaccctatacgccaaaacctaaaaaaaatacgaaaaataaaacgcccgcccacttactctctcgcgccccctctaccccgaaccgaataaaaaacgcgacttctacaaaaaaaacttaaaactacatactttaatacccgccttcaacccgcaaaaacgcgaaaaaaatcgtaccccctttactcccgaaatttatcgacataacaataaaaataatacgtaaaaaa

SEQ ID NO: 10911 - DNA, 549 bp, Artificial Sequence
  chemically treated genomic DNA (Homo sapiens) CpG-island No: 10911
gttttcgtgttgttgttgttgttgttgttgtttttttcgttgttgttgttgttgtttcgttgtagttgttgtatcgatttttttttagtggcggcggcggtagcgtgagtagtaaatttgtcgtatttggttaggttatttggggggtttcgtttttagtcgtcgtcgttttgggaggggaaatagagttcgttggaaaatcgaaatagcgtaacgttagcgttttttagttttttatcggtagttcggggagtggtttagttagggtagggggtaggcggtaagcgggtcgcgatgcgtacgcggcgtagcgtagcgtttttattttgtgcgttaggatttggaggaggtgcggaggatgggacgttcgtttatttgttttttcgcgttttttttgtttcggatcgagtagggagcgcggtttttgtaggggaagtttgggattgtatgttttagtgttcgtttttagttcgtaggggcgcgggaggaatcgtgttttttttgttttcgggatttatcggtatgatagtgggggtggtgcgtgagaga

SEQ ID NO: 10912 - DNA, 549 bp, Artificial Sequence
  chemically treated genomic DNA (Homo sapiens) CpG-island No: 10912
tctctcacgcaccacccccactatcataccgataaatcccgaaaacaaaaaaaacacgattcctcccgcgcccctacgaactaaaaacgaacactaaaacatacaatcccaaacttcccctacaaaaaccgcgctccctactcgatccgaaacaaaaaaaacgcgaaaaaacaaataaacgaacgtcccatcctccgcacctcctccaaatcctaacgcacaaaataaaaacgctacgctacgccgcgtacgcatcgcgacccgcttaccgcctaccccctaccctaactaaaccactccccgaactaccgataaaaaactaaaaaacgctaacgttacgctatttcgattttccaacgaactctatttcccctcccaaaacgacgacgactaaaaacgaaaccccccaaataacctaaccaaatacgacaaatttactactcacgctaccgccgccgccactaaaaaaaaatcgatacaacaactacaacgaaacaacaacaacaacaacgaaaaaaacaacaacaacaacaacaacaacacgaaaac

SEQ ID NO: 10913 - DNA, 537 bp, Artificial Sequence
  chemically treated genomic DNA (Homo sapiens) CpG-island No: 10913
ggtcgtcgatcgtgagtttcgtagcgatttttattatcgtttgaacgtattttcgatttatttgtcgttattacgcgagcgttcggaagatatttcgttgttggcgaaagtttttatttttaaaattgttcgtcgtttggggcgtaatatcgatagtatttttgtcgagacgttgcgtattttgagtaatatggagtggtcgggtaacgtacgcgaattggaaaacgttattgagcgcgcggtattgttaatacgcggtaacgtgttgtagttgttattgttagatattgttttatcggaatttgaaacgtcgtttgtcgtaacggttgtcgttttggagggcgaagatgaatattagttgattgtgcgcgtgttgaaagaaattaacggcgtggttgtcgggtttaaaggcgttgcgtaacgtttggggttgaaacgtacgattttgttgttacggatgaagcggttgggaattgataaatcggtattgatttaattgtaaattgtcggatagatttgtttgttcggtttattatt

SEQ ID NO: 10914 - DNA, 537 bp, Artificial Sequence
  chemically treated genomic DNA (Homo sapiens) CpG-island No: 10914
aataataaaccgaacaaacaaatctatccgacaatttacaattaaatcaataccgatttatcaattcccaaccgcttcatccgtaacaacaaaatcgtacgtttcaaccccaaacgttacgcaacgcctttaaacccgacaaccacgccgttaatttctttcaacacgcgcacaatcaactaatattcatcttcgccctccaaaacgacaaccgttacgacaaacgacgtttcaaattccgataaaacaatatctaacaataacaactacaacacgttaccgcgtattaacaataccgcgcgctcaataacgttttccaattcgcgtacgttacccgaccactccatattactcaaaatacgcaacgtctcgacaaaaatactatcgatattacgccccaaacgacgaacaattttaaaaataaaaactttcgccaacaacgaaatatcttccgaacgctcgcgtaataacgacaaataaatcgaaaatacgttcaaacgataataaaaatcgctacgaaactcacgatcgacgacc

SEQ ID NO: 10915 - DNA, 537 bp, Artificial Sequence
  chemically treated genomic DNA (Homo sapiens) CpG-island No: 10915
aatagtaggtcggataggtagatttgttcggtaatttgtagttaaattaatgtcgatttattaatttttagtcgttttattcgtgatagtagggtcgtgcgttttagttttagacgttgcgtagcgtttttaggttcggtaattacgtcgttggttttttttagtacgcgtataattaattgatatttattttcgttttttagggcgataatcgttgcggtaggcggcgttttaggtttcggtaaaataatatttggtaatgatagttgtagtacgttatcgcgtgttagtaatatcgcgcgtttaatgacgttttttagttcgcgtacgttattcggttattttatgttgtttaaggtgcgtagcgtttcggtaggaatgttgtcgatattgcgttttagacgacgggtaattttgaaggtaaaggttttcgttagtagcggaatatttttcggacgttcgcgtagtggcggtaggtgaatcgggaatacgtttaggcggtaatagagatcgttacggaatttacggtcggcgatt

SEQ ID NO: 10916 - DNA, 537 bp, Artificial Sequence
  chemically treated genomic DNA (Homo sapiens) CpG-island No: 10916
aatcgccgaccgtaaattccgtaacgatctctattaccgcctaaacgtattcccgattcacctaccgccactacgcgaacgtccgaaaaatattccgctactaacgaaaacctttaccttcaaaattacccgtcgtctaaaacgcaatatcgacaacattcctaccgaaacgctacgcaccttaaacaacataaaataaccgaataacgtacgcgaactaaaaaacgtcattaaacgcgcgatattactaacacgcgataacgtactacaactatcattaccaaatattattttaccgaaacctaaaacgccgcctaccgcaacgattatcgccctaaaaaacgaaaataaatatcaattaattatacgcgtactaaaaaaaaccaacgacgtaattaccgaacctaaaaacgctacgcaacgtctaaaactaaaacgcacgaccctactatcacgaataaaacgactaaaaattaataaatcgacattaatttaactacaaattaccgaacaaatctacctatccgacctactatt

SEQ ID NO: 10917 - DNA, 634 bp, Artificial Sequence
  chemically treated genomic DNA (Homo sapiens) CpG-island No: 10917
taggcgtcgaggtcgcgtagaatttcggagtttttgcgtttttgcgtttcgttcgcggttgcgaggttcggtgttcgtagaggtttcggcggaaacggttttatttcgggcgggttttcgttttcggttcgttttcgttcgtttcgcgttatgtatggcgtttttttttcgagttttataaggcgttttttttcggttttaggtttatataaggcgtttttttttcggcgcggttggttggcggttcgcgggttgggagttcggttcgttgggttcgtttaatttcggagttcgtagttagcggatttgttgttaaggagggggcggtagcggcgggagggacgggaacgcggggtttggttcggcgcgggaggcgcgggacgggtcgatttgggggtttcgttggttttcgttggtttcgtattttgtttcgttttttttttttagttcggagtatagtacgttttgtcggaggttttttagcggttttagttcgggatttttagttatacgggttttcgagtttcgtcggtcgtttttttttgagagttgataagtgggttttttttgatattttttttttttttcgtttgcgtttttcgtatttttttgtttttagtcgagttgttttttt

SEQ ID NO: 10918 - DNA, 634 bp, Artificial Sequence
  chemically treated genomic DNA (Homo sapiens) CpG-island No: 10918
aaaaaaacaactcgactaaaaacaaaaaaatacgaaaaacgcaaacgaaaaaaaaaaaaaatatcaaaaaaaacccacttatcaactctcaaaaaaaaacgaccgacgaaactcgaaaacccgtataactaaaaatcccgaactaaaaccgctaaaaaacctccgacaaaacgtactatactccgaactaaaaaaaaaaaacgaaacaaaatacgaaaccaacgaaaaccaacgaaacccccaaatcgacccgtcccgcgcctcccgcgccgaaccaaaccccgcgttcccgtccctcccgccgctaccgccccctccttaacaacaaatccgctaactacgaactccgaaattaaacgaacccaacgaaccgaactcccaacccgcgaaccgccaaccaaccgcgccgaaaaaaaaacgccttatataaacctaaaaccgaaaaaaaacgccttataaaactcgaaaaaaaaacgccatacataacgcgaaacgaacgaaaacgaaccgaaaacgaaaacccgcccgaaataaaaccgtttccgccgaaacctctacgaacaccgaacctcgcaaccgcgaacgaaacgcaaaaacgcaaaaactccgaaattctacgcgacctcgacgccta

SEQ ID NO: 10919 - DNA, 634 bp, Artificial Sequence
  chemically treated genomic DNA (Homo sapiens) CpG-island No: 10919
gagggggtagttcggttgaagatagggaggtacgagaagcgtaagcggggaggaagagagatgttagggaagatttatttgttaatttttaggggagagcggtcggcgaggttcggaggttcgtgtggttggaggtttcgggttggggtcgttgaaagattttcggtagggcgtgttgtgtttcgggttaggggagaaaagcgaggtaaaatacgaaattagcggggattagcgggatttttaagtcggttcgtttcgcgtttttcgcgtcgggttaggtttcgcgttttcgtttttttcgtcgttgtcgttttttttttggtagtaggttcgttggttgcgggtttcgaggttgggcgggtttagcggatcgggtttttagttcgcgggtcgttagttagtcgcgtcgggaaggaagcgttttgtatgggtttggggtcgggaggaagcgttttgtagggttcggggaggaagcgttatatatggcgcggggcggacgggggcgggtcgggggcgggagttcgttcgggatggagtcgttttcgtcggagtttttgcgggtatcgagtttcgtagtcgcgggcggggcgtaggggcgtaggggtttcggggttttacgcggtttcgacgtttg

SEQ ID NO: 10920 - DNA, 634 bp, Artificial Sequence
  chemically treated genomic DNA (Homo sapiens) CpG-island No: 10920
caaacgtcgaaaccgcgtaaaaccccgaaacccctacgcccctacgccccgcccgcgactacgaaactcgatacccgcaaaaactccgacgaaaacgactccatcccgaacgaactcccgcccccgacccgcccccgtccgccccgcgccatatataacgcttcctccccgaaccctacaaaacgcttcctcccgaccccaaacccatacaaaacgcttccttcccgacgcgactaactaacgacccgcgaactaaaaacccgatccgctaaacccgcccaacctcgaaacccgcaaccaacgaacctactaccaaaaaaaaaacgacaacgacgaaaaaaacgaaaacgcgaaacctaacccgacgcgaaaaacgcgaaacgaaccgacttaaaaatcccgctaatccccgctaatttcgtattttacctcgcttttctcccctaacccgaaacacaacacgccctaccgaaaatctttcaacgaccccaacccgaaacctccaaccacacgaacctccgaacctcgccgaccgctctcccctaaaaattaacaaataaatcttccctaacatctctcttcctccccgcttacgcttctcgtacctccctatcttcaaccgaactaccccctc

SEQ ID NO: 10921 - DNA, 790 bp, Artificial Sequence
  chemically treated genomic DNA (Homo sapiens) CpG-island No: 10921
agcgcgattgggcgttcgttttcggcgcggatgtcgttttgagtgtcgataattagtatttttttgtcggtgagtttgttggcgtgttagtttatttcggcgttttgcgttatgtcgaataggttgtcgttgggagattttattagtatttgcggggttagcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggtaaagttgtcgttcgtcgatatcgtttcgtcgtcgtcgagtagttaggtattgaatagatgatcgtcgtagtcgtagagtacggtgaagtgcggatgggtatttttgacggtatggattatgttgcgtacgtgggcgacggagtcgatggtgtttttgatgtcgataatattgttgcggcgagtcggcgatgggtttcgttttgtgttttaaagatgcgtgagttatagcgttcggtttgtttttattttttatatatgttagtgatttatttt

SEQ ID NO: 10922 - DNA, 790 bp, Artificial Sequence
  chemically treated genomic DNA (Homo sapiens) CpG-island No: 10922
aaaataaatcactaacatatataaaaaataaaaacaaaccgaacgctataactcacgcatctttaaaacacaaaacgaaacccatcgccgactcgccgcaacaatattatcgacatcaaaaacaccatcgactccgtcgcccacgtacgcaacataatccataccgtcaaaaatacccatccgcacttcaccgtactctacgactacgacgatcatctattcaatacctaactactcgacgacgacgaaacgatatcgacgaacgacaactttaccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgctaaccccgcaaatactaataaaatctcccaacgacaacctattcgacataacgcaaaacgccgaaataaactaacacgccaacaaactcaccgacaaaaaaatactaattatcgacactcaaaacgacatccgcgccgaaaacgaacgcccaatcgcgct

SEQ ID NO: 10923 - DNA, 790 bp, Artificial Sequence
  chemically treated genomic DNA (Homo sapiens) CpG-island No: 10923
aaaataagttattagtatatataaaagatgaaaataggtcgggcgttgtggtttacgtatttttagagtataggacggagtttatcgtcgattcgtcgtagtaatattatcggtattaaagatattatcgatttcgtcgtttacgtgcgtagtatgatttatatcgttaaaggtgtttattcgtattttatcgtgttttgcggttacgacgattatttgtttaatatttggttgttcggcggcgacggggcgatatcggcgagcggtaattttgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgttgatttcgtagatgttgatggaattttttagcggtaatttgttcggtatgacgtagaacgtcgggatgggttggtacgttaataagtttatcggtaaagaggtgttgattatcggtatttagggcggtattcgcgtcggagacggacgtttaatcgcgtt

SEQ ID NO: 10924 - DNA, 790 bp, Artificial Sequence
  chemically treated genomic DNA (Homo sapiens) CpG-island No: 10924
aacgcgattaaacgtccgtctccgacgcgaataccgccctaaataccgataatcaacacctctttaccgataaacttattaacgtaccaacccatcccgacgttctacgtcataccgaacaaattaccgctaaaaaattccatcaacatctacgaaatcaacgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaacaaaattaccgctcgccgatatcgccccgtcgccgccgaacaaccaaatattaaacaaataatcgtcgtaaccgcaaaacacgataaaatacgaataaacacctttaacgatataaatcatactacgcacgtaaacgacgaaatcgataatatctttaataccgataatattactacgacgaatcgacgataaactccgtcctatactctaaaaatacgtaaaccacaacgcccgacctattttcatcttttatatatactaataacttatttt

SEQ ID NO: 10925 - DNA, 597 bp, Artificial Sequence
  chemically treated genomic DNA (Homo sapiens) CpG-island No: 10925
tcgttagcgttttagacgtattgttggtcgtattgttgagttgtattattttttttttcgtcgtatttgtatttttaagcgttacggcggatgtaatattttttgttcgtttagttgttgtttcggcgcgcgttgtcgcggatttcgtcgtatttttgttttgagttgtcgtcgtcgtattgttagtagtttttgtcgttttcgtggatgtcgtcgtggcgttgtttttcgttgttgacgtttgtttggtcgttttattttttgaagtagacgtcgatgatgtcgatgacgtcgtcgaattggttgacgatgcggtagtcgtttttgaggattttgcgtttgttttcgatattttacgacgatttttattgtgttttaaagatgtcgtttatttttaggttagcggtttcgacgatcgtttttacgttatttagcgattgacgtgtttgtgtagcgacgtttgtcggtatttcgttcgttttcggatttatcgggatttgatcggaggtgatgattatattgtttagattaacgttttgtacgtaaggatcgatagttgtcggtgtatttttcgtcgcgatagttttgtttatgatt

SEQ ID NO: 10926 - DNA, 597 bp, Artificial Sequence
  chemically treated genomic DNA (Homo sapiens) CpG-island No: 10926
aatcataaacaaaactatcgcgacgaaaaatacaccgacaactatcgatccttacgtacaaaacgttaatctaaacaatataatcatcacctccgatcaaatcccgataaatccgaaaacgaacgaaataccgacaaacgtcgctacacaaacacgtcaatcgctaaataacgtaaaaacgatcgtcgaaaccgctaacctaaaaataaacgacatctttaaaacacaataaaaatcgtcgtaaaatatcgaaaacaaacgcaaaatcctcaaaaacgactaccgcatcgtcaaccaattcgacgacgtcatcgacatcatcgacgtctacttcaaaaaataaaacgaccaaacaaacgtcaacaacgaaaaacaacgccacgacgacatccacgaaaacgacaaaaactactaacaatacgacgacgacaactcaaaacaaaaatacgacgaaatccgcgacaacgcgcgccgaaacaacaactaaacgaacaaaaaatattacatccgccgtaacgcttaaaaatacaaatacgacgaaaaaaaaaataatacaactcaacaatacgaccaacaatacgtctaaaacgctaacga

SEQ ID NO: 10927 - DNA, 597 bp, Artificial Sequence
  chemically treated genomic DNA (Homo sapiens) CpG-island No: 10927
aattatgagtaaaattatcgcgacggaaaatgtatcggtagttatcggtttttacgtatagggcgttgatttgggtaatatgattattattttcggttagatttcggtaaattcgaaaacgggcgaagtatcggtagacgtcgttgtataggtacgttagtcgttggataacgtaaaagcgatcgtcgaagtcgttggtttgaaagtgggcgatatttttagagtatagtgggagtcgtcgtaaggtgtcggaaataagcgtagaatttttaaaaacggttgtcgtatcgttagttagttcggcggcgttatcggtattatcggcgtttgttttaaaagatgaggcgattagataagcgttagtagcgaagagtagcgttacgacggtatttacgaaggcgatagaggttgttggtagtgcgacggcggtagtttagagtaaaagtacggcggaattcgcggtaacgcgcgtcgagatagtagttaaacgggtagaggatattgtattcgtcgtggcgtttgaggatgtaagtacgacgaaaaaggggatagtatagtttagtagtgcgattaatagtacgtttgaaacgttggcgg

SEQ ID NO: 10928 - DNA, 597 bp, Artificial Sequence
  chemically treated genomic DNA (Homo sapiens) CpG-island No: 10928
ccgccaacgtttcaaacgtactattaatcgcactactaaactatactatcccctttttcgtcgtacttacatcctcaaacgccacgacgaatacaatatcctctacccgtttaactactatctcgacgcgcgttaccgcgaattccgccgtacttttactctaaactaccgccgtcgcactaccaacaacctctatcgccttcgtaaataccgtcgtaacgctactcttcgctactaacgcttatctaatcgcctcatcttttaaaacaaacgccgataataccgataacgccgccgaactaactaacgatacgacaaccgtttttaaaaattctacgcttatttccgacaccttacgacgactcccactatactctaaaaatatcgcccactttcaaaccaacgacttcgacgatcgcttttacgttatccaacgactaacgtacctatacaacgacgtctaccgatacttcgcccgttttcgaatttaccgaaatctaaccgaaaataataatcatattacccaaatcaacgccctatacgtaaaaaccgataactaccgatacattttccgtcgcgataattttactcataatt

SEQ ID NO: 10929 - DNA, 569 bp, Artificial Sequence
  chemically treated genomic DNA (Homo sapiens) CpG-island No: 10929
tttcggcgtttattttcgatagcgtaaaacgggtttagattttattgtcgttttttttttttagttgtagttttcgatttatttttttaatacgcgttttatcgtttttacggttgtgacgaatggatttaggatgcgtaggacgtattttgaatattgtagttgcgcgtttagtcggtgacgtcgtttgcgttattttaattcggtgttatgacgacgtttagtttattgagatttttttgttcggttagcgatattacgttttttgttatatttatggttgaaatatagcgggtggtggtaggcgagggaatgttattgttgttatcgtcgtaggtatttaacggtaaagttttagtatcgattgttagatttgtttgttgggtttttttgttgtcgtcgtaagtttggttattagttgttttagcgtattgtgtttcgtcggtaataaaggacggtcggtcgtttcggttgttgtggttgcggaataattattttttttttttgtaatagggtgagaatggtttttaattgtttcggtgagagttgatttagcggcgtttgattaa

SEQ ID NO: 10930 - DNA, 569 bp, Artificial Sequence
  chemically treated genomic DNA (Homo sapiens) CpG-island No: 10930
ttaatcaaacgccgctaaatcaactctcaccgaaacaattaaaaaccattctcaccctattacaaaaaaaaaaaataattattccgcaaccacaacaaccgaaacgaccgaccgtcctttattaccgacgaaacacaatacgctaaaacaactaataaccaaacttacgacgacaacaaaaaaacccaacaaacaaatctaacaatcgatactaaaactttaccgttaaatacctacgacgataacaacaataacattccctcgcctaccaccacccgctatatttcaaccataaatataacaaaaaacgtaatatcgctaaccgaacaaaaaaatctcaataaactaaacgtcgtcataacaccgaattaaaataacgcaaacgacgtcaccgactaaacgcgcaactacaatattcaaaatacgtcctacgcatcctaaatccattcgtcacaaccgtaaaaacgataaaacgcgtattaaaaaaataaatcgaaaactacaactaaaaaaaaaaaacgacaataaaatctaaacccgttttacgctatcgaaaataaacgccgaaa

SEQ ID NO: 10931 - DNA, 569 bp, Artificial Sequence
  chemically treated genomic DNA (Homo sapiens) CpG-island No: 10931
ttggttagacgtcgttgaattagtttttatcggagtaattaaaaattatttttattttgttgtaggaagggaagatggttatttcgtaattatagtagtcgaggcgatcgatcgttttttattatcggcggagtataatgcgttaaaatagttggtgattaaatttgcggcggtaataggggaatttagtaaatagatttggtaatcgatgttggaattttgtcgttagatatttgcgacggtggtagtaatggtattttttcgtttattattattcgttatgttttagttatgagtgtggtaaagggcgtggtgtcgttgatcgggtaagaaagttttaatgggttaagcgtcgttatgatatcgggttgggataacgtaaacggcgttatcggttggacgcgtaattgtaatatttaaagtgcgttttgcgtattttgaatttattcgttataatcgtgaaggcggtaaagcgcgtgttgaggggatgagtcgggagttgtagttggagaaaaaagacggtagtaaaatttggattcgttttgcgttatcgaaagtgagcgtcgagg

SEQ ID NO: 10932 - DNA, 569 bp, Artificial Sequence
  chemically treated genomic DNA (Homo sapiens) CpG-island No: 10932
cctcgacgctcactttcgataacgcaaaacgaatccaaattttactaccgtcttttttctccaactacaactcccgactcatcccctcaacacgcgctttaccgccttcacgattataacgaataaattcaaaatacgcaaaacgcactttaaatattacaattacgcgtccaaccgataacgccgtttacgttatcccaacccgatatcataacgacgcttaacccattaaaactttcttacccgatcaacgacaccacgccctttaccacactcataactaaaacataacgaataataataaacgaaaaaataccattactaccaccgtcgcaaatatctaacgacaaaattccaacatcgattaccaaatctatttactaaattcccctattaccgccgcaaatttaatcaccaactattttaacgcattatactccgccgataataaaaaacgatcgatcgcctcgactactataattacgaaataaccatcttcccttcctacaacaaaataaaaataatttttaattactccgataaaaactaattcaacgacgtctaaccaa

SEQ ID NO: 10933 - DNA, 622 bp, Artificial Sequence
  chemically treated genomic DNA (Homo sapiens) CpG-island No: 10933
agtcgcgcggattcggtaatcgtttttttcgcggtttaggggattttttaggtcgggacgtagtcgaagggaagtttttattcggaggcgtcgggaggagcgggcgaattttgatttagtcggggagttttgggagtcgcgttagtgcggaagcgtcgtcgggggaataggggaaatttgatttgatcggaaaagagcgatcgaaggggagattaatttgttcgtcggggttttcgttggtttcgtttgttcgtcggggcggggttatcgcgggggttttcgtcgttttgcggaagagaggaaagaggggaaggcgattttgcgcgcgttcggggacgcgggttttttcgtttcggtatatgggggttagagtttcgcgttcgcgaggttggagggaagttaagaggggttgagtgagagatacgcgaatagacgtatatagataggacgggagacgcgagtggcgcgcgggatataaaggcgtggaggtttcgaagttcggcgaggatagcgggcgttttcggtttttattattttttttgttcgcgttgtttaatttggtgttaaatcggatttatttgttttttttttatttttaggcggttcgtttttttattttagt

SEQ ID NO: 10934 - DNA, 622 bp, Artificial Sequence
  chemically treated genomic DNA (Homo sapiens) CpG-island No: 10934
actaaaataaaaaaacgaaccgcctaaaaataaaaaaaaaacaaataaatccgatttaacaccaaattaaacaacgcgaacaaaaaaaataataaaaaccgaaaacgcccgctatcctcgccgaacttcgaaacctccacgcctttatatcccgcgcgccactcgcgtctcccgtcctatctatatacgtctattcgcgtatctctcactcaacccctcttaacttccctccaacctcgcgaacgcgaaactctaacccccatataccgaaacgaaaaaacccgcgtccccgaacgcgcgcaaaatcgccttcccctctttcctctcttccgcaaaacgacgaaaacccccgcgataaccccgccccgacgaacaaacgaaaccaacgaaaaccccgacgaacaaattaatctccccttcgatcgctcttttccgatcaaatcaaatttcccctattcccccgacgacgcttccgcactaacgcgactcccaaaactccccgactaaatcaaaattcgcccgctcctcccgacgcctccgaataaaaacttcccttcgactacgtcccgacctaaaaaatcccctaaaccgcgaaaaaaacgattaccgaatccgcgcgact

SEQ ID NO: 10935 - DNA, 622 bp, Artificial Sequence
  chemically treated genomic DNA (Homo sapiens) CpG-island No: 10935
gttggggtggggaagcggatcgtttgggagtgaaggaggagtaggtgagttcgatttggtattagattaggtagcgcgagtagaggaggtggtgggagtcgagaacgttcgttgttttcgtcgggtttcggagtttttacgtttttgtgtttcgcgcgttattcgcgtttttcgttttgtttgtgtgcgtttgttcgcgtgttttttatttagttttttttagtttttttttagtttcgcgggcgcgaaattttggtttttatgtgtcggagcgagggggttcgcgttttcgggcgcgcgtagagtcgttttttttttttttttttttttcgtagagcggcgggagttttcgcggtaatttcgtttcggcgggtagacggagttagcgaggatttcggcggataaattagtttttttttcgatcgttttttttcgattaagttaggttttttttgttttttcgacggcgttttcgtattagcgcgatttttagggtttttcggttgggttagggttcgttcgtttttttcggcgttttcggataggggttttttttcggttgcgtttcggtttgaggagttttttggatcgcgggaggggcgattgtcgggttcgcgcggtt

SEQ ID NO: 10936 - DNA, 622 bp, Artificial Sequence
  chemically treated genomic DNA (Homo sapiens) CpG-island No: 10936
aaccgcgcgaacccgacaatcgcccctcccgcgatccaaaaaactcctcaaaccgaaacgcaaccgaaaaaaaacccctatccgaaaacgccgaaaaaaacgaacgaaccctaacccaaccgaaaaaccctaaaaatcgcgctaatacgaaaacgccgtcgaaaaaacaaaaaaaacctaacttaatcgaaaaaaaacgatcgaaaaaaaaactaatttatccgccgaaatcctcgctaactccgtctacccgccgaaacgaaattaccgcgaaaactcccgccgctctacgaaaaaaaaaaaaaaaaaaaaaacgactctacgcgcgcccgaaaacgcgaaccccctcgctccgacacataaaaaccaaaatttcgcgcccgcgaaactaaaaaaaaactaaaaaaaactaaataaaaaacacgcgaacaaacgcacacaaacaaaacgaaaaacgcgaataacgcgcgaaacacaaaaacgtaaaaactccgaaacccgacgaaaacaacgaacgttctcgactcccaccacctcctctactcgcgctacctaatctaataccaaatcgaactcacctactcctccttcactcccaaacgatccgcttccccaccccaac

SEQ ID NO: 10937 - DNA, 738 bp, Artificial Sequence
  chemically treated genomic DNA (Homo sapiens) CpG-island No: 10937
tcgggcgttttcgtaattggtagttgtattgcgttcgacgatatttcggcgtggtagttattttcgatggaggtattgtgattaggataggtgtttttagattttttttcggttgatggtggacggatggggcgtggtatgcgttcgaggtgggtaatcggaagtagtaggtgggtttttggataacgggttaggaacgcggaaaattttgatagttatttttgtatttcggattaaattcgattttgtcgcgtaggcgaaggaacggtttacggggtttatttcgtttcggtatttcggtgatttgcggatttcggaagttttcgtggtattcgggaatttttttggtaaatttttcgcgcggacgtaggtggtcgttcgttttaagggatttttttttgggtacgtttttgggtgggtcgatgaatttgtcgcggtatttcggtattttcgagttgggggcgtaggtcgtttcggaatcggatacgcgtaggttgtcgttttttttgatgggcgtatttttcgagtagttggtatatatacggaagttgtttttgtatttcggtatcgttacgaatttattttgaattttgatgttgtttatttggggaatggagtgcgttttttcggggaattgttgtacgaattggcgacggtattcggagggttttggtatttggttttgttgttcgtggtttatagtttgggtacgtatttgtagatggtatcgttgttgtt

SEQ ID NO: 10938 - DNA, 738 bp, Artificial Sequence
  chemically treated genomic DNA (Homo sapiens) CpG-island No: 10938
aacaacaacgataccatctacaaatacgtacccaaactataaaccacgaacaacaaaaccaaataccaaaaccctccgaataccgtcgccaattcgtacaacaattccccgaaaaaacgcactccattccccaaataaacaacatcaaaattcaaaataaattcgtaacgataccgaaatacaaaaacaacttccgtatatataccaactactcgaaaaatacgcccatcaaaaaaaacgacaacctacgcgtatccgattccgaaacgacctacgcccccaactcgaaaataccgaaataccgcgacaaattcatcgacccacccaaaaacgtacccaaaaaaaaatcccttaaaacgaacgaccacctacgtccgcgcgaaaaatttaccaaaaaaattcccgaataccacgaaaacttccgaaatccgcaaatcaccgaaataccgaaacgaaataaaccccgtaaaccgttccttcgcctacgcgacaaaatcgaatttaatccgaaatacaaaaataactatcaaaattttccgcgttcctaacccgttatccaaaaacccacctactacttccgattacccacctcgaacgcataccacgccccatccgtccaccatcaaccgaaaaaaaatctaaaaacacctatcctaatcacaatacctccatcgaaaataactaccacgccgaaatatcgtcgaacgcaatacaactaccaattacgaaaacgcccga

SEQ ID NO: 10939 - DNA, 738 bp, Artificial Sequence
  chemically treated genomic DNA (Homo sapiens) CpG-island No: 10939
agtagtagcgatgttatttgtagatgcgtgtttaggttgtggattacgaatagtagggttaggtgttagagtttttcgagtatcgtcgttagttcgtgtagtagtttttcgagaaggcgtattttattttttagatgagtagtattaagatttagggtgagttcgtggcggtgtcggaatatagggatagttttcgtatgtatgttaattattcgaagagtgcgtttattaagaagaacgataatttgcgcgtattcggtttcgaggcggtttgcgtttttagttcggaggtgtcggagtatcgcgataaatttatcgatttatttaagaacgtgtttaaagagaagttttttaagacggacgattatttgcgttcgcgcggggagtttattaaagagattttcgaatattacgagagttttcgagattcgtagattatcgaaatgtcggagcggggtaagtttcgtgagtcgttttttcgtttgcgcggtaagatcgagtttaattcggagtataggaataattattaggatttttcgcgtttttgattcgttgtttagaagtttatttgttgttttcggttgtttatttcgggcgtatgttacgttttattcgtttattattagtcggaagaggatttggaaatatttgttttggttatagtgtttttatcggaggtaattgttacgtcggagtatcgtcgagcgtagtataattattaattgcgggagcgttcga

SEQ ID NO: 10940 - DNA, 738 bp, Artificial Sequence
  chemically treated genomic DNA (Homo sapiens) CpG-island No: 10940
tcgaacgctcccgcaattaataattatactacgctcgacgatactccgacgtaacaattacctccgataaaaacactataaccaaaacaaatatttccaaatcctcttccgactaataataaacgaataaaacgtaacatacgcccgaaataaacaaccgaaaacaacaaataaacttctaaacaacgaatcaaaaacgcgaaaaatcctaataattattcctatactccgaattaaactcgatcttaccgcgcaaacgaaaaaacgactcacgaaacttaccccgctccgacatttcgataatctacgaatctcgaaaactctcgtaatattcgaaaatctctttaataaactccccgcgcgaacgcaaataatcgtccgtcttaaaaaacttctctttaaacacgttcttaaataaatcgataaatttatcgcgatactccgacacctccgaactaaaaacgcaaaccgcctcgaaaccgaatacgcgcaaattatcgttcttcttaataaacgcactcttcgaataattaacatacatacgaaaactatccctatattccgacaccgccacgaactcaccctaaatcttaatactactcatctaaaaaataaaatacgccttctcgaaaaactactacacgaactaacgacgatactcgaaaaactctaacacctaaccctactattcgtaatccacaacctaaacacgcatctacaaataacatcgctactact

SEQ ID NO: 10941 - DNA, 507 bp, Artificial Sequence
  chemically treated genomic DNA (Homo sapiens) CpG-island No: 10941
gatatttcgttttcgttattgttagaggtattatttttattttcggtttttagtacggtagtcgttaatttgaaatttagcgtcgcgtttttttcgttcgtatcgttgtcgttgtcgtcgtcgtcgttgttgtcgattttcgacgttggttcggtttttttaaagagttttacggtgcggatttttagatcgatttttttcggcggaggcggtttcgaggttttagttggggcggatcgcggagttatagagtttaggttttttttaaaggaggtgtcgtcgttttcgttattagttagtattgttcgtattcggagtcggagacggtgtcgatttattcgcggttatcgtcgtcgttgatttcgggaacgagaagagtagtaagaggaagaagcgttttttttttttcgttttagtagcgttattaattttttattgtttaatttgttgtttttcgttttttcgattcgttattggttgtaatattttggcggttgtagattattg

SEQ ID NO: 10942 - DNA, 507 bp, Artificial Sequence
  chemically treated genomic DNA (Homo sapiens) CpG-island No: 10942
caataatctacaaccgccaaaatattacaaccaataacgaatcgaaaaaacgaaaaacaacaaattaaacaataaaaaattaataacgctactaaaacgaaaaaaaaaaaacgcttcttcctcttactactcttctcgttcccgaaatcaacgacgacgataaccgcgaataaatcgacaccgtctccgactccgaatacgaacaatactaactaataacgaaaacgacgacacctcctttaaaaaaaacctaaactctataactccgcgatccgccccaactaaaacctcgaaaccgcctccgccgaaaaaaatcgatctaaaaatccgcaccgtaaaactctttaaaaaaaccgaaccaacgtcgaaaatcgacaacaacgacgacgacgacaacgacaacgatacgaacgaaaaaaacgcgacgctaaatttcaaattaacgactaccgtactaaaaaccgaaaataaaaataatacctctaacaataacgaaaacgaaatatc

SEQ ID NO: 10943 - DNA, 507 bp, Artificial Sequence
  chemically treated genomic DNA (Homo sapiens) CpG-island No: 10943
taatgatttgtagtcgttagggtattgtagttagtggcgagtcgagggggcgggaggtagtaggttaggtagtgagaagttagtggcgttgttgggacgggggaaaggagacgttttttttttttgttgtttttttcgttttcgagattagcggcggcggtgatcgcgagtgggtcggtatcgttttcggtttcgggtgcgaataatgttgattgatagcggaggcggcggtattttttttgaggaggatttggattttgtggtttcgcgattcgttttagttggggtttcggagtcgttttcgtcgggaggggtcggtttggggattcgtatcgtgaggttttttggggaggtcgggttagcgtcgggagtcggtagtagcggcggcggcggtagcggtagcggtacgggcggaggggacgcggcgttggattttaagttggcggttgtcgtgttgaggatcgggggtggaggtggtgtttttggtagtgacgaggacgaagtgtt

SEQ ID NO: 10944 - DNA, 507 bp, Artificial Sequence
  chemically treated genomic DNA (Homo sapiens) CpG-island No: 10944
aacacttcgtcctcgtcactaccaaaaacaccacctccacccccgatcctcaacacgacaaccgccaacttaaaatccaacgccgcgtcccctccgcccgtaccgctaccgctaccgccgccgccgctactaccgactcccgacgctaacccgacctccccaaaaaacctcacgatacgaatccccaaaccgacccctcccgacgaaaacgactccgaaaccccaactaaaacgaatcgcgaaaccacaaaatccaaatcctcctcaaaaaaaataccgccgcctccgctatcaatcaacattattcgcacccgaaaccgaaaacgataccgacccactcgcgatcaccgccgccgctaatctcgaaaacgaaaaaaacaacaaaaaaaaaaaacgtctcctttcccccgtcccaacaacgccactaacttctcactacctaacctactacctcccgccccctcgactcgccactaactacaataccctaacgactacaaatcatta

SEQ ID NO: 10945 - DNA, 544 bp, Artificial Sequence
  chemically treated genomic DNA (Homo sapiens) CpG-island No: 10945
aatttgtggttcggggtcgttagttggggttcggggagcgcgagcgggggttcggggggcgggggtcgcgggtcgcgaggggggcgggggtcgcgagggggcggggcgtgcgagggggcgggggcgtgcgagggggcgggggcgcgcgagggggcggggcgcgcgagggggcggggcgcgcgagggggcggggcgcgcgaaggggcggggcgcgtaaggggggcggggcgcgcgagggggcggggcgcgcgagggggcggggcgcgcgaaggggcggggcgcgtaagggggcggggcgcgtcgggttcgtttttttcgcgggcgtttagtggtaatagggagggtcgggtaagaatgttacgaataaggggagggtttttttttattttggggggatcgtttcgacgttttggggttttttttttttcgcggggtttgtttaaacgtttgtcgtgggttcggaagaatttgcgggtttggggcgggggattaaaggtttgttttttttcggagagagggtttttttggttcgattattgggttt

SEQ ID NO: 10946 - DNA, 544 bp, Artificial Sequence
  chemically treated genomic DNA (Homo sapiens) CpG-island No: 10946
aaacccaataatcgaaccaaaaaaaccctctctccgaaaaaaaacaaacctttaatcccccgccccaaacccgcaaattcttccgaacccacgacaaacgtttaaacaaaccccgcgaaaaaaaaaaaaccccaaaacgtcgaaacgatccccccaaaataaaaaaaaaccctccccttattcgtaacattcttacccgaccctccctattaccactaaacgcccgcgaaaaaaacgaacccgacgcgccccgcccccttacgcgccccgccccttcgcgcgccccgccccctcgcgcgccccgccccctcgcgcgccccgccccccttacgcgccccgccccttcgcgcgccccgccccctcgcgcgccccgccccctcgcgcgccccgccccctcgcgcgcccccgccccctcgcacgcccccgccccctcgcacgccccgccccctcgcgacccccgcccccctcgcgacccgcgacccccgccccccgaacccccgctcgcgctccccgaaccccaactaacgaccccgaaccacaaatt

SEQ ID NO: 10947 - DNA, 544 bp, Artificial Sequence
  chemically treated genomic DNA (Homo sapiens) CpG-island No: 10947
gaatttaatggtcgggttagggggatttttttttcggaaaaaagtaagtttttaatttttcgttttagattcgtaggttttttcgggtttacggtaagcgtttaaataagtttcgcgaggagggagggattttaaaacgtcgaggcggtttttttaaaataaaagagaattttttttttgttcgtggtatttttattcggttttttttgttgttattaagcgttcgcggagaggacgagttcggcgcgtttcgtttttttgcgcgtttcgttttttcgcgcgtttcgttttttcgcgcgtttcgttttttcgcgcgtttcgttttttttgcgcgtttcgttttttcgcgcgtttcgttttttcgcgcgtttcgttttttcgcgcgtttcgttttttcgcgcgttttcgttttttcgtacgttttcgttttttcgtacgtttcgttttttcgcggttttcgtttttttcgcggttcgcggttttcgtttttcggattttcgttcgcgtttttcggattttagttggcggtttcggattataaatt

SEQ ID NO: 10948 - DNA, 544 bp, Artificial Sequence
  chemically treated genomic DNA (Homo sapiens) CpG-island No: 10948
aatttataatccgaaaccgccaactaaaatccgaaaaacgcgaacgaaaatccgaaaaacgaaaaccgcgaaccgcgaaaaaaacgaaaaccgcgaaaaaacgaaacgtacgaaaaaacgaaaacgtacgaaaaaacgaaaacgcgcgaaaaaacgaaacgcgcgaaaaaacgaaacgcgcgaaaaaacgaaacgcgcgaaaaaacgaaacgcgcaaaaaaaacgaaacgcgcgaaaaaacgaaacgcgcgaaaaaacgaaacgcgcgaaaaaacgaaacgcgcaaaaaaacgaaacgcgccgaactcgtcctctccgcgaacgcttaataacaacaaaaaaaaccgaataaaaataccacgaacaaaaaaaaaattctcttttattttaaaaaaaccgcctcgacgttttaaaatccctccctcctcgcgaaacttatttaaacgcttaccgtaaacccgaaaaaacctacgaatctaaaacgaaaaattaaaaacttacttttttccgaaaaaaaaatccccctaacccgaccattaaattc

SEQ ID NO: 10949 - DNA, 660 bp, Artificial Sequence
  chemically treated genomic DNA (Homo sapiens) CpG-island No: 10949
  misc_feature (640)..(640): n is either a, c, g or t
tagattcgtttgtattagcgaatttttaaagatgataatcgagaagtttatgatgaacgtcgttagtagcgagaatagcggtaatattttatagttttgttataacggatgtattttgtagttcgtcgagattattagcgattttattgaagattggtgtatggtcggtagtagcgtatcgagcgcgatgatgaagaatattattttgtttagtcgttgtagcgatattttttattttagacgtttaaatagtgtcggagtaaattttagtgttattacgtcgatatagatggttatatagatcgtcgtttcgaatagtatcgagtttacgttgaagtgattcggaatgtagaagtacggtaggttttagtagcgatttacgtcgatagtgatcgataagttatttagtgagtaattaaatagattcgttaatagcgtcggacgtattagcggatggtattgtttacggttaaagacgtatatcgttacgttagcgtttagtcggtataggtaaaagtcggtgttaattagtaagttaaacgcgatttatacgttttacgggaagtcggcgtttagggtaaagatagaattttagatcgaatattagacgttttataattaggagtatatagatgacgantaacggtttaaaaattatga

SEQ ID NO: 10950 - DNA, 660 bp, Artificial Sequence
  chemically treated genomic DNA (Homo sapiens) CpG-island No: 10950
  misc_feature (21)..(21): n is either a, c, g or t
tcataatttttaaaccgttantcgtcatctatatactcctaattataaaacgtctaatattcgatctaaaattctatctttaccctaaacgccgacttcccgtaaaacgtataaatcgcgtttaacttactaattaacaccgacttttacctataccgactaaacgctaacgtaacgatatacgtctttaaccgtaaacaataccatccgctaatacgtccgacgctattaacgaatctatttaattactcactaaataacttatcgatcactatcgacgtaaatcgctactaaaacctaccgtacttctacattccgaatcacttcaacgtaaactcgatactattcgaaacgacgatctatataaccatctatatcgacgtaataacactaaaatttactccgacactatttaaacgtctaaaataaaaaatatcgctacaacgactaaacaaaataatattcttcatcatcgcgctcgatacgctactaccgaccatacaccaatcttcaataaaatcgctaataatctcgacgaactacaaaatacatccgttataacaaaactataaaatattaccgctattctcgctactaacgacgttcatcataaacttctcgattatcatctttaaaaattcgctaatacaaacgaatcta

SEQ ID NO: 10951 - DNA, 660 bp, Artificial Sequence
  chemically treated genomic DNA (Homo sapiens) CpG-island No: 10951
  misc_feature (21)..(21): n is either a, c, g or t
ttatgatttttggatcgttantcgttatttgtatgtttttgattgtgaagcgtttggtgttcggtttggggttttgtttttattttgaacgtcggtttttcgtggggcgtgtggatcgcgtttgatttgttgattggtatcggtttttgtttgtgtcggttgggcgttggcgtggcggtatacgtttttaatcgtgggtaatattattcgttggtgcgttcggcgttgttggcgagtttgtttggttatttattgggtggtttgtcgattattatcgacgtgggtcgttattggaatttgtcgtatttttatatttcgggttattttaacgtgaattcggtattgttcgagacggcggtttgtatgattatttatatcggcgtgatggtattggagtttgtttcggtattgtttgaacgtttggggtggaaggtgtcgttatagcgattaaataaggtgatgttttttattatcgcgttcggtgcgttgttgtcgattatgtattagtttttaatggggtcgttgatgatttcggcgggttataaggtgtattcgttgtggtagagttatgaaatgttgtcgttgttttcgttgttgacggcgtttattatgggtttttcgattgttatttttgaaggttcgttggtgtaggcgggtttg

SEQ ID NO: 10952 - DNA, 660 bp, Artificial Sequence
  chemically treated genomic DNA (Homo sapiens) CpG-island No: 10952
  misc_feature (640)..(640): n is either a, c, g or t
caaacccgcctacaccaacgaaccttcaaaaataacaatcgaaaaacccataataaacgccgtcaacaacgaaaacaacgacaacatttcataactctaccacaacgaatacaccttataacccgccgaaatcatcaacgaccccattaaaaactaatacataatcgacaacaacgcaccgaacgcgataataaaaaacatcaccttatttaatcgctataacgacaccttccaccccaaacgttcaaacaataccgaaacaaactccaataccatcacgccgatataaataatcatacaaaccgccgtctcgaacaataccgaattcacgttaaaataacccgaaatataaaaatacgacaaattccaataacgacccacgtcgataataatcgacaaaccacccaataaataaccaaacaaactcgccaacaacgccgaacgcaccaacgaataatattacccacgattaaaaacgtataccgccacgccaacgcccaaccgacacaaacaaaaaccgataccaatcaacaaatcaaacgcgatccacacgccccacgaaaaaccgacgttcaaaataaaaacaaaaccccaaaccgaacaccaaacgcttcacaatcaaaaacatacaaataacgantaacgatccaaaaatcataa

SEQ ID NO: 10953 - DNA, 553 bp, Artificial Sequence
  chemically treated genomic DNA (Homo sapiens) CpG-island No: 10953
taaacggtatttgacggttgtttattttcggtttgttcggatggttcggtatggtaattatttcgttttcgttttgatagttttcgataattagttttatcggatcgataatcgttattgcgcgcggcgtattttcgttgagatttttacggatgtaggattttagcgacgttattttaatggtgttgttttgtttggttacgtcgatgcgtttgtagaatttacgaatagaagtcgtagtgtaattacgacgacgtagatcggaaatggtcggtatacgcgggttattttagtttttaacgtgtttgtcggttattagtaggtttaatttacgtttggatattacggtgtattttagatttaggcgcgagaatttatattggcgcgggtgaataggaatcgtgatgttgtttagtatttagtcgtatagacgacggttgttttggaatttaagcgtatatagagagtgcgtaatattttttagggtatcgttgatgtagtgggtgaagtcgtatatcgggtagatgtattatttgttgttagtttggtgggt

SEQ ID NO: 10954 - DNA, 553 bp, Artificial Sequence
  chemically treated genomic DNA (Homo sapiens) CpG-island No: 10954
acccaccaaactaacaacaaataatacatctacccgatatacgacttcacccactacatcaacgataccctaaaaaatattacgcactctctatatacgcttaaattccaaaacaaccgtcgtctatacgactaaatactaaacaacatcacgattcctattcacccgcgccaatataaattctcgcgcctaaatctaaaatacaccgtaatatccaaacgtaaattaaacctactaataaccgacaaacacgttaaaaactaaaataacccgcgtataccgaccatttccgatctacgtcgtcgtaattacactacgacttctattcgtaaattctacaaacgcatcgacgtaaccaaacaaaacaacaccattaaaataacgtcgctaaaatcctacatccgtaaaaatctcaacgaaaatacgccgcgcgcaataacgattatcgatccgataaaactaattatcgaaaactatcaaaacgaaaacgaaataattaccataccgaaccatccgaacaaaccgaaaataaacaaccgtcaaataccgttta

SEQ ID NO: 10955 - DNA, 553 bp, Artificial Sequence
  chemically treated genomic DNA (Homo sapiens) CpG-island No: 10955
atttattagattggtaataagtggtgtatttattcgatgtacgattttatttattgtattagcgatgttttggaaggtattacgtattttttgtgtacgtttgagttttaggataatcgtcgtttgtacgattgggtattggataatattacgatttttgtttattcgcgttagtatgagttttcgcgtttgaatttggaatatatcgtgatgtttaagcgtaagttgaatttgttggtgatcgataagtacgttgaaggttgggatgattcgcgtatgtcgattattttcggtttgcgtcgtcgtggttatattgcggtttttattcgtgagttttgtaaacgtatcggcgtgattaagtaggataatattattgagatggcgtcgttggaattttgtattcgtgaagattttaacgaaaatgcgtcgcgcgtaatggcggttatcgattcggtgaaattggttatcgaaaattattagggcgaaggcgaaatggttattatgtcgaattattcgaataaatcggaaatgggtagtcgttaggtgtcgttta

SEQ ID NO: 10956 - DNA, 553 bp, Artificial Sequence
  chemically treated genomic DNA (Homo sapiens) CpG-island No: 10956
taaacgacacctaacgactacccatttccgatttattcgaataattcgacataataaccatttcgccttcgccctaataattttcgataaccaatttcaccgaatcgataaccgccattacgcgcgacgcattttcgttaaaatcttcacgaatacaaaattccaacgacgccatctcaataatattatcctacttaatcacgccgatacgtttacaaaactcacgaataaaaaccgcaatataaccacgacgacgcaaaccgaaaataatcgacatacgcgaatcatcccaaccttcaacgtacttatcgatcaccaacaaattcaacttacgcttaaacatcacgatatattccaaattcaaacgcgaaaactcatactaacgcgaataaacaaaaatcgtaatattatccaatacccaatcgtacaaacgacgattatcctaaaactcaaacgtacacaaaaaatacgtaataccttccaaaacatcgctaatacaataaataaaatcgtacatcgaataaatacaccacttattaccaatctaataaat

SEQ ID NO: 10957 - DNA, 777 bp, Artificial Sequence
  chemically treated genomic DNA (Homo sapiens) CpG-island No: 10957
agtttcggaggtttaggtcgtcggagtaattatattagggtcggtgtatttcggggcggcggcgtaggattaggttaggtcgggtcgggtcgggtagggcggcgcgagtcgggggtggggcggcggcgtagcgtcgtcgtcgtagttttcgttttttttttaggggtcgcgtcggagtttcggcggcggcggcggtgtttatagtttgagaagagcgtttcgttcgggagcggcggcggttatcgagatttatttaaggcgcgtttttttcggttttttagcgtttttaagtcgtagcggtcgcgtttttttagttagttcgttcgttcgttttgtttttttgttgtcggttgcgttatggcgttggcgttggcggcgttggcggcggtcgagtcggtttgcggtagtcggtattagtaggtaagcggcgttcgattttagtttcgaatttcggtttttggttttgttttgttcgttggtcgttttaggtttttttggtcggttcgcggttaattcgacgtcggggtttggtaggtcgcgttgggtttggaggggcgggtcgggtttcgggttcggattcgaggttgttacgggttcggtttgttcgtttgcgattttaggtgggatttcggcggtggaaagtttttttttcggtttcgtttttcgtattttttagggcgggcgggtttttgagttagaattcgcgatttataggcggtatcgatttgaggtattcgttttttatttttttatttttggtttgatgttattggaaaa

SEQ ID NO: 10958 - DNA, 777 bp, Artificial Sequence
  chemically treated genomic DNA (Homo sapiens) CpG-island No: 10958
ttttccaataacatcaaaccaaaaataaaaaaataaaaaacgaatacctcaaatcgataccgcctataaatcgcgaattctaactcaaaaacccgcccgccctaaaaaatacgaaaaacgaaaccgaaaaaaaaactttccaccgccgaaatcccacctaaaatcgcaaacgaacaaaccgaacccgtaacaacctcgaatccgaacccgaaacccgacccgcccctccaaacccaacgcgacctaccaaaccccgacgtcgaattaaccgcgaaccgaccaaaaaaacctaaaacgaccaacgaacaaaacaaaaccaaaaaccgaaattcgaaactaaaatcgaacgccgcttacctactaataccgactaccgcaaaccgactcgaccgccgccaacgccgccaacgccaacgccataacgcaaccgacaacaaaaaaacaaaacgaacgaacgaactaactaaaaaaacgcgaccgctacgacttaaaaacgctaaaaaaccgaaaaaaacgcgccttaaataaatctcgataaccgccgccgctcccgaacgaaacgctcttctcaaactataaacaccgccgccgccgccgaaactccgacgcgacccctaaaaaaaaaacgaaaactacgacgacgacgctacgccgccgccccacccccgactcgcgccgccctacccgacccgacccgacctaacctaatcctacgccgccgccccgaaatacaccgaccctaatataattactccgacgacctaaacctccgaaact

SEQ ID NO: 10959 - DNA, 777 bp, Artificial Sequence
  chemically treated genomic DNA (Homo sapiens) CpG-island No: 10959
ttttttaatgatattaaattaaaggtggaaaaatgaaaaacgaatgttttagatcgatgtcgtttgtgggtcgcgggttttgatttagggattcgttcgttttgggaaatgcgggaaacgaggtcgggaggaggattttttatcgtcggagttttatttggggtcgtagacgggtaggtcgggttcgtggtagtttcgaattcgagttcggggttcgattcgtttttttaggtttagcgcggtttgttaagtttcggcgtcgagttggtcgcgggtcggttagagaggtttgaggcggttagcgggtagggtagagttagggatcggagttcggggttggagtcgggcgtcgtttatttgttggtatcggttgtcgtaggtcggttcgatcgtcgttagcgtcgttaacgttaacgttatggcgtagtcggtagtagggaagtagagcgagcgagcgagttagttgaaggggcgcggtcgttgcggtttgggagcgttgggaggtcgagggggacgcgttttgggtgggtttcgatggtcgtcgtcgttttcgggcgagacgttttttttaggttgtaagtatcgtcgtcgtcgtcgaggtttcgacgcggtttttggggaagaggcggggattacgacgacggcgttgcgtcgtcgttttattttcgattcgcgtcgttttgttcggttcggttcggtttagtttagttttgcgtcgtcgtttcgaggtgtatcggttttggtgtagttgtttcgacgatttgagttttcgaggtt

SEQ ID NO: 10960 - DNA, 777 bp, Artificial Sequence
  chemically treated genomic DNA (Homo sapiens) CpG-island No: 10960
aacctcgaaaactcaaatcgtcgaaacaactacaccaaaaccgatacacctcgaaacgacgacgcaaaactaaactaaaccgaaccgaaccgaacaaaacgacgcgaatcgaaaataaaacgacgacgcaacgccgtcgtcgtaatccccgcctcttccccaaaaaccgcgtcgaaacctcgacgacgacgacgatacttacaacctaaaaaaaacgtctcgcccgaaaacgacgacgaccatcgaaacccacccaaaacgcgtccccctcgacctcccaacgctcccaaaccgcaacgaccgcgccccttcaactaactcgctcgctcgctctacttccctactaccgactacgccataacgttaacgttaacgacgctaacgacgatcgaaccgacctacgacaaccgataccaacaaataaacgacgcccgactccaaccccgaactccgatccctaactctaccctacccgctaaccgcctcaaacctctctaaccgacccgcgaccaactcgacgccgaaacttaacaaaccgcgctaaacctaaaaaaacgaatcgaaccccgaactcgaattcgaaactaccacgaacccgacctacccgtctacgaccccaaataaaactccgacgataaaaaatcctcctcccgacctcgtttcccgcatttcccaaaacgaacgaatccctaaatcaaaacccgcgacccacaaacgacatcgatctaaaacattcgtttttcatttttccacctttaatttaatatcattaaaaaa

SEQ ID NO: 10961 - DNA, 575 bp, Artificial Sequence
  chemically treated genomic DNA (Homo sapiens) CpG-island No: 10961
cgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtcggatttttgtaagaagtcgtttatattaaatagttgggttttgacggtaaatcgttgattaattcgcgttagattgatttgttgtataatttttacgtatcgatttagaaagaagtggattacgttcgtcgcgtcgtagaagtcgttgaagtcgtcgttcgcgaaggtttcggcgtggtttttttgaacggtaagatggtggacggttcggttatcgatcgcgttcgtttggtgttttttcgtgtagaatttttcggtattcgcgaagaataaggtaattaaaatgacgtagaaaatagaataattttaacgataag

SEQ ID NO: 10962 - DNA, 575 bp, Artificial Sequence
  chemically treated genomic DNA (Homo sapiens) CpG-island No: 10962
cttatcgttaaaattattctattttctacgtcattttaattaccttattcttcgcgaataccgaaaaattctacacgaaaaaacaccaaacgaacgcgatcgataaccgaaccgtccaccatcttaccgttcaaaaaaaccacgccgaaaccttcgcgaacgacgacttcaacgacttctacgacgcgacgaacgtaatccacttctttctaaatcgatacgtaaaaattatacaacaaatcaatctaacgcgaattaatcaacgatttaccgtcaaaacccaactatttaatataaacgacttcttacaaaaatccgacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacg

SEQ ID NO: 10963 - DNA, 575 bp, Artificial Sequence
  chemically treated genomic DNA (Homo sapiens) CpG-island No: 10963
tttgtcgttgagattgttttattttttgcgttattttgattgttttatttttcgcggatgtcggagagttttgtacgggagagtattagacgggcgcgatcgataatcggatcgtttattattttgtcgtttagggaaattacgtcgaggttttcgcgagcggcggttttagcggtttttacgacgcggcgggcgtgatttatttttttttgggtcggtgcgtagaggttgtgtagtagattaatttgacgcgggttgattagcgatttgtcgttaaagtttagttgtttgatgtgggcggttttttgtagaaattcggtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacg

SEQ ID NO: 10964 - DNA, 575 bp, Artificial Sequence
  chemically treated genomic DNA (Homo sapiens) CpG-island No: 10964
cgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaaccgaatttctacaaaaaaccgcccacatcaaacaactaaactttaacgacaaatcgctaatcaacccgcgtcaaattaatctactacacaacctctacgcaccgacccaaaaaaaaataaatcacgcccgccgcgtcgtaaaaaccgctaaaaccgccgctcgcgaaaacctcgacgtaatttccctaaacgacaaaataataaacgatccgattatcgatcgcgcccgtctaatactctcccgtacaaaactctccgacatccgcgaaaaataaaacaatcaaaataacgcaaaaaataaaacaatctcaacgacaaa

SEQ ID NO: 10965 - DNA, 748 bp, Artificial Sequence
  chemically treated genomic DNA (Homo sapiens) CpG-island No: 10965
gatgacggagagggattttcgggattaaagaataacgatcgtaggcgagtgtacgagcgaggtgcgcgcgttgagtagggggaggggtttggcgcgcgtcgaattagatcgagggggtgggggcgagttttttcgcgagagtgggtttgtttttgggttgtagtcgttgtcgtcgtttttcgttagcgtcgttgttgcgggggattgtgggagttttcgcgtttcgttcgttgggagagaggtatttttttttttttttttttttttttttaaggtaggcgtgaagcgggtaagagtcggggtcgggtggttgggggtttttcgtgttcgtcgggaggggataacgacggcgataggggttgcggggagtcggcggcgcgttttttttgttcgttttcgttttgttttttttcgcgttgcgtatgtgagtcgtttgatcggcggtcgttatgttaggagcgtagtggcggcgtaattagttttttagggcggcggaggtgagcggttcgggagggaaatacgcggtcggttaagggtttagggtgcggcgggagattttgggtgaagaggtgcgttgatcggtcgagttttttgcgcgttttgggttcgttgtgggcgggggcgggacgattagttcgttatacgcgggtcgcggcgttgagggggagggaggagttcgttcgaggtttgagggatagattgtatattgggggtttgtcgtttgaggaggatggttaagatatttaag

SEQ ID NO: 10966 - DNA, 748 bp, Artificial Sequence
  chemically treated genomic DNA (Homo sapiens) CpG-island No: 10966
cttaaatatcttaaccatcctcctcaaacgacaaacccccaatatacaatctatccctcaaacctcgaacgaactcctccctccccctcaacgccgcgacccgcgtataacgaactaatcgtcccgcccccgcccacaacgaacccaaaacgcgcaaaaaactcgaccgatcaacgcacctcttcacccaaaatctcccgccgcaccctaaacccttaaccgaccgcgtatttccctcccgaaccgctcacctccgccgccctaaaaaactaattacgccgccactacgctcctaacataacgaccgccgatcaaacgactcacatacgcaacgcgaaaaaaaacaaaacgaaaacgaacaaaaaaaacgcgccgccgactccccgcaacccctatcgccgtcgttatcccctcccgacgaacacgaaaaacccccaaccacccgaccccgactcttacccgcttcacgcctaccttaaaaaaaaaaaaaaaaaaaaaaaaaaatacctctctcccaacgaacgaaacgcgaaaactcccacaatcccccgcaacaacgacgctaacgaaaaacgacgacaacgactacaacccaaaaacaaacccactctcgcgaaaaaactcgcccccaccccctcgatctaattcgacgcgcgccaaacccctccccctactcaacgcgcgcacctcgctcgtacactcgcctacgatcgttattctttaatcccgaaaatccctctccgtcatc

SEQ ID NO: 10967 - DNA, 748 bp, Artificial Sequence
  chemically treated genomic DNA (Homo sapiens) CpG-island No: 10967
tttagatattttaattattttttttaaacggtaagtttttagtgtatagtttgttttttaggtttcgagcgagttttttttttttttttagcgtcgcggttcgcgtgtaacgggttagtcgtttcgttttcgtttataacgagtttaggacgcgtaggaagttcggtcggttagcgtatttttttatttaaaatttttcgtcgtattttgggtttttggtcggtcgcgtgtttttttttcggatcgtttattttcgtcgttttagaaggttggttgcgtcgttattgcgtttttaatatggcggtcgtcgattaggcggtttatatacgtaacgcggagggaggtagagcgggagcgagtaagaaaggcgcgtcgtcggtttttcgtagtttttgtcgtcgtcgttgttttttttcggcggatacggagaatttttagttattcgatttcgatttttattcgttttacgtttattttagggaaagggagagggaaaaggagaggtattttttttttagcgagcgggacgcggagatttttataatttttcgtagtaacggcgttggcgagaagcggcggtagcggttgtagtttaagaataaatttattttcgcgagagagttcgtttttattttttcgatttggttcggcgcgcgttaggtttttttttttatttagcgcgcgtatttcgttcgtgtattcgtttgcggtcgttgttttttaatttcggagattttttttcgttatt

SEQ ID NO: 10968 - DNA, 748 bp, Artificial Sequence
  chemically treated genomic DNA (Homo sapiens) CpG-island No: 10968
aataacgaaaaaaaatctccgaaattaaaaaacaacgaccgcaaacgaatacacgaacgaaatacgcgcgctaaataaaaaaaaaaacctaacgcgcgccgaaccaaatcgaaaaaataaaaacgaactctctcgcgaaaataaatttattcttaaactacaaccgctaccgccgcttctcgccaacgccgttactacgaaaaattataaaaatctccgcgtcccgctcgctaaaaaaaaaatacctctccttttccctctccctttccctaaaataaacgtaaaacgaataaaaatcgaaatcgaataactaaaaattctccgtatccgccgaaaaaaaacaacgacgacgacaaaaactacgaaaaaccgacgacgcgcctttcttactcgctcccgctctacctccctccgcgttacgtatataaaccgcctaatcgacgaccgccatattaaaaacgcaataacgacgcaaccaaccttctaaaacgacgaaaataaacgatccgaaaaaaaaacacgcgaccgaccaaaaacccaaaatacgacgaaaaattttaaataaaaaaatacgctaaccgaccgaacttcctacgcgtcctaaactcgttataaacgaaaacgaaacgactaacccgttacacgcgaaccgcgacgctaaaaaaaaaaaaaaaactcgctcgaaacctaaaaaacaaactatacactaaaaacttaccgtttaaaaaaaataattaaaatatctaaa

SEQ ID NO: 10969 - DNA, 540 bp, Artificial Sequence
  chemically treated genomic DNA (Homo sapiens) CpG-island No: 10969
gttatgtatcgtatcgtgagtattttttttttaggcgaacggttcgtgttgatatattataattttcggcgtatgtagcggttcggcgttgtttagcgtttcgataattattttgtcggtgtttagtttatattcgttttgtatttttttttcgtttaattcgcgcgtatacggaatgtcgttaaagaagtagtcggcgtgcgtggtgtttaacgtcgggatcgttagtttcgtttgcgtttatgcggtggtatgagtggagtgggtatggataatgttattaagcgacgggtaacgacggtagagttcgagatgcgtcgtagtgtcggaagatgggcgatattttttttttattattttgtcgtttatattaattattattatattcgtcgtttttttggttcgtaagtaacgttttttggtttgattattattagttcgcgttcgcggttatagcgttgatttgttttagtaaagttgtgatttatcgttattgtgttttaaagattattaagtggtagagttaggatttgaatttag

SEQ ID NO: 10970 - DNA, 540 bp, Artificial Sequence
  chemically treated genomic DNA (Homo sapiens) CpG-island No: 10970
ctaaattcaaatcctaactctaccacttaataatctttaaaacacaataacgataaatcacaactttactaaaacaaatcaacgctataaccgcgaacgcgaactaataataatcaaaccaaaaaacgttacttacgaaccaaaaaaacgacgaatataataataattaatataaacgacaaaataataaaaaaaaaatatcgcccatcttccgacactacgacgcatctcgaactctaccgtcgttacccgtcgcttaataacattatccatacccactccactcataccaccgcataaacgcaaacgaaactaacgatcccgacgttaaacaccacgcacgccgactacttctttaacgacattccgtatacgcgcgaattaaacgaaaaaaaaatacaaaacgaatataaactaaacaccgacaaaataattatcgaaacgctaaacaacgccgaaccgctacatacgccgaaaattataatatatcaacacgaaccgttcgcctaaaaaaaaaatactcacgatacgatacataac

SEQ ID NO: 10971 - DNA, 540 bp, Artificial Sequence
  chemically treated genomic DNA (Homo sapiens) CpG-island No: 10971
ttggatttaaattttagttttattatttgatggtttttagagtatagtggcgatgaattataattttattggggtaagttagcgttatgatcgcggacgcgggttggtggtgattaagttaaggggcgttgtttacgaattaagaaagcggcggatatggtggtggttaatatgagcggtaaggtggtggaagggaagtatcgtttatttttcgatattgcgacgtatttcgaattttatcgtcgttattcgtcgtttggtggtattgtttatatttattttatttatgttatcgtatgggcgtaggcggggttggcgatttcggcgttaggtattacgtacgtcgattatttttttggcgatatttcgtgtacgcgcgggttaagcgaagaagaggtgtagggcgagtatgaattgaatatcggtaaagtgattatcgaaacgttgggtaacgtcgagtcgttgtatacgtcgggaattgtggtgtattagtacgggtcgttcgtttgggggaaagatgtttacgatgcggtgtataat

SEQ ID NO: 10972 - DNA, 540 bp, Artificial Sequence
  chemically treated genomic DNA (Homo sapiens) CpG-island No: 10972
attatacaccgcatcgtaaacatctttcccccaaacgaacgacccgtactaatacaccacaattcccgacgtatacaacgactcgacgttacccaacgtttcgataatcactttaccgatattcaattcatactcgccctacacctcttcttcgcttaacccgcgcgtacacgaaatatcgccaaaaaaataatcgacgtacgtaatacctaacgccgaaatcgccaaccccgcctacgcccatacgataacataaataaaataaatataaacaataccaccaaacgacgaataacgacgataaaattcgaaatacgtcgcaatatcgaaaaataaacgatacttcccttccaccaccttaccgctcatattaaccaccaccatatccgccgctttcttaattcgtaaacaacgccccttaacttaatcaccaccaacccgcgtccgcgatcataacgctaacttaccccaataaaattataattcatcgccactatactctaaaaaccatcaaataataaaactaaaatttaaatccaa

SEQ ID NO: 10973 - DNA, 768 bp, Artificial Sequence
  chemically treated genomic DNA (Homo sapiens) CpG-island No: 10973
taaacgggcgtagtatcgtacgtaattcgttagtatagacgttttcgttatcgtttataattcgcgttttgattatcgcgtaacgtttttagtcgcgtttttgtttttggtaataattttttaacgcggtaaagtttagtattagcgggttattttcgttaaacggacgtagtcgtatatttacgcgatagacgaagttattttgcgttggttgatttagtattttaattagtcgttgttttatgcgggtaaaaaattgcgcgttatttagttttcggcgtttattttgcgtataattatgtttcggttaggtaaaaattagatcgatattagaggagaaatttagttttttatcgtttagtttatttatgtttaaaattagtagcggttgcgtttcgttttgcgtattgtacggcgttttttattcgcggtagtaggcgttatatagttagttacgcgtcgcgataattagcgttttcgttagatagttgaattgttgtaatatgttttttttagtaattagtgttagcgtttgcgtttaggggatgcgtattataatgcgtcgtcgggatagtcgtagtttgggtaattaattcgtttcgttatttatattatagagcggtttttgtaattatgtcgcgtaatgtttttattcgtcggtttggggcgggtggttttttagtttcggtcgttattttggatggggtaatattttgttttggtataaattattaaaagtaagtttggtttcgttgtgcgttatttttt

SEQ ID NO: 10974 - DNA, 768 bp, Artificial Sequence
  chemically treated genomic DNA (Homo sapiens) CpG-island No: 10974
aaaaaataacgcacaacgaaaccaaacttacttttaataatttataccaaaacaaaatattaccccatccaaaataacgaccgaaactaaaaaaccacccgccccaaaccgacgaataaaaacattacgcgacataattacaaaaaccgctctataatataaataacgaaacgaattaattacccaaactacgactatcccgacgacgcattataatacgcatcccctaaacgcaaacgctaacactaattactaaaaaaaacatattacaacaattcaactatctaacgaaaacgctaattatcgcgacgcgtaactaactatataacgcctactaccgcgaataaaaaacgccgtacaatacgcaaaacgaaacgcaaccgctactaattttaaacataaataaactaaacgataaaaaactaaatttctcctctaatatcgatctaatttttacctaaccgaaacataattatacgcaaaataaacgccgaaaactaaataacgcgcaattttttacccgcataaaacaacgactaattaaaatactaaatcaaccaacgcaaaataacttcgtctatcgcgtaaatatacgactacgtccgtttaacgaaaataacccgctaatactaaactttaccgcgttaaaaaattattaccaaaaacaaaaacgcgactaaaaacgttacgcgataatcaaaacgcgaattataaacgataacgaaaacgtctatactaacgaattacgtacgatactacgcccgttta

SEQ ID NO: 10975 - DNA, 768 bp, Artificial Sequence
  chemically treated genomic DNA (Homo sapiens) CpG-island No: 10975
aagaggtagcgtatagcgaagttaaatttatttttagtgatttgtgttagaatagggtattgttttatttagagtggcgatcggaattggaaagttattcgttttaggtcgacgaatggaagtattacgcggtatggttgtagaagtcgttttgtaatgtgagtgacgaagcgggttaattgtttaagttgcggttatttcggcggcgtattatggtgcgtattttttgggcgtaaacgttggtattggttattgaagagagtatattgtagtagtttagttatttggcggagacgttgattgtcgcggcgcgtgattggttgtatgacgtttgttgtcgcgagtggggaacgtcgtgtaatgcgtagggcgaagcgtaatcgttgttgattttaggtatgggtaagttgggcggtggggagttgaattttttttttgatatcgatttgatttttgtttggtcggaatatggttgtacgtagggtggacgtcgggaattggataacgcgtagttttttattcgtatggggtagcggttgattaaagtgttggattaattaacgtaggatggtttcgtttatcgcgtggatatgcggttgcgttcgtttggcgaaagtggttcgttggtgttgagttttgtcgcgttggaagattattattaggagtaggggcgcgattgggagcgttacgcgatggttaaggcgcggattatgggcgatagcgaaggcgtttatgttaacgagttgcgtgcgatgttgcgttcgtttg

SEQ ID NO: 10976 - DNA, 768 bp, Artificial Sequence
  chemically treated genomic DNA (Homo sapiens) CpG-island No: 10976
caaacgaacgcaacatcgcacgcaactcgttaacataaacgccttcgctatcgcccataatccgcgccttaaccatcgcgtaacgctcccaatcgcgcccctactcctaataataatcttccaacgcgacaaaactcaacaccaacgaaccactttcgccaaacgaacgcaaccgcatatccacgcgataaacgaaaccatcctacgttaattaatccaacactttaatcaaccgctaccccatacgaataaaaaactacgcgttatccaattcccgacgtccaccctacgtacaaccatattccgaccaaacaaaaatcaaatcgatatcaaaaaaaaaattcaactccccaccgcccaacttacccatacctaaaatcaacaacgattacgcttcgccctacgcattacacgacgttccccactcgcgacaacaaacgtcatacaaccaatcacgcgccgcgacaatcaacgtctccgccaaataactaaactactacaatatactctcttcaataaccaataccaacgtttacgcccaaaaaatacgcaccataatacgccgccgaaataaccgcaacttaaacaattaacccgcttcgtcactcacattacaaaacgacttctacaaccataccgcgtaatacttccattcgtcgacctaaaacgaataactttccaattccgatcgccactctaaataaaacaataccctattctaacacaaatcactaaaaataaatttaacttcgctatacgctacctctt

SEQ ID NO: 10977 - DNA, 531 bp, Artificial Sequence
  chemically treated genomic DNA (Homo sapiens) CpG-island No: 10977
  misc_feature (429)..(430): n is either a, c, g or t
  misc_feature (433)..(433): n is either a, c, g or t
acgatggggcggggttaaatcgtgagcgaattttggtaaaagcggtttcgtaaggtttgattgttagcgaaaatatgagcgacgacgaagtcgcgatgttgatatttgtatttggtttttttacggtagagtaggttatcgacgttttcgggcgcggcgtcggtatggacgtcgttaaacgtaatatttagaagatgggcggttatgtcgaaatttagtcgaagtaggttattggtattacgattcgtattttattgtcgttgacgttggttattttcgacggtatgttcgtacgcgttgcggatgaatttttattttgtcgttgaatttgttatggattattgtaattcgtgaagtcgattttaattacggtcggcggcgatcgggtgttgaatgcgggtgaaatttgttatcgttatatttttggtnnggnagggggtttggtgcgaggatattgagggcgagatcgttcgtttaggggatttttagagttttttatagcgagattttattttaaaaaaaaaaaaaaaa

SEQ ID NO: 10978 - DNA, 531 bp, Artificial Sequence
  chemically treated genomic DNA (Homo sapiens) CpG-island No: 10978
  misc_feature (99)..(99): n is either a, c, g or t
  misc_feature (102)..(103): n is either a, c, g or t
ttttttttttttttttaaaataaaatctcgctataaaaaactctaaaaatcccctaaacgaacgatctcgccctcaatatcctcgcaccaaaccccctnccnnaccaaaaatataacgataacaaatttcacccgcattcaacacccgatcgccgccgaccgtaattaaaatcgacttcacgaattacaataatccataacaaattcaacgacaaaataaaaattcatccgcaacgcgtacgaacataccgtcgaaaataaccaacgtcaacgacaataaaatacgaatcgtaataccaataacctacttcgactaaatttcgacataaccgcccatcttctaaatattacgtttaacgacgtccataccgacgccgcgcccgaaaacgtcgataacctactctaccgtaaaaaaaccaaatacaaatatcaacatcgcgacttcgtcgtcgctcatattttcgctaacaatcaaaccttacgaaaccgcttttaccaaaattcgctcacgatttaaccccgccccatcgt

SEQ ID NO: 10979 - DNA, 531 bp, Artificial Sequence
  chemically treated genomic DNA (Homo sapiens) CpG-island No: 10979
  misc_feature (99)..(99): n is either a, c, g or t
  misc_feature (102)..(103): n is either a, c, g or t
ttttttttttttttttaagatggagtttcgttgtggaggattttagaggttttttaggcgggcgatttcgtttttagtattttcgtattaggttttttnttnnattaaagatgtgacgatggtaaattttattcgtatttagtattcggtcgtcgtcggtcgtgattgagatcggttttacgggttgtagtgatttataatagatttagcggtagaatgaaaatttattcgtaacgcgtacggatatgtcgtcgaggatggttagcgttagcggtagtaaaatgcggatcgtagtgttagtaatttgtttcgattggatttcgatatgatcgtttattttttggatattacgtttaacgacgtttatgtcgacgtcgcgttcggagacgtcggtgatttgttttgtcgtggagaagttaggtgtaaatattagtatcgcgatttcgtcgtcgtttatgttttcgttgatagttaaattttgcgaggtcgtttttgttagaattcgtttacggtttagtttcgttttatcgt

SEQ ID NO: 10980 - DNA, 531 bp, Artificial Sequence
  chemically treated genomic DNA (Homo sapiens) CpG-island No: 10980
  misc_feature (429)..(430): n is either a, c, g or t
  misc_feature (433)..(433): n is either a, c, g or t
acgataaaacgaaactaaaccgtaaacgaattctaacaaaaacgacctcgcaaaatttaactatcaacgaaaacataaacgacgacgaaatcgcgatactaatatttacacctaacttctccacgacaaaacaaatcaccgacgtctccgaacgcgacgtcgacataaacgtcgttaaacgtaatatccaaaaaataaacgatcatatcgaaatccaatcgaaacaaattactaacactacgatccgcattttactaccgctaacgctaaccatcctcgacgacatatccgtacgcgttacgaataaattttcattctaccgctaaatctattataaatcactacaacccgtaaaaccgatctcaatcacgaccgacgacgaccgaatactaaatacgaataaaatttaccatcgtcacatctttaatnnaanaaaaaacctaatacgaaaatactaaaaacgaaatcgcccgcctaaaaaacctctaaaatcctccacaacgaaactccatcttaaaaaaaaaaaaaaaa

SEQ ID NO: 10981 - DNA, 586 bp, Artificial Sequence
  chemically treated genomic DNA (Homo sapiens) CpG-island No: 10981
gtcgtaatgtacgggtaatcgggcgcgttgtaagggttaattacgttgacgtagttgttgtacgattagggttacgttatttaggttatcggaaaatggtatatgcgggaaattatagagtcgtagtcgtagaacgttggttttgatgattttcgtggttttaattcggtgtttgatatgtatatcgtatggcgcgacgtttacgttaattcggaagtggttttgagttcggatcgttttgtatatattaattaattatcgtttagtaaagatgacgtttatgcgttgcgcggcggcgattaataggttattgtcgattattacgtcgaaatatatggtagatttggattaacgttgtacggagtatggcgtttagtttttcgataagatggcgaagagcgttaaattattttttttttattacggtattcgtggttgttatttcgataatttatttaaatgtcgaaattatgtcgggtagttattcggtacggtcgttcgtatggcgattgtattggtggagatgaacgattgtgttcgttaatttgtattaaatattggagaaaaacggttagtttgataatat

SEQ ID NO: 10982 - DNA, 586 bp, Artificial Sequence
  chemically treated genomic DNA (Homo sapiens) CpG-island No: 10982
atattatcaaactaaccgtttttctccaatatttaatacaaattaacgaacacaatcgttcatctccaccaatacaatcgccatacgaacgaccgtaccgaataactacccgacataatttcgacatttaaataaattatcgaaataacaaccacgaataccgtaataaaaaaaaaataatttaacgctcttcgccatcttatcgaaaaactaaacgccatactccgtacaacgttaatccaaatctaccatatatttcgacgtaataatcgacaataacctattaatcgccgccgcgcaacgcataaacgtcatctttactaaacgataattaattaatatatacaaaacgatccgaactcaaaaccacttccgaattaacgtaaacgtcgcgccatacgatatacatatcaaacaccgaattaaaaccacgaaaatcatcaaaaccaacgttctacgactacgactctataatttcccgcatataccattttccgataacctaaataacgtaaccctaatcgtacaacaactacgtcaacgtaattaacccttacaacgcgcccgattacccgtacattacgac

SEQ ID NO: 10983 - DNA, 586 bp, Artificial Sequence
  chemically treated genomic DNA (Homo sapiens) CpG-island No: 10983
gtgttattaagttgatcgtttttttttagtgtttgatatagattagcgaatatagtcgtttatttttattaatgtagtcgttatacgagcggtcgtgtcggatagttattcggtataatttcggtatttgggtaggttatcgaagtggtagttacgagtgtcgtagtagaggaagaatggtttagcgtttttcgttattttgtcgaggagttgagcgttatatttcgtgtagcgttgatttagatttgttatatatttcggcgtaatggtcggtaatggtttgttggtcgtcgtcgcgtagcgtatgaacgttatttttgttgagcggtgattggttgatgtatgtaggacggttcggatttagggttattttcggattgacgtgaacgtcgcgttatgcggtgtatatattagatatcgagttaaagttacggaaattattaaagttaacgttttgcggttgcggttttgtggtttttcgtatatgttatttttcgatggtttgagtgacgtagttttgatcgtgtagtaattgcgttagcgtggttaatttttgtagcgcgttcggttgttcgtatattgcgat

SEQ ID NO: 10984 - DNA, 586 bp, Artificial Sequence
  chemically treated genomic DNA (Homo sapiens) CpG-island No: 10984
atcgcaatatacgaacaaccgaacgcgctacaaaaattaaccacgctaacgcaattactacacgatcaaaactacgtcactcaaaccatcgaaaaataacatatacgaaaaaccacaaaaccgcaaccgcaaaacgttaactttaataatttccgtaactttaactcgatatctaatatatacaccgcataacgcgacgttcacgtcaatccgaaaataaccctaaatccgaaccgtcctacatacatcaaccaatcaccgctcaacaaaaataacgttcatacgctacgcgacgacgaccaacaaaccattaccgaccattacgccgaaatatataacaaatctaaatcaacgctacacgaaatataacgctcaactcctcgacaaaataacgaaaaacgctaaaccattcttcctctactacgacactcgtaactaccacttcgataacctacccaaataccgaaattataccgaataactatccgacacgaccgctcgtataacgactacattaataaaaataaacgactatattcgctaatctatatcaaacactaaaaaaaaacgatcaacttaataacac

SEQ ID NO: 10985 - DNA, 512 bp, Artificial Sequence
  chemically treated genomic DNA (Homo sapiens) CpG-island No: 10985
gtcgttacgtcgcggtattgataatgtcgttggacgtataaaaatgtcgtcgagttcggtgatattcggttcgcgttcgcgtagttcgtcggcgttaagtattcgcgttcgatatcgttcgtcgttgtgcgtttttataaggcgcgtattcgttttatttcgagatcggacgtggtaattagtattttgtcgtagttgtcgtagcgaatgtcgttttgatcgtaaaaggttttggtggcgcggtttttcgttaggtaaaattgcgtttttaggttgtcgggcgtgtaatagatttcggtatggattacgtcgttgttgtggttcgtttggtgataggtcggggcggaatttttttttagtaaagtaattgcgggcgttcggataggtattaattagttgtatgggggtcgaaatggcgatgatgtcgtcgttaataattataaaattttatattcgttcgtaattagacgcgtatcgtttggttcggtagagatttttatcggagtgttgat

SEQ ID NO: 10986 - DNA, 512 bp, Artificial Sequence
  chemically treated genomic DNA (Homo sapiens) CpG-island No: 10986
atcaacactccgataaaaatctctaccgaaccaaacgatacgcgtctaattacgaacgaatataaaattttataattattaacgacgacatcatcgccatttcgacccccatacaactaattaatacctatccgaacgcccgcaattactttactaaaaaaaaattccgccccgacctatcaccaaacgaaccacaacaacgacgtaatccataccgaaatctattacacgcccgacaacctaaaaacgcaattttacctaacgaaaaaccgcgccaccaaaaccttttacgatcaaaacgacattcgctacgacaactacgacaaaatactaattaccacgtccgatctcgaaataaaacgaatacgcgccttataaaaacgcacaacgacgaacgatatcgaacgcgaatacttaacgccgacgaactacgcgaacgcgaaccgaatatcaccgaactcgacgacatttttatacgtccaacgacattatcaataccgcgacgtaacgac

SEQ ID NO: 10987 - DNA, 512 bp, Artificial Sequence
  chemically treated genomic DNA (Homo sapiens) CpG-island No: 10987
attaatatttcgataaaagtttttgtcgaattaaacggtgcgcgtttggttgcgagcgaatgtaggattttgtgattattggcggcggtattatcgttatttcgatttttatgtaattgattgatgtttattcggacgttcgtaattgttttgttggaaaaagatttcgtttcggtttgttattagacgggttataatagcggcgtgatttatgtcggggtttattatacgttcggtagtttgaaggcgtagttttgtttggcgggaaatcgcgttattaaagttttttgcgattaaaacggtattcgttacgataattgcggtaagatgttggttgttacgttcgatttcgaaatggaacggatgcgcgttttatgggaacgtatagcggcgaacggtatcgagcgcgaatgtttaacgtcgacgaattgcgcgagcgcgaatcgaatattatcgggttcggcggtatttttgtgcgtttagcggtattgttagtatcgcgacgtgacggt

SEQ ID NO: 10988 - DNA, 512 bp, Artificial Sequence
  chemically treated genomic DNA (Homo sapiens) CpG-island No: 10988
accgtcacgtcgcgatactaacaataccgctaaacgcacaaaaataccgccgaacccgataatattcgattcgcgctcgcgcaattcgtcgacgttaaacattcgcgctcgataccgttcgccgctatacgttcccataaaacgcgcatccgttccatttcgaaatcgaacgtaacaaccaacatcttaccgcaattatcgtaacgaataccgttttaatcgcaaaaaactttaataacgcgatttcccgccaaacaaaactacgccttcaaactaccgaacgtataataaaccccgacataaatcacgccgctattataacccgtctaataacaaaccgaaacgaaatctttttccaacaaaacaattacgaacgtccgaataaacatcaatcaattacataaaaatcgaaataacgataataccgccgccaataatcacaaaatcctacattcgctcgcaaccaaacgcgcaccgtttaattcgacaaaaacttttatcgaaatattaat

SEQ ID NO: 10989 - DNA, 834 bp, Artificial Sequence
  chemically treated genomic DNA (Homo sapiens) CpG-island No: 10989
  misc_feature (3)..(3): n is either a, c, g or t
  misc_feature (5)..(5): n is either a, c, g or t
  misc_feature (9)..(9): n is either a, c, g or t
  misc_feature (20)..(20): n is either a, c, g or t
  misc_feature (28)..(28): n is either a, c, g or t
  misc_feature (35)..(35): n is either a, c, g or t
  misc_feature (39)..(39): n is either a, c, g or t
  misc_feature (41)..(41): n is either a, c, g or t
  misc_feature (54)..(54): n is either a, c, g or t
  misc_feature (56)..(56): n is either a, c, g or t
  misc_feature (59)..(59): n is either a, c, g or t
  misc_feature (68)..(68): n is either a, c, g or t
  misc_feature (70)..(70): n is either a, c, g or t
  misc_feature (72)..(72): n is either a, c, g or t
  misc_feature (85)..(85): n is either a, c, g or t
  misc_feature (87)..(87): n is either a, c, g or t
  misc_feature (98)..(98): n is either a, c, g or t
  misc_feature (110)..(110): n is either a, c, g or t
  misc_feature (126)..(126): n is either a, c, g or t
  misc_feature (129)..(129): n is either a, c, g or t
  misc_feature (132)..(132): n is either a, c, g or t
  misc_feature (142)..(142): n is either a, c, g or t
  misc_feature (147)..(147): n is either a, c, g or t
  misc_feature (150)..(150): n is either a, c, g or t
  misc_feature (158)..(158): n is either a, c, g or t
  misc_feature (218)..(218): n is either a, c, g or t
  misc_feature (246)..(246): n is either a, c, g or t
  misc_feature (260)..(260): n is either a, c, g or t
  misc_feature (262)..(262): n is either a, c, g or t
  misc_feature (274)..(275): n is either a, c, g or t
  misc_feature (313)..(314): n is either a, c, g or t
  misc_feature (357)..(357): n is either a, c, g or t
  misc_feature (375)..(375): n is either a, c, g or t
  misc_feature (380)..(381): n is either a, c, g or t
  misc_feature (420)..(420): n is either a, c, g or t
  misc_feature (427)..(428): n is either a, c, g or t
  misc_feature (437)..(437): n is either a, c, g or t
  misc_feature (440)..(440): n is either a, c, g or t
  misc_feature (445)..(445): n is either a, c, g or t
  misc_feature (465)..(465): n is either a, c, g or t
  misc_feature (467)..(467): n is either a, c, g or t
  misc_feature (471)..(471): n is either a, c, g or t
  misc_feature (477)..(477): n is either a, c, g or t
  misc_feature (481)..(481): n is either a, c, g or t
  misc_feature (487)..(487): n is either a, c, g or t
  misc_feature (505)..(505): n is either a, c, g or t
  misc_feature (559)..(560): n is either a, c, g or t
  misc_feature (578)..(579): n is either a, c, g or t
  misc_feature (592)..(592): n is either a, c, g or t
  misc_feature (608)..(608): n is either a, c, g or t
  misc_feature (620)..(620): n is either a, c, g or t
  misc_feature (638)..(638): n is either a, c, g or t
  misc_feature (642)..(642): n is either a, c, g or t
  misc_feature (650)..(650): n is either a, c, g or t
  misc_feature (655)..(655): n is either a, c, g or t
  misc_feature (657)..(657): n is either a, c, g or t
  misc_feature (667)..(667): n is either a, c, g or t
  misc_feature (692)..(692): n is either a, c, g or t
  misc_feature (701)..(701): n is either a, c, g or t
  misc_feature (705)..(705): n is either a, c, g or t
  misc_feature (727)..(727): n is either a, c, g or t
  misc_feature (730)..(730): n is either a, c, g or t
  misc_feature (733)..(733): n is either a, c, g or t
  misc_feature (739)..(739): n is either a, c, g or t
  misc_feature (742)..(744): n is either a, c, g or t
  misc_feature (749)..(749): n is either a, c, g or t
  misc_feature (755)..(755): n is either a, c, g or t
  misc_feature (757)..(757): n is either a, c, g or t
  misc_feature (793)..(793): n is either a, c, g or t
  misc_feature (804)..(805): n is either a, c, g or t
  misc_feature (808)..(810): n is either a, c, g or t
  misc_feature (814)..(814): n is either a, c, g or t
  misc_feature (816)..(816): n is either a, c, g or t
  misc_feature (818)..(818): n is either a, c, g or t
  misc_feature (820)..(820): n is either a, c, g or t
  misc_feature (822)..(822): n is either a, c, g or t
tantncganatcgtttacgnatttcgtnttaacgnttanantttttcgcgtttnanatncgttcgatnantnacgcgttatcgtnanacgtttacgtnacgtacgtttancgtatattttcgcgtntanttnttacgtattntcgtntanttttatanttttttttttatatatatatacgttcgtacgtatttatttatattttcgtacgtatatancgttatttatatatacgttattattttnttttttttacgcgntnttacgcgtacgnntcgcgttcgcgttttttatttcgttttcgtttatattnnttttaacgttatttttttcgcgcgtacgtcgttttcgcgcgtngttacgcgttacgtattnttatnntttcgtacgcgttttacgcgtacgttttcgcgtacgtantttacgnnttttcgcgnttntatanttattcgcgcgtatatatantntttnttattntttnttttanttttatatatatatttangtatatatatatttttagcgattcgcgcgttcgttcgcgttcgcgttcgcgcgnnttattttcgtttatattnnttttacgattatnttattcgcgtacgcgntttcgtacgcgnttattcgtacgtatattntcgntttttcgntatantntttcgcgcgnacgcgttcgcgtacgcgttttcgtntacgttcgnacgntttcgtacgtattttcgttcgnttntantttcgntannnttttnttacgntntttcgcgcgtacgtatttacgttatttcgtacgtanttttttcgttnnttnnnatanananananacgtatatatat

SEQ ID NO: 10990 - DNA, 834 bp, Artificial Sequence
  chemically treated genomic DNA (Homo sapiens) CpG-island No: 10990
  misc_feature (13)..(13): n is either a, c, g or t
  misc_feature (15)..(15): n is either a, c, g or t
  misc_feature (17)..(17): n is either a, c, g or t
  misc_feature (19)..(19): n is either a, c, g or t
  misc_feature (21)..(21): n is either a, c, g or t
  misc_feature (25)..(27): n is either a, c, g or t
  misc_feature (30)..(31): n is either a, c, g or t
  misc_feature (42)..(42): n is either a, c, g or t
  misc_feature (78)..(78): n is either a, c, g or t
  misc_feature (80)..(80): n is either a, c, g or t
  misc_feature (86)..(86): n is either a, c, g or t
  misc_feature (91)..(93): n is either a, c, g or t
  misc_feature (96)..(96): n is either a, c, g or t
  misc_feature (102)..(102): n is either a, c, g or t
  misc_feature (105)..(105): n is either a, c, g or t
  misc_feature (108)..(108): n is either a, c, g or t
  misc_feature (130)..(130): n is either a, c, g or t
  misc_feature (134)..(134): n is either a, c, g or t
  misc_feature (143)..(143): n is either a, c, g or t
  misc_feature (168)..(168): n is either a, c, g or t
  misc_feature (178)..(178): n is either a, c, g or t
  misc_feature (180)..(180): n is either a, c, g or t
  misc_feature (185)..(185): n is either a, c, g or t
  misc_feature (193)..(193): n is either a, c, g or t
  misc_feature (197)..(197): n is either a, c, g or t
  misc_feature (215)..(215): n is either a, c, g or t
  misc_feature (227)..(227): n is either a, c, g or t
  misc_feature (243)..(243): n is either a, c, g or t
  misc_feature (256)..(257): n is either a, c, g or t
  misc_feature (275)..(276): n is either a, c, g or t
  misc_feature (330)..(330): n is either a, c, g or t
  misc_feature (348)..(348): n is either a, c, g or t
  misc_feature (354)..(354): n is either a, c, g or t
  misc_feature (358)..(358): n is either a, c, g or t
  misc_feature (364)..(364): n is either a, c, g or t
  misc_feature (368)..(368): n is either a, c, g or t
  misc_feature (370)..(370): n is either a, c, g or t
  misc_feature (390)..(390): n is either a, c, g or t
  misc_feature (395)..(395): n is either a, c, g or t
  misc_feature (398)..(398): n is either a, c, g or t
  misc_feature (407)..(408): n is either a, c, g or t
  misc_feature (415)..(415): n is either a, c, g or t
  misc_feature (454)..(455): n is either a, c, g or t
  misc_feature (460)..(460): n is either a, c, g or t
  misc_feature (478)..(478): n is either a, c, g or t
  misc_feature (521)..(522): n is either a, c, g or t
  misc_feature (560)..(561): n is either a, c, g or t
  misc_feature (573)..(573): n is either a, c, g or t
  misc_feature (575)..(575): n is either a, c, g or t
  misc_feature (589)..(589): n is either a, c, g or t
  misc_feature (617)..(617): n is either a, c, g or t
  misc_feature (677)..(677): n is either a, c, g or t
  misc_feature (685)..(685): n is either a, c, g or t
  misc_feature (688)..(688): n is either a, c, g or t
  misc_feature (693)..(693): n is either a, c, g or t
  misc_feature (703)..(703): n is either a, c, g or t
  misc_feature (706)..(706): n is either a, c, g or t
  misc_feature (709)..(709): n is either a, c, g or t
  misc_feature (725)..(725): n is either a, c, g or t
  misc_feature (737)..(737): n is either a, c, g or t
  misc_feature (748)..(748): n is either a, c, g or t
  misc_feature (750)..(750): n is either a, c, g or t
  misc_feature (763)..(763): n is either a, c, g or t
  misc_feature (765)..(765): n is either a, c, g or t
  misc_feature (767)..(767): n is either a, c, g or t
  misc_feature (776)..(776): n is either a, c, g or t
  misc_feature (779)..(779): n is either a, c, g or t
  misc_feature (781)..(781): n is either a, c, g or t
  misc_feature (794)..(794): n is either a, c, g or t
  misc_feature (796)..(796): n is either a, c, g or t
  misc_feature (800)..(800): n is either a, c, g or t
  misc_feature (807)..(807): n is either a, c, g or t
  misc_feature (815)..(815): n is either a, c, g or t
  misc_feature (826)..(826): n is either a, c, g or t
  misc_feature (830)..(830): n is either a, c, g or t
  misc_feature (832)..(832): n is either a, c, g or t
atatatatacgtntntntntntatnnnaannaacgaaaaaantacgtacgaaataacgtaaatacgtacgcgcgaaanancgtaanaaaannntancgaaantanaancgaacgaaaatacgtacgaaancgtncgaacgtanacgaaaacgcgtacgcgaacgcgtncgcgcgaaanantatancgaaaaancganaatatacgtacgaataancgcgtacgaaancgcgtacgcgaataanataatcgtaaaannaatataaacgaaaataanncgcgcgaacgcgaacgcgaacgaacgcgcgaatcgctaaaaatatatatatacntaaatatatatataaaantaaaanaaanaataanaaanantatatatacgcgcgaataantatanaancgcgaaaanncgtaaantacgtacgcgaaaacgtacgcgtaaaacgcgtacgaaannataanaatacgtaacgcgtaacnacgcgcgaaaacgacgtacgcgcgaaaaaaataacgttaaaannaatataaacgaaaacgaaataaaaaacgcgaacgcganncgtacgcgtaanancgcgtaaaaaaaanaaaataataacgtatatataaataacgntatatacgtacgaaaatataaataaatacgtacgaacgtatatatatataaaaaaaaaantataaaantanacganaatacgtaanaantanacgcgaaaatatacgntaaacgtacgtnacgtaaacgtntnacgataacgcgtnantnatcgaacgnatntnaaacgcgaaaaantntaancgttaanacgaaatncgtaaacgatntcgnanta

SEQ ID NO: 10991 - DNA, 834 bp, Artificial Sequence
  chemically treated genomic DNA (Homo sapiens) CpG-island No: 10991
  misc_feature (13)..(13): n is either a, c, g or t
  misc_feature (15)..(15): n is either a, c, g or t
  misc_feature (17)..(17): n is either a, c, g or t
  misc_feature (19)..(19): n is either a, c, g or t
  misc_feature (21)..(21): n is either a, c, g or t
  misc_feature (25)..(27): n is either a, c, g or t
  misc_feature (30)..(31): n is either a, c, g or t
  misc_feature (42)..(42): n is either a, c, g or t
  misc_feature (78)..(78): n is either a, c, g or t
  misc_feature (80)..(80): n is either a, c, g or t
  misc_feature (86)..(86): n is either a, c, g or t
  misc_feature (91)..(93): n is either a, c, g or t
  misc_feature (96)..(96): n is either a, c, g or t
  misc_feature (102)..(102): n is either a, c, g or t
  misc_feature (105)..(105): n is either a, c, g or t
  misc_feature (108)..(108): n is either a, c, g or t
  misc_feature (130)..(130): n is either a, c, g or t
  misc_feature (134)..(134): n is either a, c, g or t
  misc_feature (143)..(143): n is either a, c, g or t
  misc_feature (168)..(168): n is either a, c, g or t
  misc_feature (178)..(178): n is either a, c, g or t
  misc_feature (180)..(180): n is either a, c, g or t
  misc_feature (185)..(185): n is either a, c, g or t
  misc_feature (193)..(193): n is either a, c, g or t
  misc_feature (197)..(197): n is either a, c, g or t
  misc_feature (215)..(215): n is either a, c, g or t
  misc_feature (227)..(227): n is either a, c, g or t
  misc_feature (243)..(243): n is either a, c, g or t
  misc_feature (256)..(257): n is either a, c, g or t
  misc_feature (275)..(276): n is either a, c, g or t
  misc_feature (330)..(330): n is either a, c, g or t
  misc_feature (348)..(348): n is either a, c, g or t
  misc_feature (354)..(354): n is either a, c, g or t
  misc_feature (358)..(358): n is either a, c, g or t
  misc_feature (364)..(364): n is either a, c, g or t
  misc_feature (368)..(368): n is either a, c, g or t
  misc_feature (370)..(370): n is either a, c, g or t
  misc_feature (390)..(390): n is either a, c, g or t
  misc_feature (395)..(395): n is either a, c, g or t
  misc_feature (398)..(398): n is either a, c, g or t
  misc_feature (407)..(408): n is either a, c, g or t
  misc_feature (415)..(415): n is either a, c, g or t
  misc_feature (454)..(455): n is either a, c, g or t
  misc_feature (460)..(460): n is either a, c, g or t
  misc_feature (478)..(478): n is either a, c, g or t
  misc_feature (521)..(522): n is either a, c, g or t
  misc_feature (560)..(561): n is either a, c, g or t
  misc_feature (573)..(573): n is either a, c, g or t
  misc_feature (575)..(575): n is either a, c, g or t
  misc_feature (589)..(589): n is either a, c, g or t
  misc_feature (617)..(617): n is either a, c, g or t
  misc_feature (677)..(677): n is either a, c, g or t
  misc_feature (685)..(685): n is either a, c, g or t
  misc_feature (688)..(688): n is either a, c, g or t
  misc_feature (693)..(693): n is either a, c, g or t
  misc_feature (703)..(703): n is either a, c, g or t
  misc_feature (706)..(706): n is either a, c, g or t
  misc_feature (709)..(709): n is either a, c, g or t
  misc_feature (725)..(725): n is either a, c, g or t
  misc_feature (737)..(737): n is either a, c, g or t
  misc_feature (748)..(748): n is either a, c, g or t
  misc_feature (750)..(750): n is either a, c, g or t
  misc_feature (763)..(763): n is either a, c, g or t
  misc_feature (765)..(765): n is either a, c, g or t
  misc_feature (767)..(767): n is either a, c, g or t
  misc_feature (776)..(776): n is either a, c, g or t
  misc_feature (779)..(779): n is either a, c, g or t
  misc_feature (781)..(781): n is either a, c, g or t
  misc_feature (794)..(794): n is either a, c, g or t
  misc_feature (796)..(796): n is either a, c, g or t
  misc_feature (800)..(800): n is either a, c, g or t
  misc_feature (807)..(807): n is either a, c, g or t
  misc_feature (815)..(815): n is either a, c, g or t
  misc_feature (826)..(826): n is either a, c, g or t
  misc_feature (830)..(830): n is either a, c, g or t
  misc_feature (832)..(832): n is either a, c, g or t
gtatatgtgcgtntntntntntatnnnagnnagcgaggaggntgcgtgcgaggtggcgtgggtgcgtgcgcgcgaggngncgtggngaggnnntgncgaggntgnggncgagcgagagtgcgtgcggggncgtncgagcgtgngcgagagcgcgtgcgcgagcgcgtncgcgcgaggngntgtgncgagaggncggnagtgtgcgtgcgggtggncgcgtgcgaggncgcgtgcgcgagtagngtagtcgtggggnnagtgtgagcgagggtggnncgcgcgagcgcgagcgcgagcgagcgcgcgagtcgttaagagtgtgtgtgtgtntgagtgtgtgtgtgaggntgaggnaggnagtggnaggngntgtgtgtgcgcgcgagtggntgtgnggncgcgagggnncgtgggntgcgtgcgcgagagcgtgcgcgtggagcgcgtgcgaggnngtggnagtgcgtggcgcgtggtngcgcgcgagggcggcgtgcgcgcgagagaggtggcgttggggnnagtgtgagcgagggcggggtggagagcgcgagcgcggnncgtgcgcgtggngncgcgtgagagaggngaggtggtagcgtgtgtgtgagtggcgntgtgtgcgtgcgagagtgtgagtgagtgcgtgcgagcgtgtgtgtgtgtgagagagaggntgtgaggntgngcggnagtgcgtggnggntgngcgcgagagtgtgcgntaggcgtgcgtngcgtgagcgtntngcggtagcgcgtngntngtcgagcgngtntngagcgcgagagantntagncgttagngcgaggtncgtgggcggtntcgngnta

SEQ ID NO: 10992 - DNA, 834 bp, Artificial Sequence
  chemically treated genomic DNA (Homo sapiens) CpG-island No: 10992
  misc_feature (3)..(3): n is either a, c, g or t
  misc_feature (5)..(5): n is either a, c, g or t
  misc_feature (9)..(9): n is either a, c, g or t
  misc_feature (20)..(20): n is either a, c, g or t
  misc_feature (28)..(28): n is either a, c, g or t
  misc_feature (35)..(35): n is either a, c, g or t
  misc_feature (39)..(39): n is either a, c, g or t
  misc_feature (41)..(41): n is either a, c, g or t
  misc_feature (54)..(54): n is either a, c, g or t
  misc_feature (56)..(56): n is either a, c, g or t
  misc_feature (59)..(59): n is either a, c, g or t
  misc_feature (68)..(68): n is either a, c, g or t
  misc_feature (70)..(70): n is either a, c, g or t
  misc_feature (72)..(72): n is either a, c, g or t
  misc_feature (85)..(85): n is either a, c, g or t
  misc_feature (87)..(87): n is either a, c, g or t
  misc_feature (98)..(98): n is either a, c, g or t
  misc_feature (110)..(110): n is either a, c, g or t
  misc_feature (126)..(126): n is either a, c, g or t
  misc_feature (129)..(129): n is either a, c, g or t
  misc_feature (132)..(132): n is either a, c, g or t
  misc_feature (142)..(142): n is either a, c, g or t
  misc_feature (147)..(147): n is either a, c, g or t
  misc_feature (150)..(150): n is either a, c, g or t
  misc_feature (158)..(158): n is either a, c, g or t
  misc_feature (218)..(218): n is either a, c, g or t
  misc_feature (246)..(246): n is either a, c, g or t
  misc_feature (260)..(260): n is either a, c, g or t
  misc_feature (262)..(262): n is either a, c, g or t
  misc_feature (274)..(275): n is either a, c, g or t
  misc_feature (313)..(314): n is either a, c, g or t
  misc_feature (357)..(357): n is either a, c, g or t
  misc_feature (375)..(375): n is either a, c, g or t
  misc_feature (380)..(381): n is either a, c, g or t
  misc_feature (420)..(420): n is either a, c, g or t
  misc_feature (427)..(428): n is either a, c, g or t
  misc_feature (437)..(437): n is either a, c, g or t
  misc_feature (440)..(440): n is either a, c, g or t
  misc_feature (445)..(445): n is either a, c, g or t
  misc_feature (465)..(465): n is either a, c, g or t
  misc_feature (467)..(467): n is either a, c, g or t
  misc_feature (471)..(471): n is either a, c, g or t
  misc_feature (477)..(477): n is either a, c, g or t
  misc_feature (481)..(481): n is either a, c, g or t
  misc_feature (487)..(487): n is either a, c, g or t
  misc_feature (505)..(505): n is either a, c, g or t
  misc_feature (559)..(560): n is either a, c, g or t
  misc_feature (578)..(579): n is either a, c, g or t
  misc_feature (592)..(592): n is either a, c, g or t
  misc_feature (608)..(608): n is either a, c, g or t
  misc_feature (620)..(620): n is either a, c, g or t
  misc_feature (638)..(638): n is either a, c, g or t
  misc_feature (642)..(642): n is either a, c, g or t
  misc_feature (650)..(650): n is either a, c, g or t
  misc_feature (655)..(655): n is either a, c, g or t
  misc_feature (657)..(657): n is either a, c, g or t
  misc_feature (667)..(667): n is either a, c, g or t
  misc_feature (692)..(692): n is either a, c, g or t
  misc_feature (701)..(701): n is either a, c, g or t
  misc_feature (705)..(705): n is either a, c, g or t
  misc_feature (727)..(727): n is either a, c, g or t
  misc_feature (730)..(730): n is either a, c, g or t
  misc_feature (733)..(733): n is either a, c, g or t
  misc_feature (739)..(739): n is either a, c, g or t
  misc_feature (742)..(744): n is either a, c, g or t
  misc_feature (749)..(749): n is either a, c, g or t
  misc_feature (755)..(755): n is either a, c, g or t
  misc_feature (757)..(757): n is either a, c, g or t
  misc_feature (793)..(793): n is either a, c, g or t
  misc_feature (804)..(805): n is either a, c, g or t
  misc_feature (808)..(810): n is either a, c, g or t
  misc_feature (814)..(814): n is either a, c, g or t
  misc_feature (816)..(816): n is either a, c, g or t
  misc_feature (818)..(818): n is either a, c, g or t
  misc_feature (820)..(820): n is either a, c, g or t
  misc_feature (822)..(822): n is either a, c, g or t
tancncganaccgcccacgnacctcgcnctaacgnctanantctctcgcgctcnanacncgctcgacnancnacgcgctaccgcnanacgctcacgcnacgcacgcctancgcacactctcgcgcncanccnccacgcactnccgcncancctcacancctctctctcacacacacacacgctcgcacgcactcactcacactctcgcacgcacacancgccactcacacacacgctaccacctcncctctctcacgcgncnccacgcgcacgnnccgcgctcgcgctctccaccccgccctcgctcacactnnccccaacgccacctctctcgcgcgcacgccgccctcgcgcgcnaccacgcgccacgcactnccacnncctcgcacgcgctccacgcgcacgctctcgcgcacgcancccacgnnccctcgcgnccncacanccactcgcgcgcacacacancncctnccactncctncctcancctcacacacacactcanacacacacacactcttaacgactcgcgcgctcgctcgcgctcgcgctcgcgcgnnccaccctcgctcacactnnccccacgactacnctactcgcgcacgcgncctcgcacgcgnccacccgcacgcacactnccgncctctcgncacancncctcgcgcgnacgcgctcgcgcacgcgctctcgcncacgctcgnacgnccccgcacgcactctcgctcgnccncancctcgncannncctcnccacgncncctcgcgcgcacgcacccacgccacctcgcacgcancctcctcgctnnctnnnatanananananacgcacatatac

SEQ ID NO: 10993 - DNA, 616 bp, Artificial Sequence
  chemically treated genomic DNA (Homo sapiens) CpG-island No: 10993
gtttgcgcggcgtgttattcggtttgttggtattaaaaattattcggtttttgtaatttattattttggcgatggtttgcgttagttcgcggatagtgtagttaacgttcgtgtcgacgttaatgtgcgataatatcggttgggtgttttttagttagattttatgcgttagttttatgatatgaattttcgtcgtcgttatattatcgacgtgtagaaattcgcgtatcgtgtatcgttttcgcgatacgttttaattagtttttttagtgaaacgcgatttaaatcgttgggatttggtagtatttaaatttgcgtcgaattaatggtgagcgtttgttttttttattgtgtatcgcgttggttgaatttttgtttatatgtttgtttgtttagaatcgttaacgtcgttttttagtatttttagttgtttgtcgtagttattattatcgtaagttagatttagttttaggttagtagttttcgttagcggttttgcgtcggtatggatttgtacggtaagtttacgcgtcggtgttataattaaggtacgcggttgatttattttgcgatcggtaatcgtaggatgagagagaagataatgaaacgttgacgt

SEQ ID NO: 10994 - DNA, 616 bp, Artificial Sequence
  chemically treated genomic DNA (Homo sapiens) CpG-island No: 10994
acgtcaacgtttcattatcttctctctcatcctacgattaccgatcgcaaaataaatcaaccgcgtaccttaattataacaccgacgcgtaaacttaccgtacaaatccataccgacgcaaaaccgctaacgaaaactactaacctaaaactaaatctaacttacgataataataactacgacaaacaactaaaaatactaaaaaacgacgttaacgattctaaacaaacaaacatataaacaaaaattcaaccaacgcgatacacaataaaaaaaacaaacgctcaccattaattcgacgcaaatttaaatactaccaaatcccaacgatttaaatcgcgtttcactaaaaaaactaattaaaacgtatcgcgaaaacgatacacgatacgcgaatttctacacgtcgataatataacgacgacgaaaattcatatcataaaactaacgcataaaatctaactaaaaaacacccaaccgatattatcgcacattaacgtcgacacgaacgttaactacactatccgcgaactaacgcaaaccatcgccaaaataataaattacaaaaaccgaataatttttaataccaacaaaccgaataacacgccgcgcaaac

SEQ ID NO: 10995 - DNA, 616 bp, Artificial Sequence
  chemically treated genomic DNA (Homo sapiens) CpG-island No: 10995
acgttaacgttttattatttttttttttattttgcgattgtcgatcgtaaggtgaattagtcgcgtgttttaattatggtatcgacgcgtgaatttgtcgtgtagatttatgtcgacgtagaatcgttggcggaagttattggtttgaagttgggtttggtttacggtggtgatggttacgataaatagttgaaagtgttggaaagcggcgttggcgattttgggtaaataagtatatgaatagggatttagttagcgcggtgtatagtgggggaaataaacgtttattattggttcgacgtagatttgggtgttgttaaattttagcggtttaagtcgcgttttattggagaaattggttgaagcgtatcgcgagagcggtatacgatgcgcgaatttttgtacgtcgatgatatggcggcggcgagagtttatgttatggagttggcgtatgaagtttggttggagaatatttagtcgatgttgtcgtatattaacgtcggtacgggcgttgattgtattattcgcgagttggcgtaaattatcgttaaagtggtgggttataaaggtcgggtggtttttgatgttagtaaatcggatggtacgtcgcgtaaat

SEQ ID NO: 10996 - DNA, 616 bp, Artificial Sequence
  chemically treated genomic DNA (Homo sapiens) CpG-island No: 10996
atttacgcgacgtaccatccgatttactaacatcaaaaaccacccgacctttataacccaccactttaacgataatttacgccaactcgcgaataatacaatcaacgcccgtaccgacgttaatatacgacaacatcgactaaatattctccaaccaaacttcatacgccaactccataacataaactctcgccgccgccatatcatcgacgtacaaaaattcgcgcatcgtataccgctctcgcgatacgcttcaaccaatttctccaataaaacgcgacttaaaccgctaaaatttaacaacacccaaatctacgtcgaaccaataataaacgtttatttcccccactatacaccgcgctaactaaatccctattcatatacttatttacccaaaatcgccaacgccgctttccaacactttcaactatttatcgtaaccatcaccaccgtaaaccaaacccaacttcaaaccaataacttccgccaacgattctacgtcgacataaatctacacgacaaattcacgcgtcgataccataattaaaacacgcgactaattcaccttacgatcgacaatcgcaaaataaaaaaaaaaataataaaacgttaacgt

SEQ ID NO: 10997 - DNA, 769 bp, Artificial Sequence
  chemically treated genomic DNA (Homo sapiens) CpG-island No: 10997
gatttagagacgttttaatattagattcgttggtatcgcgtagtgcgtttgttcggcgatagatttttgtagatgtagatttgtcgcgcgattaaagattattaggtttagtagcgagttgtcgtttagacggttagcgtcgtgtatcgatatataagcgattttattaacggtaaatagtttcggaataattatattttcgttttttttatttatagttagtgtttgatcggtaattttggtcggaatatcgtttattatgtagtgataggttgggataatcggaatcggtttttttatcggatcgacgtgagcgaaggtacgggaaagttttaggatattcggtagacgggattcgagaatttttttatttaggtgatcgagttttagtttcgcgtgtggtttttacggattattatagtcgcgatttttacggatttcgattatgatggaacgcgtaattacgttacggttcgttaggtttttggcgttcggcgtataacgttttataaaacgttcgttatgtttgtttagtagataatcgtttttattacggtaatttcggtgattagtacgtttcgtaagtaatgtcggtcgggtggaattgttatatttttatattttgtatcggtacgtcggtacggatagttatggattttagagattttcgcgagcgatttggttttatgtaggcggttatttgatgttgtacgtttttgtattatataggaaagttgataatagtggtattagaaggaaatgttgtacg

SEQ ID NO: 10998 - DNA, 769 bp, Artificial Sequence
  chemically treated genomic DNA (Homo sapiens) CpG-island No: 10998
cgtacaacatttccttctaataccactattatcaactttcctatataatacaaaaacgtacaacatcaaataaccgcctacataaaaccaaatcgctcgcgaaaatctctaaaatccataactatccgtaccgacgtaccgatacaaaatataaaaatataacaattccacccgaccgacattacttacgaaacgtactaatcaccgaaattaccgtaataaaaacgattatctactaaacaaacataacgaacgttttataaaacgttatacgccgaacgccaaaaacctaacgaaccgtaacgtaattacgcgttccatcataatcgaaatccgtaaaaatcgcgactataataatccgtaaaaaccacacgcgaaactaaaactcgatcacctaaataaaaaaattctcgaatcccgtctaccgaatatcctaaaactttcccgtaccttcgctcacgtcgatccgataaaaaaaccgattccgattatcccaacctatcactacataataaacgatattccgaccaaaattaccgatcaaacactaactataaataaaaaaaacgaaaatataattattccgaaactatttaccgttaataaaatcgcttatatatcgatacacgacgctaaccgtctaaacgacaactcgctactaaacctaataatctttaatcgcgcgacaaatctacatctacaaaaatctatcgccgaacaaacgcactacgcgataccaacgaatctaatattaaaacgtctctaaatc

SEQ ID NO: 10999 - DNA, 769 bp, Artificial Sequence
  chemically treated genomic DNA (Homo sapiens) CpG-island No: 10999
cgtgtaatatttttttttgatgttattgttgttagtttttttgtatagtataggggcgtgtagtattaaatggtcgtttgtataaaattagatcgttcgcggggatttttagagtttatggttattcgtgtcggcgtatcggtgtaggatatggaaatgtggtagttttattcgatcggtattgtttgcggggcgtattggttatcgaagttgtcgtggtgaaggcggttatttgttgaataaatatggcgaacgttttatggagcgttatgcgtcgaacgttaaagatttggcgggtcgtgacgtggttgcgcgttttattatgatcgaaattcgtgaaggtcgcggttgtgatggttcgtgggggttatacgcgaaattgaaattcgattatttgggtaaagaagttttcgaatttcgtttgtcgggtattttggagttttttcgtattttcgtttacgtcgattcggtgaaagagtcgatttcggttattttaatttgttattatatgatgggcggtatttcgattaaagttatcggttaggtattgattgtgaatgagaaaggcgaagatgtggttgtttcgggattgtttgtcgttggtgaaatcgtttgtgtatcggtatacggcgttaatcgtttgggcggtaattcgttgttggatttggtggtttttggtcgcgcggtaggtttgtatttgtaagagtttatcgtcgagtaggcgtattgcgcgatgttagcgagtttgatgttgaagcgtttttggatt

SEQ ID NO: 11000 - DNA, 769 bp, Artificial Sequence
  chemically treated genomic DNA (Homo sapiens) CpG-island No: 11000
aatccaaaaacgcttcaacatcaaactcgctaacatcgcgcaatacgcctactcgacgataaactcttacaaatacaaacctaccgcgcgaccaaaaaccaccaaatccaacaacgaattaccgcccaaacgattaacgccgtataccgatacacaaacgatttcaccaacgacaaacaatcccgaaacaaccacatcttcgcctttctcattcacaatcaatacctaaccgataactttaatcgaaataccgcccatcatataataacaaattaaaataaccgaaatcgactctttcaccgaatcgacgtaaacgaaaatacgaaaaaactccaaaatacccgacaaacgaaattcgaaaacttctttacccaaataatcgaatttcaatttcgcgtataacccccacgaaccatcacaaccgcgaccttcacgaatttcgatcataataaaacgcgcaaccacgtcacgacccgccaaatctttaacgttcgacgcataacgctccataaaacgttcgccatatttattcaacaaataaccgccttcaccacgacaacttcgataaccaatacgccccgcaaacaataccgatcgaataaaactaccacatttccatatcctacaccgatacgccgacacgaataaccataaactctaaaaatccccgcgaacgatctaattttatacaaacgaccatttaatactacacgcccctatactatacaaaaaaactaacaacaataacatcaaaaaaaaatattacacg

SEQ ID NO: 11001 - DNA, 620 bp, Artificial Sequence
  chemically treated genomic DNA (Homo sapiens) CpG-island No: 11001
gattaagtcgagtcgtagtatttgtgagagagagaagtttgagtggcgttcgcggcggtcgcgttagtcgcgttttttattttaatttttattttaacggtcgtaggcgcgcgcggcggacggacgggcgcgcggcggtttttcgttttcgttttcgtttcggttggggcgcgtggtcgtgttcgtcgcgtgcgcgtgttgcgtttaacggtttcgcggggtaggagtaagtcgcggtcgtcgtttgggttttagggcggtttttggggttaggggtttcgcgtttagcgtttttcgttcgttatttttttcgttacgcgttcgcggcgttttttcgggtggttatcgtttcgtattcggatttttttttggtaagtagtttataaaatttttgaggttaattaacgagtggagttttatggtataggtttcgaagtatgtagtcgcgtggcgagtattaaggtattataggatatttttttggtggcgagttacggtatggtttagtatgatttcgttttagtagtgttacgtttcgaggtgatagtatgcgtatgatgtagtttgttaagtcgtgtgtaatataattatgatataaatatgtgtttttttattttttt

SEQ ID NO: 11002 - DNA, 620 bp, Artificial Sequence
  chemically treated genomic DNA (Homo sapiens) CpG-island No: 11002
aaaaaaataaaaaaacacatatttatatcataattatattacacacgacttaacaaactacatcatacgcatactatcacctcgaaacgtaacactactaaaacgaaatcatactaaaccataccgtaactcgccaccaaaaaaatatcctataataccttaatactcgccacgcgactacatacttcgaaacctataccataaaactccactcgttaattaacctcaaaaattttataaactacttaccaaaaaaaaatccgaatacgaaacgataaccacccgaaaaaacgccgcgaacgcgtaacgaaaaaaataacgaacgaaaaacgctaaacgcgaaacccctaaccccaaaaaccgccctaaaacccaaacgacgaccgcgacttactcctaccccgcgaaaccgttaaacgcaacacgcgcacgcgacgaacacgaccacgcgccccaaccgaaacgaaaacgaaaacgaaaaaccgccgcgcgcccgtccgtccgccgcgcgcgcctacgaccgttaaaataaaaattaaaataaaaaacgcgactaacgcgaccgccgcgaacgccactcaaacttctctctctcacaaatactacgactcgacttaatc

SEQ ID NO: 11003 - DNA, 620 bp, Artificial Sequence
  chemically treated genomic DNA (Homo sapiens) CpG-island No: 11003
ggggagataagaggatatatgtttgtgttatgattgtgttatatacgatttagtagattgtattatgcgtatgttgttatttcgaggcgtggtattattgaggcgaagttatgttgagttatatcgtaattcgttattaaaagagtattttatgatgttttgatgttcgttacgcgattatatgtttcgggatttgtgttatgaggttttattcgttgattggttttagggattttgtggattatttattagaaagggattcggatgcgaggcgataattattcgaaaaggcgtcgcgggcgcgtggcggagagggtggcgggcgggaaacgttgggcgcgggatttttggttttagagatcgttttggggtttaggcggcggtcgcggtttatttttgtttcgcgaggtcgttggacgtagtacgcgtacgcggcggatacggttacgcgttttagtcgggacgggagcgggagcgaggagtcgtcgcgcgttcgttcgttcgtcgcgcgcgtttgcggtcgttggggtgggggttggggtgggggacgcgattggcgcggtcgtcgcgagcgttatttagattttttttttttataagtgttgcggttcggtttagtt

SEQ ID NO: 11004 - DNA, 620 bp, Artificial Sequence
  chemically treated genomic DNA (Homo sapiens) CpG-island No: 11004
aactaaaccgaaccgcaacacttataaaaaaaaaaaatctaaataacgctcgcgacgaccgcgccaatcgcgtcccccaccccaacccccaccccaacgaccgcaaacgcgcgcgacgaacgaacgaacgcgcgacgactcctcgctcccgctcccgtcccgactaaaacgcgtaaccgtatccgccgcgtacgcgtactacgtccaacgacctcgcgaaacaaaaataaaccgcgaccgccgcctaaaccccaaaacgatctctaaaaccaaaaatcccgcgcccaacgtttcccgcccgccaccctctccgccacgcgcccgcgacgccttttcgaataattatcgcctcgcatccgaatccctttctaataaataatccacaaaatccctaaaaccaatcaacgaataaaacctcataacacaaatcccgaaacatataatcgcgtaacgaacatcaaaacatcataaaatactcttttaataacgaattacgatataactcaacataacttcgcctcaataataccacgcctcgaaataacaacatacgcataatacaatctactaaatcgtatataacacaatcataacacaaacatatatcctcttatctcccc

SEQ ID NO: 11005 - DNA, 813 bp, Artificial Sequence
  chemically treated genomic DNA (Homo sapiens) CpG-island No: 11005
  misc_feature (280)..(280): n is either a, c, g or t
  misc_feature (391)..(391): n is either a, c, g or t
  misc_feature (394)..(394): n is either a, c, g or t
gtatcgtcgagtggtatcggatgtcggtaatttgttggcgtaataggcgattgtcgatgtgttttgtgttaacggcgatagcgaatggcgcggtttaggcgtgattgaattttttggcgtgtatttgacgtcggattattaacgattcgatgtcgaagtatattttcgttcggtatcgtagtaggtttgcgatgattcgcgcgcgcgttgtggtgaggtattaacgggtaaatgtaagtcgtattaatgttcgttgtttggtaatatttgtaatttttanatcgcgtttggtgcgttgatggtttttttcgaaagagcgtgcgtcgcgtggtattagtatcgttagtaggagagtgaagcgtgaattatatttaattcgtttatcgtagtngtngttacgcgatgtagtaattaattatttgagaattttaacggttcgagatttcgttattgtgttttaaagggttatatcgttattatttacgtttattcggtgaaggtaaatgggcgttacgtgatggattcgtcgtcgatttcgaaattcgataatttaaaaatggatatgatgttcgttttgtaattgttcggcgcggggcgcgagaagcgtatttatgcggtgtcgtcgtttattcgcgtggaaagtttcgatttcgacgattattcgtttatcgtttagtagtgggatgagttatgcgttatttgcggatcgatttatagttattttgatgaagtggtgttggatgacgtcggaaatcgtatgtttgtttgtttcgatatcgattattgtcgttaatagagcgaggtaaaaaatta

SEQ ID NO: 11006 - DNA, 813 bp, Artificial Sequence
  chemically treated genomic DNA (Homo sapiens) CpG-island No: 11006
  misc_feature (420)..(420): n is either a, c, g or t
  misc_feature (423)..(423): n is either a, c, g or t
  misc_feature (534)..(534): n is either a, c, g or t
taattttttacctcgctctattaacgacaataatcgatatcgaaacaaacaaacatacgatttccgacgtcatccaacaccacttcatcaaaataactataaatcgatccgcaaataacgcataactcatcccactactaaacgataaacgaataatcgtcgaaatcgaaactttccacgcgaataaacgacgacaccgcataaatacgcttctcgcgccccgcgccgaacaattacaaaacgaacatcatatccatttttaaattatcgaatttcgaaatcgacgacgaatccatcacgtaacgcccatttaccttcaccgaataaacgtaaataataacgatataaccctttaaaacacaataacgaaatctcgaaccgttaaaattctcaaataattaattactacatcgcgtaacnacnactacgataaacgaattaaatataattcacgcttcactctcctactaacgatactaataccacgcgacgcacgctctttcgaaaaaaaccatcaacgcaccaaacgcgatntaaaaattacaaatattaccaaacaacgaacattaatacgacttacatttacccgttaatacctcaccacaacgcgcgcgcgaatcatcgcaaacctactacgataccgaacgaaaatatacttcgacatcgaatcgttaataatccgacgtcaaatacacgccaaaaaattcaatcacgcctaaaccgcgccattcgctatcgccgttaacacaaaacacatcgacaatcgcctattacgccaacaaattaccgacatccgataccactcgacgatac

SEQ ID NO: 11007 - DNA, 813 bp, Artificial Sequence
  chemically treated genomic DNA (Homo sapiens) CpG-island No: 11007
  misc_feature (420)..(420): n is either a, c, g or t
  misc_feature (423)..(423): n is either a, c, g or t
  misc_feature (534)..(534): n is either a, c, g or t
tggttttttgtttcgttttgttggcggtaataatcggtatcggagtagataaatatgcggttttcggcgttatttagtattattttattaagatagttgtgggtcgattcgtagatggcgtatggtttattttattgttgaacggtgaacgggtgatcgtcgaaatcgagattttttacgcgggtaaacggcggtatcgtatagatgcgtttttcgcgtttcgcgtcgaatagttgtagggcgggtattatgtttatttttgggttatcgaatttcgggatcggcgacgggtttattacgtagcgtttatttatttttatcggataggcgtaggtggtggcgatatgattttttagagtatagtggcgagatttcgaatcgttggggtttttaaatggttgattgttgtatcgcgtggtngtngttacggtgggcgagttggatataatttacgttttatttttttgttgacgatattgatattacgcggcgtacgttttttcggaggaaattattagcgtattaaacgcggtntgaggattataggtgttattaaatagcgggtattgatgcggtttatatttgttcgttaatattttattataacgcgcgcgcgggttatcgtagatttgttgcggtgtcgggcggaaatgtgtttcggtatcgaatcgttgataattcggcgttaggtgtacgttagaagatttaattacgtttaagtcgcgttattcgttgtcgtcgttgatatagaatatatcggtaatcgtttgttgcgttagtaggttatcggtattcggtattattcgacgatat

SEQ ID NO: 11008 - DNA, 813 bp, Artificial Sequence
  chemically treated genomic DNA (Homo sapiens) CpG-island No: 11008
  misc_feature (280)..(280): n is either a, c, g or t
  misc_feature (391)..(391): n is either a, c, g or t
  misc_feature (394)..(394): n is either a, c, g or t
atatcgtcgaataataccgaataccgataacctactaacgcaacaaacgattaccgatatattctatatcaacgacgacaacgaataacgcgacttaaacgtaattaaatcttctaacgtacacctaacgccgaattatcaacgattcgataccgaaacacatttccgcccgacaccgcaacaaatctacgataacccgcgcgcgcgttataataaaatattaacgaacaaatataaaccgcatcaatacccgctatttaataacacctataatcctcanaccgcgtttaatacgctaataatttcctccgaaaaaacgtacgccgcgtaatatcaatatcgtcaacaaaaaaataaaacgtaaattatatccaactcgcccaccgtaacnacnaccacgcgatacaacaatcaaccatttaaaaaccccaacgattcgaaatctcgccactatactctaaaaaatcatatcgccaccacctacgcctatccgataaaaataaataaacgctacgtaataaacccgtcgccgatcccgaaattcgataacccaaaaataaacataatacccgccctacaactattcgacgcgaaacgcgaaaaacgcatctatacgataccgccgtttacccgcgtaaaaaatctcgatttcgacgatcacccgttcaccgttcaacaataaaataaaccatacgccatctacgaatcgacccacaactatcttaataaaataatactaaataacgccgaaaaccgcatatttatctactccgataccgattattaccgccaacaaaacgaaacaaaaaacca

SEQ ID NO: 11009 - DNA, 1622 bp, Artificial Sequence
  chemically treated genomic DNA (Homo sapiens) CpG-island No: 11009
  misc_feature (921)..(921): n is either a, c, g or t
gtgttgggtattgtcggggaattcggtttcgggaagattacgttgttgaagtcgattttcgcgcgtttgacgtcgtagtagggggaaatttattacgagaatcgttcgttgtatgtaatgagcgaggtcgatcggcgtcgtttgttgcgtatcgaaagggggggggggggataagtatttttttaaagggtcgcgtcgataggatatttgttttaagattacgtcgttgtacggttggcggcgatattgcggcgagcgtcgcgttttggcgtaggtcgtatattcgtagttttatgtcggaacgttttgtgcgtcgtcggtgtcggtgagcgtgagggttaggtttatgttatagcgttttggtgaagcggaagtggttttgttcgtagttttcgcgtagatagaaacggtgcgcgtcgtggcgttttacgttggtcgaaagttcggttatttcggtttcggtttggcgggtttttttttttgtttacgttagtaatttattgtcgacgtttagatcgcgcgtttgcggtattattattaatttttgaatttcgtcgatttagttgatatgatgtagatgaaattgtaaatgtaggtcgattatgtcgataatttcgttattaagtagcgttagatggtagcgtatgtttgggtcgcgtagattggcgttaaaatttacgcgaaacgcgtggtggttaaatttcgtttgttttagtttataaattagcgcgtaaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtatagcgggcggcgcgcgttaggcgggcgttaattttattggtngttttaacgttacgggtatttaggcgtttgcgggaggatttttgcggaatttgtaaatagacggttaattattcgtaatggcgggatttcgttcgcggttttcgttagcgattcgtgcgacgggcgttcgtagggtacgtacggtatgttcgattttttgtcgtatcgtaacgacgcggcgatcgtgtttcgtcgtttgattcgttttttgtcgacgcggcgggcggtgatcggcgtagcgatttgcgataaagggttgttcgttattatgattgcgttggtcgcgatgtacgatttgtcgattattttggtgtcgggcggggcgacgttgtcgtcgatcgtcggggaagacgcgggtaaggtgtagattatcggcgcgcgtttcgttaattacgaattttttttgtaggaggtcgtcgaattgggttgtcgcgtttgcgtttcgtcgggcggcgggtgttagtttttcggtacggcgggtatttcgtaggtggtcgcggaggcgttgggtttggcgttgtcgtatttcgcgttggcgtcgttcgggtaggcggtgtggttggagatcgttcgttagtcggcgcgcgcggttagcgagttggatagtcgcggtatattttttcggaaaatttttttttataagttttttaaatttttttgtgtattttttcggcgttggggggtttattaaaattttgggt

SEQ ID NO: 11010 - DNA, 1622 bp, Artificial Sequence
  chemically treated genomic DNA (Homo sapiens) CpG-island No: 11010
  misc_feature (702)..(702): n is either a, c, g or t
acccaaaattttaataaaccccccaacgccgaaaaaatacacaaaaaaatttaaaaaacttataaaaaaaaattttccgaaaaaatataccgcgactatccaactcgctaaccgcgcgcgccgactaacgaacgatctccaaccacaccgcctacccgaacgacgccaacgcgaaatacgacaacgccaaacccaacgcctccgcgaccacctacgaaatacccgccgtaccgaaaaactaacacccgccgcccgacgaaacgcaaacgcgacaacccaattcgacgacctcctacaaaaaaaattcgtaattaacgaaacgcgcgccgataatctacaccttacccgcgtcttccccgacgatcgacgacaacgtcgccccgcccgacaccaaaataatcgacaaatcgtacatcgcgaccaacgcaatcataataacgaacaaccctttatcgcaaatcgctacgccgatcaccgcccgccgcgtcgacaaaaaacgaatcaaacgacgaaacacgatcgccgcgtcgttacgatacgacaaaaaatcgaacataccgtacgtaccctacgaacgcccgtcgcacgaatcgctaacgaaaaccgcgaacgaaatcccgccattacgaataattaaccgtctatttacaaattccgcaaaaatcctcccgcaaacgcctaaatacccgtaacgttaaaacnaccaataaaattaacgcccgcctaacgcgcgccgcccgctatactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgatttacgcgctaatttataaactaaaacaaacgaaatttaaccaccacgcgtttcgcgtaaattttaacgccaatctacgcgacccaaacatacgctaccatctaacgctacttaataacgaaattatcgacataatcgacctacatttacaatttcatctacatcatatcaactaaatcgacgaaattcaaaaattaataataataccgcaaacgcgcgatctaaacgtcgacaataaattactaacgtaaacaaaaaaaaaaacccgccaaaccgaaaccgaaataaccgaactttcgaccaacgtaaaacgccacgacgcgcaccgtttctatctacgcgaaaactacgaacaaaaccacttccgcttcaccaaaacgctataacataaacctaaccctcacgctcaccgacaccgacgacgcacaaaacgttccgacataaaactacgaatatacgacctacgccaaaacgcgacgctcgccgcaatatcgccgccaaccgtacaacgacgtaatcttaaaacaaatatcctatcgacgcgaccctttaaaaaaatacttatccccccccccccctttcgatacgcaacaaacgacgccgatcgacctcgctcattacatacaacgaacgattctcgtaataaatttccccctactacgacgtcaaacgcgcgaaaatcgacttcaacaacgtaatcttcccgaaaccgaattccccgacaatacccaacac

SEQ ID NO: 11011 - DNA, 1622 bp, Artificial Sequence
  chemically treated genomic DNA (Homo sapiens) CpG-island No: 11011
  misc_feature (702)..(702): n is either a, c, g or t
atttaaaattttggtgagttttttaacgtcggggggatatataagggggtttgagaggtttatggagaagaatttttcgggggggtatgtcgcggttatttagttcgttgatcgcgcgcgtcgattggcgggcgatttttagttatatcgtttgttcggacggcgttagcgcggagtgcggtagcgttagatttagcgttttcgcgattatttgcgaggtgttcgtcgtgtcgaggaattgatattcgtcgttcggcgaggcgtaggcgcgatagtttagttcggcggttttttgtagggagagttcgtggttggcgaaacgcgcgtcgatggtttgtattttgttcgcgtttttttcgacggtcggcggtagcgtcgtttcgttcggtattagaatagtcggtaggtcgtgtatcgcggttagcgtaattatggtggcgggtagttttttatcgtaggtcgttacgtcgattatcgttcgtcgcgtcggtagggagcggattaggcggcgaaatacgatcgtcgcgtcgttgcggtacggtagggaatcgaatatatcgtgcgtgttttgcgagcgttcgtcgtacggatcgttgacgaaggtcgcgaacgggatttcgttattgcgggtgattggtcgtttgtttataggtttcgtagagattttttcgtaggcgtttggatattcgtggcgttgaaatngttagtgaaattaacgttcgtttggcgcgcgtcgttcgttatattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggtttacgcgttgatttgtgagttaaaataggcggagtttgattattacgcgtttcgcgtgggttttaacgttaatttgcgcgatttaaatatgcgttattatttggcgttgtttgatggcgaagttgtcggtatgatcggtttgtatttgtagttttatttgtattatgttaattggatcggcgaaatttaggagttggtggtaatgtcgtaggcgcgcggtttgaacgtcggtagtaagttattggcgtgggtagaagaagaagttcgttaggtcggggtcgaaatgatcgaattttcgattaacgtgaagcgttacgacgcgtatcgtttttatttgcgcgaaggttacgagtagagttattttcgttttattaaggcgttgtaatatgagtttgatttttacgtttatcggtatcggcggcgtatagggcgtttcggtatggggttgcgagtgtgcggtttgcgttagagcgcggcgttcgtcgtagtatcgtcgttaatcgtgtagcggcgtagttttagagtagatgttttgtcggcgcggttttttaaggggatgtttatttttttttttttttttcggtacgtagtaggcgacgtcggtcggtttcgtttattgtatatagcgaacggttttcgtagtgaatttttttttgttgcggcgttaggcgcgcggagatcgattttagtagcgtggttttttcggagtcggatttttcgataatgtttagtat

SEQ ID NO: 11012 - DNA, 1622 bp, Artificial Sequence
  chemically treated genomic DNA (Homo sapiens) CpG-island No: 11012
  misc_feature (921)..(921): n is either a, c, g or t
atactaaacattatcgaaaaatccgactccgaaaaaaccacgctactaaaatcgatctccgcgcgcctaacgccgcaacaaaaaaaaattcactacgaaaaccgttcgctatatacaataaacgaaaccgaccgacgtcgcctactacgtaccgaaaaaaaaaaaaaaaaataaacatccccttaaaaaaccgcgccgacaaaacatctactctaaaactacgccgctacacgattaacgacgatactacgacgaacgccgcgctctaacgcaaaccgcacactcgcaaccccataccgaaacgccctatacgccgccgataccgataaacgtaaaaatcaaactcatattacaacgccttaataaaacgaaaataactctactcgtaaccttcgcgcaaataaaaacgatacgcgtcgtaacgcttcacgttaatcgaaaattcgatcatttcgaccccgacctaacgaacttcttcttctacccacgccaataacttactaccgacgttcaaaccgcgcgcctacgacattaccaccaactcctaaatttcgccgatccaattaacataatacaaataaaactacaaatacaaaccgatcataccgacaacttcgccatcaaacaacgccaaataataacgcatatttaaatcgcgcaaattaacgttaaaacccacgcgaaacgcgtaataatcaaactccgcctattttaactcacaaatcaacgcgtaaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatataacgaacgacgcgcgccaaacgaacgttaatttcactaacnatttcaacgccacgaatatccaaacgcctacgaaaaaatctctacgaaacctataaacaaacgaccaatcacccgcaataacgaaatcccgttcgcgaccttcgtcaacgatccgtacgacgaacgctcgcaaaacacgcacgatatattcgattccctaccgtaccgcaacgacgcgacgatcgtatttcgccgcctaatccgctccctaccgacgcgacgaacgataatcgacgtaacgacctacgataaaaaactacccgccaccataattacgctaaccgcgatacacgacctaccgactattctaataccgaacgaaacgacgctaccgccgaccgtcgaaaaaaacgcgaacaaaatacaaaccatcgacgcgcgtttcgccaaccacgaactctccctacaaaaaaccgccgaactaaactatcgcgcctacgcctcgccgaacgacgaatatcaattcctcgacacgacgaacacctcgcaaataatcgcgaaaacgctaaatctaacgctaccgcactccgcgctaacgccgtccgaacaaacgatataactaaaaatcgcccgccaatcgacgcgcgcgatcaacgaactaaataaccgcgacatacccccccgaaaaattcttctccataaacctctcaaacccccttatatatccccccgacgttaaaaaactcaccaaaattttaaat

SEQ ID NO: 11013 - DNA, 1084 bp, Artificial Sequence
  chemically treated genomic DNA (Homo sapiens) CpG-island No: 11013
gcgttttaagtggagggcgcggtgacgaggaagttgcggtcgtttttttacggcgagtcgataatttttacgtcggtgtagagtagttagaatttatcgtcggcgtagtttaggtacggcgtttagatgtcgtcggagttcgggttgttttttatgtttagtatcgatacgcggtttaacggggtgttgattagcgattagttttttaggttacgggagtggtagatgcgtacgttcgggaattattcgaaggtcgaggtggcgatgtagtagttttcgttttggcggtatagggacgggttcgggttgaagtcggtgagtatcgggttagtgatttttatattgttttcggttaatgggatgcggttgtcgcggcgtcgggaacggtttcgttttgcgtcgcgcggtgtttaattagttgtcggttgatggtttttacgcgggtatcggtgagtttgtagagcgatagtatgatgaatatgttcgcgtagagtattatcggtattacgtagaatagaattttgatggtggtgagtattttaatcggcgttacgttgttgttggcggaatagttgacgtacgtttagatttagtttattttcgtttcgttaatcgttaggttaatttttagttgaatagttagtggtagaatatcgttcgtcgtagcggcgatcgttgtagtttttttcgtagtttaatacgttagaagttattagatattgtagcggcgtggtggtattaaagacgaataggaataggatgttgaaggtaaaagtgagcgtttagtttgtggtttatcgttttgtgttttaaagatcgatacgttgggcgttggtatcggtaaaagttttacgtttatgattaaatagatcgttttttagtaattcggtaggtatcgtcgcgtagtttattttgattatgcggcgattattacgtttattgagattatggatcgtacgggtaattagttttttattcgtgttagttttatcgaggattagtacggtattgttattttgcgttattattttaatttgtttaagtacgttgtatatggtttcgttgcggttaataatttcgttaa

SEQ ID NO: 11014 - DNA, 1084 bp, Artificial Sequence
  chemically treated genomic DNA (Homo sapiens) CpG-island No: 11014
ttaacgaaattattaaccgcaacgaaaccatatacaacgtacttaaacaaattaaaataataacgcaaaataacaataccgtactaatcctcgataaaactaacacgaataaaaaactaattacccgtacgatccataatctcaataaacgtaataatcgccgcataatcaaaataaactacgcgacgatacctaccgaattactaaaaaacgatctatttaatcataaacgtaaaacttttaccgataccaacgcccaacgtatcgatctttaaaacacaaaacgataaaccacaaactaaacgctcacttttaccttcaacatcctattcctattcgtctttaataccaccacgccgctacaatatctaataacttctaacgtattaaactacgaaaaaaactacaacgatcgccgctacgacgaacgatattctaccactaactattcaactaaaaattaacctaacgattaacgaaacgaaaataaactaaatctaaacgtacgtcaactattccgccaacaacaacgtaacgccgattaaaatactcaccaccatcaaaattctattctacgtaataccgataatactctacgcgaacatattcatcatactatcgctctacaaactcaccgatacccgcgtaaaaaccatcaaccgacaactaattaaacaccgcgcgacgcaaaacgaaaccgttcccgacgccgcgacaaccgcatcccattaaccgaaaacaatataaaaatcactaacccgatactcaccgacttcaacccgaacccgtccctataccgccaaaacgaaaactactacatcgccacctcgaccttcgaataattcccgaacgtacgcatctaccactcccgtaacctaaaaaactaatcgctaatcaacaccccgttaaaccgcgtatcgatactaaacataaaaaacaacccgaactccgacgacatctaaacgccgtacctaaactacgccgacgataaattctaactactctacaccgacgtaaaaattatcgactcgccgtaaaaaaacgaccgcaacttcctcgtcaccgcgccctccacttaaaacgc

SEQ ID NO: 11015 - DNA, 1084 bp, Artificial Sequence
  chemically treated genomic DNA (Homo sapiens) CpG-island No: 11015
ttggcgagattattggtcgtagcgaagttatgtatagcgtgtttaaataagttgaaatggtggcgtaaagtgatagtatcgtgttgattttcggtgaaattggtacgggtaaagagttgattgttcgtgcgatttataattttagtgggcgtaataatcgtcgtatggttaaaatgaattgcgcggcgatgtttgtcggattgttggaaagcgatttgtttggttatgagcgtggggtttttatcggtgttagcgtttagcgtatcggtttttagagtatagggcgatagattatagattaagcgtttatttttgtttttaatattttgtttttgttcgtttttaatattattacgtcgttgtagtgtttgatggtttttgacgtgttggattacgagaagagttgtagcggtcgtcgttacgacgggcggtgttttattattaattgtttagttgaagattggtttggcgattggcgggacggaggtgggttggatttgggcgtacgttaattatttcgttagtagtagcgtgacgtcggttgaggtgtttattattattaaaattttgttttgcgtggtgtcggtggtgttttacgcgggtatgtttattatgttgtcgttttataagtttatcgatgttcgcgtggaggttattagtcggtagttgattaagtatcgcgcggcgtagggcgaggtcgttttcgacgtcgcgatagtcgtattttattaatcggaggtaatatggaaattattaattcgatatttatcggttttaattcggattcgtttttgtgtcgttagggcgaggattattatatcgttatttcgattttcgagtggttttcgggcgtgcgtatttattattttcgtgatttgaaaaattggtcgttggttagtatttcgttggatcgcgtgtcgatgttggatatgaagggtaattcggatttcggcggtatttgggcgtcgtgtttgagttacgtcgacggtaaattttggttgttttatatcgacgtgaagattgtcgattcgtcgtggaaaaacggtcgtaattttttcgttatcgcgttttttatttagagcgt

SEQ ID NO: 11016 - DNA, 1084 bp, Artificial Sequence
  chemically treated genomic DNA (Homo sapiens) CpG-island No: 11016
acgctctaaataaaaaacgcgataacgaaaaaattacgaccgtttttccacgacgaatcgacaatcttcacgtcgatataaaacaaccaaaatttaccgtcgacgtaactcaaacacgacgcccaaataccgccgaaatccgaattacccttcatatccaacatcgacacgcgatccaacgaaatactaaccaacgaccaatttttcaaatcacgaaaataataaatacgcacgcccgaaaaccactcgaaaatcgaaataacgatataataatcctcgccctaacgacacaaaaacgaatccgaattaaaaccgataaatatcgaattaataatttccatattacctccgattaataaaatacgactatcgcgacgtcgaaaacgacctcgccctacgccgcgcgatacttaatcaactaccgactaataacctccacgcgaacatcgataaacttataaaacgacaacataataaacatacccgcgtaaaacaccaccgacaccacgcaaaacaaaattttaataataataaacacctcaaccgacgtcacgctactactaacgaaataattaacgtacgcccaaatccaacccacctccgtcccgccaatcgccaaaccaatcttcaactaaacaattaataataaaacaccgcccgtcgtaacgacgaccgctacaactcttctcgtaatccaacacgtcaaaaaccatcaaacactacaacgacgtaataatattaaaaacgaacaaaaacaaaatattaaaaacaaaaataaacgcttaatctataatctatcgccctatactctaaaaaccgatacgctaaacgctaacaccgataaaaaccccacgctcataaccaaacaaatcgctttccaacaatccgacaaacatcgccgcgcaattcattttaaccatacgacgattattacgcccactaaaattataaatcgcacgaacaatcaactctttacccgtaccaatttcaccgaaaatcaacacgatactatcactttacgccaccatttcaacttatttaaacacgctatacataacttcgctacgaccaataatctcgccaa

SEQ ID NO: 11017 - DNA, 529 bp, Artificial Sequence
  chemically treated genomic DNA (Homo sapiens) CpG-island No: 11017
tagttagcgtgtaatttgtttttcgttttgttttaattgtgtaaggtaattatcggtaatttgacgatcgtaacgataattcgttaggcgacgtgtttcgcgatttatttttacgcgtagcggttgtattatattattatgtaggattttcgtcggttgtttatttagtttattcggtttacgggcgtgaattttttgttttagtaggtcgagcgttattgtaaagtcgtatagcgtggcggtaggcgttggcgggtagttagggatataaatatttatagggataattttattcgtatcgttttatacgtagtagagatcgtggaagatttcgttattgttatcgtaggtatcgtaggagatataaattttcgggttcggcgcggattgttacgtacgtagcgtaggggatcgtattgtacgggtgatcgcgtcgggaaattttatgtatagtagattatatcgtattgaggtattattcgttattgttttaaagaatatcggacggtttttgttacgtatggtttga

SEQ ID NO: 11018 - DNA, 529 bp, Artificial Sequence
  chemically treated genomic DNA (Homo sapiens) CpG-island No: 11018
tcaaaccatacgtaacaaaaaccgtccgatattctttaaaacaataacgaataatacctcaatacgatataatctactatacataaaatttcccgacgcgatcacccgtacaatacgatcccctacgctacgtacgtaacaatccgcgccgaacccgaaaatttatatctcctacgatacctacgataacaataacgaaatcttccacgatctctactacgtataaaacgatacgaataaaattatccctataaatatttatatccctaactacccgccaacgcctaccgccacgctatacgactttacaataacgctcgacctactaaaacaaaaaattcacgcccgtaaaccgaataaactaaataaacaaccgacgaaaatcctacataataatataatacaaccgctacgcgtaaaaataaatcgcgaaacacgtcgcctaacgaattatcgttacgatcgtcaaattaccgataattaccttacacaattaaaacaaaacgaaaaacaaattacacgctaacta

SEQ ID NO: 11019 - DNA, 529 bp, Artificial Sequence
  chemically treated genomic DNA (Homo sapiens) CpG-island No: 11019
ttagattatgcgtagtaaaggtcgttcggtgttttttagagtagtggcggatgatattttaatgcggtatagtttattgtgtataaagtttttcggcgcggttattcgtgtaatgcgattttttgcgttgcgtgcgtggtagttcgcgtcggattcgaaaatttgtattttttacggtgtttgcggtaatagtggcgggattttttacgatttttattgcgtgtggggcggtacggataaaattgtttttgtggatgtttatatttttggttgttcgttaacgtttgtcgttacgttgtacggttttgtaatggcgttcggtttgttggagtagaaaatttacgttcgtgggtcgggtgaattggatgaataatcggcggagattttgtatggtgatatggtgtagtcgttgcgcgtgaaagtggatcgcgaagtacgtcgtttggcgggttatcgttacggtcgttagattgtcgatgattattttatatagttagggtagggcgaagaataggttgtacgttggttg

SEQ ID NO: 11020 - DNA, 529 bp, Artificial Sequence
  chemically treated genomic DNA (Homo sapiens) CpG-island No: 11020
caaccaacgtacaacctattcttcgccctaccctaactatataaaataatcatcgacaatctaacgaccgtaacgataacccgccaaacgacgtacttcgcgatccactttcacgcgcaacgactacaccatatcaccatacaaaatctccgccgattattcatccaattcacccgacccacgaacgtaaattttctactccaacaaaccgaacgccattacaaaaccgtacaacgtaacgacaaacgttaacgaacaaccaaaaatataaacatccacaaaaacaattttatccgtaccgccccacacgcaataaaaatcgtaaaaaatcccgccactattaccgcaaacaccgtaaaaaatacaaattttcgaatccgacgcgaactaccacgcacgcaacgcaaaaaatcgcattacacgaataaccgcgccgaaaaactttatacacaataaactataccgcattaaaatatcatccgccactactctaaaaaacaccgaacgacctttactacgcataatctaa

SEQ ID NO: 11021 - DNA, 632 bp, Artificial Sequence
  chemically treated genomic DNA (Homo sapiens) CpG-island No: 11021
tattggatcgatatcggtggttaggcgattcggattatttattcggtattcggttattgcgtcgcgtagtatttttaacgtgtggtcggtaattttattttgtaggtatagtacgcgtagcgtcgaataacgttgattcgtattgtcgaacgtcgaggttagtatatttacgacgatttgttcggttagtgttgaagaatcgataattatcgcgtttatgtcgtcggttttagcgatgagcggaatagggcgattttgagcgtttaggcggttggcgatattgcgttgtagtaacgtagcgatttcggttgaatcggtaaatattatttcgcgtacgcgattattattcgttagttgcgcgtttacggttttatttcgatttggtagtaattgtattacgtttggcggtatattcgtttttagtaaaatggcgattttttgcgcggtaattagcggcgtttgttttgtcggttttgttagtacgttgttatttgtcgttagtgcggcggcgatttgttcggtgaaaatagttagcgggaagtttacggattgatatatattataggttttaatggacggtgggtttttttagcgaaattatttcgtatttgttcgtcgattaatggagaaaa

SEQ ID NO: 11022 - DNA, 632 bp, Artificial Sequence
  chemically treated genomic DNA (Homo sapiens) CpG-island No: 11022
ttttctccattaatcgacgaacaaatacgaaataatttcgctaaaaaaacccaccgtccattaaaacctataatatatatcaatccgtaaacttcccgctaactattttcaccgaacaaatcgccgccgcactaacgacaaataacaacgtactaacaaaaccgacaaaacaaacgccgctaattaccgcgcaaaaaatcgccattttactaaaaacgaatataccgccaaacgtaatacaattactaccaaatcgaaataaaaccgtaaacgcgcaactaacgaataataatcgcgtacgcgaaataatatttaccgattcaaccgaaatcgctacgttactacaacgcaatatcgccaaccgcctaaacgctcaaaatcgccctattccgctcatcgctaaaaccgacgacataaacgcgataattatcgattcttcaacactaaccgaacaaatcgtcgtaaatatactaacctcgacgttcgacaatacgaatcaacgttattcgacgctacgcgtactatacctacaaaataaaattaccgaccacacgttaaaaatactacgcgacgcaataaccgaataccgaataaataatccgaatcgcctaaccaccgatatcgatccaata

SEQ ID NO: 11023 - DNA, 632 bp, Artificial Sequence
  chemically treated genomic DNA (Homo sapiens) CpG-island No: 11023
ttttttttattaatcggcggataggtgcggaatgatttcgttaaagaaatttatcgtttattagggtttgtggtgtgtattagttcgtgaatttttcgttggttatttttatcgggtagatcgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgttaggtcggggtgaaatcgtgggcgcgtaattgacgggtgatgatcgcgtgcgcggggtgatgtttatcggtttaatcgaagtcgttacgttattgtagcgtaatatcgttagtcgtttggacgtttagggtcgttttatttcgtttatcgttgaaatcggcggtatgaacgcgatgattgtcgattttttagtattgatcgaataggtcgtcgtggatgtattggtttcggcgttcgatagtgcgggttagcgttgttcggcgttgcgcgtgttgtgtttgtaagatgagattgtcgattatacgttgaaaatgttgcgcggcgtaatggtcgaatgtcggatgggtaattcgggtcgtttgattatcgatatcggtttagtg

SEQ ID NO: 11024 - DNA, 632 bp, Artificial Sequence
  chemically treated genomic DNA (Homo sapiens) CpG-island No: 11024
cactaaaccgatatcgataatcaaacgacccgaattacccatccgacattcgaccattacgccgcgcaacattttcaacgtataatcgacaatctcatcttacaaacacaacacgcgcaacgccgaacaacgctaacccgcactatcgaacgccgaaaccaatacatccacgacgacctattcgatcaatactaaaaaatcgacaatcatcgcgttcataccgccgatttcaacgataaacgaaataaaacgaccctaaacgtccaaacgactaacgatattacgctacaataacgtaacgacttcgattaaaccgataaacatcaccccgcgcacgcgatcatcacccgtcaattacgcgcccacgatttcaccccgacctaacaacaattacaccacgcctaacgatacacccgcttccaacaaaataacgatcccttacgcgacaatcaacgacgtttattctaccgattttaccaacacgctattacctaccgccaatacgacgacgatctacccgataaaaataaccaacgaaaaattcacgaactaatacacaccacaaaccctaataaacgataaatttctttaacgaaatcattccgcacctatccgccgattaataaaaaaaa

SEQ ID NO: 11025 - DNA, 582 bp, Artificial Sequence
  chemically treated genomic DNA (Homo sapiens) CpG-island No: 11025
agtcgttgatgtttgaattcgtttatgcgcgggtttttttttgcgcgttggttggttagttgggtattattcggttgatagatatcgtttttggtattacgtttgatgtcggataaatagtcgaatcgttggcgttgtttggtgaggatgatgatatggattttcgtttattacgtagttattaggtggtaaatggtatcgcggttttgtcggttttcggtacgttggttagtaaaattcgtgcgttttagttttatttcgggatgacgggttataacgggattattgttcgtttgtagtagggtaattagtgatttcggcgttgacggtatttttttggatatggatacgtcgggtggaatggtgttcggggcgtttgattgcgtcgatattattgttcggtatgcgcgatattaaatttatttgggcgttggttaatgatatgaattggagggaaggtaaattttttgttagttcggtatcgcgacggttgggtaaataatcgggtaagaacgggttattgggggtatgatggtttaaagaattatggcgttcggttaaaattatatagaatgattttaa

SEQ ID NO: 11026 - DNA, 582 bp, Artificial Sequence
  chemically treated genomic DNA (Homo sapiens) CpG-island No: 11026
ttaaaatcattctatataattttaaccgaacgccataattctttaaaccatcatacccccaataacccgttcttacccgattatttacccaaccgtcgcgataccgaactaacaaaaaatttaccttccctccaattcatatcattaaccaacgcccaaataaatttaatatcgcgcataccgaacaataatatcgacgcaatcaaacgccccgaacaccattccacccgacgtatccatatccaaaaaaataccgtcaacgccgaaatcactaattaccctactacaaacgaacaataatcccgttataacccgtcatcccgaaataaaactaaaacgcacgaattttactaaccaacgtaccgaaaaccgacaaaaccgcgataccatttaccacctaataactacgtaataaacgaaaatccatatcatcatcctcaccaaacaacgccaacgattcgactatttatccgacatcaaacgtaataccaaaaacgatatctatcaaccgaataatacccaactaaccaaccaacgcgcaaaaaaaaacccgcgcataaacgaattcaaacatcaacgact

SEQ ID NO: 11027 - DNA, 582 bp, Artificial Sequence
  chemically treated genomic DNA (Homo sapiens) CpG-island No: 11027
ttgaggttattttatgtgattttaatcgagcgttatagttttttgggttattatatttttaatgattcgtttttgttcggttgtttatttagtcgtcgcgatgtcgaattggtaaaaagtttattttttttttagtttatgttattggttagcgtttaaatgggtttgatatcgcgtatatcgggtaataatgtcggcgtagttaaacgtttcggatattattttattcggcgtatttatatttagaagaatgtcgttaacgtcggggttattgattgttttgttgtaggcgagtaatgatttcgttgtaattcgttatttcggaataaggttgaagcgtacgggttttattgattagcgtgtcggaaatcggtaagatcgcgatattatttgttatttgatagttgcgtgatggacggggatttatgttattatttttattaaatagcgttagcggttcggttatttgttcggtattaagcgtgatgttagagacggtatttgttagtcgggtgatgtttaattggttagttagcgcgtaaaagaaaattcgcgtataggcgggtttaagtattagcggtt

SEQ ID NO: 11028 - DNA, 582 bp, Artificial Sequence
  chemically treated genomic DNA (Homo sapiens) CpG-island No: 11028
aaccgctaatacttaaacccgcctatacgcgaattttcttttacgcgctaactaaccaattaaacatcacccgactaacaaataccgtctctaacatcacgcttaataccgaacaaataaccgaaccgctaacgctatttaataaaaataataacataaatccccgtccatcacgcaactatcaaataacaaataatatcgcgatcttaccgatttccgacacgctaatcaataaaacccgtacgcttcaaccttattccgaaataacgaattacaacgaaatcattactcgcctacaacaaaacaatcaataaccccgacgttaacgacattcttctaaatataaatacgccgaataaaataatatccgaaacgtttaactacgccgacattattacccgatatacgcgatatcaaacccatttaaacgctaaccaataacataaactaaaaaaaaaataaactttttaccaattcgacatcgcgacgactaaataaacaaccgaacaaaaacgaatcattaaaaatataataacccaaaaaactataacgctcgattaaaatcacataaaataacctcaa

SEQ ID NO: 11029 - DNA, 839 bp, Artificial Sequence
  chemically treated genomic DNA (Homo sapiens) CpG-island No: 11029
atcgtattcgcgaggattttatttttattgaagaagttcgtagtgattagcggtagtgtcgatagtgttgcgtcgtttattaggaagtagagataaattagcggaatagatttacgtagatcgtttattttgaagatgttttgttcgtgatggtaggttagaatgacggaatcggatgttaggaatagtagcgttttaaagaacgcgtgggttattaagtggaaaatcgtcgtattttatgtttgtacgttaagcgcgaggaatatgtagttaatttggtttatggtagagtaagcgagaatacgtttgatgtcggtttgtagtagcgcggaaaaatcggttagtagtagcgtaatcgtttcgataatatttattagatgtagaattttcggcgttatttaggaataggtcgttggtacgggcgattaggtagatattcgcggttattatgcgttgcggttttgattagcgcggagataggcgttggggttcgttatcgtcgtcgttaagttatgtttgtaagtgtaattgcgtagatttatcgacgggatcgtttagtagtattagcgtcgtttatattagtatgttattgtcgttagtaaagtgcgttggtgttagttttattatttcgcggaagtttagggtgtttagttcgttgtaaagaatgaatagtgcgaaagcgaggaatacgttatttatacgggttacgacgaacgtttttattgtcgtgcgttatttttcggatcggtgtaatagaattcgattagtagataggagtataggtttacgtttttttagtcgaggtatattagtagtaggttgtcggtaagtattagaat

SEQ ID NO: 11030 - DNA, 839 bp, Artificial Sequence
  chemically treated genomic DNA (Homo sapiens) CpG-island No: 11030
attctaatacttaccgacaacctactactaatatacctcgactaaaaaaacgtaaacctatactcctatctactaatcgaattctattacaccgatccgaaaaataacgcacgacaataaaaacgttcgtcgtaacccgtataaataacgtattcctcgctttcgcactattcattctttacaacgaactaaacaccctaaacttccgcgaaataataaaactaacaccaacgcactttactaacgacaataacatactaatataaacgacgctaatactactaaacgatcccgtcgataaatctacgcaattacacttacaaacataacttaacgacgacgataacgaaccccaacgcctatctccgcgctaatcaaaaccgcaacgcataataaccgcgaatatctacctaatcgcccgtaccaacgacctattcctaaataacgccgaaaattctacatctaataaatattatcgaaacgattacgctactactaaccgatttttccgcgctactacaaaccgacatcaaacgtattctcgcttactctaccataaaccaaattaactacatattcctcgcgcttaacgtacaaacataaaatacgacgattttccacttaataacccacgcgttctttaaaacgctactattcctaacatccgattccgtcattctaacctaccatcacgaacaaaacatcttcaaaataaacgatctacgtaaatctattccgctaatttatctctacttcctaataaacgacgcaacactatcgacactaccgctaatcactacgaacttcttcaataaaaataaaatcctcgcgaatacgat

SEQ ID NO: 11031 - DNA, 839 bp, Artificial Sequence
  chemically treated genomic DNA (Homo sapiens) CpG-island No: 11031
gttttggtgtttgtcgataatttgttgttgatgtatttcggttgggaaggcgtgggtttgtgtttttatttgttgatcgggttttattatatcgattcgaagaatggcgtacggtaatgaaagcgttcgtcgtgattcgtgtgggtgacgtgtttttcgttttcgtattgtttattttttataacgaattgggtattttgaattttcgcgaaatggtggaattggtattagcgtattttgttgacggtaataatatgttgatgtgggcgacgttgatgttgttgggcggtttcgtcggtaaatttgcgtagttgtatttgtagatatggtttgacgacggcgatggcgggttttaacgtttgttttcgcgttgattaaagtcgtaacgtatggtaatcgcgggtgtttatttgatcgttcgtattaacggtttgtttttgaatgacgtcggaagttttgtatttggtgggtattgtcggggcggttacgttgttgttggtcggttttttcgcgttgttatagatcgatattaaacgtgttttcgtttattttattatgagttagattggttatatgtttttcgcgtttggcgtgtaggtatgggatgcggcgattttttatttgatgatttacgcgttttttaaagcgttgttgtttttggtattcggtttcgttattttggtttgttattacgaatagaatatttttaagatgggcggtttgcgtaaatttatttcgttggtttatttttgttttttggtgggcggcgtagtattgtcggtattatcgttggttattgcgggtttttttagtaaggatgagattttcgcgggtgcgat

SEQ ID NO: 11032 - DNA, 839 bp, Artificial Sequence
  chemically treated genomic DNA (Homo sapiens) CpG-island No: 11032
atcgcacccgcgaaaatctcatccttactaaaaaaacccgcaataaccaacgataataccgacaatactacgccgcccaccaaaaaacaaaaataaaccaacgaaataaatttacgcaaaccgcccatcttaaaaatattctattcgtaataacaaaccaaaataacgaaaccgaataccaaaaacaacaacgctttaaaaaacgcgtaaatcatcaaataaaaaatcgccgcatcccatacctacacgccaaacgcgaaaaacatataaccaatctaactcataataaaataaacgaaaacacgtttaatatcgatctataacaacgcgaaaaaaccgaccaacaacaacgtaaccgccccgacaatacccaccaaatacaaaacttccgacgtcattcaaaaacaaaccgttaatacgaacgatcaaataaacacccgcgattaccatacgttacgactttaatcaacgcgaaaacaaacgttaaaacccgccatcgccgtcgtcaaaccatatctacaaatacaactacgcaaatttaccgacgaaaccgcccaacaacatcaacgtcgcccacatcaacatattattaccgtcaacaaaatacgctaataccaattccaccatttcgcgaaaattcaaaatacccaattcgttataaaaaataaacaatacgaaaacgaaaaacacgtcacccacacgaatcacgacgaacgctttcattaccgtacgccattcttcgaatcgatataataaaacccgatcaacaaataaaaacacaaacccacgccttcccaaccgaaatacatcaacaacaaattatcgacaaacaccaaaac

SEQ ID NO: 11033 - DNA, 612 bp, Artificial Sequence
  chemically treated genomic DNA (Homo sapiens) CpG-island No: 11033
  misc_feature (151)..(151): n is either a, c, g or t
  misc_feature (165)..(165): n is either a, c, g or t
  misc_feature (319)..(319): n is either a, c, g or t
cgagggaaaaggaaaatcgtatataaggttagataataaacgagttcgaaggtaaaagggaaaagttcggggagcgaaaagagagaggtaacgtataagaatagcgggagcgtatataggtcggtaagtttagatcgggaaattcgatcgngttacgacgttaanaaaggaacgcggtaaagcgtcggagagaagtcgggaagcggaaaggggcgtattatcggaaacgacgagttatagtatcgtcgcggtatcggaggaaagggatcgcggttaacggggaaataggttttaattataaggtcggaataaacggggnaattttttcgtaattaaacgacgatgtggttttcgtttttaaattcgtattggatgcgttggcgtgtcgggtgtgcgatttaatgtcgttttgtttttgagataatacggttcgattattggcggcgttgtttttaatcgtttagttacgtatattagggattacgtttgacggataagtaattgtaagtttcgggtatgtagatttgttaaaagtttgtttttgtattagggtataattagacggaacggtatttgatggttacgggattggtgtatcgattggataaaatt

SEQ ID NO: 11034 - DNA, 612 bp, Artificial Sequence
  chemically treated genomic DNA (Homo sapiens) CpG-island No: 11034
  misc_feature (294)..(294): n is either a, c, g or t
  misc_feature (448)..(448): n is either a, c, g or t
  misc_feature (462)..(462): n is either a, c, g or t
aattttatccaatcgatacaccaatcccgtaaccatcaaataccgttccgtctaattataccctaatacaaaaacaaacttttaacaaatctacatacccgaaacttacaattacttatccgtcaaacgtaatccctaatatacgtaactaaacgattaaaaacaacgccgccaataatcgaaccgtattatctcaaaaacaaaacgacattaaatcgcacacccgacacgccaacgcatccaatacgaatttaaaaacgaaaaccacatcgtcgtttaattacgaaaaaattnccccgtttattccgaccttataattaaaacctatttccccgttaaccgcgatccctttcctccgataccgcgacgatactataactcgtcgtttccgataatacgcccctttccgcttcccgacttctctccgacgctttaccgcgttcctttnttaacgtcgtaacncgatcgaatttcccgatctaaacttaccgacctatatacgctcccgctattcttatacgttacctctctcttttcgctccccgaacttttcccttttaccttcgaactcgtttattatctaaccttatatacgattttccttttccctcg

SEQ ID NO: 11035 - DNA, 612 bp, Artificial Sequence
  chemically treated genomic DNA (Homo sapiens) CpG-island No: 11035
  misc_feature (294)..(294): n is either a, c, g or t
  misc_feature (448)..(448): n is either a, c, g or t
  misc_feature (462)..(462): n is either a, c, g or t
agttttatttagtcggtgtattaatttcgtggttattagatatcgtttcgtttggttatgttttgatgtaggggtagatttttgataaatttgtatattcgaaatttgtagttgtttattcgttaggcgtgatttttgatatgcgtggttggacgattaagggtaacgtcgttagtggtcgggtcgtattattttaggaataggacggtattaaatcgtatattcgatacgttagcgtatttagtacggatttggggacggaaattatatcgtcgtttgattacggaagggttntttcgtttgtttcggttttgtggttggggtttgttttttcgttggtcgcggtttttttttttcggtgtcgcggcggtgttgtggttcgtcgttttcggtggtgcgttttttttcgtttttcggttttttttcggcgttttgtcgcgtttttttnttggcgtcgtggtncggtcgggtttttcggtttgggtttgtcggtttgtgtgcgttttcgttgtttttgtgcgttgttttttttttttcgtttttcgggttttttttttttgttttcgggttcgtttgttgtttggttttgtgtgcggttttttttttttttcg

SEQ ID NO: 11036 - DNA, 612 bp, Artificial Sequence
  chemically treated genomic DNA (Homo sapiens) CpG-island No: 11036
  misc_feature (151)..(151): n is either a, c, g or t
  misc_feature (165)..(165): n is either a, c, g or t
  misc_feature (319)..(319): n is either a, c, g or t
cgaaaaaaaaaaaaaaccgcacacaaaaccaaacaacaaacgaacccgaaaacaaaaaaaaaaaacccgaaaaacgaaaaaaaaaaaacaacgcacaaaaacaacgaaaacgcacacaaaccgacaaacccaaaccgaaaaacccgaccgnaccacgacgccaanaaaaaaacgcgacaaaacgccgaaaaaaaaccgaaaaacgaaaaaaaacgcaccaccgaaaacgacgaaccacaacaccgccgcgacaccgaaaaaaaaaaaccgcgaccaacgaaaaaacaaaccccaaccacaaaaccgaaacaaacgaaanaacccttccgtaatcaaacgacgatataatttccgtccccaaatccgtactaaatacgctaacgtatcgaatatacgatttaataccgtcctattcctaaaataatacgacccgaccactaacgacgttacccttaatcgtccaaccacgcatatcaaaaatcacgcctaacgaataaacaactacaaatttcgaatatacaaatttatcaaaaatctacccctacatcaaaacataaccaaacgaaacgatatctaataaccacgaaattaatacaccgactaaataaaact

SEQ ID NO: 11037 - DNA, 544 bp, Artificial Sequence
  chemically treated genomic DNA (Homo sapiens) CpG-island No: 11037
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtcgcgaagtagcgtttatattcgacgataattatagatttgtaggtagtgtgtttttgagaatgttgaatgttaggttcgagtgggattgtttagtataa

SEQ ID NO: 11038 - DNA, 544 bp, Artificial Sequence
  chemically treated genomic DNA (Homo sapiens) CpG-island No: 11038
ttatactaaacaatcccactcgaacctaacattcaacattctcaaaaacacactacctacaaatctataattatcgtcgaatataaacgctacttcgcgacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 11039 - DNA, 544 bp, Artificial Sequence
  chemically treated genomic DNA (Homo sapiens) CpG-island No: 11039
ttatattgaatagttttattcggatttaatatttagtatttttagaaatatattgtttgtaggtttatggttatcgtcgggtatgggcgttgtttcgcgataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 11040 - DNA, 544 bp, Artificial Sequence
  chemically treated genomic DNA (Homo sapiens) CpG-island No: 11040
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatcgcgaaacaacgcccatacccgacgataaccataaacctacaaacaatatatttctaaaaatactaaatattaaatccgaataaaactattcaatataa

SEQ ID NO: 11041 - DNA, 1077 bp, Artificial Sequence
  chemically treated genomic DNA (Homo sapiens) CpG-island No: 11041
ggtagtttgacgcgtatgttgcgcgatagttttcgggaattggggttggattaggttattgtcgaagcggcggaatatttttcgatgcgcgcgatcgtttgttttatggtcgtatgttcgagatcgcgaaatgagttgttgttaggtttttaggatattatcggttcgacgattcgtgttttaatttaaagatttggcgtgttgggtttttcggttgatcgggggacgtagtttttttgttatatcgcggcgtattcgaagttagttgacgtgaatacgtattatacgttgtcggattttattatgaatcgtttgttgatagttttgtacgcggattcggttatagcgttgcgttgaatagagtcgtggtatttttagcgcgatagtttgttagcgttgggttattgattagtaaacgggttgtttatttgtcgtggtttatttttttagttaatttaaaaaattagtatgtttttcgttcgtcggaacggtcgaagaggtaaattattgatggtaatagtgacgcgtggtcggtgtcgtattgatattttttgttagatgttgtgtcgttttttcgagtaaattatttagtaataacgttatcgtttgcgggttttttagacggtaggtatcgttaaatgttttttagcgtaatttttttagaacgataaaatagcgtttaggtaacgattaggcgttatacgttttagtacgttagcgggtaaaaatttgttcgttttgattatttgtttgtattagtaggtttcgttgcgttaacgttttttttttttagcgataacgggttgaaaattatttatataaggcggtaatttgttgggggagtttcgggaaagtagagtgttggcggtgatttattttttgtagtagcgttagatgttgcgcgatttgcgttagtgttagatgagcggggatttagtatcgacgttagtttttttattaatgttagacgtaggttaagcggcgtattttatatggtcgtcgtttgtttatggtttgaatttgtatacgcgaaaagaagtttttttattagtggtttataaacggttgttaggttta

SEQ ID NO: 11042 - DNA, 1077 bp, Artificial Sequence
  chemically treated genomic DNA (Homo sapiens) CpG-island No: 11042
taaacctaacaaccgtttataaaccactaataaaaaaacttcttttcgcgtatacaaattcaaaccataaacaaacgacgaccatataaaatacgccgcttaacctacgtctaacattaataaaaaaactaacgtcgatactaaatccccgctcatctaacactaacgcaaatcgcgcaacatctaacgctactacaaaaaataaatcaccgccaacactctactttcccgaaactcccccaacaaattaccgccttatataaataattttcaacccgttatcgctaaaaaaaaaaaacgttaacgcaacgaaacctactaatacaaacaaataatcaaaacgaacaaatttttacccgctaacgtactaaaacgtataacgcctaatcgttacctaaacgctattttatcgttctaaaaaaattacgctaaaaaacatttaacgatacctaccgtctaaaaaacccgcaaacgataacgttattactaaataatttactcgaaaaaacgacacaacatctaacaaaaaatatcaatacgacaccgaccacgcgtcactattaccatcaataatttacctcttcgaccgttccgacgaacgaaaaacatactaattttttaaattaactaaaaaaataaaccacgacaaataaacaacccgtttactaatcaataacccaacgctaacaaactatcgcgctaaaaataccacgactctattcaacgcaacgctataaccgaatccgcgtacaaaactatcaacaaacgattcataataaaatccgacaacgtataatacgtattcacgtcaactaacttcgaatacgccgcgatataacaaaaaaactacgtcccccgatcaaccgaaaaacccaacacgccaaatctttaaattaaaacacgaatcgtcgaaccgataatatcctaaaaacctaacaacaactcatttcgcgatctcgaacatacgaccataaaacaaacgatcgcgcgcatcgaaaaatattccgccgcttcgacaataacctaatccaaccccaattcccgaaaactatcgcgcaacatacgcgtcaaactacc

SEQ ID NO: 11043 - DNA, 1077 bp, Artificial Sequence
  chemically treated genomic DNA (Homo sapiens) CpG-island No: 11043
taaatttggtagtcgtttgtgaattattgatgaaggaattttttttcgcgtgtgtaagtttagattatggataaacggcggttatgtaaaatgcgtcgtttagtttgcgtttgatattggtggaaaaattggcgtcgatgttggattttcgtttatttggtattgacgtagatcgcgtagtatttggcgttgttgtaaaaaatggattatcgttagtattttgttttttcggagtttttttagtaaattgtcgttttgtatgagtggtttttagttcgttgtcgttggaaggaaaaggcgttaacgtaacgaggtttattggtgtaggtaggtgattagagcgagtaaatttttattcgttggcgtgttggggcgtataacgtttggtcgttgtttgggcgttgttttatcgttttggaggagttgcgttggggggtatttggcgatgtttgtcgtttgggaagttcgtaagcggtggcgttgttgttgggtgatttgttcgagaaagcgatataatatttggtagagagtattaatgcggtatcgattacgcgttattattattattagtggtttgttttttcgatcgtttcgacgggcggggagtatgttgattttttaagttggttgggaaagtggattacggtagataaataattcgtttgttggttagtgatttaacgttggtaaattgtcgcgttggggatgttacgattttgtttagcgtagcgttatagtcgaattcgcgtataaagttgttaataaacggtttataatgaagttcggtagcgtgtggtgcgtgtttacgttaattggtttcggatacgtcgcggtgtggtagaaagattgcgtttttcggttagtcgagaagtttagtacgttaggtttttgggttggagtacgggtcgtcgggtcggtggtgttttgggaatttaatagtagtttatttcgcggtttcgagtatgcggttatagaataaacgatcgcgcgtatcggggaatgtttcgtcgtttcggtaatggtttgatttagttttagttttcgaaaattgtcgcgtagtatacgcgttaggttgtt

SEQ ID NO: 11044 - DNA, 1077 bp, Artificial Sequence
  chemically treated genomic DNA (Homo sapiens) CpG-island No: 11044
aacaacctaacgcgtatactacgcgacaattttcgaaaactaaaactaaatcaaaccattaccgaaacgacgaaacattccccgatacgcgcgatcgtttattctataaccgcatactcgaaaccgcgaaataaactactattaaattcccaaaacaccaccgacccgacgacccgtactccaacccaaaaacctaacgtactaaacttctcgactaaccgaaaaacgcaatctttctaccacaccgcgacgtatccgaaaccaattaacgtaaacacgcaccacacgctaccgaacttcattataaaccgtttattaacaactttatacgcgaattcgactataacgctacgctaaacaaaatcgtaacatccccaacgcgacaatttaccaacgttaaatcactaaccaacaaacgaattatttatctaccgtaatccactttcccaaccaacttaaaaaatcaacatactccccgcccgtcgaaacgatcgaaaaaacaaaccactaataataataataacgcgtaatcgataccgcattaatactctctaccaaatattatatcgctttctcgaacaaatcacccaacaacaacgccaccgcttacgaacttcccaaacgacaaacatcgccaaataccccccaacgcaactcctccaaaacgataaaacaacgcccaaacaacgaccaaacgttatacgccccaacacgccaacgaataaaaatttactcgctctaatcacctacctacaccaataaacctcgttacgttaacgccttttccttccaacgacaacgaactaaaaaccactcatacaaaacgacaatttactaaaaaaactccgaaaaaacaaaatactaacgataatccattttttacaacaacgccaaatactacgcgatctacgtcaataccaaataaacgaaaatccaacatcgacgccaatttttccaccaatatcaaacgcaaactaaacgacgcattttacataaccgccgtttatccataatctaaacttacacacgcgaaaaaaaattccttcatcaataattcacaaacgactaccaaattta

SEQ ID NO: 11045 - DNA, 503 bp, Artificial Sequence
  chemically treated genomic DNA (Homo sapiens) CpG-island No: 11045
gtttcggtatcggaaaaatcggttttttaaggtgtagcgaaaggcgattacgtaattttaatttaatcgttttttgaattgagttttcgttcgacgaaagatttgagcggtgcggatatgtggggagttattatgtttgattaattggtgtgtcgcgtgatgttttattagatgcgttatgaaggtatttttatttcgttatttgaatagggtacgttggttttttcgggtaatttggggatgtttgaatggggtcgggatttttttgatttaaatcggaagtgcgattgttaatttaaggtattgtcgtttgtttgaaattgaattcgcgtggtttggtaattttatggtatagttagagattttaagggacggggacggattcggtatttaattacggtaggggttacgtatggtgtttcgtttaattcgttttttttataattgggtttgtttttgtaattagggtatttttttagtttgttattacgtttcggaatagt

SEQ ID NO: 11046 - DNA, 503 bp, Artificial Sequence
  chemically treated genomic DNA (Homo sapiens) CpG-island No: 11046
actattccgaaacgtaataacaaactaaaaaaataccctaattacaaaaacaaacccaattataaaaaaaacgaattaaacgaaacaccatacgtaacccctaccgtaattaaataccgaatccgtccccgtcccttaaaatctctaactataccataaaattaccaaaccacgcgaattcaatttcaaacaaacgacaataccttaaattaacaatcgcacttccgatttaaatcaaaaaaatcccgaccccattcaaacatccccaaattacccgaaaaaaccaacgtaccctattcaaataacgaaataaaaataccttcataacgcatctaataaaacatcacgcgacacaccaattaatcaaacataataactccccacatatccgcaccgctcaaatctttcgtcgaacgaaaactcaattcaaaaaacgattaaattaaaattacgtaatcgcctttcgctacaccttaaaaaaccgatttttccgataccgaaac

SEQ ID NO: 11047 - DNA, 503 bp, Artificial Sequence
  chemically treated genomic DNA (Homo sapiens) CpG-island No: 11047
attgtttcgaagcgtagtgataagttgggagggtattttggttataagggtaaatttaattgtaagaagaacgggttgaacggaatattatacgtaatttttatcgtggttgaatgtcggattcgttttcgttttttggaatttttggttgtattatagggttgttaggttacgcggatttagttttaaataaacggtagtgttttgggttggtaatcgtattttcgatttggattaaaggaatttcggttttatttaaatatttttaggttattcgggaagattagcgtattttgtttagatggcggggtgaaaatgtttttatagcgtatttggtggaatattacgcggtatattagttggttaaatatggtggttttttatatattcgtatcgtttaaatttttcgtcggacggaagtttagtttagaaaacggttgagttggggttacgtaatcgtttttcgttgtattttggggaatcggttttttcggtgtcggaat

SEQ ID NO: 11048 - DNA, 503 bp, Artificial Sequence
  chemically treated genomic DNA (Homo sapiens) CpG-island No: 11048
attccgacaccgaaaaaaccgattccccaaaatacaacgaaaaacgattacgtaaccccaactcaaccgttttctaaactaaacttccgtccgacgaaaaatttaaacgatacgaatatataaaaaaccaccatatttaaccaactaatataccgcgtaatattccaccaaatacgctataaaaacattttcaccccgccatctaaacaaaatacgctaatcttcccgaataacctaaaaatatttaaataaaaccgaaattcctttaatccaaatcgaaaatacgattaccaacccaaaacactaccgtttatttaaaactaaatccgcgtaacctaacaaccctataatacaaccaaaaattccaaaaaacgaaaacgaatccgacattcaaccacgataaaaattacgtataatattccgttcaacccgttcttcttacaattaaatttacccttataaccaaaataccctcccaacttatcactacgcttcgaaacaat

SEQ ID NO: 11049 - DNA, 613 bp, Artificial Sequence
  chemically treated genomic DNA (Homo sapiens) CpG-island No: 11049
tagtagtcgtagtagggcggagtatcgcgaaaaacggagtaatatcgggggaggaggtagtaagaacgcgttaggacggtcgtataagaggaaggtttaagaagcggggagagggatcgaggacggcgaaaggattatagcgacgttagaggagtttcggggatcgagcgcgaacgcggaattaaggttagagtcggcgttagggggaaagagggattcgtatataaggttatataatagacgagtcggaagtataaagcgtaaagttcggcggggtttagcgagggagttaacgtataggaagcggcggagcgcgtatcggttcgcggggttagacggggaaagttagatcgcgttagtaggtagtagaggaaagcggtttatacgcgtcgggcgagtaggcggtcgcgcggaatcggggcgcgcgatttcgcggttcgcggtcgatcgatcgcgtcgcgttacggcgcgagtcggtcggcggcgagtcgggaatatagcgtacgttaaaaggtcgggaacgacgggagaggttatagaatttagggggattaacgtcgggataagaaatacggggagttataaggttagtataaaggtttaggttcggtat

SEQ ID NO: 11050 - DNA, 613 bp, Artificial Sequence
  chemically treated genomic DNA (Homo sapiens) CpG-island No: 11050
ataccgaacctaaacctttatactaaccttataactccccgtatttcttatcccgacgttaatccccctaaattctataacctctcccgtcgttcccgaccttttaacgtacgctatattcccgactcgccgccgaccgactcgcgccgtaacgcgacgcgatcgatcgaccgcgaaccgcgaaatcgcgcgccccgattccgcgcgaccgcctactcgcccgacgcgtataaaccgctttcctctactacctactaacgcgatctaactttccccgtctaaccccgcgaaccgatacgcgctccgccgcttcctatacgttaactccctcgctaaaccccgccgaactttacgctttatacttccgactcgtctattatataaccttatatacgaatccctctttccccctaacgccgactctaaccttaattccgcgttcgcgctcgatccccgaaactcctctaacgtcgctataatcctttcgccgtcctcgatccctctccccgcttcttaaaccttcctcttatacgaccgtcctaacgcgttcttactacctcctcccccgatattactccgtttttcgcgatactccgccctactacgactacta

SEQ ID NO: 11051 - DNA, 613 bp, Artificial Sequence
  chemically treated genomic DNA (Homo sapiens) CpG-island No: 11051
atgtcggatttgggtttttgtgttggttttgtggtttttcgtgttttttgtttcggcgttggtttttttgggttttgtggtttttttcgtcgttttcggttttttggcgtgcgttgtgttttcggttcgtcgtcggtcggttcgcgtcgtggcgcggcgcggtcggtcggtcgcgggtcgcggggtcgcgcgtttcggtttcgcgcggtcgtttgttcgttcggcgcgtgtgggtcgtttttttttgttgtttgttggcgcggtttggtttttttcgtttggtttcgcgggtcggtgcgcgtttcgtcgttttttgtgcgttggttttttcgttgggtttcgtcgggttttgcgttttgtgttttcggttcgtttgttgtgtggttttgtgtgcgggtttttttttttttttggcgtcggttttggttttggtttcgcgttcgcgttcggttttcggggtttttttggcgtcgttgtggttttttcgtcgttttcggttttttttttcgttttttgggttttttttttgtgcggtcgttttggcgcgtttttgttgttttttttttcggtgttgtttcgtttttcgcggtgtttcgttttgttgcggttgttg

SEQ ID NO: 11052 - DNA, 613 bp, Artificial Sequence
  chemically treated genomic DNA (Homo sapiens) CpG-island No: 11052
caacaaccgcaacaaaacgaaacaccgcgaaaaacgaaacaacaccgaaaaaaaaaacaacaaaaacgcgccaaaacgaccgcacaaaaaaaaaacccaaaaaacgaaaaaaaaaaccgaaaacgacgaaaaaaccacaacgacgccaaaaaaaccccgaaaaccgaacgcgaacgcgaaaccaaaaccaaaaccgacgccaaaaaaaaaaaaaaacccgcacacaaaaccacacaacaaacgaaccgaaaacacaaaacgcaaaacccgacgaaacccaacgaaaaaaccaacgcacaaaaaacgacgaaacgcgcaccgacccgcgaaaccaaacgaaaaaaaccaaaccgcgccaacaaacaacaaaaaaaaacgacccacacgcgccgaacgaacaaacgaccgcgcgaaaccgaaacgcgcgaccccgcgacccgcgaccgaccgaccgcgccgcgccacgacgcgaaccgaccgacgacgaaccgaaaacacaacgcacgccaaaaaaccgaaaacgacgaaaaaaaccacaaaacccaaaaaaaccaacgccgaaacaaaaaacacgaaaaaccacaaaaccaacacaaaaacccaaatccgacat

SEQ ID NO: 11053 - DNA, 578 bp, Artificial Sequence
  chemically treated genomic DNA (Homo sapiens) CpG-island No: 11053
  misc_feature (189)..(189): n is either a, c, g or t
gtttgcggatcgttatttaacgcggcgtaaacggcgaaatatttggcggatcgttttttcgatttttaggtttacgttattttcggttgggagttttgcgataatatttcgtatcgtttcgacgatcgttgcgtagtaattggcgtttttgattacggtaaaatcgaagaggtaattaaagcgttgganttgggtcgggtttgcggcgtatttattgcggcgtttattaaacgcgcggatagttcgattatttcggcggcggaatttagtattgattattaggtcgattgtatttgggaaatttatttgttgttttgttatagcgtggtgttggagatgattattcgtttcgcgtcgaacgcggaaatcggtaagattaaaaacgattttaattagttgtcgaatgcgtttcgttatttggtacgtatttggaaggagattttttttgcgatttgtcgcgtataaattgttgaattacgcgtagtaggcgcgggaatatttggattttcgtgcgtacgggttaaacgtcgtttgtgaataattgcggtaaaatatttattagatcgaagaaagtttgt

SEQ ID NO: 11054 - DNA, 578 bp, Artificial Sequence
  chemically treated genomic DNA (Homo sapiens) CpG-island No: 11054
  misc_feature (390)..(390): n is either a, c, g or t
acaaactttcttcgatctaataaatattttaccgcaattattcacaaacgacgtttaacccgtacgcacgaaaatccaaatattcccgcgcctactacgcgtaattcaacaatttatacgcgacaaatcgcaaaaaaaatctccttccaaatacgtaccaaataacgaaacgcattcgacaactaattaaaatcgtttttaatcttaccgatttccgcgttcgacgcgaaacgaataatcatctccaacaccacgctataacaaaacaacaaataaatttcccaaatacaatcgacctaataatcaatactaaattccgccgccgaaataatcgaactatccgcgcgtttaataaacgccgcaataaatacgccgcaaacccgacccaantccaacgctttaattacctcttcgattttaccgtaatcaaaaacgccaattactacgcaacgatcgtcgaaacgatacgaaatattatcgcaaaactcccaaccgaaaataacgtaaacctaaaaatcgaaaaaacgatccgccaaatatttcgccgtttacgccgcgttaaataacgatccgcaaac

SEQ ID NO: 11055 - DNA, 578 bp, Artificial Sequence
  chemically treated genomic DNA (Homo sapiens) CpG-island No: 11055
  misc_feature (390)..(390): n is either a, c, g or t
gtaaatttttttcgatttggtggatattttgtcgtaattgtttataagcgacgtttaattcgtgcgtacgaaaatttaggtattttcgcgtttgttgcgcgtaatttaatagtttatgcgcggtagatcgtagagggggtttttttttaggtgcgtattagatgacgaagcgtattcggtaattgattgagatcgtttttgattttgtcgattttcgcgttcggcgcgaggcgggtgattatttttagtattacgttgtagtagagtagtaggtgaattttttagatatagtcggtttgataattaatgttaaatttcgtcgtcgaggtaatcgggttattcgcgcgtttggtgaacgtcgtagtgagtgcgtcgtaggttcggtttagntttagcgttttgattattttttcggttttatcgtagttagaaacgttaattattgcgtaacgatcgtcgaggcgatacggggtgttatcgtagaatttttagtcggaaatggcgtagatttgaagatcggaaaagcgattcgttagatgtttcgtcgtttgcgtcgcgttgagtggcgattcgtaggt

SEQ ID NO: 11056 - DNA, 578 bp, Artificial Sequence
  chemically treated genomic DNA (Homo sapiens) CpG-island No: 11056
  misc_feature (189)..(189): n is either a, c, g or t
acctacgaatcgccactcaacgcgacgcaaacgacgaaacatctaacgaatcgcttttccgatcttcaaatctacgccatttccgactaaaaattctacgataacaccccgtatcgcctcgacgatcgttacgcaataattaacgtttctaactacgataaaaccgaaaaaataatcaaaacgctaaanctaaaccgaacctacgacgcactcactacgacgttcaccaaacgcgcgaataacccgattacctcgacgacgaaatttaacattaattatcaaaccgactatatctaaaaaattcacctactactctactacaacgtaatactaaaaataatcacccgcctcgcgccgaacgcgaaaatcgacaaaatcaaaaacgatctcaatcaattaccgaatacgcttcgtcatctaatacgcacctaaaaaaaaaccccctctacgatctaccgcgcataaactattaaattacgcgcaacaaacgcgaaaatacctaaattttcgtacgcacgaattaaacgtcgcttataaacaattacgacaaaatatccaccaaatcgaaaaaaatttac

SEQ ID NO: 11057 - DNA, 757 bp, Artificial Sequence
  chemically treated genomic DNA (Homo sapiens) CpG-island No: 11057
  misc_feature (91)..(91): n is either a, c, g or t
gcgtggcggttaagtcgtacgagtttgtaggttatttgttcggcggtatcgagcgtgcgtatagtaaagtagattattttaattcgggtanatcgttatatcggtcggagttatcgaagattgatttagcggacgcgtagatatgttagcgtatagtattttacgatatttatggcgttcgaaatcgcgatcgacgaattggcggaaaaagcgggtatcgatttcgtcgagtttcgtattttgaatgatatttaggttgatttcgtcgattcgacgcgttgtttttttcgtcgttagtttatcgagtgtttgcgtatcggagcggataaatttggttggaagtagcgtaacgttatattcggataggtgcgcgacggggagtggttagtcggttacggtgttgcggcgggttttcgtaataatttgttggaaaaatcgggtgttcgggtttatttcgaataaaacggtatcgttatcgtagaaacggatatgatcgatattggtatcggtagttatattattttggtttagacggtagcggaaatgtttggcgtatcgttggagtaggttgcggtttatttcggcgattttagtttttcggtttttgcgggttttggtggataatggggcgcgaatattttttatttcgggggtttacgtcgtttgtatgaagtcgcgaaatgattgtttcggtagtcgggtttgattttgagtagtgaatttgtttggagtgggagtgcgtaattaattcgttatg

SEQ ID NO: 11058 - DNA, 757 bp, Artificial Sequence
  chemically treated genomic DNA (Homo sapiens) CpG-island No: 11058
  misc_feature (667)..(667): n is either a, c, g or t
cataacgaattaattacgcactcccactccaaacaaattcactactcaaaatcaaacccgactaccgaaacaatcatttcgcgacttcatacaaacgacgtaaacccccgaaataaaaaatattcgcgccccattatccaccaaaacccgcaaaaaccgaaaaactaaaatcgccgaaataaaccgcaacctactccaacgatacgccaaacatttccgctaccgtctaaaccaaaataatataactaccgataccaatatcgatcatatccgtttctacgataacgataccgttttattcgaaataaacccgaacacccgatttttccaacaaattattacgaaaacccgccgcaacaccgtaaccgactaaccactccccgtcgcgcacctatccgaatataacgttacgctacttccaaccaaatttatccgctccgatacgcaaacactcgataaactaacgacgaaaaaaacaacgcgtcgaatcgacgaaatcaacctaaatatcattcaaaatacgaaactcgacgaaatcgatacccgctttttccgccaattcgtcgatcgcgatttcgaacgccataaatatcgtaaaatactatacgctaacatatctacgcgtccgctaaatcaatcttcgataactccgaccgatataacgatntacccgaattaaaataatctactttactatacgcacgctcgataccgccgaacaaataacctacaaactcgtacgacttaaccgccacgc

SEQ ID NO: 11059 - DNA, 757 bp, Artificial Sequence
  chemically treated genomic DNA (Homo sapiens) CpG-island No: 11059
  misc_feature (667)..(667): n is either a, c, g or t
tataacgaattgattacgtatttttattttaggtaaatttattgtttaggattaaattcgattgtcgaggtaattatttcgcgattttatataggcggcgtaaattttcgaggtgagaggtattcgcgttttattgtttattagaattcgtagaaatcgggaaattggaatcgtcgaggtgaatcgtaatttgttttagcggtacgttaagtattttcgttgtcgtttgggttagaatggtgtagttgtcggtgttaatgtcggttatgttcgtttttacggtaacggtgtcgttttgttcgaggtgaattcgagtattcgatttttttagtagattattgcgaaagttcgtcgtaatatcgtggtcgattagttatttttcgtcgcgtatttgttcgggtgtggcgttgcgttgtttttagttaaatttattcgtttcggtgcgtaagtattcgataagttgacggcgagagaagtagcgcgtcgggtcggcggggttaatttgagtgttatttaggatgcgaaattcgacgggatcgatgttcgtttttttcgttagttcgtcgatcgcgatttcgagcgttatgagtatcgtgggatgttgtacgttggtatatttgcgcgttcgttaagttagttttcggtagtttcggtcggtatgacgatntgttcggattagagtaatttgttttgttgtacgtacgttcggtgtcgtcgggtaggtgatttgtaggttcgtgcgatttagtcgttacgt

SEQ ID NO: 11060 - DNA, 757 bp, Artificial Sequence
  chemically treated genomic DNA (Homo sapiens) CpG-island No: 11060
  misc_feature (91)..(91): n is either a, c, g or t
acgtaacgactaaatcgcacgaacctacaaatcacctacccgacgacaccgaacgtacgtacaacaaaacaaattactctaatccgaacanatcgtcataccgaccgaaactaccgaaaactaacttaacgaacgcgcaaatataccaacgtacaacatcccacgatactcataacgctcgaaatcgcgatcgacgaactaacgaaaaaaacgaacatcgatcccgtcgaatttcgcatcctaaataacactcaaattaaccccgccgacccgacgcgctacttctctcgccgtcaacttatcgaatacttacgcaccgaaacgaataaatttaactaaaaacaacgcaacgccacacccgaacaaatacgcgacgaaaaataactaatcgaccacgatattacgacgaactttcgcaataatctactaaaaaaatcgaatactcgaattcacctcgaacaaaacgacaccgttaccgtaaaaacgaacataaccgacattaacaccgacaactacaccattctaacccaaacgacaacgaaaatacttaacgtaccgctaaaacaaattacgattcacctcgacgattccaatttcccgatttctacgaattctaataaacaataaaacgcgaatacctctcacctcgaaaatttacgccgcctatataaaatcgcgaaataattacctcgacaatcgaatttaatcctaaacaataaatttacctaaaataaaaatacgtaatcaattcgttata

SEQ ID NO: 11061 - DNA, 618 bp, Artificial Sequence
  chemically treated genomic DNA (Homo sapiens) CpG-island No: 11061
tttagtcggttgtcgtttcgcgttgttttcgcgtcgtcgttcgtatacgggtttatacgtatacgtcgtcgtcggtttttcgtgtatttttggcggttgttgaggttggcgttggttcgttggtttttatcgtagtattcggtcgtcggtcgttgcgttttttttttcgttcgttgaggttttagagttcggttttttgtaatggcggtcgtcgggcgtggtgacgttacgttcggcgttaggagacggcggggagcggaggggaaaagggtcggggagtaagttgcgtaattgtagagtttttttcgggcggtcgtacgatcggagttggggcgtaaattgggggttaaagcgtaggcgcgacgtagtcggttggtaattgaagcgttttgattttttgggcgtggttttcggagggcggggtggtgggggaagggaaggatggagttggagtatgcgtagtgcgtatagcggcgaatcggattaatttttgagtattattttaggagaggcgagggtttgggtcgcgcgtaggcgtagatcggatggaagtcggggttattggtagtttgtaattggtttttttgggaaggtcgttttggtgatgaatttagtttt

SEQ ID NO: 11062 - DNA, 618 bp, Artificial Sequence
  chemically treated genomic DNA (Homo sapiens) CpG-island No: 11062
aaaactaaattcatcaccaaaacgaccttcccaaaaaaaccaattacaaactaccaataaccccgacttccatccgatctacgcctacgcgcgacccaaaccctcgcctctcctaaaataatactcaaaaattaatccgattcgccgctatacgcactacgcatactccaactccatccttcccttcccccaccaccccgccctccgaaaaccacgcccaaaaaatcaaaacgcttcaattaccaaccgactacgtcgcgcctacgctttaacccccaatttacgccccaactccgatcgtacgaccgcccgaaaaaaactctacaattacgcaacttactccccgacccttttcccctccgctccccgccgtctcctaacgccgaacgtaacgtcaccacgcccgacgaccgccattacaaaaaaccgaactctaaaacctcaacgaacgaaaaaaaaaacgcaacgaccgacgaccgaatactacgataaaaaccaacgaaccaacgccaacctcaacaaccgccaaaaatacacgaaaaaccgacgacgacgtatacgtataaacccgtatacgaacgacgacgcgaaaacaacgcgaaacgacaaccgactaaa

SEQ ID NO: 11063 - DNA, 618 bp, Artificial Sequence
  chemically treated genomic DNA (Homo sapiens) CpG-island No: 11063
ggagttgagtttattattagagcggtttttttaggggaattagttataggttgttagtggtttcggtttttattcggtttgcgtttgcgcgcggtttaagttttcgttttttttggaatagtgtttagggattagttcggttcgtcgttgtgcgtattgcgtatgttttagttttatttttttttttttttattatttcgtttttcgggagttacgtttaaaaagttaaggcgttttagttattagtcggttacgtcgcgtttgcgttttgatttttagtttgcgttttaatttcggtcgtgcggtcgttcggggagggttttgtagttgcgtagtttgtttttcggtttttttttttttcgtttttcgtcgttttttgacgtcgggcgtgacgttattacgttcggcggtcgttattatagagagtcgagttttggagttttagcgagcggaggaggaggcgtagcggtcgacggtcgagtattgcggtgagagttagcgggttagcgttagttttaatagtcgttagaagtatacgaggaatcggcggcggcgtgtgcgtgtaggttcgtgtgcgggcggcggcgcgggagtagcgcggagcggtagtcggttggg

SEQ ID NO: 11064 - DNA, 618 bp, Artificial Sequence
  chemically treated genomic DNA (Homo sapiens) CpG-island No: 11064
cccaaccgactaccgctccgcgctactcccgcgccgccgcccgcacacgaacctacacgcacacgccgccgccgattcctcgtatacttctaacgactattaaaactaacgctaacccgctaactctcaccgcaatactcgaccgtcgaccgctacgcctcctcctccgctcgctaaaactccaaaactcgactctctataataacgaccgccgaacgtaataacgtcacgcccgacgtcaaaaaacgacgaaaaacgaaaaaaaaaaaaaccgaaaaacaaactacgcaactacaaaaccctccccgaacgaccgcacgaccgaaattaaaacgcaaactaaaaatcaaaacgcaaacgcgacgtaaccgactaataactaaaacgccttaactttttaaacgtaactcccgaaaaacgaaataataaaaaaaaaaaaaaataaaactaaaacatacgcaatacgcacaacgacgaaccgaactaatccctaaacactattccaaaaaaaacgaaaacttaaaccgcgcgcaaacgcaaaccgaataaaaaccgaaaccactaacaacctataactaattcccctaaaaaaaccgctctaataataaactcaactcc

SEQ ID NO: 11065 - DNA, 628 bp, Artificial Sequence
  chemically treated genomic DNA (Homo sapiens) CpG-island No: 11065
ggaagtggtaggtgaatgtttgcgtaagggcgcgtaggtttatatcgaaggttagtttcgtattcgtagttgggaggataacggtattattcgttacgttatcgaaatttttgttaagattacgggtattatgtagatgttggtacgtgtcgtaggtgtttagatttagtcggaagaggggtaatagtttagcggttagttttagtcggaattataggcggaggtcggtacgaaaaaaggtggcgtaaaaacgaaaggtcgtggacgtaaggtcgcgtagtcggagttttagtcgtaatcgtcggagggtgacgattacgggtttttagacgatatttcgttttgaacgattgattgtgataatcgtttcgttttgtgcggggtattatcggagagatgaggatgagcgaatattttagaatattttagggattgtttgacggtttttttattcgtaaatatgtcgaagtcgttgtcgtatagtatcggaacgtttttatcgaggatgattacggcgaatagtttcgtttggttgttcgtaataacggtgtaatggtttggcgtatttggaattttgaggacggtgtcgggtattggatgaattatgttattcgtgatttcgggattt

SEQ ID NO: 11066 - DNA, 628 bp, Artificial Sequence
  chemically treated genomic DNA (Homo sapiens) CpG-island No: 11066
aaatcccgaaatcacgaataacataattcatccaatacccgacaccgtcctcaaaattccaaatacgccaaaccattacaccgttattacgaacaaccaaacgaaactattcgccgtaatcatcctcgataaaaacgttccgatactatacgacaacgacttcgacatatttacgaataaaaaaaccgtcaaacaatccctaaaatattctaaaatattcgctcatcctcatctctccgataataccccgcacaaaacgaaacgattatcacaatcaatcgttcaaaacgaaatatcgtctaaaaacccgtaatcgtcaccctccgacgattacgactaaaactccgactacgcgaccttacgtccacgacctttcgtttttacgccaccttttttcgtaccgacctccgcctataattccgactaaaactaaccgctaaactattacccctcttccgactaaatctaaacacctacgacacgtaccaacatctacataatacccgtaatcttaacaaaaatttcgataacgtaacgaataataccgttatcctcccaactacgaatacgaaactaaccttcgatataaacctacgcgcccttacgcaaacattcacctaccacttcc

SEQ ID NO: 11067 - DNA, 628 bp, Artificial Sequence
  chemically treated genomic DNA (Homo sapiens) CpG-island No: 11067
gaatttcgaaattacggatgatatggtttatttagtattcggtatcgtttttaaaattttaggtacgttagattattgtatcgttattacggataattaggcgaaattgttcgtcgtggttattttcgataaagacgtttcggtattgtgcggtaacggtttcggtatgtttgcgggtaaaaggatcgttaggtagtttttgaagtattttgaaatattcgtttatttttattttttcggtgatgtttcgtataggacggggcggttgttatagttagtcgtttagaacgggatatcgtttgaaaattcgtaatcgttatttttcggcggttgcggttgaggtttcggttgcgcggttttacgtttacggtttttcgtttttgcgttattttttttcgtatcggttttcgtttgtggtttcggttgaggttgatcgttgaattgttgtttttttttcggttgagtttgagtatttgcggtacgtattagtatttgtatggtgttcgtggttttaataagaatttcggtgacgtaacgggtgatatcgttatttttttagttacgggtgcgaagttgattttcgatgtagatttgcgcgtttttgcgtagatatttatttgttattttt

SEQ ID NO: 11068 - DNA, 628 bp, Artificial Sequence
  chemically treated genomic DNA (Homo sapiens) CpG-island No: 11068
aaaaataacaaataaatatctacgcaaaaacgcgcaaatctacatcgaaaatcaacttcgcacccgtaactaaaaaaataacgatatcacccgttacgtcaccgaaattcttattaaaaccacgaacaccatacaaatactaatacgtaccgcaaatactcaaactcaaccgaaaaaaaaacaacaattcaacgatcaacctcaaccgaaaccacaaacgaaaaccgatacgaaaaaaaataacgcaaaaacgaaaaaccgtaaacgtaaaaccgcgcaaccgaaacctcaaccgcaaccgccgaaaaataacgattacgaattttcaaacgatatcccgttctaaacgactaactataacaaccgccccgtcctatacgaaacatcaccgaaaaaataaaaataaacgaatatttcaaaatacttcaaaaactacctaacgatccttttacccgcaaacataccgaaaccgttaccgcacaataccgaaacgtctttatcgaaaataaccacgacgaacaatttcgcctaattatccgtaataacgatacaataatctaacgtacctaaaattttaaaaacgataccgaatactaaataaaccatatcatccgtaatttcgaaattc

SEQ ID NO: 11069 - DNA, 730 bp, Artificial Sequence
  chemically treated genomic DNA (Homo sapiens) CpG-island No: 11069
atagtcgtttttagcgatgttttatcggttcgcgtttttatttgtttagaaattatcgtaaaggacggatggcgggtaagttttttcgtagtacgggttttatttagtgaggaatatagtcggatattacgattattgcgggttagatcgtttagggtggtattgtttattgttatttgtgtgacggaggtaaaaatcgtcgtattgtcgttgacggaatgttcgggcgtttttatttagtcgttttttagttttagtgtcgtgaacggtgaatcgtttataggtagggtggtcggtttagttcgtttcggtataataatcgttatcgtatttttattgacggatgttatttgtaggcggttatcgtcggagacgcggagttcgggaattttttttgttatttttagtcgttcgtcgtttgttatcggtatttttttcggtcggaatagcgattagttgttgtttagggaggaaatacgtattatttgcgttttattttgcgtatttcgtagattaggttgtgattttgcgtcgttattcggtcgataatatagcggttatgattgcgtgttttcgggttttattgttttattattattttcggacggtatatatttcgtagataacggtttcggttgtttagttagatcggtgaaagggtagttatggttattttcgggagttcgagtacgttttgtgtttttagtttaatgcgaatggtttgtgttag

SEQ ID NO: 11070 - DNA, 730 bp, Artificial Sequence
  chemically treated genomic DNA (Homo sapiens) CpG-island No: 11070
ctaacacaaaccattcgcattaaactaaaaacacaaaacgtactcgaactcccgaaaataaccataactaccctttcaccgatctaactaaacaaccgaaaccgttatctacgaaatatataccgtccgaaaataataataaaacaataaaacccgaaaacacgcaatcataaccgctatattatcgaccgaataacgacgcaaaatcacaacctaatctacgaaatacgcaaaataaaacgcaaataatacgtatttcctccctaaacaacaactaatcgctattccgaccgaaaaaaataccgataacaaacgacgaacgactaaaaataacaaaaaaaattcccgaactccgcgtctccgacgataaccgcctacaaataacatccgtcaataaaaatacgataacgattattataccgaaacgaactaaaccgaccaccctacctataaacgattcaccgttcacgacactaaaactaaaaaacgactaaataaaaacgcccgaacattccgtcaacgacaatacgacgatttttacctccgtcacacaaataacaataaacaataccaccctaaacgatctaacccgcaataatcgtaatatccgactatattcctcactaaataaaacccgtactacgaaaaaacttacccgccatccgtcctttacgataatttctaaacaaataaaaacgcgaaccgataaaacatcgctaaaaacgactat

SEQ ID NO: 11071 - DNA, 730 bp, Artificial Sequence
  chemically treated genomic DNA (Homo sapiens) CpG-island No: 11071
ttgatataggttattcgtattgagttgaaaatatagggcgtgttcggattttcggaggtgattatgattgtttttttatcggtttggttggatagtcggagtcgttatttgcgggatatgtatcgttcggggatggtgatggagtagtggaattcggagatacgtagttatgatcgttatgttatcgatcgggtgacggcgtagagttatagtttgatttgcgggatgcgtagggtgaaacgtaggtggtgcgtattttttttttggatagtagttggtcgttgtttcggtcggaaaaaatgtcggtggtagacggcgagcgattgagggtgatagggaaaattttcggatttcgcgttttcggcggtgatcgtttgtaggtggtattcgttagtgaagatgcgatgacggttgttgtgtcgggacgggttgaatcggttattttgtttgtgagcgatttatcgtttacggtattgaagttggagaacggttgggtggaaacgttcgggtatttcgttagcgatagtgcgacggtttttgttttcgttatatagatggtaatggataatgttattttgaacggtttggttcgtagtggtcgtgatgttcggttgtattttttattggatgaaattcgtattgcggaaaaatttgttcgttattcgttttttacggtggtttttgagtagataaagacgcgggtcggtgagatatcgttggaaacggttat

SEQ ID NO: 11072 - DNA, 730 bp, Artificial Sequence
  chemically treated genomic DNA (Homo sapiens) CpG-island No: 11072
ataaccgtttccaacgatatctcaccgacccgcgtctttatctactcaaaaaccaccgtaaaaaacgaataacgaacaaatttttccgcaatacgaatttcatccaataaaaaatacaaccgaacatcacgaccactacgaaccaaaccgttcaaaataacattatccattaccatctatataacgaaaacaaaaaccgtcgcactatcgctaacgaaatacccgaacgtttccacccaaccgttctccaacttcaataccgtaaacgataaatcgctcacaaacaaaataaccgattcaacccgtcccgacacaacaaccgtcatcgcatcttcactaacgaataccacctacaaacgatcaccgccgaaaacgcgaaatccgaaaattttccctatcaccctcaatcgctcgccgtctaccaccgacattttttccgaccgaaacaacgaccaactactatccaaaaaaaaaatacgcaccacctacgtttcaccctacgcatcccgcaaatcaaactataactctacgccgtcacccgatcgataacataacgatcataactacgtatctccgaattccactactccatcaccatccccgaacgatacatatcccgcaaataacgactccgactatccaaccaaaccgataaaaaaacaatcataatcacctccgaaaatccgaacacgccctatattttcaactcaatacgaataacctatatcaa

SEQ ID NO: 11073 - DNA, 634 bp, Artificial Sequence
  chemically treated genomic DNA (Homo sapiens) CpG-island No: 11073
cgtttcgttttcggcggggcggtgtggttgtttattaggcggtattagttaggttatcggtacgtttagtggtattcgtttgtgggcgtggtgtatatatttagttaggtatttagcggttgttttttatgtggaattttgtatgtttagtcgtatcgtttttttttatttttttcgcgtttcgtgtagtatcggatagttcggttttatttagggttgcgataatttgcggtttttttaggtgttcgaagaagtttgtttttgtcggttgttattagtcgcgtatgtggaattcgatagcggtttttagcgggttaagcggattgcgtgacgtgtgattatattcgcgggtttgaacgtcgtggatgttgtacgtaatgtagaaattgagtagggataatagtattttttggttgagtgataggaacgtcgttatgtttcgtgattattttttcggtaataggacgattaaacgtgttttttttgttattagcgttatgaatgcggtattttttttttttgacggcgtatcgttggttagcgaataatgtttatattttaggttgatttgtgttggtttattgtacgtttcgttgttaaatatatttaggtagagcgtttatgttagtagtgt

SEQ ID NO: 11074 - DNA, 634 bp, Artificial Sequence
  chemically treated genomic DNA (Homo sapiens) CpG-island No: 11074
acactactaacataaacgctctacctaaatatatttaacaacgaaacgtacaataaaccaacacaaatcaacctaaaatataaacattattcgctaaccaacgatacgccgtcaaaaaaaaaaaataccgcattcataacgctaataacaaaaaaaacacgtttaatcgtcctattaccgaaaaaataatcacgaaacataacgacgttcctatcactcaaccaaaaaatactattatccctactcaatttctacattacgtacaacatccacgacgttcaaacccgcgaatataatcacacgtcacgcaatccgcttaacccgctaaaaaccgctatcgaattccacatacgcgactaataacaaccgacaaaaacaaacttcttcgaacacctaaaaaaaccgcaaattatcgcaaccctaaataaaaccgaactatccgatactacacgaaacgcgaaaaaaataaaaaaaaacgatacgactaaacatacaaaattccacataaaaaacaaccgctaaatacctaactaaatatatacaccacgcccacaaacgaataccactaaacgtaccgataacctaactaataccgcctaataaacaaccacaccgccccgccgaaaacgaaacg

SEQ ID NO: 11075 - DNA, 634 bp, Artificial Sequence
  chemically treated genomic DNA (Homo sapiens) CpG-island No: 11075
gtattgttgatatggacgttttgtttgaatgtgtttggtagcggggcgtatagtaaattagtataaattagtttggaatgtaaatattattcgttgattagcgatgcgtcgttagggaaggaaggtgtcgtatttatggcgttgatggtagaaaaagtacgtttggtcgttttgttgtcggagggatggttacgggatatgacgacgtttttgttatttagttaggaggtgttgttatttttgtttagtttttgtattgcgtgtagtatttacggcgtttagattcgcgagtgtggttatacgttacgtagttcgtttgattcgttggaaatcgttatcggattttatatgcgcgattggtggtagtcgataaaagtaaattttttcggatatttgaaaaagtcgtagattatcgtagttttgaatgaggtcggattgttcggtgttgtacgggacgcggagaagatgaagaaaggcgatgcggttgaatatgtagagttttatatgaaagataatcgttgggtgtttggttggatgtgtgtattacgtttatagacggatgttattgaacgtatcgataatttggttgatgtcgtttgatgaataattatatcgtttcgtcggagacggggcg

SEQ ID NO: 11076 - DNA, 634 bp, Artificial Sequence
  chemically treated genomic DNA (Homo sapiens) CpG-island No: 11076
cgccccgtctccgacgaaacgatataattattcatcaaacgacatcaaccaaattatcgatacgttcaataacatccgtctataaacgtaatacacacatccaaccaaacacccaacgattatctttcatataaaactctacatattcaaccgcatcgcctttcttcatcttctccgcgtcccgtacaacaccgaacaatccgacctcattcaaaactacgataatctacgactttttcaaatatccgaaaaaatttacttttatcgactaccaccaatcgcgcatataaaatccgataacgatttccaacgaatcaaacgaactacgtaacgtataaccacactcgcgaatctaaacgccgtaaatactacacgcaatacaaaaactaaacaaaaataacaacacctcctaactaaataacaaaaacgtcgtcatatcccgtaaccatccctccgacaacaaaacgaccaaacgtactttttctaccatcaacgccataaatacgacaccttccttccctaacgacgcatcgctaatcaacgaataatatttacattccaaactaatttatactaatttactatacgccccgctaccaaacacattcaaacaaaacgtccatatcaacaatac

SEQ ID NO: 11077 - DNA, 562 bp, Artificial Sequence
  chemically treated genomic DNA (Homo sapiens) CpG-island No: 11077
tggcgtttttgtatgtatatcgtggattttttttcgggtatgggttatatacgcggttttcgttattttgtttgattcgtataacgttcggtagttatcgtaagtatcggtttgaaatatatcgttgtaatcggttaggtgattttgtgaatggatatttttttagtaggattgtacgcgaattagatcgtcgggggtattttcgagtcggtattacggttattacggacgtagtattattgtcggacggttcgagttttatcggttattagtatatattggcgtagtatgttatatagtagttttagtagttcgtaacggaatagatttagcgtggtacgttttagttatacgttttggcgacggtatatttttgattcgcggtataatggtagatggtttgtatatttttcggtgattatatgggtttaaagtttcggttcggaataattgttgaaggtttaggtgtttgtacgatatagttgtatcggtaataggtttgtttcgggcgttgtgtttcgataattttaaaggtgtagttgataagttttagtagttttga

SEQ ID NO: 11078 - DNA, 562 bp, Artificial Sequence
  chemically treated genomic DNA (Homo sapiens) CpG-island No: 11078
tcaaaactactaaaacttatcaactacacctttaaaattatcgaaacacaacgcccgaaacaaacctattaccgatacaactatatcgtacaaacacctaaaccttcaacaattattccgaaccgaaactttaaacccatataatcaccgaaaaatatacaaaccatctaccattataccgcgaatcaaaaatataccgtcgccaaaacgtataactaaaacgtaccacgctaaatctattccgttacgaactactaaaactactatataacatactacgccaatatatactaataaccgataaaactcgaaccgtccgacaataatactacgtccgtaataaccgtaataccgactcgaaaatacccccgacgatctaattcgcgtacaatcctactaaaaaaatatccattcacaaaatcacctaaccgattacaacgatatatttcaaaccgatacttacgataactaccgaacgttatacgaatcaaacaaaataacgaaaaccgcgtatataacccatacccgaaaaaaaatccacgatatacatacaaaaacgcca

SEQ ID NO: 11079 - DNA, 562 bp, Artificial Sequence
  chemically treated genomic DNA (Homo sapiens) CpG-island No: 11079
ttagagttgttagagtttattagttgtatttttaaggttatcgaaatataacgttcgaaataggtttgttgtcggtgtaattatatcgtgtagatatttgagtttttagtagttatttcggatcggggttttaggtttatgtagttatcgggaaatatgtagattatttgttattatatcgcgagttagaaatatatcgtcgttagggcgtgtagttgaggcgtgttacgttggatttgtttcgttgcgaattattggagttgttgtataatatattgcgttagtatgtgttgatggtcggtaaaattcgaatcgttcggtagtggtgttacgttcgtgatgatcgtgatgtcggttcggagatgttttcggcggtttggttcgcgtatagttttgttggaaaggtatttatttataaaattatttggtcggttatagcggtgtgttttaagtcgatgtttacggtggttatcgggcgttatacgaattaggtagaataacggaagtcgcgtgtatggtttatgttcggagaaaaatttacgatgtgtatgtaagagcgtta

SEQ ID NO: 11080 - DNA, 562 bp, Artificial Sequence
  chemically treated genomic DNA (Homo sapiens) CpG-island No: 11080
taacgctcttacatacacatcgtaaatttttctccgaacataaaccatacacgcgacttccgttattctacctaattcgtataacgcccgataaccaccgtaaacatcgacttaaaacacaccgctataaccgaccaaataattttataaataaatacctttccaacaaaactatacgcgaaccaaaccgccgaaaacatctccgaaccgacatcacgatcatcacgaacgtaacaccactaccgaacgattcgaattttaccgaccatcaacacatactaacgcaatatattatacaacaactccaataattcgcaacgaaacaaatccaacgtaacacgcctcaactacacgccctaacgacgatatatttctaactcgcgatataataacaaataatctacatatttcccgataactacataaacctaaaaccccgatccgaaataactactaaaaactcaaatatctacacgatataattacaccgacaacaaacctatttcgaacgttatatttcgataaccttaaaaatacaactaataaactctaacaactctaa

SEQ ID NO: 11081 - DNA, 651 bp, Artificial Sequence
  chemically treated genomic DNA (Homo sapiens) CpG-island No: 11081
tggcgtgttaggcgtttaataagtatatcggaattaaagcgatagcgatgttttatatcgtttagtttggttcgaaggttatatatggtgttggttattttcgttacgtcggcgcgaagttttttatgttcggtatagtttatttacgtagttttcggtataaattagttattatttgtagttttttgttgtatgggtcgttgtacggtagttagacgttgttgttcggtacggtgatattgtttaagtagttcgatatcgatatatcggcgttcggattgaacggcggttatataggttgagtcgttgtttgtaaacgggtttagtataatcgcgttcgggtgtgtgaagtttttaattagtggttgtaggttggtaataggttttttcgtcgggtgatgacgattgtttgaatatttttagtttaatacgtcgggtaatggtttttgaggtagcgtcggacgtttttttgtaggatgtaagcgtattcggggggatagtttatatatgtagttttcgatgtgtacggtttggggaatattatgggggtaattacgtttgaattcggattttttaggtcggtataaagcggatcgaggcggtttagttattaaagttttttatagcgggattttttttagacgtcggtta

SEQ ID NO: 11082 - DNA, 651 bp, Artificial Sequence
  chemically treated genomic DNA (Homo sapiens) CpG-island No: 11082
taaccgacgtctaaaaaaaatcccgctataaaaaactttaataactaaaccgcctcgatccgctttataccgacctaaaaaatccgaattcaaacgtaattacccccataatattccccaaaccgtacacatcgaaaactacatatataaactatccccccgaatacgcttacatcctacaaaaaaacgtccgacgctacctcaaaaaccattacccgacgtattaaactaaaaatattcaaacaatcgtcatcacccgacgaaaaaacctattaccaacctacaaccactaattaaaaacttcacacacccgaacgcgattatactaaacccgtttacaaacaacgactcaacctatataaccgccgttcaatccgaacgccgatatatcgatatcgaactacttaaacaatatcaccgtaccgaacaacaacgtctaactaccgtacaacgacccatacaacaaaaaactacaaataataactaatttataccgaaaactacgtaaataaactataccgaacataaaaaacttcgcgccgacgtaacgaaaataaccaacaccatatataaccttcgaaccaaactaaacgatataaaacatcgctatcgctttaattccgatatacttattaaacgcctaacacgcca

SEQ ID NO: 11083 - DNA, 651 bp, Artificial Sequence
  chemically treated genomic DNA (Homo sapiens) CpG-island No: 11083
tgatcggcgtttaaaaaaaatttcgttatggggagttttaatggttgaatcgtttcgattcgttttatgtcggtttgaaaaattcggatttaagcgtggttgtttttatggtgttttttaaatcgtatatatcgagggttgtatatgtgggttattttttcgaatgcgtttatattttgtaaaagagcgttcggcgttgttttagaagttattgttcgacgtgttgggttggaaatatttaggtaatcgttattattcgacggaaaagtttgttattagtttgtaattattgattgagagttttatatattcgaacgcgattgtgttggattcgtttgtaggtagcggtttaatttgtgtggtcgtcgtttagttcggacgtcggtatatcggtatcgagttgtttgaatagtattatcgtgtcggatagtaacgtttggttgtcgtatagcggtttatgtagtagggggttgtaaatgatgattggtttatgtcggaggttgcgtaaatgaattatgtcggatataaaaaatttcgcgtcgacgtggcggaggtggttaatattatgtgtgattttcgggttaggttgaacgatatggagtatcgttgtcgttttgatttcgatgtgtttgttgaacgtttggtacgtta

SEQ ID NO: 11084 - DNA, 651 bp, Artificial Sequence
  chemically treated genomic DNA (Homo sapiens) CpG-island No: 11084
taacgtaccaaacgttcaacaaacacatcgaaatcaaaacgacaacgatactccatatcgttcaacctaacccgaaaatcacacataatattaaccacctccgccacgtcgacgcgaaattttttatatccgacataattcatttacgcaacctccgacataaaccaatcatcatttacaaccccctactacataaaccgctatacgacaaccaaacgttactatccgacacgataatactattcaaacaactcgataccgatataccgacgtccgaactaaacgacgaccacacaaattaaaccgctacctacaaacgaatccaacacaatcgcgttcgaatatataaaactctcaatcaataattacaaactaataacaaacttttccgtcgaataataacgattacctaaatatttccaacccaacacgtcgaacaataacttctaaaacaacgccgaacgctcttttacaaaatataaacgcattcgaaaaaataacccacatatacaaccctcgatatatacgatttaaaaaacaccataaaaacaaccacgcttaaatccgaatttttcaaaccgacataaaacgaatcgaaacgattcaaccattaaaactccccataacgaaattttttttaaacgccgatca

SEQ ID NO: 11085 - DNA, 583 bp, Artificial Sequence
  chemically treated genomic DNA (Homo sapiens) CpG-island No: 11085
taggcggttataaagcgatcgacgcggttttagttatagaagtttattattagcgtatttttttttagtacgcggtatattttattataggtcggttgtagttatttatcggttttatcgtcggcgatggtacgtttttgacggttacggaaatcgacgagatatggcgggtcggtgaggatgaaatcgatagtattgttcggaaacgtggttataatacgtacgtagttattttggataaaacgggatataatagtatttttttttttatagagggtatcgggagggcgtttttgtggcgttcgtttttcgcggtttgtgggttgtttatcgcgttcggtaacgggttaggtcgatcgtggaatatcgtagtcgtcgtttttttgacggcgagaatatgtcgcgaaaggtttggaagggcgtttaattagaaagggttacgggttggcggatattgttatcgatggtaatcgggatcggtaaaaacgttcgtttcgtggttagtcgggaggggggttattgttataggaagggtttttttcgtttttttgaaaacgtggaggatagagataattaattttat

SEQ ID NO: 11086 - DNA, 583 bp, Artificial Sequence
  chemically treated genomic DNA (Homo sapiens) CpG-island No: 11086
ataaaattaattatctctatcctccacgttttcaaaaaaacgaaaaaaacccttcctataacaataacccccctcccgactaaccacgaaacgaacgtttttaccgatcccgattaccatcgataacaatatccgccaacccgtaaccctttctaattaaacgcccttccaaacctttcgcgacatattctcgccgtcaaaaaaacgacgactacgatattccacgatcgacctaacccgttaccgaacgcgataaacaacccacaaaccgcgaaaaacgaacgccacaaaaacgccctcccgataccctctataaaaaaaaaaatactattatatcccgttttatccaaaataactacgtacgtattataaccacgtttccgaacaatactatcgatttcatcctcaccgacccgccatatctcgtcgatttccgtaaccgtcaaaaacgtaccatcgccgacgataaaaccgataaataactacaaccgacctataataaaatataccgcgtactaaaaaaaaatacgctaataataaacttctataactaaaaccgcgtcgatcgctttataaccgccta

SEQ ID NO: 11087 - DNA, 583 bp, Artificial Sequence
  chemically treated genomic DNA (Homo sapiens) CpG-island No: 11087
gtaaggttggttgtttttgttttttacgtttttaaggggacgggaggaattttttttgtggtagtggtttttttttcggttggttacgggacgggcgtttttatcggtttcggttgttatcggtgataatgttcgttagttcgtggttttttttgattgaacgtttttttaagtttttcgcggtatattttcgtcgttaaaaagacgacggttgcgatattttacggtcggtttgattcgttatcggacgcggtgaatagtttataggtcgcggggaacgggcgttataggggcgttttttcggtgttttttgtaagagaaggagtgttgttatgtttcgttttatttagggtgattgcgtgcgtgttatggttacgttttcgggtaatgttgtcgattttatttttatcgattcgttatatttcgtcggttttcgtgatcgttaggggcgtattatcgtcggcgataaaatcgatgaatggttgtaatcggtttgtaatgaaatgtatcgcgtgttgaaaaaagatgcgttgatggtgagtttttatggttggaatcgcgtcgatcgttttatggtcgtttg

SEQ ID NO: 11088 - DNA, 583 bp, Artificial Sequence
  chemically treated genomic DNA (Homo sapiens) CpG-island No: 11088
caaacgaccataaaacgatcgacgcgattccaaccataaaaactcaccatcaacgcatcttttttcaacacgcgatacatttcattacaaaccgattacaaccattcatcgattttatcgccgacgataatacgcccctaacgatcacgaaaaccgacgaaatataacgaatcgataaaaataaaatcgacaacattacccgaaaacgtaaccataacacgcacgcaatcaccctaaataaaacgaaacataacaacactccttctcttacaaaaaacaccgaaaaaacgcccctataacgcccgttccccgcgacctataaactattcaccgcgtccgataacgaatcaaaccgaccgtaaaatatcgcaaccgtcgtctttttaacgacgaaaatataccgcgaaaaacttaaaaaaacgttcaatcaaaaaaaaccacgaactaacgaacattatcaccgataacaaccgaaaccgataaaaacgcccgtcccgtaaccaaccgaaaaaaaaaccactaccacaaaaaaaattcctcccgtccccttaaaaacgtaaaaaacaaaaacaaccaaccttac

SEQ ID NO: 11089 - DNA, 512 bp, Artificial Sequence
  chemically treated genomic DNA (Homo sapiens) CpG-island No: 11089
ttcggttgggattggattttaaaaaggtaagaacgttggtacggaagcggcgtcggttatttttttcgtttcgaaattattgagttcggttcgttgcgtttgaagattcgcgtgacggtttagtttttcggagaacgttcgggggtttggtatattatatttcgtttgtatttgttgattatcggttaggatttcgtggtgtcgtacggttgggaagcgttattcgaattgttgggtttgtttacgttgtatgttcggtattcggaagttttgacgtacggttattagggggagcgagtgatgtttttttcgttcggaaacgttacgtcggagggttttttcgggatagacggtttgcggatttttatgtcggcggaggtttttgagacgttggttcgggagttcgttacgcggtgttaagaaggttcgttggcggaggttttgatcgggttgcgttgtttgtacggagatttgtaatatgaagatattgaggtagttgtggaattagaaag

SEQ ID NO: 11090 - DNA, 512 bp, Artificial Sequence
  chemically treated genomic DNA (Homo sapiens) CpG-island No: 11090
ctttctaattccacaactacctcaatatcttcatattacaaatctccgtacaaacaacgcaacccgatcaaaacctccgccaacgaaccttcttaacaccgcgtaacgaactcccgaaccaacgtctcaaaaacctccgccgacataaaaatccgcaaaccgtctatcccgaaaaaaccctccgacgtaacgtttccgaacgaaaaaaacatcactcgctccccctaataaccgtacgtcaaaacttccgaataccgaacatacaacgtaaacaaacccaacaattcgaataacgcttcccaaccgtacgacaccacgaaatcctaaccgataatcaacaaatacaaacgaaatataatataccaaacccccgaacgttctccgaaaaactaaaccgtcacgcgaatcttcaaacgcaacgaaccgaactcaataatttcgaaacgaaaaaaataaccgacgccgcttccgtaccaacgttcttacctttttaaaatccaatcccaaccgaa

SEQ ID NO: 11091 - DNA, 512 bp, Artificial Sequence
  chemically treated genomic DNA (Homo sapiens) CpG-island No: 11091
ttttttggttttatagttgttttagtatttttatattatagattttcgtataggtagcgtagttcggttagggttttcgttagcgggtttttttgatatcgcgtggcgagttttcggattagcgttttaaaggttttcgtcggtataaaaattcgtaggtcgtttatttcgaagaagtttttcggcgtgacgttttcgggcggggagaatattattcgttttttttggtgatcgtgcgttagggttttcggatgtcgggtatatagcgtgaataggtttagtagttcggataacgttttttagtcgtacggtattacgaagttttggtcggtgattagtaagtgtaaacggggtgtggtgtattaggttttcgggcgtttttcggggggttgggtcgttacgcggatttttaggcgtaacgggtcgggtttaatggtttcgggacggaaaaaataatcggcgtcgttttcgtgttagcgtttttgtttttttggggtttagttttagtcggg

SEQ ID NO: 11092 - DNA, 512 bp, Artificial Sequence
  chemically treated genomic DNA (Homo sapiens) CpG-island No: 11092
cccgactaaaactaaaccccaaaaaaacaaaaacgctaacacgaaaacgacgccgattattttttccgtcccgaaaccattaaacccgacccgttacgcctaaaaatccgcgtaacgacccaaccccccgaaaaacgcccgaaaacctaatacaccacaccccgtttacacttactaatcaccgaccaaaacttcgtaataccgtacgactaaaaaacgttatccgaactactaaacctattcacgctatatacccgacatccgaaaaccctaacgcacgatcaccaaaaaaaacgaataatattctccccgcccgaaaacgtcacgccgaaaaacttcttcgaaataaacgacctacgaatttttataccgacgaaaacctttaaaacgctaatccgaaaactcgccacgcgatatcaaaaaaacccgctaacgaaaaccctaaccgaactacgctacctatacgaaaatctataatataaaaatactaaaacaactataaaaccaaaaaa

SEQ ID NO: 11093 - DNA, 596 bp, Artificial Sequence
  chemically treated genomic DNA (Homo sapiens) CpG-island No: 11093
atattttcgttagtagtggtagattgattttttttattgacgtttttttttgtatttgtttcgtgcggttagcgtcgttagttacgttatttttattgcgtaattgtatattacgttggatatatatattatcgtaacgttaggatattattacgttattttcggtacgtattttcggcgtgtacgttttgattttcgttatgtagttaattagttttatttttgttgttagtaggttagattttttatattggggtttttagcgcgtcgtaacgtattattagttcgggtaggcgttttttttttgcgttcgttagtatcgggttcggtttcggtagttgcggtatgttcgggagtttttacggtatttatcgagaggttttatgcgttcggcgtattatttttagtcgtcggtttttcgaaggtgtttagcgatagtttggagtttttttagtagggcggtatcgagcgttacgtagtttatatagttattttcgttatcgttgaataaattagtacgtattcgttaggtgagaaagtattagcgtttacgaagcggaatttagtgttgttttttatcgttattttatttttcg

SEQ ID NO: 11094 - DNA, 596 bp, Artificial Sequence
  chemically treated genomic DNA (Homo sapiens) CpG-island No: 11094
cgaaaaataaaataacgataaaaaacaacactaaattccgcttcgtaaacgctaatactttctcacctaacgaatacgtactaatttattcaacgataacgaaaataactatataaactacgtaacgctcgataccgccctactaaaaaaactccaaactatcgctaaacaccttcgaaaaaccgacgactaaaaataatacgccgaacgcataaaacctctcgataaataccgtaaaaactcccgaacataccgcaactaccgaaaccgaacccgatactaacgaacgcaaaaaaaaaacgcctacccgaactaataatacgttacgacgcgctaaaaaccccaatataaaaaatctaacctactaacaacaaaaataaaactaattaactacataacgaaaatcaaaacgtacacgccgaaaatacgtaccgaaaataacgtaataatatcctaacgttacgataatatatatatccaacgtaatatacaattacgcaataaaaataacgtaactaacgacgctaaccgcacgaaacaaatacaaaaaaaaacgtcaataaaaaaaatcaatctaccactactaacgaaaatat

SEQ ID NO: 11095 - DNA, 596 bp, Artificial Sequence
  chemically treated genomic DNA (Homo sapiens) CpG-island No: 11095
cggaaagtgaagtggcggtgaaggataatattaaatttcgtttcgtgggcgttgatgtttttttatttgacgaatgcgtattgatttgtttagcgatgacgagggtggttatgtggattgcgtggcgttcgatgtcgttttgttggaaaaattttaggttgtcgttgaatattttcgggaagtcgacggttgggaatggtgcgtcggacgtatggagtttttcggtgagtgtcgtgaagattttcgggtatatcgtaattgtcggagtcggattcggtgttgacggacgtagaagaagaacgtttgttcgaattgatgatgcgttacgacgcgttggaaattttagtgtgaggaatttgatttgttggtagtagaaatgaagttgattgattgtatggcgaaggttagggcgtgtacgtcggagatgcgtgtcggaagtggcgtggtggtgttttggcgttacggtaatgtgtgtgtttagcgtggtgtgtagttgcgtagtgaagatgacgtgattgacgacgttgatcgtacggaataggtgtaggaaaaagcgttagtggaggaaattagtttgttattattgacgaaaatgt

SEQ ID NO: 11096 - DNA, 596 bp, Artificial Sequence
  chemically treated genomic DNA (Homo sapiens) CpG-island No: 11096
acattttcgtcaataataacaaactaatttcctccactaacgctttttcctacacctattccgtacgatcaacgtcgtcaatcacgtcatcttcactacgcaactacacaccacgctaaacacacacattaccgtaacgccaaaacaccaccacgccacttccgacacgcatctccgacgtacacgccctaaccttcgccatacaatcaatcaacttcatttctactaccaacaaatcaaattcctcacactaaaatttccaacgcgtcgtaacgcatcatcaattcgaacaaacgttcttcttctacgtccgtcaacaccgaatccgactccgacaattacgatatacccgaaaatcttcacgacactcaccgaaaaactccatacgtccgacgcaccattcccaaccgtcgacttcccgaaaatattcaacgacaacctaaaatttttccaacaaaacgacatcgaacgccacgcaatccacataaccaccctcgtcatcgctaaacaaatcaatacgcattcgtcaaataaaaaaacatcaacgcccacgaaacgaaatttaatattatccttcaccgccacttcactttccg

SEQ ID NO: 11097 - DNA, 629 bp, Artificial Sequence
  chemically treated genomic DNA (Homo sapiens) CpG-island No: 11097
cggttcgtagatgttatcggcggtttggttcgcgtatagttttgttggaaaggtatttatttttaaaattatttggtcggttatagcggtgtgttttaagtcgatgtttacggtggttatcgggcgttatacgaattaggtagaataacggaagtcgcgtgtatggtttatgttcggagaaaaatttacgatgtgtatgtaagagcgttaatcgacgttattacggaagttttgtagcgtattagtgaattgtatgttatcgaggttgcggttcggggttgtttagtagaatagcgtttggcggtaagaaaagttagatttgcgttattgatgtagttattgtacgattggatatagatttagatgaaaatattggcgcgttattcggatacggtaaaagcgtttgtatatttgttgtagtagcgggatgttcggaacgtgtattgtagtaatggttgggtggaaatcgataataatatcgtagagaacgttttacggggagtggttataggtcggaagaattggtttttcgcgggtggatttgttttaaatttttagatattgttaattattaatttattataaagtcgtggtcgcgatattttcgtgggcgatcgattattagcgat

SEQ ID NO: 11098 - DNA, 629 bp, Artificial Sequence
  chemically treated genomic DNA (Homo sapiens) CpG-island No: 11098
atcgctaataatcgatcgcccacgaaaatatcgcgaccacgactttataataaattaataattaacaatatctaaaaatttaaaacaaatccacccgcgaaaaaccaattcttccgacctataaccactccccgtaaaacgttctctacgatattattatcgatttccacccaaccattactacaatacacgttccgaacatcccgctactacaacaaatatacaaacgcttttaccgtatccgaataacgcgccaatattttcatctaaatctatatccaatcgtacaataactacatcaataacgcaaatctaacttttcttaccgccaaacgctattctactaaacaaccccgaaccgcaacctcgataacatacaattcactaatacgctacaaaacttccgtaataacgtcgattaacgctcttacatacacatcgtaaatttttctccgaacataaaccatacacgcgacttccgttattctacctaattcgtataacgcccgataaccaccgtaaacatcgacttaaaacacaccgctataaccgaccaaataattttaaaaataaatacctttccaacaaaactatacgcgaaccaaaccgccgataacatctacgaaccg

SEQ ID NO: 11099 - DNA, 629 bp, Artificial Sequence
  chemically treated genomic DNA (Homo sapiens) CpG-island No: 11099
gtcgttggtaatcggtcgtttacgggaatatcgcggttacggttttgtaatgggttaatgattaatagtgtttggaaatttagggtaaatttattcgcgaagagttagttttttcggtttatggttatttttcgtaaggcgttttttgcgatgttgttgtcgatttttatttaattattattgtagtatacgtttcgagtatttcgttattgtagtaggtatgtaaacgtttttgtcgtattcgagtgacgcgttagtgtttttatttgagtttgtatttagtcgtatagtgattgtattagtggcgtaggtttggttttttttgtcgttagacgttgttttgttgaatagtttcggatcgtaatttcgatggtatatagtttattgatacgttgtagggttttcgtggtgacgtcggttggcgtttttgtatgtatatcgtggattttttttcgggtatgggttatatacgcggttttcgttattttgtttgattcgtataacgttcggtagttatcgtaagtatcggtttgaaatatatcgttgtaatcggttaagtgattttgggaatggatatttttttagtaggattgtacgcgaattagatcgtcggtggtatttacgagtcg

SEQ ID NO: 11100 - DNA, 629 bp, Artificial Sequence
  chemically treated genomic DNA (Homo sapiens) CpG-island No: 11100
cgactcgtaaataccaccgacgatctaattcgcgtacaatcctactaaaaaaatatccattcccaaaatcacttaaccgattacaacgatatatttcaaaccgatacttacgataactaccgaacgttatacgaatcaaacaaaataacgaaaaccgcgtatataacccatacccgaaaaaaaatccacgatatacatacaaaaacgccaaccgacgtcaccacgaaaaccctacaacgtatcaataaactatataccatcgaaattacgatccgaaactattcaacaaaacaacgtctaacgacaaaaaaaaccaaacctacgccactaatacaatcactatacgactaaatacaaactcaaataaaaacactaacgcgtcactcgaatacgacaaaaacgtttacatacctactacaataacgaaatactcgaaacgtatactacaataataattaaataaaaatcgacaacaacatcgcaaaaaacgccttacgaaaaataaccataaaccgaaaaaactaactcttcgcgaataaatttaccctaaatttccaaacactattaatcattaacccattacaaaaccgtaaccgcgatattcccgtaaacgaccgattaccaacgac

SEQ ID NO: 11101 - DNA, 513 bp, Artificial Sequence
  chemically treated genomic DNA (Homo sapiens) CpG-island No: 11101
gtttcgcgcgttcgttcgtttttaaggatttgacgggggtttttaggttgggtttagttatttcgttcgcgtgtcggggaagaagttcgttttcggttgtttttagttattttcgagcgttgatttttagatttgggttttacgtgggagggcgggcgtaagggaggagtcgaggttagagagcgagttttcggaggggtcggttttcgatttgttcgggtcgcgtggtttcgggtttagattttagtagggtttttttcgcggttttttttaatttggaggttgagtttaggttgttacgcgtggggcgcggaggggcgagttagtggagtcggttttcgggaaatttttgggggcggtagagcgataggagcgcgtttttttttgtggcgtttcgcgtaggcggttggtatacgtcgatagggagtttattttttaatagttttagtagagttgaattcggttatttttggcggcgttcggatagcgtttttaggatagttaggattttta

SEQ ID NO: 11102 - DNA, 513 bp, Artificial Sequence
  chemically treated genomic DNA (Homo sapiens) CpG-island No: 11102
taaaaatcctaactatcctaaaaacgctatccgaacgccgccaaaaataaccgaattcaactctactaaaactattaaaaaataaactccctatcgacgtataccaaccgcctacgcgaaacgccacaaaaaaaaacgcgctcctatcgctctaccgcccccaaaaatttcccgaaaaccgactccactaactcgcccctccgcgccccacgcgtaacaacctaaactcaacctccaaattaaaaaaaaccgcgaaaaaaaccctactaaaatctaaacccgaaaccacgcgacccgaacaaatcgaaaaccgacccctccgaaaactcgctctctaacctcgactcctcccttacgcccgccctcccacgtaaaacccaaatctaaaaatcaacgctcgaaaataactaaaaacaaccgaaaacgaacttcttccccgacacgcgaacgaaataactaaacccaacctaaaaacccccgtcaaatccttaaaaacgaacgaacgcgcgaaac

SEQ ID NO: 11103 - DNA, 513 bp, Artificial Sequence
  chemically treated genomic DNA (Homo sapiens) CpG-island No: 11103
tgagggttttggttgttttgaggacgttgttcgggcgtcgttaggggtgatcgaatttagttttgttaggattgttgggaaatgagttttttgtcggcgtgtgttagtcgtttgcgcgaggcgttataggagagggcgcgtttttgtcgttttgtcgtttttagaagtttttcgggaatcgattttattgattcgttttttcgcgttttacgcgtggtagtttaagtttagtttttagattggaggagatcgcggagggaattttgttggggtttgggttcggggttacgcggttcgagtagatcgagggtcgattttttcgagaattcgttttttggtttcggttttttttttgcgttcgtttttttacgtggggtttaggtttgggaattagcgttcgggggtggttggggataatcgagaacgagtttttttttcggtacgcgggcggaatggttgagtttagtttggaagttttcgttaggtttttgggggcgggcgggcgcgcgaagt

SEQ ID NO: 11104 - DNA, 513 bp, Artificial Sequence
  chemically treated genomic DNA (Homo sapiens) CpG-island No: 11104
acttcgcgcgcccgcccgcccccaaaaacctaacgaaaacttccaaactaaactcaaccattccgcccgcgtaccgaaaaaaaaactcgttctcgattatccccaaccacccccgaacgctaattcccaaacctaaaccccacgtaaaaaaacgaacgcaaaaaaaaaaccgaaaccaaaaaacgaattctcgaaaaaatcgaccctcgatctactcgaaccgcgtaaccccgaacccaaaccccaacaaaattccctccgcgatctcctccaatctaaaaactaaacttaaactaccacgcgtaaaacgcgaaaaaacgaatcaataaaatcgattcccgaaaaacttctaaaaacgacaaaacgacaaaaacgcgccctctcctataacgcctcgcgcaaacgactaacacacgccgacaaaaaactcatttcccaacaatcctaacaaaactaaattcgatcacccctaacgacgcccgaacaacgtcctcaaaacaaccaaaaccctca

SEQ ID NO: 11105 - DNA, 534 bp, Artificial Sequence
  chemically treated genomic DNA (Homo sapiens) CpG-island No: 11105
  misc_feature (159)..(159): n is either a, c, g or t
ttttgcgtcggcgtttttttttttcgtagggttttttttttcgtcgttgtttttttttttttttttttttttttgtggtttgcggtgtttttttttttttttttcgttgcgttatttttcgttttgcggtttttttttttttttattttatcgttattntggtcgcgtcgcgttacgtcgttttttttttttttttttttttcgtcgtttttcgttgtcggttgtttttttgtttttttttttttttttttcgttgttcggttgtttgttttttttttttcgtttgcggttcgttttcgtttggtttgttttttcgtgtttttgtttcgttttgttttttcgtacgtttttttttttttttttttttcggtcgcgtggttttttttttttttttcgtttttttttttttttttttttttttgtttttttttttgttttcgttttcggggcggttattttttttcgttttttttttttgcgttcgtttattttttttttcgttttttattatcgatgagagtgtgaattttttaa

SEQ ID NO: 11106 - DNA, 534 bp, Artificial Sequence
  chemically treated genomic DNA (Homo sapiens) CpG-island No: 11106
  misc_feature (376)..(376): n is either a, c, g or t
ttaaaaaattcacactctcatcgataataaaaaacgaaaaaaaaaataaacgaacgcaaaaaaaaaaaacgaaaaaaaataaccgccccgaaaacgaaaacaaaaaaaaaaacaaaaaaaaaaaaaaaaaaaaaaaaacgaaaaaaaaaaaaaaaaccacgcgaccgaaaaaaaaaaaaaaaaaaaaacgtacgaaaaaacaaaacgaaacaaaaacacgaaaaaacaaaccaaacgaaaacgaaccgcaaacgaaaaaaaaaaaacaaacaaccgaacaacgaaaaaaaaaaaaaaaaaaacaaaaaaacaaccgacaacgaaaaacgacgaaaaaaaaaaaaaaaaaaaaaacgacgtaacgcgacgcgaccanaataacgataaaataaaaaaaaaaaaaaaccgcaaaacgaaaaataacgcaacgaaaaaaaaaaaaaaaaacaccgcaaaccacaaaaaaaaaaaaaaaaaaaaaaaaacaacgacgaaaaaaaaaaccctacgaaaaaaaaaaacgccgacgcaaaa

SEQ ID NO: 11107 - DNA, 534 bp, Artificial Sequence
  chemically treated genomic DNA (Homo sapiens) CpG-island No: 11107
  misc_feature (376)..(376): n is either a, c, g or t
ttaaaaagtttatatttttatcggtaatagggagcgagagagagagtagacgaacgtagagggagaggacgaaagaagatgatcgtttcgaagacgaggatagaaaaggagatagaagaagaagaaggagagagagagcggggggaaagaaagagattacgcgatcggaaagaagaaagaaaagggggcgtacgaaaagataaggcgggatagaaatacgagagagtaggttaaacggagacgggtcgtaggcgaaaaggaagaaataaatagtcggatagcgggaaagagaagaaggagagtagaggagtagtcgatagcgaggagcggcggagagagagagaggaagagaaacgacgtggcgcgacgcggttangatagcggtggagtggaagaaagagaagatcgtagaacgggaagtaacgtagcgaaaagagagaaaggagatatcgtaggttataaagagaagagaagaagagaggaggtagcggcgggagagaggattttacggagaggagggacgtcgacgtaaaa

SEQ ID NO: 11108 - DNA, 534 bp, Artificial Sequence
  chemically treated genomic DNA (Homo sapiens) CpG-island No: 11108
  misc_feature (159)..(159): n is either a, c, g or t
ttttacgtcgacgtccctcctctccgtaaaatcctctctcccgccgctacctcctctcttcttctcttctctttataacctacgatatctcctttctctcttttcgctacgttacttcccgttctacgatcttctctttcttccactccaccgctatcntaaccgcgtcgcgccacgtcgtttctcttcctctctctctctccgccgctcctcgctatcgactactcctctactctccttcttctctttcccgctatccgactatttatttcttccttttcgcctacgacccgtctccgtttaacctactctctcgtatttctatcccgccttatcttttcgtacgcccccttttctttcttctttccgatcgcgtaatctctttctttccccccgctctctctctccttcttcttcttctatctccttttctatcctcgtcttcgaaacgatcatcttctttcgtcctctccctctacgttcgtctactctctctctcgctccctattaccgataaaaatataaactttttaa

SEQ ID NO: 11109 - DNA, 854 bp, Artificial Sequence
  chemically treated genomic DNA (Homo sapiens) CpG-island No: 11109
gttcggggttaggtcgttatttttcgggagtttgatagggaagagcggttaagtttttagtttcgttcgatagtcgagggaattgtacgaagggcgtcgttgattttattattttgagttcgggaaggtttgcgggcggcggtataagaatttagacgggtgtagaaatagggcggagggtgtagggtggcggttcggattgcgttgttggcggttagcggcgcgattttcggtttcggattcggtttcggtttttaatttttagtttcgcgcgggtagaacgtatcgtttggcgattttagttcgcgttttagcgttaaggttgatttggcggttgagcgggcggggcgtttatttggatattcgtagttttcggcgtttttagaatttttcgcggcgtcgttcggttagttcggcgtttttttttttggcgatttcgttttcggtcgttgtcggggtttcgtttatttgagtcgtcgttacgtttttattttacgttttatacgtttgtttgcgttttggtttttagtttcggtggtttcgtcggggttcgttattttttgcgatttttgggaacgtttaggttattcggtttcgcgggagtcggagtcggagtcggagtcggagttggtcgttcgcgttttttatgtcgttcgtagtttatcgtacgtatttcgcgttcgtttggttttggcgtttttatttgcgggttttggttcgtttttttgtttagtttttgggcgtttggagaggtcgttacgattcgattttttcgtcggggttgtagggagagcgtttttggaggttgacggatttttttgtttgcgtttatgtttattgtttggggggttttg

SEQ ID NO: 11110 - DNA, 854 bp, Artificial Sequence
  chemically treated genomic DNA (Homo sapiens) CpG-island No: 11110
caaaaccccccaaacaataaacataaacgcaaacaaaaaaatccgtcaacctccaaaaacgctctccctacaaccccgacgaaaaaatcgaatcgtaacgacctctccaaacgcccaaaaactaaacaaaaaaacgaaccaaaacccgcaaataaaaacgccaaaaccaaacgaacgcgaaatacgtacgataaactacgaacgacataaaaaacgcgaacgaccaactccgactccgactccgactccgactcccgcgaaaccgaataacctaaacgttcccaaaaatcgcaaaaaataacgaaccccgacgaaaccaccgaaactaaaaaccaaaacgcaaacaaacgtataaaacgtaaaataaaaacgtaacgacgactcaaataaacgaaaccccgacaacgaccgaaaacgaaatcgccaaaaaaaaaaacgccgaactaaccgaacgacgccgcgaaaaattctaaaaacgccgaaaactacgaatatccaaataaacgccccgcccgctcaaccgccaaatcaaccttaacgctaaaacgcgaactaaaatcgccaaacgatacgttctacccgcgcgaaactaaaaattaaaaaccgaaaccgaatccgaaaccgaaaatcgcgccgctaaccgccaacaacgcaatccgaaccgccaccctacaccctccgccctatttctacacccgtctaaattcttataccgccgcccgcaaaccttcccgaactcaaaataataaaatcaacgacgcccttcgtacaattccctcgactatcgaacgaaactaaaaacttaaccgctcttccctatcaaactcccgaaaaataacgacctaaccccgaac

SEQ ID NO: 11111 - DNA, 854 bp, Artificial Sequence
  chemically treated genomic DNA (Homo sapiens) CpG-island No: 11111
tagggttttttaggtaatgggtatgagcgtaggtagggaaattcgttagtttttagggacgttttttttatagtttcggcgaggggatcgggtcgtggcgatttttttagacgtttaggggttgggtaggagggcgggttaaggttcgtaggtgggggcgttaaagttaggcgggcgcggagtacgtgcggtgggttgcgggcggtatgaagggcgcgggcggttagtttcggtttcggtttcggtttcggttttcgcgaggtcgggtagtttgggcgtttttaggggtcgtagaggatggcgaatttcggcggagttatcggagttggggattaggacgtaggtaggcgtgtggagcgtgaggtggggacgtggcggcggtttaagtgggcggagtttcggtagcggtcggaggcggagtcgttaagggaggaggcgtcgagttgatcgggcgacgtcgcgggaggttttggaaacgtcgggagttgcgagtgtttaggtgagcgtttcgttcgtttagtcgttagattaattttagcgttggggcgcgggttggggtcgttaggcggtgcgttttgttcgcgcggggttgagagttaggggtcggggtcggattcggggtcgggggtcgcgtcgttagtcgttagtagcgtagttcgggtcgttattttgtatttttcgttttgtttttgtattcgtttgggtttttgtgtcgtcgttcgtaagttttttcgagtttagggtggtgaggttagcggcgtttttcgtgtagttttttcggttgtcgggcggggttgggaatttggtcgtttttttttgttaggttttcgggaagtggcggtttgatttcgggt

SEQ ID NO: 11112 - DNA, 854 bp, Artificial Sequence
  chemically treated genomic DNA (Homo sapiens) CpG-island No: 11112
acccgaaatcaaaccgccacttcccgaaaacctaacaaaaaaaaacgaccaaattcccaaccccgcccgacaaccgaaaaaactacacgaaaaacgccgctaacctcaccaccctaaactcgaaaaaacttacgaacgacgacacaaaaacccaaacgaatacaaaaacaaaacgaaaaatacaaaataacgacccgaactacgctactaacgactaacgacgcgacccccgaccccgaatccgaccccgacccctaactctcaaccccgcgcgaacaaaacgcaccgcctaacgaccccaacccgcgccccaacgctaaaattaatctaacgactaaacgaacgaaacgctcacctaaacactcgcaactcccgacgtttccaaaacctcccgcgacgtcgcccgatcaactcgacgcctcctcccttaacgactccgcctccgaccgctaccgaaactccgcccacttaaaccgccgccacgtccccacctcacgctccacacgcctacctacgtcctaatccccaactccgataactccgccgaaattcgccatcctctacgacccctaaaaacgcccaaactacccgacctcgcgaaaaccgaaaccgaaaccgaaaccgaaactaaccgcccgcgcccttcataccgcccgcaacccaccgcacgtactccgcgcccgcctaactttaacgcccccacctacgaaccttaacccgccctcctacccaacccctaaacgtctaaaaaaatcgccacgacccgatcccctcgccgaaactataaaaaaaacgtccctaaaaactaacgaatttccctacctacgctcatacccattacctaaaaaacccta

SEQ ID NO: 11113 - DNA, 575 bp, Artificial Sequence
  chemically treated genomic DNA (Homo sapiens) CpG-island No: 11113
tagaacgggatatcgtttgaaaattcgtaatcgttatttttcggcggttgcggttgaggtttcggttgcgcggttttacgtttacggtttttcgtttttgcgttattttttttcgtatcggttttcgtttgtggtttcggttgaggttgatcgttgaattgttgtttttttttcggttgagtttgagtatttgcggtacgtattagtatttgtatggtgttcgtggttttaataagaatttcggtgacgtaacgggtgatatcgttatttttttagttacgggtgcgaagttgattttcgatgtagatttgcgcgtttttgcgtagatatttatttgttattttcgcgagtttgtcgaatagtattacgcgatgttattttgtttgttttcgtatttttttcgtttgtttgttacgttagttttttgacgtggttatttgtaggtttgttattgcgttttcgttggggatgtaacggattttcggatttttttttaggcgttttacgaggatgattttgttaatgttacgaattgttatgatgtgtttttttttgttgatggttttagtttttat

SEQ ID NO: 11114 - DNA, 575 bp, Artificial Sequence
  chemically treated genomic DNA (Homo sapiens) CpG-island No: 11114
ataaaaactaaaaccatcaacaaaaaaaaacacatcataacaattcgtaacattaacaaaatcatcctcgtaaaacgcctaaaaaaaaatccgaaaatccgttacatccccaacgaaaacgcaataacaaacctacaaataaccacgtcaaaaaactaacgtaacaaacaaacgaaaaaaatacgaaaacaaacaaaataacatcgcgtaatactattcgacaaactcgcgaaaataacaaataaatatctacgcaaaaacgcgcaaatctacatcgaaaatcaacttcgcacccgtaactaaaaaaataacgatatcacccgttacgtcaccgaaattcttattaaaaccacgaacaccatacaaatactaatacgtaccgcaaatactcaaactcaaccgaaaaaaaaacaacaattcaacgatcaacctcaaccgaaaccacaaacgaaaaccgatacgaaaaaaaataacgcaaaaacgaaaaaccgtaaacgtaaaaccgcgcaaccgaaacctcaaccgcaaccgccgaaaaataacgattacgaattttcaaacgatatcccgttcta

SEQ ID NO: 11115 - DNA, 575 bp, Artificial Sequence
  chemically treated genomic DNA (Homo sapiens) CpG-island No: 11115
atgggggttgaaattattaatagaaggagatatattatggtagttcgtggtattaataaggttattttcgtaggacgtttgggaaaggattcggaagttcgttatatttttaacgggggcgtagtggtaaatttgtaggtggttacgttagaaagttggcgtgataaatagacgggggagatgcgggagtagatagaatggtatcgcgtggtgttgttcggtaagttcgcggaagtggtaggtgaatgtttgcgtaagggcgcgtaggtttatatcgaaggttagtttcgtattcgtagttgggaggataacggtattattcgttacgttatcgaaatttttgttaagattacgggtattatgtagatgttggtacgtgtcgtaggtgtttagatttagtcggaagaggggtaatagtttagcggttagttttagtcggaattataggcggaggtcggtacgaaaaaaggtggcgtaaaaacgaaaggtcgtggacgtaaggtcgcgtagtcggagttttagtcgtaatcgtcggagggtgacgattacgggtttttagacgatatttcgttttg

SEQ ID NO: 11116 - DNA, 575 bp, Artificial Sequence
  chemically treated genomic DNA (Homo sapiens) CpG-island No: 11116
caaaacgaaatatcgtctaaaaacccgtaatcgtcaccctccgacgattacgactaaaactccgactacgcgaccttacgtccacgacctttcgtttttacgccaccttttttcgtaccgacctccgcctataattccgactaaaactaaccgctaaactattacccctcttccgactaaatctaaacacctacgacacgtaccaacatctacataatacccgtaatcttaacaaaaatttcgataacgtaacgaataataccgttatcctcccaactacgaatacgaaactaaccttcgatataaacctacgcgcccttacgcaaacattcacctaccacttccgcgaacttaccgaacaacaccacgcgataccattctatctactcccgcatctcccccgtctatttatcacgccaactttctaacgtaaccacctacaaatttaccactacgcccccgttaaaaatataacgaacttccgaatcctttcccaaacgtcctacgaaaataaccttattaataccacgaactaccataatatatctccttctattaataatttcaacccccat

SEQ ID NO: 11117 - DNA, 736 bp, Artificial Sequence
  chemically treated genomic DNA (Homo sapiens) CpG-island No: 11117
cgtttttattgttcggggatggggagtaagtttagttagtcgttgtttcgggttgtcgcgtgcgtagttgtacgttatttttagacgaatcgatgattggatggatgtcggtcgtagtcgttatattgatgatacgtatgtgtattttcgtatatattatgttatcggagagttgttaacgtatggtaatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcggagttttagagtattataggaggcggttaagttaacgggtgtgttttttgttttgtggtttttaggtgggaaaggt

SEQ ID NO: 11118 - DNA, 736 bp, Artificial Sequence
  chemically treated genomic DNA (Homo sapiens) CpG-island No: 11118
acctttcccacctaaaaaccacaaaacaaaaaacacacccgttaacttaaccgcctcctataatactctaaaactccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgattaccatacgttaacaactctccgataacataatatatacgaaaatacacatacgtatcatcaatataacgactacgaccgacatccatccaatcatcgattcgtctaaaaataacgtacaactacgcacgcgacaacccgaaacaacgactaactaaacttactccccatccccgaacaataaaaacg

SEQ ID NO: 11119 - DNA, 736 bp, Artificial Sequence
  chemically treated genomic DNA (Homo sapiens) CpG-island No: 11119
gttttttttatttggaaattatagggtagggggtatattcgttggtttggtcgttttttatagtgttttaaagtttcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgattattatacgttggtagtttttcgataatatggtgtatacggagatgtatatacgtattattagtgtgacgattgcggtcggtatttatttagttatcggttcgtttgagaatgacgtgtaattgcgtacgcgataattcgagataacggttgattaagtttattttttattttcgggtaataagggcg

SEQ ID NO: 11120 - DNA, 736 bp, Artificial Sequence
  chemically treated genomic DNA (Homo sapiens) CpG-island No: 11120
cgcccttattacccgaaaataaaaaataaacttaatcaaccgttatctcgaattatcgcgtacgcaattacacgtcattctcaaacgaaccgataactaaataaataccgaccgcaatcgtcacactaataatacgtatatacatctccgtatacaccatattatcgaaaaactaccaacgtataataatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacgaaactttaaaacactataaaaaacgaccaaaccaacgaatataccccctaccctataatttccaaataaaaaaaac

SEQ ID NO: 11121 - DNA, 739 bp, Artificial Sequence
  chemically treated genomic DNA (Homo sapiens) CpG-island No: 11121
agatagaatggaacgtttggtgtttgtcgtttgtttgttggtcgtgatttcggcgtttaattttgttattagtgatgcggcggttgtagtcggttttgtgatgacggtgttgatcgttggtttggtgtcgtgtgtagggaaattattatttcgtttttggttcggagattttttttcgacgttttatgtttgttatttggttgtgttgggcgttttggcgttgtgacgggtgtggtatttttggtcgtaagaggatgattcgttagaggtagaatatagtatgatagagtagaagcgatcggtattgatattgaagcggaagatagaaggggagacgtttgttcgtagtcggaaaattattattaatgttattacgttattaaagtggaaggtgaaaaagtagaagttggtcgagaaagtttgtcgggaagtagagttggcggtaaaaaaagcgtaggttagataggcgttgtttatttatttgaatttgtttacgttggatgatgtcgtgaatattttgaagttttggtggtcgggattatttgacggtgatacgtttcggtttttggtttgcggtattcgggacgtgttattggaagacgtggcgtagcggaatatttcgttttcgtataaaaaattgcgtagggcgttgaaggttattattcgtttagaaagttgattttatttagtaatagtggatacgcggttaagtgagtaaatttttagttagaggtgattt

SEQ ID NO: 11122 - DNA, 739 bp, Artificial Sequence
  chemically treated genomic DNA (Homo sapiens) CpG-island No: 11122
aaatcacctctaactaaaaatttactcacttaaccgcgtatccactattactaaataaaatcaactttctaaacgaataataaccttcaacgccctacgcaattttttatacgaaaacgaaatattccgctacgccacgtcttccaataacacgtcccgaataccgcaaaccaaaaaccgaaacgtatcaccgtcaaataatcccgaccaccaaaacttcaaaatattcacgacatcatccaacgtaaacaaattcaaataaataaacaacgcctatctaacctacgctttttttaccgccaactctacttcccgacaaactttctcgaccaacttctactttttcaccttccactttaataacgtaataacattaataataattttccgactacgaacaaacgtctccccttctatcttccgcttcaatatcaataccgatcgcttctactctatcatactatattctacctctaacgaatcatcctcttacgaccaaaaataccacacccgtcacaacgccaaaacgcccaacacaaccaaataacaaacataaaacgtcgaaaaaaaatctccgaaccaaaaacgaaataataatttccctacacacgacaccaaaccaacgatcaacaccgtcatcacaaaaccgactacaaccgccgcatcactaataacaaaattaaacgccgaaatcacgaccaacaaacaaacgacaaacaccaaacgttccattctatct

SEQ ID NO: 11123 - DNA, 739 bp, Artificial Sequence
  chemically treated genomic DNA (Homo sapiens) CpG-island No: 11123
gagttatttttgattgagagtttatttatttagtcgcgtgtttattattgttgggtaagattagttttttgaacgggtgatggtttttagcgttttgcgtagttttttatgcgagagcgggatatttcgttgcgttacgttttttagtaatacgtttcggatatcgtaggttagaagtcggggcgtgttatcgttaaataatttcggttattagggttttagggtgtttacggtattatttagcgtgggtagatttagataaatggatagcgtttgtttggtttgcgttttttttgtcgttagttttgtttttcggtaggttttttcggttagtttttgtttttttattttttattttggtggcgtggtgatattgatgatggtttttcggttgcggataagcgtttttttttttgtttttcgttttagtgttagtatcggtcgtttttgttttgttatgttgtgttttgtttttgacgaattatttttttgcggttaaagatattatattcgttatagcgttagaacgtttagtatagttagatgataggtatagaacgtcgggaaaaagttttcgggttagaaacgggataataatttttttgtatacgatattagattaacggttagtatcgttattataaggtcggttatagtcgtcgtattattggtggtaaggttaagcgtcggaattacggttagtaggtaagcgataagtattagacgttttattttgttt

SEQ ID NO: 11124 - DNA, 739 bp, Artificial Sequence
  chemically treated genomic DNA (Homo sapiens) CpG-island No: 11124
aaacaaaataaaacgtctaatacttatcgcttacctactaaccgtaattccgacgcttaaccttaccaccaataatacgacgactataaccgaccttataataacgatactaaccgttaatctaatatcgtatacaaaaaaattattatcccgtttctaacccgaaaactttttcccgacgttctatacctatcatctaactatactaaacgttctaacgctataacgaatataatatctttaaccgcaaaaaaataattcgtcaaaaacaaaacacaacataacaaaacaaaaacgaccgatactaacactaaaacgaaaaacaaaaaaaaaaacgcttatccgcaaccgaaaaaccatcatcaatatcaccacgccaccaaaataaaaaataaaaaaacaaaaactaaccgaaaaaacctaccgaaaaacaaaactaacgacaaaaaaaacgcaaaccaaacaaacgctatccatttatctaaatctacccacgctaaataataccgtaaacaccctaaaaccctaataaccgaaattatttaacgataacacgccccgacttctaacctacgatatccgaaacgtattactaaaaaacgtaacgcaacgaaatatcccgctctcgcataaaaaactacgcaaaacgctaaaaaccatcacccgttcaaaaaactaatcttacccaacaataataaacacgcgactaaataaataaactctcaatcaaaaataactc

SEQ ID NO: 11125 - DNA, 595 bp, Artificial Sequence
  chemically treated genomic DNA (Homo sapiens) CpG-island No: 11125
cgatttttgttgatgttttagttgcggagtttagtagtttagtagttgtttatttcgtaggtttacggacgttacggttacgtaggttacggatttgtgttttggtgtatttacgtggttttgatcggttcgcggatagtagtcgtgtaggagacgcggtgtcgagttttaggcgttaaagattttttcgcgtggagagtttagtggtgatcgagtgcggtattttcgcggcgatgatcgcgtttttcgtttgagtcgaaaggcgttggggcgatcggtttttgtgcggtatagtagcgatgtagcgacgtttcgattttttacggatagttcgttttatacggttcgtgggttatcggttcgttcgggtatattagatcgtcgtcgtgtcgtcgaggtgtcgttgacgtgcgttcggtacgtcgtttgttcgtttatagtatcggcgttgacgcggtggacgttggaatgacgttcgcgcggtttgagcgttgacgagttggcgtcgcggatcgtcggacgcgcgtttcgttaggtcgtcgcgtttattgttaagtatttagtgtttagaatatataaaaaattattttagggt

SEQ ID NO: 11126 - DNA, 595 bp, Artificial Sequence
  chemically treated genomic DNA (Homo sapiens) CpG-island No: 11126
accctaaaataattttttatatattctaaacactaaatacttaacaataaacgcgacgacctaacgaaacgcgcgtccgacgatccgcgacgccaactcgtcaacgctcaaaccgcgcgaacgtcattccaacgtccaccgcgtcaacgccgatactataaacgaacaaacgacgtaccgaacgcacgtcaacgacacctcgacgacacgacgacgatctaatatacccgaacgaaccgataacccacgaaccgtataaaacgaactatccgtaaaaaatcgaaacgtcgctacatcgctactataccgcacaaaaaccgatcgccccaacgcctttcgactcaaacgaaaaacgcgatcatcgccgcgaaaataccgcactcgatcaccactaaactctccacgcgaaaaaatctttaacgcctaaaactcgacaccgcgtctcctacacgactactatccgcgaaccgatcaaaaccacgtaaatacaccaaaacacaaatccgtaacctacgtaaccgtaacgtccgtaaacctacgaaataaacaactactaaactactaaactccgcaactaaaacatcaacaaaaatcg

SEQ ID NO: 11127 - DNA, 595 bp, Artificial Sequence
  chemically treated genomic DNA (Homo sapiens) CpG-island No: 11127
attttaaaatagttttttatatattttggatattgaatatttaataatagacgcgacgatttggcggggcgcgcgttcggcggttcgcggcgttagttcgttagcgtttaaatcgcgcgagcgttattttagcgtttatcgcgttagcgtcggtgttgtgggcgagtaggcggcgtgtcggacgtacgttagcgatatttcggcggtacgacggcggtttggtgtattcgggcgggtcggtggtttacgggtcgtgtggggcggattgttcgtggagggtcggggcgtcgttgtatcgttattgtgtcgtatagaggtcggtcgttttaacgtttttcggtttagacgaaggacgcggttatcgtcgcggaggtgtcgtattcggttattattgagttttttacgcgggaagatttttggcgtttggggttcggtatcgcgttttttgtacggttgttgttcgcgggtcggttaggattacgtgggtgtattagggtataggttcgtagtttacgtgatcgtggcgttcgtaggtttgcgaggtgggtaattgttggattgttgggtttcgtagttgaggtattagtaaaggtcg

SEQ ID NO: 11128 - DNA, 595 bp, Artificial Sequence
  chemically treated genomic DNA (Homo sapiens) CpG-island No: 11128
cgacctttactaatacctcaactacgaaacccaacaatccaacaattacccacctcgcaaacctacgaacgccacgatcacgtaaactacgaacctataccctaatacacccacgtaatcctaaccgacccgcgaacaacaaccgtacaaaaaacgcgataccgaaccccaaacgccaaaaatcttcccgcgtaaaaaactcaataataaccgaatacgacacctccgcgacgataaccgcgtccttcgtctaaaccgaaaaacgttaaaacgaccgacctctatacgacacaataacgatacaacgacgccccgaccctccacgaacaatccgccccacacgacccgtaaaccaccgacccgcccgaatacaccaaaccgccgtcgtaccgccgaaatatcgctaacgtacgtccgacacgccgcctactcgcccacaacaccgacgctaacgcgataaacgctaaaataacgctcgcgcgatttaaacgctaacgaactaacgccgcgaaccgccgaacgcgcgccccgccaaatcgtcgcgtctattattaaatattcaatatccaaaatatataaaaaactattttaaaat

SEQ ID NO: 11129 - DNA, 1385 bp, Artificial Sequence
  chemically treated genomic DNA (Homo sapiens) CpG-island No: 11129
tttatagtcgtttaggtttcggggtagagaaattggaagtcgtatcggggggaggttttggttcggggcgggagtgggagattcggttacgtcggggtcgtatttattatggaaggttagttcgtcggtcgatgttatggtcgtttaggggcgttttcgtatttttcgttgaggatagagatcggttaggtatatttttttttcgttttcgagtcggtttttcggtttttagttttatttggcgattaattgtatttacggaggtttgaattcgtcgtttcgtttttataggtgcgtttcgtttttttttatttgaggttatttgggtcggcgtggttggggttttttgcgtttgcgcgtttcgtttattcgttagattttaatcgatttagatttgatagtaatattcggcgtttgttttttttttattttttttcgttgggaagttattttcggtaaagttggcgtttgcgtagaagagattttcgggtttttaacgtcgggtattaggagttttttttcggagtaaggatttttaagacggaagaggatggtcgcggcggttttgaggagattttggtttcggcgtcgcgtagaggcgggcgacgcggtagtggcgaagtcgggagtgtgggcgcggttgggtgagtagcggcggaaggcggtagggtgggtggtcgtcgcgatagggtgggtggtcgtcgcggtcggattatttttatcgcgtttttttttttttagggttttgggttcgcgcgttgtttcgggattacgtcgaggtttgtagggacgtttcggcggaggttagggttcggtcggggcgcgtcgttgtgtatgtgggtttgttgggcggcgcggcggtttgttttacgttggcgtttagcgagggtgttttcgaggaggcgttgttggaggcgtcggggatttttttgttgttggcgtcggttattcgtaatcgcgagttcgaagttttcgtgtagaggttgttttggttgcggggtcgtggtcgtttgcgttacgttaatttggggttttgttcgttggtgtacgaggcgtttttcgacgtttaggttagtttttattaggcgcgttgtcgttatttgtagtttcgttggatcgattttttcggtcgggttttggacgtgggtttcgtgggtcgttggtgggtgttgggggtttggatgcgcgattgcgatattaacgacgacgaatttttgtatttgtcggcgtatttgcgggtggtcgggttttagtagttgtatttcgagattaacgagcggtttttcgatgagaagtataagtttgtcgtgtttatcgacgattaggtggattaggcgttgtgggaggagtaggttttgtagaaggagaagaaggataggttcgtt

SEQ ID NO: 11130 - DNA, 1385 bp, Artificial Sequence
  chemically treated genomic DNA (Homo sapiens) CpG-island No: 11130
aacgaacctatccttcttctccttctacaaaacctactcctcccacaacgcctaatccacctaatcgtcgataaacacgacaaacttatacttctcatcgaaaaaccgctcgttaatctcgaaatacaactactaaaacccgaccacccgcaaatacgccgacaaatacaaaaattcgtcgtcgttaatatcgcaatcgcgcatccaaacccccaacacccaccaacgacccacgaaacccacgtccaaaacccgaccgaaaaaatcgatccaacgaaactacaaataacgacaacgcgcctaataaaaactaacctaaacgtcgaaaaacgcctcgtacaccaacgaacaaaaccccaaattaacgtaacgcaaacgaccacgaccccgcaaccaaaacaacctctacacgaaaacttcgaactcgcgattacgaataaccgacgccaacaacaaaaaaatccccgacgcctccaacaacgcctcctcgaaaacaccctcgctaaacgccaacgtaaaacaaaccgccgcgccgcccaacaaacccacatacacaacgacgcgccccgaccgaaccctaacctccgccgaaacgtccctacaaacctcgacgtaatcccgaaacaacgcgcgaacccaaaaccctaaaaaaaaaaaaacgcgataaaaataatccgaccgcgacgaccacccaccctatcgcgacgaccacccaccctaccgccttccgccgctactcacccaaccgcgcccacactcccgacttcgccactaccgcgtcgcccgcctctacgcgacgccgaaaccaaaatctcctcaaaaccgccgcgaccatcctcttccgtcttaaaaatccttactccgaaaaaaaactcctaatacccgacgttaaaaacccgaaaatctcttctacgcaaacgccaactttaccgaaaataacttcccaacgaaaaaaaataaaaaaaaaacaaacgccgaatattactatcaaatctaaatcgattaaaatctaacgaataaacgaaacgcgcaaacgcaaaaaaccccaaccacgccgacccaaataacctcaaataaaaaaaaacgaaacgcacctataaaaacgaaacgacgaattcaaacctccgtaaatacaattaatcgccaaataaaactaaaaaccgaaaaaccgactcgaaaacgaaaaaaaaatatacctaaccgatctctatcctcaacgaaaaatacgaaaacgcccctaaacgaccataacatcgaccgacgaactaaccttccataataaatacgaccccgacgtaaccgaatctcccactcccgccccgaaccaaaacctccccccgatacgacttccaatttctctaccccgaaacctaaacgactataaa

SEQ ID NO: 11131 - DNA, 1385 bp, Artificial Sequence
  chemically treated genomic DNA (Homo sapiens) CpG-island No: 11131
ggcgagtttgttttttttttttttttgtaagatttgttttttttatagcgtttggtttatttgatcgtcggtgagtacgataggtttgtattttttatcgaagagtcgttcgttggtttcggaatgtagttgttggggttcgattattcgtaaatgcgtcggtaggtgtaggaattcgtcgtcgttgatgtcgtagtcgcgtatttaggtttttagtatttattagcgatttacgaagtttacgtttaggattcggtcggggaagtcggtttagcggggttgtaggtagcggtaacgcgtttggtagaggttggtttgggcgtcgaagggcgtttcgtatattagcgagtagagttttaggttgacgtagcgtaggcggttacggtttcgtagttagagtagtttttgtacgaaggtttcggattcgcggttgcgggtggtcggcgttagtagtaggagggttttcgacgtttttagtagcgttttttcgaaggtattttcgttgggcgttagcgtgaagtaggtcgtcgcgtcgtttagtagatttatatatatagcggcgcgtttcggtcgggttttagttttcgtcgaagcgtttttgtaggtttcggcgtagtttcggagtagcgcgcgggtttaggattttgaggggagaggagcgcggtaagagtgattcggtcgcggcggttatttattttgtcgcggcggttatttattttgtcgtttttcgtcgttatttatttagtcgcgtttatattttcggtttcgttattatcgcgtcgttcgtttttgcgcggcgtcgggattaaaatttttttagagtcgtcgcggttattttttttcgttttgggggtttttgtttcgggaagaaatttttgatattcgacgttaagagttcgggagttttttttgcgtaagcgttaattttatcggaagtggttttttaacgggagaggatagaaagaggataggcgtcggatgttgttgttaggtttgagtcggttggagtttgacgggtaggcgagacgcgtaggcgtagagagttttagttacgtcggtttaggtggttttaggtgagggggggcggagcgtatttgtggggacgggacgacgagtttaagttttcgtgggtgtagttggtcgttaggtagggttgggggtcgagggatcggttcgggggcgggggggaagtgtgtttgatcggtttttgtttttagcgagggatgcggagacgtttttgaacgattatggtatcggtcgacgagttgattttttatggtgagtgcggtttcgacgtggtcggattttttattttcgtttcgggttagaattttttttcgatacggtttttaatttttttatttcgaagtttaggcggttgtgaa

SEQ ID NO: 11132 - DNA, 1385 bp, Artificial Sequence
  chemically treated genomic DNA (Homo sapiens) CpG-island No: 11132
ttcacaaccgcctaaacttcgaaataaaaaaattaaaaaccgtatcgaaaaaaaattctaacccgaaacgaaaataaaaaatccgaccacgtcgaaaccgcactcaccataaaaaatcaactcgtcgaccgataccataatcgttcaaaaacgtctccgcatccctcgctaaaaacaaaaaccgatcaaacacacttcccccccgcccccgaaccgatccctcgacccccaaccctacctaacgaccaactacacccacgaaaacttaaactcgtcgtcccgtccccacaaatacgctccgccccccctcacctaaaaccacctaaaccgacgtaactaaaactctctacgcctacgcgtctcgcctacccgtcaaactccaaccgactcaaacctaacaacaacatccgacgcctatcctctttctatcctctcccgttaaaaaaccacttccgataaaattaacgcttacgcaaaaaaaactcccgaactcttaacgtcgaatatcaaaaatttcttcccgaaacaaaaacccccaaaacgaaaaaaaataaccgcgacgactctaaaaaaattttaatcccgacgccgcgcaaaaacgaacgacgcgataataacgaaaccgaaaatataaacgcgactaaataaataacgacgaaaaacgacaaaataaataaccgccgcgacaaaataaataaccgccgcgaccgaatcactcttaccgcgctcctctcccctcaaaatcctaaacccgcgcgctactccgaaactacgccgaaacctacaaaaacgcttcgacgaaaactaaaacccgaccgaaacgcgccgctatatatataaatctactaaacgacgcgacgacctacttcacgctaacgcccaacgaaaataccttcgaaaaaacgctactaaaaacgtcgaaaaccctcctactactaacgccgaccacccgcaaccgcgaatccgaaaccttcgtacaaaaactactctaactacgaaaccgtaaccgcctacgctacgtcaacctaaaactctactcgctaatatacgaaacgcccttcgacgcccaaaccaacctctaccaaacgcgttaccgctacctacaaccccgctaaaccgacttccccgaccgaatcctaaacgtaaacttcgtaaatcgctaataaatactaaaaacctaaatacgcgactacgacatcaacgacgacgaattcctacacctaccgacgcatttacgaataatcgaaccccaacaactacattccgaaaccaacgaacgactcttcgataaaaaatacaaacctatcgtactcaccgacgatcaaataaaccaaacgctataaaaaaaacaaatcttacaaaaaaaaaaaaaaaacaaactcgcc

SEQ ID NO: 11133 - DNA, 1263 bp, Artificial Sequence
  chemically treated genomic DNA (Homo sapiens) CpG-island No: 11133
tcgtgttcggtcgacgtcggatatatttggaggtttggttgagtttcgatcgtagtttcgttaaaaacgtaatattcgggtcggattcgttattacgtagttagaaaagttttaacgtttgtttattgttgtagtcgttgtaattgggagggcgattgtaggggtgtcgggcgaggggggcgagttttgttcggcgatttcggcgagagcgcgcgcggagaggatcgcgcggtttttacgcggttcgggttttttatttatttcgtcgtttcgcgggggtcgtcgttgttacggtttcgcgatattgtggttttttttacgcgcgcggttgtcggttgggttttttgattttcgggcgtcgtcgtatttcggtttcgtatagggcgcgtcggtagtttttttttttttcggcgtttcggttttatttaaatcgtttttttcggtttcgcgtcgcgttgttttcgcggttcgcgttttttattaggagtcgtcggcgtcgtcgatttttcggcgtttttttcgttttttcgcgcggggtcgggggtagaatgggcgtttcgtttttttttacgaaataaagaagtcgtcgtcgtcgttaaacgaggggaagtttcgcgcgcgcgttcgttcgtttcggttatcgttttttttttatatatacgcgcgttattcgcgttttcgttgcgcgcgcgttcgtcggttttttttttttttagtatcgcggcggtttttttagttttcgtcgtttgttcggtttcgtgcgcgcgttagttcgttttttcgttttcggcgcgcgtgcgcgttcgtttttgggcggacgggggtgggcgtggttcggaggaagtacgcgcgttcgatgtatcgttttattcgggtcgcgatggtttcgcgtttgcgtacgtttcgttttttgtacgtttcgcgttttgacgtttcggagtatgcgtagagcggacgttattgcggcggcggtggcggcggtcgcggtgacgatggggtaattggagaatgggatttcggtggtcgtggggttcgtggggaaaggaggtttttgaggttcggaaataggaattttggatcgtaggacgggtcgtttggattaagatcgggtagtggtttttcgcgggttaagggcgcgtttgggaatcgttttgatttttgatttggggcgcgaggtttatttggggaggtaaggcggggttcgatcgtggtcgttttttttgtaaaattttttaagtgttattaattagtttagtaaatatt

SEQ ID NO: 11134 - DNA, 1263 bp, Artificial Sequence
  chemically treated genomic DNA (Homo sapiens) CpG-island No: 11134
aatatttactaaactaattaataacacttaaaaaattttacaaaaaaaacgaccacgatcgaaccccgccttacctccccaaataaacctcgcgccccaaatcaaaaatcaaaacgattcccaaacgcgcccttaacccgcgaaaaaccactacccgatcttaatccaaacgacccgtcctacgatccaaaattcctatttccgaacctcaaaaacctcctttccccacgaaccccacgaccaccgaaatcccattctccaattaccccatcgtcaccgcgaccgccgccaccgccgccgcaataacgtccgctctacgcatactccgaaacgtcaaaacgcgaaacgtacaaaaaacgaaacgtacgcaaacgcgaaaccatcgcgacccgaataaaacgatacatcgaacgcgcgtacttcctccgaaccacgcccacccccgtccgcccaaaaacgaacgcgcacgcgcgccgaaaacgaaaaaacgaactaacgcgcgcacgaaaccgaacaaacgacgaaaactaaaaaaaccgccgcgatactaaaaaaaaaaaaaaccgacgaacgcgcgcgcaacgaaaacgcgaataacgcgcgtatatataaaaaaaaaacgataaccgaaacgaacgaacgcgcgcgcgaaacttcccctcgtttaacgacgacgacgacttctttatttcgtaaaaaaaaacgaaacgcccattctacccccgaccccgcgcgaaaaaacgaaaaaaacgccgaaaaatcgacgacgccgacgactcctaataaaaaacgcgaaccgcgaaaacaacgcgacgcgaaaccgaaaaaaacgatttaaataaaaccgaaacgccgaaaaaaaaaaaaactaccgacgcgccctatacgaaaccgaaatacgacgacgcccgaaaatcaaaaaacccaaccgacaaccgcgcgcgtaaaaaaaaccacaatatcgcgaaaccgtaacaacgacgacccccgcgaaacgacgaaataaataaaaaacccgaaccgcgtaaaaaccgcgcgatcctctccgcgcgcgctctcgccgaaatcgccgaacaaaactcgcccccctcgcccgacacccctacaatcgccctcccaattacaacgactacaacaataaacaaacgttaaaacttttctaactacgtaataacgaatccgacccgaatattacgtttttaacgaaactacgatcgaaactcaaccaaacctccaaatatatccgacgtcgaccgaacacga

SEQ ID NO: 11135 - DNA, 1263 bp, Artificial Sequence
  chemically treated genomic DNA (Homo sapiens) CpG-island No: 11135
aatatttgttaagttaattaatggtatttgggaagttttgtagagaaggcggttacggtcgggtttcgttttgtttttttaaataggtttcgcgttttaggttagggattaaagcggtttttaggcgcgtttttggttcgcgggaaattattgttcggttttggtttaggcggttcgttttacggtttagggtttttattttcgagttttagggattttttttttttacggattttacggttatcgggattttattttttagttgttttatcgttatcgcggtcgtcgttatcgtcgtcgtagtggcgttcgttttgcgtatgtttcggggcgttaagacgcgaggcgtgtagaaggcgaagcgtgcgtaggcgcggggttatcgcggttcgagtggggcggtgtatcggacgcgcgtgtttttttcgggttacgtttattttcgttcgtttagggacgggcgcgtacgcgcgtcgggagcggaagggcgggttggcgcgcgtacgaggtcgggtaggcggcggaagttggagaggtcgtcgcggtgttgagggggaggggagtcggcgagcgcgcgcgtagcgggggcgcgggtggcgcgcgtgtgtgtgaagggggggcggtggtcgaggcgggcgggcgcgcgcgcgaggttttttttcgtttggcggcggcggcggtttttttgtttcgtgaagagaagcgagacgtttattttgttttcggtttcgcgcggaggggcgggggaggcgtcgggaagtcgacggcgtcggcggtttttggtaaggaacgcgggtcgcgggggtagcgcggcgcggggtcggggagggcggtttgaatggagtcggggcgtcgaggggggagggggttgtcggcgcgttttgtgcggggtcggggtacggcggcgttcgagggttaagaagtttagtcggtagtcgcgcgcgtggggaaggttatagtgtcgcgaggtcgtggtagcggcggttttcgcggagcggcggggtgggtggggggttcgggtcgcgtggaggtcgcgcgatttttttcgcgcgcgttttcgtcggggtcgtcggataaagttcgtttttttcgttcggtatttttatagtcgtttttttaattatagcggttgtaataataggtaggcgttggggtttttttggttgcgtggtaacgggttcgattcgaatgttgcgtttttggcgaagttgcgatcggggtttagttaaatttttagatatgttcggcgtcggtcggatacgg

SEQ ID NO: 11136 - DNA, 1263 bp, Artificial Sequence
  chemically treated genomic DNA (Homo sapiens) CpG-island No: 11136
ccgtatccgaccgacgccgaacatatctaaaaatttaactaaaccccgatcgcaacttcgccaaaaacgcaacattcgaatcgaacccgttaccacgcaaccaaaaaaaccccaacgcctacctattattacaaccgctataattaaaaaaacgactataaaaataccgaacgaaaaaaacgaactttatccgacgaccccgacgaaaacgcgcgcgaaaaaaatcgcgcgacctccacgcgacccgaaccccccacccaccccgccgctccgcgaaaaccgccgctaccacgacctcgcgacactataaccttccccacgcgcgcgactaccgactaaacttcttaaccctcgaacgccgccgtaccccgaccccgcacaaaacgcgccgacaaccccctcccccctcgacgccccgactccattcaaaccgccctccccgaccccgcgccgcgctacccccgcgacccgcgttccttaccaaaaaccgccgacgccgtcgacttcccgacgcctcccccgcccctccgcgcgaaaccgaaaacaaaataaacgtctcgcttctcttcacgaaacaaaaaaaccgccgccgccgccaaacgaaaaaaaacctcgcgcgcgcgcccgcccgcctcgaccaccgcccccccttcacacacacgcgcgccacccgcgcccccgctacgcgcgcgctcgccgactcccctccccctcaacaccgcgacgacctctccaacttccgccgcctacccgacctcgtacgcgcgccaacccgcccttccgctcccgacgcgcgtacgcgcccgtccctaaacgaacgaaaataaacgtaacccgaaaaaaacacgcgcgtccgatacaccgccccactcgaaccgcgataaccccgcgcctacgcacgcttcgccttctacacgcctcgcgtcttaacgccccgaaacatacgcaaaacgaacgccactacgacgacgataacgacgaccgcgataacgataaaacaactaaaaaataaaatcccgataaccgtaaaatccgtaaaaaaaaaaaatccctaaaactcgaaaataaaaaccctaaaccgtaaaacgaaccgcctaaaccaaaaccgaacaataatttcccgcgaaccaaaaacgcgcctaaaaaccgctttaatccctaacctaaaacgcgaaacctatttaaaaaaacaaaacgaaacccgaccgtaaccgccttctctacaaaacttcccaaataccattaattaacttaacaaatatt

SEQ ID NO: 11137 - DNA, 563 bp, Artificial Sequence
  chemically treated genomic DNA (Homo sapiens) CpG-island No: 11137
ggtcggtttttcgtttttcgtttttgttgtataggttaatatcgtatcgggatcgttcgataaagcgtttaattagtatgtcgtatatagcggatttattttttcggttgacgttagtttgacgcgcggtaagtagagtaacggtttgtacggcgattacgacgtcgagagcggtttgtaataattgttggacggtagcggattgtaggtaaaatcgttgggaaataatagttggacgttggagttcgcgttcgtattaaaagaagatgttttgatcgtggtcggcgattggttgggtgatgcgcgtgaaaacgacgtatttgaatatgttggcgcgcgtgacgtgattcgtcgtgaggatttcgttaaaatcggcgtaatattatgcgtgaggtatttaatcgtatttttggcgttagcgcgtcggaaaataacggtatcggtagttatagtttttatgtttgtaggttcggtaatgtgtcgttggcggtaaagcgtaattggatttttcggttgtttgtattttgatttattagttgtaatgagtggttaattagcgtgtt

SEQ ID NO: 11138 - DNA, 563 bp, Artificial Sequence
  chemically treated genomic DNA (Homo sapiens) CpG-island No: 11138
aacacgctaattaaccactcattacaactaataaatcaaaatacaaacaaccgaaaaatccaattacgctttaccgccaacgacacattaccgaacctacaaacataaaaactataactaccgataccgttattttccgacgcgctaacgccaaaaatacgattaaatacctcacgcataatattacgccgattttaacgaaatcctcacgacgaatcacgtcacgcgcgccaacatattcaaatacgtcgttttcacgcgcatcacccaaccaatcgccgaccacgatcaaaacatcttcttttaatacgaacgcgaactccaacgtccaactattatttcccaacgattttacctacaatccgctaccgtccaacaattattacaaaccgctctcgacgtcgtaatcgccgtacaaaccgttactctacttaccgcgcgtcaaactaacgtcaaccgaaaaaataaatccgctatatacgacatactaattaaacgctttatcgaacgatcccgatacgatattaacctatacaacaaaaacgaaaaacgaaaaaccgacc

SEQ ID NO: 11139 - DNA, 563 bp, Artificial Sequence
  chemically treated genomic DNA (Homo sapiens) CpG-island No: 11139
aatacgttgattaattatttattatagttggtaagttaggatgtaaatagtcgggagatttagttacgttttatcgttaacgatatattatcggatttgtaggtatgaaagttgtggttgtcggtgtcgttgtttttcggcgcgttgacgttagggatgcggttaagtattttacgtatggtgttgcgtcggttttggcgaaatttttacggcggattacgttacgcgcgttagtatgtttaaatacgtcgtttttacgcgtattatttagttagtcgtcgattacggttagggtatttttttttggtgcgggcgcgggttttagcgtttagttgttattttttagcggttttatttgtagttcgttgtcgtttagtagttgttgtaggtcgttttcgacgtcgtaatcgtcgtgtaggtcgttgttttgtttgtcgcgcgttaggttggcgttaatcgagagggtaaattcgttgtgtgcggtatattgattgagcgttttatcgagcgatttcggtgcgatattaatttgtgtagtaaaagcggaaaacgagagatcggtt

SEQ ID NO: 11140 - DNA, 563 bp, Artificial Sequence
  chemically treated genomic DNA (Homo sapiens) CpG-island No: 11140
aaccgatctctcgttttccgcttttactacacaaattaatatcgcaccgaaatcgctcgataaaacgctcaatcaatataccgcacacaacgaatttaccctctcgattaacgccaacctaacgcgcgacaaacaaaacaacgacctacacgacgattacgacgtcgaaaacgacctacaacaactactaaacgacaacgaactacaaataaaaccgctaaaaaataacaactaaacgctaaaacccgcgcccgcaccaaaaaaaaataccctaaccgtaatcgacgactaactaaataatacgcgtaaaaacgacgtatttaaacatactaacgcgcgtaacgtaatccgccgtaaaaatttcgccaaaaccgacgcaacaccatacgtaaaatacttaaccgcatccctaacgtcaacgcgccgaaaaacaacgacaccgacaaccacaactttcatacctacaaatccgataatatatcgttaacgataaaacgtaactaaatctcccgactatttacatcctaacttaccaactataataaataattaatcaacgtatt

SEQ ID NO: 11141 - DNA, 586 bp, Artificial Sequence
  chemically treated genomic DNA (Homo sapiens) CpG-island No: 11141
gttcgcgtgatttttgattaggtggattatttgtaatatatttgaagaattggcggcgtttattaagggattcggcgatgtttcggtacgtttgaacgcgttttatgtttacggcgtgtatggcgaggcgtaaagttgggcgagcgttacgtcggaagacgttgagtcgttggttgatgcgttaaaggtgcgcggggtgagtcggttgatattttcggcgttttatttgtgatatgtcggatacggtttacggttcggtatagatttgtaggtttgataagacgcgttaagcgtcgtattaggtattgtgttttaattgtcggatgcggcgcgaacgttttattcggtttacggttcggtataaatttgtaggtatgataagacgcgataagcgtcgtattatgtattatgcgtcgattgtcggatgcggcgtgaacgttttattcgatttacgattcggggtcgtttgtaggttcgataagacgcgttagcgtcgtatcgggtattcgttgtcgcgtaaacgttttattcgtttaggcgtatagggtcgttatatggaaaaattaacggttttgtttttttaata

SEQ ID NO: 11142 - DNA, 586 bp, Artificial Sequence
  chemically treated genomic DNA (Homo sapiens) CpG-island No: 11142
tattaaaaaaacaaaaccgttaatttttccatataacgaccctatacgcctaaacgaataaaacgtttacgcgacaacgaatacccgatacgacgctaacgcgtcttatcgaacctacaaacgaccccgaatcgtaaatcgaataaaacgttcacgccgcatccgacaatcgacgcataatacataatacgacgcttatcgcgtcttatcatacctacaaatttataccgaaccgtaaaccgaataaaacgttcgcgccgcatccgacaattaaaacacaatacctaatacgacgcttaacgcgtcttatcaaacctacaaatctataccgaaccgtaaaccgtatccgacatatcacaaataaaacgccgaaaatatcaaccgactcaccccgcgcacctttaacgcatcaaccaacgactcaacgtcttccgacgtaacgctcgcccaactttacgcctcgccatacacgccgtaaacataaaacgcgttcaaacgtaccgaaacatcgccgaatcccttaataaacgccgccaattcttcaaatatattacaaataatccacctaatcaaaaatcacgcgaac

SEQ ID NO: 11143 - DNA, 586 bp, Artificial Sequence
  chemically treated genomic DNA (Homo sapiens) CpG-island No: 11143
tgttgagaaagtagagtcgttaatttttttatataacggttttgtacgtttggacggataaagcgtttacgcgataacggatgttcgatgcgacgttggcgcgttttatcgggtttataaacggtttcgaatcgtaggtcggataaggcgtttacgtcgtattcggtagtcggcgtataatgtatgatgcgacgtttgtcgcgttttattatgtttataggtttgtgtcgaatcgtaggtcggataaggcgttcgcgtcgtattcggtagttggagtataatgtttgatgcgacgtttgacgcgttttattaggtttataagtttgtgtcgaatcgtaggtcgtattcggtatgttataaatagagcgtcggaaatattaatcggtttatttcgcgtatttttaacgtattagttaacggtttaacgtttttcggcgtggcgttcgtttagttttgcgtttcgttatatacgtcgtgggtatgaaacgcgtttaggcgtatcggaatatcgtcgagttttttgataaacgtcgttagttttttagatgtgttgtaaataatttatttggttagggattacgcgagt

SEQ ID NO: 11144 - DNA, 586 bp, Artificial Sequence
  chemically treated genomic DNA (Homo sapiens) CpG-island No: 11144
actcgcgtaatccctaaccaaataaattatttacaacacatctaaaaaactaacgacgtttatcaaaaaactcgacgatattccgatacgcctaaacgcgtttcatacccacgacgtatataacgaaacgcaaaactaaacgaacgccacgccgaaaaacgttaaaccgttaactaatacgttaaaaatacgcgaaataaaccgattaatatttccgacgctctatttataacataccgaatacgacctacgattcgacacaaacttataaacctaataaaacgcgtcaaacgtcgcatcaaacattatactccaactaccgaatacgacgcgaacgccttatccgacctacgattcgacacaaacctataaacataataaaacgcgacaaacgtcgcatcatacattatacgccgactaccgaatacgacgtaaacgccttatccgacctacgattcgaaaccgtttataaacccgataaaacgcgccaacgtcgcatcgaacatccgttatcgcgtaaacgctttatccgtccaaacgtacaaaaccgttatataaaaaaattaacgactctactttctcaaca

SEQ ID NO: 11145 - DNA, 1166 bp, Artificial Sequence
  chemically treated genomic DNA (Homo sapiens) CpG-island No: 11145
  misc_feature (54)..(54): n is either a, c, g or t
cggtttcgcgttgtttttgatttttttttttttacgggggttatagtcgttgancgttatttttttcgattgttagtttttttttttcgagcgcgtttagtgttgcgtcgttcgtttattagattattagtttcgttttttttcgacggttttgtatcgttttgggggttattcggcgtcgcggggtaattgttagttaatatcgcgttttatttcggtttgttgcgttagtatttaggttattaatttaattagtattcggggattttagagtagtttcggtcgcggtcggcgtaggtagtattttattcgttttcggtattcgtttatattaatcgagtagttattacggtttttgcggattgtttgtcgttagataacgatgcggatttaagcggagttttttcggtagcgttgttagagtgcggttatcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtattgttaagcggagtattcgtaggtagttttttagtcggggtcgaggttttttatcgggcgcgggcgtgttttgttcgggtaattgttggtaggtgcgggagaggatgaacggtagcgggtcgggtagggcgatgtcggttttatcgggaaggatttttgtatcgagtaggggattgatcggatggtcggacgttatttcgtcggggtatatcgaataggttacgcggtgggggtattaatattgattcgggattttttagagttattttcgttttgttcgttagtcggtaaggttaggaatagtaggtcgttgaaaatcgttattagaataaagtttattagcgtgatacgagtttcgtttagacggttagataatgtattatttgtataacgcgttagcgtattaataaacggttcgaagaaagcgtattgtagaatttgaatattcgggaattgcgtttttgatagtattgtaaagttcgcggagaagtcgatgaaggagtcgaaggttgttagatatagtaggtttataatttatagatgatttcgtttgagtatcggtaattgttttttgatggaggttttcgag

SEQ ID NO: 11146 - DNA, 1166 bp, Artificial Sequence
  chemically treated genomic DNA (Homo sapiens) CpG-island No: 11146
  misc_feature (1113)..(1113): n is either a, c, g or t
ctcgaaaacctccatcaaaaaacaattaccgatactcaaacgaaatcatctataaattataaacctactatatctaacaaccttcgactccttcatcgacttctccgcgaactttacaatactatcaaaaacgcaattcccgaatattcaaattctacaatacgctttcttcgaaccgtttattaatacgctaacgcgttatacaaataatacattatctaaccgtctaaacgaaactcgtatcacgctaataaactttattctaataacgattttcaacgacctactattcctaaccttaccgactaacgaacaaaacgaaaataactctaaaaaatcccgaatcaatattaatacccccaccgcgtaacctattcgatataccccgacgaaataacgtccgaccatccgatcaatcccctactcgatacaaaaatccttcccgataaaaccgacatcgccctacccgacccgctaccgttcatcctctcccgcacctaccaacaattacccgaacaaaacacgcccgcgcccgataaaaaacctcgaccccgactaaaaaactacctacgaatactccgcttaacaatacgcgataacacactaatactcaataataacgacgacaaaaacctatattttaaacacctatttcccgataaaaacgattacaaccgcaacgaatcactataactaatacgcgacgacgtaacgaaactaaataaaaatcaccgataaccgcactctaacaacgctaccgaaaaaactccgcttaaatccgcatcgttatctaacgacaaacaatccgcaaaaaccgtaataactactcgattaatataaacgaataccgaaaacgaataaaatactacctacgccgaccgcgaccgaaactactctaaaatccccgaatactaattaaattaataacctaaatactaacgcaacaaaccgaaataaaacgcgatattaactaacaattaccccgcgacgccgaataacccccaaaacgatacaaaaccgtcgaaaaaaaacgaaactaataatctaataaacgaacgacgcaacactaaacgcgctcgaaaaaaaaaaactaacaatcgaaaaaaataacgntcaacgactataacccccgtaaaaaaaaaaaaatcaaaaacaacgcgaaaccg

SEQ ID NO: 11147 - DNA, 1166 bp, Artificial Sequence
  chemically treated genomic DNA (Homo sapiens) CpG-island No: 11147
  misc_feature (1113)..(1113): n is either a, c, g or t
ttcgaaagtttttattaaggagtagttgtcggtatttaaacggggttatttgtggattatgagtttgttgtatttggtaattttcggtttttttatcggttttttcgcgggttttgtaatgttgttaaaaacgtagttttcggatgtttagattttgtaatacgtttttttcgggtcgtttattggtgcgttggcgcgttatgtaggtggtgtattatttgatcgtttgggcggaattcgtgttacgttggtgaattttattttgatggcgatttttagcggtttgttgtttttgattttatcgattgacgggtagggcggaagtgattttagaggatttcgggttagtattggtgtttttatcgcgtggtttgttcggtgtgtttcggcggagtgacgttcggttattcggttaattttttgttcggtgtaaaggtttttttcggtgaaatcgatatcgttttgttcggttcgttgtcgtttattttttttcgtatttattagtagttattcggataaaatacgttcgcgttcggtggggagtttcggtttcggttggaaaattgtttgcggatatttcgtttaatagtgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggtggtcgtattttggtagcgttgtcggaagaatttcgtttaagttcgtatcgttatttggcgataaatagttcgtaggggtcgtggtggttgttcggttggtgtgagcgggtgtcggaagcggatgaggtgttgtttgcgtcggtcgcgatcgggattgttttgagattttcgggtattggttggattgataatttgaatgttggcgtagtaggtcggagtagagcgcggtgttggttgatagttatttcgcgacgtcgggtagtttttaaggcgatatagagtcgtcggaggaaaacggagttggtgatttggtggacgagcgacgtaatattgggcgcgttcgaggaggagggattagtaatcgagaggaataacgnttaacggttgtggttttcgtagggggaggaaaattagagataacgcgaggtcg

SEQ ID NO: 11148 - DNA, 1166 bp, Artificial Sequence
  chemically treated genomic DNA (Homo sapiens) CpG-island No: 11148
  misc_feature (54)..(54): n is either a, c, g or t
cgacctcgcgttatctctaattttcctccccctacgaaaaccacaaccgttaancgttattcctctcgattactaatccctcctcctcgaacgcgcccaatattacgtcgctcgtccaccaaatcaccaactccgttttcctccgacgactctatatcgccttaaaaactacccgacgtcgcgaaataactatcaaccaacaccgcgctctactccgacctactacgccaacattcaaattatcaatccaaccaatacccgaaaatctcaaaacaatcccgatcgcgaccgacgcaaacaacacctcatccgcttccgacacccgctcacaccaaccgaacaaccaccacgacccctacgaactatttatcgccaaataacgatacgaacttaaacgaaattcttccgacaacgctaccaaaatacgaccaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcactattaaacgaaatatccgcaaacaattttccaaccgaaaccgaaactccccaccgaacgcgaacgtattttatccgaataactactaataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaaccacgcgataaaaacaccaatactaacccgaaatcctctaaaatcacttccgccctacccgtcaatcgataaaatcaaaaacaacaaaccgctaaaaatcgccatcaaaataaaattcaccaacgtaacacgaattccgcccaaacgatcaaataatacaccacctacataacgcgccaacgcaccaataaacgacccgaaaaaaacgtattacaaaatctaaacatccgaaaactacgtttttaacaacattacaaaacccgcgaaaaaaccgataaaaaaaccgaaaattaccaaatacaacaaactcataatccacaaataaccccgtttaaataccgacaactactccttaataaaaactttcgaa

SEQ ID NO: 11149 - DNA, 861 bp, Artificial Sequence
  chemically treated genomic DNA (Homo sapiens) CpG-island No: 11149
cggcgtcgcgcgcgcgatcggttcgttaattttttgagtcgcgcgcgtttttcgttaagattcgttttttttcgcggttattggtcgagtttcgtatttttttttaagggggaacgtttttttttttcgatagattttgtagatagttaatggaacgtcgtagggtttcgcgtttcgtttttttgggggttcgttggaggcgagcgtgggcgggtcgttaggaaggtggggcgcggagtttggtaatcgttgtcggtaataacgtttcgtttcgtcgggcgggcgggttgcgcgaggttggttggcggcgggagtcggaggaggagcggtcgtcgtcgttatcgtcgtcgttatagagattgtagtcgtggagattgttatttattaacggggattaatacgtagtagtcgttgtcgtcgtcgcgggagtcgttgttcgaattttcggttcgaattttaggtgatcgatgcgatcgtttcgggtttagttcggtcggggagtgtggggggcggcggggatttcgttcggggggtcggggggcgggtagtacgttttcgtcgtttattttaaacgttcgggtggtgcgttcgcgggattcgttttcgttaattttcgtttttcgcgcgcggcggagtttggggggattttggcgacgtttttattttttttattgattgaacgcgggggaggtgcggtgtcgtcgttttattttttataaaattttttgaggttggggcgttcggggattttttttttacgtttatttttaaattcgttgagttgggggcgtttcgggaacgttttttaaattttttaaattttttgaattgggggcgtttggggattttttttttatttta

SEQ ID NO: 11150 - DNA, 861 bp, Artificial Sequence
  chemically treated genomic DNA (Homo sapiens) CpG-island No: 11150
taaaataaaaaaaaaatccccaaacgcccccaattcaaaaaatttaaaaaatttaaaaaacgttcccgaaacgcccccaactcaacgaatttaaaaataaacgtaaaaaaaaaatccccgaacgccccaacctcaaaaaattttataaaaaataaaacgacgacaccgcacctcccccgcgttcaatcaataaaaaaaataaaaacgtcgccaaaatccccccaaactccgccgcgcgcgaaaaacgaaaattaacgaaaacgaatcccgcgaacgcaccacccgaacgtttaaaataaacgacgaaaacgtactacccgccccccgaccccccgaacgaaatccccgccgccccccacactccccgaccgaactaaacccgaaacgatcgcatcgatcacctaaaattcgaaccgaaaattcgaacaacgactcccgcgacgacgacaacgactactacgtattaatccccgttaataaataacaatctccacgactacaatctctataacgacgacgataacgacgacgaccgctcctcctccgactcccgccgccaaccaacctcgcgcaacccgcccgcccgacgaaacgaaacgttattaccgacaacgattaccaaactccgcgccccaccttcctaacgacccgcccacgctcgcctccaacgaacccccaaaaaaacgaaacgcgaaaccctacgacgttccattaactatctacaaaatctatcgaaaaaaaaaaacgttcccccttaaaaaaaaatacgaaactcgaccaataaccgcgaaaaaaaacgaatcttaacgaaaaacgcgcgcgactcaaaaaattaacgaaccgatcgcgcgcgcgacgccg

SEQ ID NO: 11151 - DNA, 861 bp, Artificial Sequence
  chemically treated genomic DNA (Homo sapiens) CpG-island No: 11151
taaggtgagaagagggtttttaagcgtttttaatttagggagtttgaggagtttgagagacgttttcggggcgtttttaatttagcgagtttgaaggtaagcgtgagaaaggggttttcggacgttttaattttaggaagttttgtaaaaagtgaggcgacggtatcgtatttttttcgcgtttagttaataaggaaagtggggacgtcgttagggtttttttaaatttcgtcgcgcgcgggaaacgggggttggcggaggcgggtttcgcgggcgtattattcggacgtttggggtgagcggcggggacgtgttgttcgtttttcggtttttcgaacggggttttcgtcgttttttatatttttcggtcgggttgggttcggggcggtcgtatcggttatttggagttcgggtcgggagttcgggtagcggttttcgcggcggcggtagcggttgttgcgtgttggttttcgttggtaagtaatagtttttacggttatagtttttatggcggcggcggtggcggcggcggtcgtttttttttcggttttcgtcgttagttagtttcgcgtagttcgttcgttcgacggggcggggcgttgttatcggtaacggttattaggtttcgcgttttatttttttaacggttcgtttacgttcgtttttaacgggtttttaagagggcggggcgcgagattttacggcgttttattggttgtttgtagagtttgtcggaaggaggaggcgtttttttttgaaaaagagtgcgagattcggttaatggtcgcgaagaggggcgggttttggcgggaggcgcgcgcggtttagagggttggcgaatcggtcgcgcgcgcggcgtcg

SEQ ID NO: 11152 - DNA, 861 bp, Artificial Sequence
  chemically treated genomic DNA (Homo sapiens) CpG-island No: 11152
cgacgccgcgcgcgcgaccgattcgccaaccctctaaaccgcgcgcgcctcccgccaaaacccgcccctcttcgcgaccattaaccgaatctcgcactctttttcaaaaaaaaacgcctcctccttccgacaaactctacaaacaaccaataaaacgccgtaaaatctcgcgccccgccctcttaaaaacccgttaaaaacgaacgtaaacgaaccgttaaaaaaataaaacgcgaaacctaataaccgttaccgataacaacgccccgccccgtcgaacgaacgaactacgcgaaactaactaacgacgaaaaccgaaaaaaaaacgaccgccgccgccaccgccgccgccataaaaactataaccgtaaaaactattacttaccaacgaaaaccaacacgcaacaaccgctaccgccgccgcgaaaaccgctacccgaactcccgacccgaactccaaataaccgatacgaccgccccgaacccaacccgaccgaaaaatataaaaaacgacgaaaaccccgttcgaaaaaccgaaaaacgaacaacacgtccccgccgctcaccccaaacgtccgaataatacgcccgcgaaacccgcctccgccaacccccgtttcccgcgcgcgacgaaatttaaaaaaaccctaacgacgtccccactttccttattaactaaacgcgaaaaaaatacgataccgtcgcctcactttttacaaaacttcctaaaattaaaacgtccgaaaacccctttctcacgcttaccttcaaactcgctaaattaaaaacgccccgaaaacgtctctcaaactcctcaaactccctaaattaaaaacgcttaaaaaccctcttctcacctta

SEQ ID NO: 11153 - DNA, 521 bp, Artificial Sequence
  chemically treated genomic DNA (Homo sapiens) CpG-island No: 11153
  misc_feature (477)..(477): n is either a, c, g or t
cggaggggcggtcgttcggggggatacgcgtgtatagtcggatacgtcggtcgggttcgatatttcgcgtatattcgatggttatacgggtagggcgtcgtatacgtcggtatcgggtatatatagggtcgcgcgggcgtacgtcgggttcgtcgtagcgttacggatatatatttcgaggggttttgcgttttagcgtttagtaggcgttttttgtacgttagattttatagtttttattacgagattttcgtagttttcgtcgttagcgcgaacgtaggtttagggttaattataaaagggattttgtagggcggatttcgttttaggtcgcgggcgtaggattatgtcggggggagagcgggatgtaatttaattttggtttacgttttcggggagttttttgggtttatatacgataggtacgatcgtacgttgttagtatttatttacgtttaggaaatttagattgtgtanaggtaaggggttcggttaggggtttagttatatgttataagcgt

SEQ ID NO: 11154 - DNA, 521 bp, Artificial Sequence
  chemically treated genomic DNA (Homo sapiens) CpG-island No: 11154
  misc_feature (45)..(45): n is either a, c, g or t
acgcttataacatataactaaacccctaaccgaaccccttacctntacacaatctaaatttcctaaacgtaaataaatactaacaacgtacgatcgtacctatcgtatataaacccaaaaaactccccgaaaacgtaaaccaaaattaaattacatcccgctctccccccgacataatcctacgcccgcgacctaaaacgaaatccgccctacaaaatcccttttataattaaccctaaacctacgttcgcgctaacgacgaaaactacgaaaatctcgtaataaaaactataaaatctaacgtacaaaaaacgcctactaaacgctaaaacgcaaaacccctcgaaatatatatccgtaacgctacgacgaacccgacgtacgcccgcgcgaccctatatatacccgataccgacgtatacgacgccctacccgtataaccatcgaatatacgcgaaatatcgaacccgaccgacgtatccgactatacacgcgtatccccccgaacgaccgcccctccg

SEQ ID NO: 11155 - DNA, 521 bp, Artificial Sequence
  chemically treated genomic DNA (Homo sapiens) CpG-island No: 11155
  misc_feature (45)..(45): n is either a, c, g or t
gcgtttatggtatatgattgggtttttggtcgggttttttatttntgtatagtttggattttttggacgtggatgggtattggtaacgtacggtcgtgtttgtcgtgtatgaatttagggagtttttcgaaggcgtgaattagggttgaattgtatttcgtttttttttcggtatagttttgcgttcgcgatttggagcggagttcgttttgtagggttttttttgtgattgattttgagtttgcgttcgcgttgacgacggggattgcggggatttcgtggtgggaattgtggggtttgacgtataagaggcgtttgttgggcgttaggacgtaggatttttcggagtgtgtgttcgtggcgttgcggcgggttcggcgtgcgttcgcgcggttttatgtgtgttcggtgtcggcgtgtgcggcgttttgttcgtgtggttatcgggtgtgcgcggggtgtcgagttcggtcggcgtgttcggttgtgtacgcgtgttttttcgagcggtcgttttttcg

SEQ ID NO: 11156 - DNA, 521 bp, Artificial Sequence
  chemically treated genomic DNA (Homo sapiens) CpG-island No: 11156
  misc_feature (477)..(477): n is either a, c, g or t
cgaaaaaacgaccgctcgaaaaaacacgcgtacacaaccgaacacgccgaccgaactcgacaccccgcgcacacccgataaccacacgaacaaaacgccgcacacgccgacaccgaacacacataaaaccgcgcgaacgcacgccgaacccgccgcaacgccacgaacacacactccgaaaaatcctacgtcctaacgcccaacaaacgcctcttatacgtcaaaccccacaattcccaccacgaaatccccgcaatccccgtcgtcaacgcgaacgcaaactcaaaatcaatcacaaaaaaaaccctacaaaacgaactccgctccaaatcgcgaacgcaaaactataccgaaaaaaaaacgaaatacaattcaaccctaattcacgccttcgaaaaactccctaaattcatacacgacaaacacgaccgtacgttaccaatacccatccacgtccaaaaaatccaaactatacanaaataaaaaacccgaccaaaaacccaatcatataccataaacgc

SEQ ID NO: 11157 - DNA, 801 bp, Artificial Sequence
  chemically treated genomic DNA (Homo sapiens) CpG-island No: 11157
gacgggcgcggggtttttttcgtggggttcggtttttcgaggttcgcgtttcgtattcgttcgtcgtcgtcgttcgcggttcggggtttttgagggggcggggtcgttcgcgcggtttgggtcgttttgaggggagtttcgcgcgtttcgattcgtcgtcgtttcgcgtcggttcggttcgagatttatcgtttcggttttcgtcgttatcgtcgtcgttcgggtttttttaggttatcgtcgtcgtcgtcgttttttttcgggttcgtaagttttttttttttttttcgtatcgattatcgtcgtcgtcgtcgtcgtcgtcgtcgcgttgcgttatcgcgtcgtgcgttatcgtttttggtttcgtttcgacgggggtcgtcgcgcgtcggtattagtttacgttcgggtgacgaacggcgcgttagttaacgggcggcgagggtagttcgaagggcgggaggtgtgagtcgagtaaggcggggtcgcggcgaggggggagcgacggtggtggaacggggtttaagaggttcgtttttttttcggcgggattggtcggacgtgggggtgacgggtagtcggttaggtttggggtttggggttggggggcggggaaggggcggggcgcgcggggcgttgtttagggtaacgggttcggcggagtttgaggttgggtttttaggttcgtagggggtaggttcgcgcgcgtttattttagttgtttcgagcgaagttatagtttttgatttaggcgttttaggttttttttttttcgttttttgggtggttcgttttatttaa

SEQ ID NO: 11158 - DNA, 801 bp, Artificial Sequence
  chemically treated genomic DNA (Homo sapiens) CpG-island No: 11158
ttaaataaaacgaaccacccaaaaaacgaaaaaaaaaaaacctaaaacgcctaaatcaaaaactataacttcgctcgaaacaactaaaataaacgcgcgcgaacctaccccctacgaacctaaaaacccaacctcaaactccgccgaacccgttaccctaaacaacgccccgcgcgccccgccccttccccgccccccaaccccaaaccccaaacctaaccgactacccgtcacccccacgtccgaccaatcccgccgaaaaaaaaacgaacctcttaaaccccgttccaccaccgtcgctcccccctcgccgcgaccccgccttactcgactcacacctcccgcccttcgaactaccctcgccgcccgttaactaacgcgccgttcgtcacccgaacgtaaactaataccgacgcgcgacgacccccgtcgaaacgaaaccaaaaacgataacgcacgacgcgataacgcaacgcgacgacgacgacgacgacgacgacgataatcgatacgaaaaaaaaaaaaaaaacttacgaacccgaaaaaaaacgacgacgacgacgataacctaaaaaaacccgaacgacgacgataacgacgaaaaccgaaacgataaatctcgaaccgaaccgacgcgaaacgacgacgaatcgaaacgcgcgaaactcccctcaaaacgacccaaaccgcgcgaacgaccccgccccctcaaaaaccccgaaccgcgaacgacgacgacgaacgaatacgaaacgcgaacctcgaaaaaccgaaccccacgaaaaaaaccccgcgcccgtc

SEQ ID NO: 11159 - DNA, 801 bp, Artificial Sequence
  chemically treated genomic DNA (Homo sapiens) CpG-island No: 11159
ttgggtgaggcgggttatttaaggggcggggaagaggaggtttggaacgtttgaattaggaattgtgatttcgttcggggtagttggggtggacgcgcgcgagtttgttttttgcgggtttggaggtttaattttagatttcgtcgggttcgttgttttgggtaacgtttcgcgcgtttcgtttttttttcgttttttagttttaaattttaggtttggtcgattgttcgttatttttacgttcgattaatttcgtcgaggagggggcgggttttttgggtttcgttttattatcgtcgtttttttttcgtcgcgatttcgttttattcggtttatatttttcgtttttcgggttgttttcgtcgttcgttggttggcgcgtcgttcgttattcgggcgtgagttaatgtcggcgcgcggcggttttcgtcggggcggggttaggggcggtgacgtacggcgcggtgacgtagcgcgacggcggcggcggcggcggcggcggtggtcggtgcgggaggagggaggggagtttgcgggttcgagagggggcgacggcggcggcggtggtttgaggaggttcgagcggcggcggtggcggcgaaggtcgaggcggtgagtttcgggtcgggtcggcgcggggcggcggcgagtcggggcgcgcggggttttttttagggcgatttaggtcgcgcgggcggtttcgtttttttagggatttcgaatcgcgggcggcggcggcgggcgggtgcggaacgcgggtttcggggggtcgggttttacgggagaagtttcgcgttcgtt

SEQ ID NO: 11160 - DNA, 801 bp, Artificial Sequence
  chemically treated genomic DNA (Homo sapiens) CpG-island No: 11160
aacgaacgcgaaacttctcccgtaaaacccgaccccccgaaacccgcgttccgcacccgcccgccgccgccgcccgcgattcgaaatccctaaaaaaacgaaaccgcccgcgcgacctaaatcgccctaaaaaaaaccccgcgcgccccgactcgccgccgccccgcgccgacccgacccgaaactcaccgcctcgaccttcgccgccaccgccgccgctcgaacctcctcaaaccaccgccgccgccgtcgccccctctcgaacccgcaaactcccctccctcctcccgcaccgaccaccgccgccgccgccgccgccgccgtcgcgctacgtcaccgcgccgtacgtcaccgcccctaaccccgccccgacgaaaaccgccgcgcgccgacattaactcacgcccgaataacgaacgacgcgccaaccaacgaacgacgaaaacaacccgaaaaacgaaaaatataaaccgaataaaacgaaatcgcgacgaaaaaaaaacgacgataataaaacgaaacccaaaaaacccgccccctcctcgacgaaattaatcgaacgtaaaaataacgaacaatcgaccaaacctaaaatttaaaactaaaaaacgaaaaaaaaacgaaacgcgcgaaacgttacccaaaacaacgaacccgacgaaatctaaaattaaacctccaaacccgcaaaaaacaaactcgcgcgcgtccaccccaactaccccgaacgaaatcacaattcctaattcaaacgttccaaacctcctcttccccgccccttaaataacccgcctcacccaa

SEQ ID NO: 11161 - DNA, 567 bp, Artificial Sequence
  chemically treated genomic DNA (Homo sapiens) CpG-island No: 11161
ggattttaggatatttagaggattcgatttcggtttggatgggttttttcgttaagtaggatagattggtaaagcgttggggttcgtcgtgggtttgaggatgtagagaagttggcgggggagaggggcggcggggcgcggtcgttatttacgtaggtcgttatattttttttcgcggtcgttagtagttttaggatcgggtcggcgtcggggagtagtttcgagcggtgtaggtcgttgagtattgtttgggcgttcgcgatgtttcgggttacgtggcggagtcgagcgtaggattgcggggacgagagggcgttagagcgggtcgcgttcgggttatgtttttttcgtttattttcgggttttatcgatggtcgcggaggattttttttggggcggaaggagtagttgcgttgtttttagtttagcgttttttttttttgcgggataagcggcgtttatcgtatacggttaggttttttcgttagggtttttaatttttgtatagtttgggatttttggacgtggatgggtattggtagcgtacggtcgtgtttgtcgtgtatt

SEQ ID NO: 11162 - DNA, 567 bp, Artificial Sequence
  chemically treated genomic DNA (Homo sapiens) CpG-island No: 11162
aatacacgacaaacacgaccgtacgctaccaatacccatccacgtccaaaaatcccaaactatacaaaaattaaaaaccctaacgaaaaaacctaaccgtatacgataaacgccgcttatcccgcaaaaaaaaaaaacgctaaactaaaaacaacgcaactactccttccgccccaaaaaaaatcctccgcgaccatcgataaaacccgaaaataaacgaaaaaaacataacccgaacgcgacccgctctaacgccctctcgtccccgcaatcctacgctcgactccgccacgtaacccgaaacatcgcgaacgcccaaacaatactcaacgacctacaccgctcgaaactactccccgacgccgacccgatcctaaaactactaacgaccgcgaaaaaaaatataacgacctacgtaaataacgaccgcgccccgccgcccctctcccccgccaacttctctacatcctcaaacccacgacgaaccccaacgctttaccaatctatcctacttaacgaaaaaacccatccaaaccgaaatcgaatcctctaaatatcctaaaatcc

SEQ ID NO: 11163 - DNA, 567 bp, Artificial Sequence
  chemically treated genomic DNA (Homo sapiens) CpG-island No: 11163
agtatacgataggtacgatcgtgcgttgttagtatttatttacgtttaggaattttagattgtgtagaggttaggggttttggcgagggggtttagtcgtatgcgataagcgtcgtttgtttcgtaggaggaagaggcgttgagttgggggtagcgtaattgtttttttcgttttaggagggatttttcgcggttatcggtgaggttcgggagtgggcgggagaggtatggttcgggcgcggttcgttttaacgttttttcgttttcgtagttttgcgttcggtttcgttacgtggttcggggtatcgcggacgtttaggtagtgtttagcggtttgtatcgttcggagttgtttttcggcgtcggttcgattttggagttgttggcggtcgcggggagggatgtggcggtttgcgtgagtgacggtcgcgtttcgtcgtttttttttttcgttagtttttttgtatttttaggtttacggcgagttttagcgttttgttaatttgttttgtttagcggaaaaatttatttagatcggagtcgggttttttgggtgttttgaaattt

SEQ ID NO: 11164 - DNA, 567 bp, Artificial Sequence
  chemically treated genomic DNA (Homo sapiens) CpG-island No: 11164
aaatttcaaaacacccaaaaaacccgactccgatctaaataaatttttccgctaaacaaaacaaattaacaaaacgctaaaactcgccgtaaacctaaaaatacaaaaaaactaacgaaaaaaaaaaacgacgaaacgcgaccgtcactcacgcaaaccgccacatccctccccgcgaccgccaacaactccaaaatcgaaccgacgccgaaaaacaactccgaacgatacaaaccgctaaacactacctaaacgtccgcgataccccgaaccacgtaacgaaaccgaacgcaaaactacgaaaacgaaaaaacgttaaaacgaaccgcgcccgaaccatacctctcccgcccactcccgaacctcaccgataaccgcgaaaaatccctcctaaaacgaaaaaaacaattacgctacccccaactcaacgcctcttcctcctacgaaacaaacgacgcttatcgcatacgactaaaccccctcgccaaaacccctaacctctacacaatctaaaattcctaaacgtaaataaatactaacaacgcacgatcgtacctatcgtatact

SEQ ID NO: 11165 - DNA, 518 bp, Artificial Sequence
  chemically treated genomic DNA (Homo sapiens) CpG-island No: 11165
cgcggtggtcgcgggattgtgggtcgtgtgtacggtgggcgcggcgattcgttagcgttgtttgttttcgtattatcgttcgttggagtttcggacgttggcggcggttaaggcgttgaggaatcgttaagtgagtgatcgtttagtttttgcgtttttcggtatattggtttcgtcgggtttttatatattcgtcgttgattcgaggggttttgcgttttagcgtttagtaggcgttttttgtacgttagagtttatagtttttattacgagattttcgtagttttcgtcgttagcgcgaacgtaggtttagggttagttataaaaggagttttgtagggcggattcggttttaggtcgcgggcgtagggttatgtcgggggagagcgggatgtaatttaattttggtttacgttttcggggagttttttggtttagtatacgataggtacgatcgtacgttgttagtatttatttacgtttaggaattttagattgtgtagaggttaggggttttg

SEQ ID NO: 11166 - DNA, 518 bp, Artificial Sequence
  chemically treated genomic DNA (Homo sapiens) CpG-island No: 11166
caaaacccctaacctctacacaatctaaaattcctaaacgtaaataaatactaacaacgtacgatcgtacctatcgtatactaaaccaaaaaactccccgaaaacgtaaaccaaaattaaattacatcccgctctcccccgacataaccctacgcccgcgacctaaaaccgaatccgccctacaaaactccttttataactaaccctaaacctacgttcgcgctaacgacgaaaactacgaaaatctcgtaataaaaactataaactctaacgtacaaaaaacgcctactaaacgctaaaacgcaaaacccctcgaatcaacgacgaatatataaaaacccgacgaaaccaatataccgaaaaacgcaaaaactaaacgatcactcacttaacgattcctcaacgccttaaccgccgccaacgtccgaaactccaacgaacgataatacgaaaacaaacaacgctaacgaatcgccgcgcccaccgtacacacgacccacaatcccgcgaccaccgcg

SEQ ID NO: 11167 - DNA, 518 bp, Artificial Sequence
  chemically treated genomic DNA (Homo sapiens) CpG-island No: 11167
tagggtttttaatttttgtatagtttgggatttttggacgtggatgggtattggtagcgtacggtcgtgtttgtcgtgtattgaattagggagtttttcgaaggcgtgaattagggttgaattgtatttcgttttttttcggtatagttttgcgttcgcgatttggagtcgagttcgttttgtagggttttttttgtgattgattttgagtttgcgttcgcgttgacgacggggattgcggggatttcgtggtgggaattgtgggttttgacgtataagaggcgtttgttgggcgttaggacgtaggatttttcgggttagcgacgggtgtgtgggaattcggcggggttagtgtatcggggggcgtaagggttgggcggttatttatttagcggttttttagcgttttgatcgtcgttagcgttcggggttttagcgagcggtagtgcgagagtaggtagcgttggcggatcgtcgcgtttatcgtgtatacgatttatagtttcgcggttatcgcg

SEQ ID NO: 11168 - DNA, 518 bp, Artificial Sequence
  chemically treated genomic DNA (Homo sapiens) CpG-island No: 11168
cgcgataaccgcgaaactataaatcgtatacacgataaacgcgacgatccgccaacgctacctactctcgcactaccgctcgctaaaaccccgaacgctaacgacgatcaaaacgctaaaaaaccgctaaataaataaccgcccaacccttacgccccccgatacactaaccccgccgaattcccacacacccgtcgctaacccgaaaaatcctacgtcctaacgcccaacaaacgcctcttatacgtcaaaacccacaattcccaccacgaaatccccgcaatccccgtcgtcaacgcgaacgcaaactcaaaatcaatcacaaaaaaaaccctacaaaacgaactcgactccaaatcgcgaacgcaaaactataccgaaaaaaaacgaaatacaattcaaccctaattcacgccttcgaaaaactccctaattcaatacacgacaaacacgaccgtacgctaccaatacccatccacgtccaaaaatcccaaactatacaaaaattaaaaacccta

SEQ ID NO: 11169 - DNA, 843 bp, Artificial Sequence
  chemically treated genomic DNA (Homo sapiens) CpG-island No: 11169
gtgcggcgtggatcggtggcgttttgttcgtcgggcgcggcgcgggtaattgtggttttggaatagtgtttcgtagttttcgtcgaacgaatagcgttgttgcggtttcggtcgggtcgcggtttttttaggaattagagttagagtagggggcgtcgaggttggtggttttagggcgtcggatcggttttttcgagggtttatcgcggttcgagattttttttcggaagttttttcggatggtagtaggtatagcgaggtggtcgagtcgtttagagaacgtttaaggattattttcggtttcgcggatgtcgtttcggtttttatggttttggtttcgacggcgacggcgggggtagtttgggattttatttcgcgtagcgtttcgtagtggttttgggtcggtagggtcggggtttgtgtcgcgtttgtgtttgcgtcgttggtttgcgagtatacgtggttgattcgcgggagcgatttggagtttttgacgcggcggttgttttcgtcgttatatattttatagcggattatgagtagaacgatgaagacgaggatcgaggcgacgatgacgttttcgatggcgatgattatggtgtcgtttaagaaatgggtttttagcgggcggtagggcgtcggatttttagcggtggtgaattgtatatagtttattattcgcgttgtcggtagcgttgtggtttcgtcgtcgtagatcgttagtacgtataagtcgtaggtacggttcgtcgttaggttatttattaggaaggtttgattggtggacgggattattttgtaggagggggcgggtttagggcggggttagttttttcgaattat

SEQ ID NO: 11170 - DNA, 843 bp, Artificial Sequence
  chemically treated genomic DNA (Homo sapiens) CpG-island No: 11170
ataattcgaaaaaactaaccccgccctaaacccgccccctcctacaaaataatcccgtccaccaatcaaaccttcctaataaataacctaacgacgaaccgtacctacgacttatacgtactaacgatctacgacgacgaaaccacaacgctaccgacaacgcgaataataaactatatacaattcaccaccgctaaaaatccgacgccctaccgcccgctaaaaacccatttcttaaacgacaccataatcatcgccatcgaaaacgtcatcgtcgcctcgatcctcgtcttcatcgttctactcataatccgctataaaatatataacgacgaaaacaaccgccgcgtcaaaaactccaaatcgctcccgcgaatcaaccacgtatactcgcaaaccaacgacgcaaacacaaacgcgacacaaaccccgaccctaccgacccaaaaccactacgaaacgctacgcgaaataaaatcccaaactacccccgccgtcgccgtcgaaaccaaaaccataaaaaccgaaacgacatccgcgaaaccgaaaataatccttaaacgttctctaaacgactcgaccacctcgctatacctactaccatccgaaaaaacttccgaaaaaaaatctcgaaccgcgataaaccctcgaaaaaaccgatccgacgccctaaaaccaccaacctcgacgccccctactctaactctaattcctaaaaaaaccgcgacccgaccgaaaccgcaacaacgctattcgttcgacgaaaactacgaaacactattccaaaaccacaattacccgcgccgcgcccgacgaacaaaacgccaccgatccacgccgcac

SEQ ID NO: 11171 - DNA, 843 bp, Artificial Sequence
  chemically treated genomic DNA (Homo sapiens) CpG-island No: 11171
gtggttcggggggattaatttcgttttgaattcgtttttttttataggatgatttcgtttattagttagatttttttggtgaatgatttggcggcgggtcgtgtttacgatttgtgcgtgttggcggtttacgacgacggggttatagcgttgtcggtaacgcgagtggtgggttgtgtatagtttattatcgttggggattcggcgttttgtcgttcgttgagggtttattttttgggcggtattatgattatcgttatcgggggcgttatcgtcgtttcggttttcgtttttatcgttttgtttatgattcgttataaggtgtatggcgacggggatagtcgtcgcgttaagggttttaggtcgttttcgcgggttagttacgtgtgttcgtagattaacggcgtaggtataggcgcggtataggtttcggttttgtcggtttaggattattacgaggcgttgcgcgaggtggagttttaggttgttttcgtcgtcgtcgtcgaggttaaggttatggaggtcgagacggtattcgcggagtcggaggtggtttttggacgttttttgggcggttcggttatttcgttgtgtttgttgttattcgaggaaattttcggggaggagtttcgggtcgcggtgggttttcgaaggagtcgattcggcgttttggagttattaatttcggcgttttttattttagttttagtttttgggggagtcgcggttcggtcgaggtcgtagtagcgttattcgttcgacggggattacggggtattattttagagttatagttattcgcgtcgcgttcggcggataaagcgttatcggtttacgtcgtat

SEQ ID NO: 11172 - DNA, 843 bp, Artificial Sequence
  chemically treated genomic DNA (Homo sapiens) CpG-island No: 11172
atacgacgtaaaccgataacgctttatccgccgaacgcgacgcgaataactataactctaaaataataccccgtaatccccgtcgaacgaataacgctactacgacctcgaccgaaccgcgactcccccaaaaactaaaactaaaataaaaaacgccgaaattaataactccaaaacgccgaatcgactccttcgaaaacccaccgcgacccgaaactcctccccgaaaatttcctcgaataacaacaaacacaacgaaataaccgaaccgcccaaaaaacgtccaaaaaccacctccgactccgcgaataccgtctcgacctccataaccttaacctcgacgacgacgacgaaaacaacctaaaactccacctcgcgcaacgcctcgtaataatcctaaaccgacaaaaccgaaacctataccgcgcctatacctacgccgttaatctacgaacacacgtaactaacccgcgaaaacgacctaaaacccttaacgcgacgactatccccgtcgccatacaccttataacgaatcataaacaaaacgataaaaacgaaaaccgaaacgacgataacgcccccgataacgataatcataataccgcccaaaaaataaaccctcaacgaacgacaaaacgccgaatccccaacgataataaactatacacaacccaccactcgcgttaccgacaacgctataaccccgtcgtcgtaaaccgccaacacgcacaaatcgtaaacacgacccgccgccaaatcattcaccaaaaaaatctaactaataaacgaaatcatcctataaaaaaaaacgaattcaaaacgaaattaatccccccgaaccac

SEQ ID NO: 11173 - DNA, 640 bp, Artificial Sequence
  chemically treated genomic DNA (Homo sapiens) CpG-island No: 11173
ggaggggcggtcgttcggggggatacgcgtgtatagtcggatacgtcggtcgggttcgatatttcgcgtatattcgatggttatacgggtagggcgtcgtatacgtcggtatcgggtatatatagggtcgcgcgggcgtacgtcgggttcgtcgtagcgttacggatatatattcgtacgttcgtacgtttatattcgcgtatatattcgcgttttcgttcgtcgttttcgggtcgttgtaggtcgcgtttatttagttcgggggggtttcgggttcggtttcgtcgtcgttgtttcgtttcgcgttatggtggggggagggtcgggggagggggcgcggtgcgcgggtcgtttttttttcgttttcgggcgtttttttcgagatgttttttagtggtatttttgggcggagataggggttagcgtcgttttttcgtcgtttcgtcggtggaatggtggcgggcggtcgggcggggcggtcgtatattcgggattttcgtttcgaattcgtcgtagatttttttttattgtcgagtcgtcgcgggttcgttttcgatttttttttagttttatttttagtttcgtcggttttttcggagatttttttagattacgttttaattggtttagggatttcgga

SEQ ID NO: 11174 - DNA, 640 bp, Artificial Sequence
  chemically treated genomic DNA (Homo sapiens) CpG-island No: 11174
tccgaaatccctaaaccaattaaaacgtaatctaaaaaaatctccgaaaaaaccgacgaaactaaaaataaaactaaaaaaaaatcgaaaacgaacccgcgacgactcgacaataaaaaaaaatctacgacgaattcgaaacgaaaatcccgaatatacgaccgccccgcccgaccgcccgccaccattccaccgacgaaacgacgaaaaaacgacgctaacccctatctccgcccaaaaataccactaaaaaacatctcgaaaaaaacgcccgaaaacgaaaaaaaaacgacccgcgcaccgcgccccctcccccgaccctccccccaccataacgcgaaacgaaacaacgacgacgaaaccgaacccgaaacccccccgaactaaataaacgcgacctacaacgacccgaaaacgacgaacgaaaacgcgaatatatacgcgaatataaacgtacgaacgtacgaatatatatccgtaacgctacgacgaacccgacgtacgcccgcgcgaccctatatatacccgataccgacgtatacgacgccctacccgtataaccatcgaatatacgcgaaatatcgaacccgaccgacgtatccgactatacacgcgtatccccccgaacgaccgcccctcc

SEQ ID NO: 11175 - DNA, 640 bp, Artificial Sequence
  chemically treated genomic DNA (Homo sapiens) CpG-island No: 11175
ttcggggtttttaggttagttggggcgtggtttgggggggttttcggggaggtcggcggggttgggggtggggttggggaagggtcgggggcgggttcgcggcggttcggtagtggagaggggtttgcggcgggttcggggcggggatttcgggtgtgcgatcgtttcgttcggtcgttcgttattattttatcggcggggcggcgggggggcggcgttggtttttgttttcgtttaaggatgttattggggggtatttcgggagggacgttcggaggcgggagggaggcggttcgcgtatcgcgttttttttttcggttttttttttattatggcgcggagcgaggtagcggcggcggggtcgggttcggggttttttcgggttgggtgagcgcggtttgtagcggttcgggagcggcgggcgggggcgcgggtgtgtgcgcgggtgtgagcgtgcgagcgtgcgagtgtgtgttcgtggcgttgcggcgggttcggcgtgcgttcgcgcggttttatgtgtgttcggtgtcggcgtgtgcggcgttttgttcgtgtggttatcgggtgtgcgcggggtgtcgagttcggtcggcgtgttcggttgtgtacgcgtgttttttcgagcggtcgttttttt

SEQ ID NO: 11176 - DNA, 640 bp, Artificial Sequence
  chemically treated genomic DNA (Homo sapiens) CpG-island No: 11176
aaaaaaacgaccgctcgaaaaaacacgcgtacacaaccgaacacgccgaccgaactcgacaccccgcgcacacccgataaccacacgaacaaaacgccgcacacgccgacaccgaacacacataaaaccgcgcgaacgcacgccgaacccgccgcaacgccacgaacacacactcgcacgctcgcacgctcacacccgcgcacacacccgcgcccccgcccgccgctcccgaaccgctacaaaccgcgctcacccaacccgaaaaaaccccgaacccgaccccgccgccgctacctcgctccgcgccataataaaaaaaaaaccgaaaaaaaaaacgcgatacgcgaaccgcctccctcccgcctccgaacgtccctcccgaaataccccccaataacatccttaaacgaaaacaaaaaccaacgccgcccccccgccgccccgccgataaaataataacgaacgaccgaacgaaacgatcgcacacccgaaatccccgccccgaacccgccgcaaacccctctccactaccgaaccgccgcgaacccgcccccgacccttccccaaccccacccccaaccccgccgacctccccgaaaacccccccaaaccacgccccaactaacctaaaaaccccgaa

SEQ ID NO: 11177 - DNA, 591 bp, Artificial Sequence
  chemically treated genomic DNA (Homo sapiens) CpG-island No: 11177
ggagatcggtcgtttacggggggttatagtagcggtcgttcgtttaggatggagaggcgggttttaggttcggttcggagcgagttttttagggtttgtcgatacggcggggttcggtggtcggtatttggttcgtacgtgttcgaggggttttcgggttttcggtattatggttattatcggggtttcgattacgacgaggtcgatggttcgggtagcgggggcggcgaggaggttatggtcggggtttacgacgcgttatttttcgtacgatacgcgttttcgggcgttatcgggcgttcgtttaggatttttcgggtttcgggttcggtttgcgtttcgttttttcggtacggtcggcgattttttaacggttattattcggcgtacggattggttaggtttcgcgggtcgggttttaggaagggtttgtacgaattttatagcgagagtgacgatgattggtgttaagttcgggcgaggtggcgttcgttcggttttttacgtattttacgtatatattttattcgaggagtcgcgtagaggtcgcgggggtttagtatagagggttcgggagagggttagtcggga

SEQ ID NO: 11178 - DNA, 591 bp, Artificial Sequence
  chemically treated genomic DNA (Homo sapiens) CpG-island No: 11178
tcccgactaaccctctcccgaaccctctatactaaacccccgcgacctctacgcgactcctcgaataaaatatatacgtaaaatacgtaaaaaaccgaacgaacgccacctcgcccgaacttaacaccaatcatcgtcactctcgctataaaattcgtacaaacccttcctaaaacccgacccgcgaaacctaaccaatccgtacgccgaataataaccgttaaaaaatcgccgaccgtaccgaaaaaacgaaacgcaaaccgaacccgaaacccgaaaaatcctaaacgaacgcccgataacgcccgaaaacgcgtatcgtacgaaaaataacgcgtcgtaaaccccgaccataacctcctcgccgcccccgctacccgaaccatcgacctcgtcgtaatcgaaaccccgataataaccataataccgaaaacccgaaaacccctcgaacacgtacgaaccaaataccgaccaccgaaccccgccgtatcgacaaaccctaaaaaactcgctccgaaccgaacctaaaacccgcctctccatcctaaacgaacgaccgctactataaccccccgtaaacgaccgatctcc

SEQ ID NO: 11179 - DNA, 591 bp, Artificial Sequence
  chemically treated genomic DNA (Homo sapiens) CpG-island No: 11179
tttcggttggttttttttcgggttttttgtgttgggttttcgcggtttttgcgcggtttttcgggtggggtgtgtgcgtggggtgcgtggggggtcgggcgggcgttatttcgttcgggtttagtattaattatcgttattttcgttgtagggttcgtgtaggttttttttggagttcggttcgcggggtttggttagttcgtgcgtcgggtagtagtcgttggggagtcgtcggtcgtgtcgagaaggcgaggcgtaggtcgggttcgaggttcggggagttttgggcgagcgttcggtggcgttcgaggacgcgtgtcgtacggggggtggcgcgtcgtaggtttcggttatggttttttcgtcgttttcgttgttcgggttatcggtttcgtcgtagtcggagtttcggtagtagttatggtgtcggggattcgggggtttttcggatacgtgcgggttagatgtcggttatcgggtttcgtcgtgtcgataggttttgggggattcgtttcgggtcgggtttgggattcgtttttttattttgggcgagcggtcgttgttgtggtttttcgtgggcggtcgattttt

SEQ ID NO: 11180 - DNA, 591 bp, Artificial Sequence
  chemically treated genomic DNA (Homo sapiens) CpG-island No: 11180
aaaaatcgaccgcccacgaaaaaccacaacaacgaccgctcgcccaaaataaaaaaacgaatcccaaacccgacccgaaacgaatcccccaaaacctatcgacacgacgaaacccgataaccgacatctaacccgcacgtatccgaaaaacccccgaatccccgacaccataactactaccgaaactccgactacgacgaaaccgataacccgaacaacgaaaacgacgaaaaaaccataaccgaaacctacgacgcgccaccccccgtacgacacgcgtcctcgaacgccaccgaacgctcgcccaaaactccccgaacctcgaacccgacctacgcctcgccttctcgacacgaccgacgactccccaacgactactacccgacgcacgaactaaccaaaccccgcgaaccgaactccaaaaaaaacctacacgaaccctacaacgaaaataacgataattaatactaaacccgaacgaaataacgcccgcccgaccccccacgcaccccacgcacacaccccacccgaaaaaccgcgcaaaaaccgcgaaaacccaacacaaaaaacccgaaaaaaaaccaaccgaaa

SEQ ID NO: 11181 - DNA, 1294 bp, Artificial Sequence
  chemically treated genomic DNA (Homo sapiens) CpG-island No: 11181
gttcgcgttttcggtttagatttttcggtgtcgtttttgtatattgaaggcgatggtttttcggggatagagttttttttcgggttttttagtagttcgggcggcggtttttttttacggttttcgcgggcgttttttttaggatggaggggggtggtttcgttttaggtttgcgttttcgggtcgacggttcgacgcgcgttttgggtttcggtagcgtcgttcggggtttttagaaggttattacggttcgtacgagtacgttgagtatgttgttcgtcgggcggtaagcgggttttgtttcgtacgcgggcggcgtcgtcggaggggtcgcggggttgtagtttaggaggtcggagaagcgtttttgtaggacgcgggttaggttgggaaaggcgtttttcgtttgcgtcggagggggttgtaggcgatcggcgatttcggatgacgttttttttttttttttttttttttttagacgggtttttttgttcgggattagtttagcgttttcgtcgtcgtttaggttgttgttgcgtcgtttgcggttgattttggcggggcgcggggtatagtaggcggaggttttttcggttgtcggcgttttttgcgtgtttattggtttcggaaacgggtgtttatcgtcgggggtcgttgtttcggtcgtggattcggtttttcggggcgggtgtaggcgagggttagaggggagggcggtcggtaacgatatttcgggttcgagggtttttattttggtcgagaggtagagttttcgggcgttgcgtatgattagcgatagttgtagatttcggtgtagtcgtaggttatcgcgttgtatgcgggagtgatatattttttatatcgatagggttatgatgcgttgtgtttttttttgtatttttatggcgattcgacggcgatagcggcgggggttttcgggagggatagaataggtagtaggtgtatttcggataacgggttcgtttacgtttttttatataaattaatttacgtagtgatattgttaggacgttttgtttaggcgttcgttatttaggtttttttatatttttagtgacgttattgagatatttcgtttaatcgaaggacgtattcgggttttttaattcgtcgcggttaaatattttttaaagagatagaatgcgatttatttagtagggaaaggggacgggaattttggcgaggaggagcgtttttcgattttacgttgagttttttgggtgggtttttttttttgagtttcgtcgatgtattagcgttttggtttaaggga

SEQ ID NO: 11182 - DNA, 1294 bp, Artificial Sequence
  chemically treated genomic DNA (Homo sapiens) CpG-island No: 11182
tcccttaaaccaaaacgctaatacatcgacgaaactcaaaaaaaaaaacccacccaaaaaactcaacgtaaaatcgaaaaacgctcctcctcgccaaaattcccgtcccctttccctactaaataaatcgcattctatctctttaaaaaatatttaaccgcgacgaattaaaaaacccgaatacgtccttcgattaaacgaaatatctcaataacgtcactaaaaatataaaaaaacctaaataacgaacgcctaaacaaaacgtcctaacaatatcactacgtaaattaatttatataaaaaaacgtaaacgaacccgttatccgaaatacacctactacctattctatccctcccgaaaacccccgccgctatcgccgtcgaatcgccataaaaatacaaaaaaaaacacaacgcatcataaccctatcgatataaaaaatatatcactcccgcatacaacgcgataacctacgactacaccgaaatctacaactatcgctaatcatacgcaacgcccgaaaactctacctctcgaccaaaataaaaaccctcgaacccgaaatatcgttaccgaccgccctcccctctaaccctcgcctacacccgccccgaaaaaccgaatccacgaccgaaacaacgacccccgacgataaacacccgtttccgaaaccaataaacacgcaaaaaacgccgacaaccgaaaaaacctccgcctactataccccgcgccccgccaaaatcaaccgcaaacgacgcaacaacaacctaaacgacgacgaaaacgctaaactaatcccgaacaaaaaaacccgtctaaaaaaaaaaaaaaaaaaaaaaaaaacgtcatccgaaatcgccgatcgcctacaaccccctccgacgcaaacgaaaaacgcctttcccaacctaacccgcgtcctacaaaaacgcttctccgacctcctaaactacaaccccgcgacccctccgacgacgccgcccgcgtacgaaacaaaacccgcttaccgcccgacgaacaacatactcaacgtactcgtacgaaccgtaataaccttctaaaaaccccgaacgacgctaccgaaacccaaaacgcgcgtcgaaccgtcgacccgaaaacgcaaacctaaaacgaaaccacccccctccatcctaaaaaaaacgcccgcgaaaaccgtaaaaaaaaaccgccgcccgaactactaaaaaacccgaaaaaaaactctatccccgaaaaaccatcgccttcaatatacaaaaacgacaccgaaaaatctaaaccgaaaacgcgaac

SEQ ID NO: 11183 - DNA, 1294 bp, Artificial Sequence
  chemically treated genomic DNA (Homo sapiens) CpG-island No: 11183
ttttttgggttaaggcgttgatgtatcggcggggtttagagaaaggagtttatttagaaagtttagcgtggagtcgggggacgttttttttcgttagggttttcgttttttttttttgttgggtaaatcgtattttgtttttttaaggagtgtttggtcgcgacgagttggaaagttcggatgcgtttttcggttgggcggggtgttttagtgacgttattgggggtataaaagggtttgggtggcgggcgtttgggtagagcgttttagtagtgttattgcgtgggttggtttgtgtagagaggcgtgagcgagttcgttgttcggagtgtatttgttgtttgttttgtttttttcgggagttttcgtcgttgtcgtcgtcgagtcgttatggaagtgtagaaagaggtatagcgtattatgattttgtcggtgtggaagatgtattattttcgtatgtagcgcggtggtttgcggttgtatcggagtttgtagttgtcgttggttatgcgtagcgttcgggagttttatttttcggttaaggtggaggttttcgagttcgaggtgtcgttgtcggtcgtttttttttttgattttcgtttgtattcgtttcgagaagtcgagtttacggtcgagatagcgattttcgacggtgagtattcgttttcggagttaatggatacgtaggaggcgtcgatagtcgaggagattttcgtttgttgtgtttcgcgtttcgttaaagttagtcgtaaacgacgtagtagtagtttgagcgacggcggggacgttggattggtttcgagtaagaaagttcgtttggaagaaaaggaagaagaggagggagcgttattcgaagtcgtcgatcgtttgtagtttttttcggcgtaagcggagggcgttttttttaatttggttcgcgttttgtagaggcgttttttcggttttttgaattgtagtttcgcggttttttcgacggcgtcgttcgcgtgcgaggtaaagttcgtttgtcgttcggcggatagtatgtttaacgtgttcgtgcgggtcgtggtggttttttgaggatttcgagcggcgttgtcggagtttagagcgcgcgtcgaatcgtcggttcgagggcgtagatttgaggcgaggttatttttttttattttgggggaagcgttcgcgaaaatcgtggagagaagtcgtcgttcgggttgttgagaggttcggagagggattttgttttcggggagttatcgtttttagtgtgtagggacggtatcgaggagtttgagtcgggggcgcgggt

SEQ ID NO: 11184 - DNA, 1294 bp, Artificial Sequence
  chemically treated genomic DNA (Homo sapiens) CpG-island No: 11184
acccgcgcccccgactcaaactcctcgataccgtccctacacactaaaaacgataactccccgaaaacaaaatccctctccgaacctctcaacaacccgaacgacgacttctctccacgattttcgcgaacgcttcccccaaaataaaaaaaaataacctcgcctcaaatctacgccctcgaaccgacgattcgacgcgcgctctaaactccgacaacgccgctcgaaatcctcaaaaaaccaccacgacccgcacgaacacgttaaacatactatccgccgaacgacaaacgaactttacctcgcacgcgaacgacgccgtcgaaaaaaccgcgaaactacaattcaaaaaaccgaaaaaacgcctctacaaaacgcgaaccaaattaaaaaaaacgccctccgcttacgccgaaaaaaactacaaacgatcgacgacttcgaataacgctccctcctcttcttccttttcttccaaacgaactttcttactcgaaaccaatccaacgtccccgccgtcgctcaaactactactacgtcgtttacgactaactttaacgaaacgcgaaacacaacaaacgaaaatctcctcgactatcgacgcctcctacgtatccattaactccgaaaacgaatactcaccgtcgaaaatcgctatctcgaccgtaaactcgacttctcgaaacgaatacaaacgaaaatcaaaaaaaaaaacgaccgacaacgacacctcgaactcgaaaacctccaccttaaccgaaaaataaaactcccgaacgctacgcataaccaacgacaactacaaactccgatacaaccgcaaaccaccgcgctacatacgaaaataatacatcttccacaccgacaaaatcataatacgctatacctctttctacacttccataacgactcgacgacgacaacgacgaaaactcccgaaaaaaacaaaacaaacaacaaatacactccgaacaacgaactcgctcacgcctctctacacaaaccaacccacgcaataacactactaaaacgctctacccaaacgcccgccacccaaacccttttatacccccaataacgtcactaaaacaccccgcccaaccgaaaaacgcatccgaactttccaactcgtcgcgaccaaacactccttaaaaaaacaaaatacgatttacccaacaaaaaaaaaaaacgaaaaccctaacgaaaaaaaacgtcccccgactccacgctaaactttctaaataaactcctttctctaaaccccgccgatacatcaacgccttaacccaaaaaa

SEQ ID NO: 11185 - DNA, 542 bp, Artificial Sequence
  chemically treated genomic DNA (Homo sapiens) CpG-island No: 11185
ttttgacgtcgttttacgtttaagggtttttcggttttttttagttacgtttatatttatacggttttgttttttttagttttatttattacgatttttttcggcgttcgttagtttcgtttatttaaagtttcgttttcgttatttagtttcgtttttatttagtgggtagcggaagcgtacgtggtagttggagtagcggcggttacgcggttgttcgcggttgaggtattagaagtcgcgcgtggggtttaagtgtacgcgttcgtcgacggcggacggtagggtttagttcgtggtgcgcgtttttagcgttagcggtcgcgggtatacgcgcgttggttcgtagtagaagcggatggtagttaggttttcgaagtcgtcgtcgttttcggggtggtttacgttgaattaggacgtttattcgttggtttttgcgggtatcgtacgcgttgggattagggcggcggtttgtaggtttttatgtatgcgtgtaaaggttttatttgttgttttagttttttttttcggtgggtatcggt

SEQ ID NO: 11186 - DNA, 542 bp, Artificial Sequence
  chemically treated genomic DNA (Homo sapiens) CpG-island No: 11186
accgatacccaccgaaaaaaaaaactaaaacaacaaataaaacctttacacgcatacataaaaacctacaaaccgccgccctaatcccaacgcgtacgatacccgcaaaaaccaacgaataaacgtcctaattcaacgtaaaccaccccgaaaacgacgacgacttcgaaaacctaactaccatccgcttctactacgaaccaacgcgcgtatacccgcgaccgctaacgctaaaaacgcgcaccacgaactaaaccctaccgtccgccgtcgacgaacgcgtacacttaaaccccacgcgcgacttctaatacctcaaccgcgaacaaccgcgtaaccgccgctactccaactaccacgtacgcttccgctacccactaaataaaaacgaaactaaataacgaaaacgaaactttaaataaacgaaactaacgaacgccgaaaaaaatcgtaataaataaaactaaaaaaaacaaaaccgtataaatataaacgtaactaaaaaaaaccgaaaaacccttaaacgtaaaacgacgtcaaaa

SEQ ID NO: 11187 - DNA, 542 bp, Artificial Sequence
  chemically treated genomic DNA (Homo sapiens) CpG-island No: 11187
gtcggtgtttatcgggggagggggttgagatagtaagtaaggtttttgtacgtatgtatgggggtttataggtcgtcgttttggttttagcgcgtgcggtgttcgtagaggttagcgagtggacgttttggtttaacgtggattatttcggaggcgacggcgatttcgagagtttggttgttattcgtttttattacgggttagcgcgcgtgtgttcgcgatcgttggcgttggaagcgcgtattacggattgggttttgtcgttcgtcgtcggcgagcgcgtgtatttgaattttacgcgcggtttttggtgttttaatcgcgagtaatcgcgtggtcgtcgttgttttaattattacgtgcgttttcgttgtttattaggtgagggcggggttggatgacgggggcggggttttgaatgggcggggttggcgaacgtcgggaagagtcgtggtgggtggggttgggaggggtaggatcgtgtgggtgtgggcgtggttgggaagagtcgggggatttttaggcgtaggacgacgttaggg

SEQ ID NO: 11188 - DNA, 542 bp, Artificial Sequence
  chemically treated genomic DNA (Homo sapiens) CpG-island No: 11188
ccctaacgtcgtcctacgcctaaaaatcccccgactcttcccaaccacgcccacacccacacgatcctacccctcccaaccccacccaccacgactcttcccgacgttcgccaaccccgcccattcaaaaccccgcccccgtcatccaaccccgccctcacctaataaacaacgaaaacgcacgtaataattaaaacaacgacgaccacgcgattactcgcgattaaaacaccaaaaaccgcgcgtaaaattcaaatacacgcgctcgccgacgacgaacgacaaaacccaatccgtaatacgcgcttccaacgccaacgatcgcgaacacacgcgcgctaacccgtaataaaaacgaataacaaccaaactctcgaaatcgccgtcgcctccgaaataatccacgttaaaccaaaacgtccactcgctaacctctacgaacaccgcacgcgctaaaaccaaaacgacgacctataaacccccatacatacgtacaaaaaccttacttactatctcaaccccctcccccgataaacaccgac

SEQ ID NO: 11189 - DNA, 1229 bp, Artificial Sequence
  chemically treated genomic DNA (Homo sapiens) CpG-island No: 11189
tcggatttcgttaataagtttttgtcgcgagagttgtttattttgcggggcgtgcgatattcgtatatcgtgtacgttttcgagtttatcgaggtgtgtaacgggaaattgtatatcgtgatggaagcggtcgttatcgatttgttgtaagtcgtgtagcgtaacgggcgtattttcggagtttaggcgcgcgatttttttgcgtagatcgtcggcgtcgtgcgttatttgtacgattattatttggtgtatcgcgattttaagtgcgaaaacgtgttgttgagttcggacgagcgtcgcgttaagtttatcgatttcggtttcggtcgttaggtttatggttatttagatttgagtattatttattgcggtttagtcgtttacgcgttattcgaggtgtttttgggtattttttacgattttaagaagtacgatgtgtggagtatgggcgtcgtgttttacgttatggttatcgggtgtatgtttttcgacgattcggatatcgtcggtttgtttcggcgttagaaacgcggcgtgttttatttcgaaggtttcgagttgttcgagcgttgtaaggttttgatcgtcgagttgttgtagtttagttcgttcgttaggtttttcgcgggttaggtagcgcgtaattgttggttgcgcgtcggggatttcggttagaagtcgggtggttttagttatttttgtagttaagggtattgggttagggcggcgtacgcgtaagaggcgcgtttcgagggaatatgcgaagttgtcgcgtgttgttgtatatgcgttttttttttttcgtttttttttttttttttttacgggggagttcgtagttgtttttgttcggaatttacgtttttcgcgatttcgggagttggaggcgtatgcgtattcgcgattttttgcgattaggtttcgagagggcgagattagaggggacggaagtattgcgtttgcgcggaatttttagtttttgcgcggagggcgtttttttttaattagtcgtgggtgttaggttttcggttggaatttgtaataaattcgttgtttttcgtatttggttttaacggtggtttttatttgcggattagtggagaagcgatcgttttattcggggaaggtaggcgcgggtattttattttagagttacgtatgttgaggttattgttttaagatttaaaagggagtcgggaggattcgagtttggattttttgagtttttt

SEQ ID NO: 11190 - DNA, 1229 bp, Artificial Sequence
  chemically treated genomic DNA (Homo sapiens) CpG-island No: 11190
aaaaaactcaaaaaatccaaactcgaatcctcccgactcccttttaaatcttaaaacaataacctcaacatacgtaactctaaaataaaatacccgcgcctaccttccccgaataaaacgatcgcttctccactaatccgcaaataaaaaccaccgttaaaaccaaatacgaaaaacaacgaatttattacaaattccaaccgaaaacctaacacccacgactaattaaaaaaaaacgccctccgcgcaaaaactaaaaattccgcgcaaacgcaatacttccgtcccctctaatctcgccctctcgaaacctaatcgcaaaaaatcgcgaatacgcatacgcctccaactcccgaaatcgcgaaaaacgtaaattccgaacaaaaacaactacgaactcccccgtaaaaaaaaaaaaaaaaaaacgaaaaaaaaaaaacgcatatacaacaacacgcgacaacttcgcatattccctcgaaacgcgcctcttacgcgtacgccgccctaacccaatacccttaactacaaaaataactaaaaccacccgacttctaaccgaaatccccgacgcgcaaccaacaattacgcgctacctaacccgcgaaaaacctaacgaacgaactaaactacaacaactcgacgatcaaaaccttacaacgctcgaacaactcgaaaccttcgaaataaaacacgccgcgtttctaacgccgaaacaaaccgacgatatccgaatcgtcgaaaaacatacacccgataaccataacgtaaaacacgacgcccatactccacacatcgtacttcttaaaatcgtaaaaaatacccaaaaacacctcgaataacgcgtaaacgactaaaccgcaataaataatactcaaatctaaataaccataaacctaacgaccgaaaccgaaatcgataaacttaacgcgacgctcgtccgaactcaacaacacgttttcgcacttaaaatcgcgatacaccaaataataatcgtacaaataacgcacgacgccgacgatctacgcaaaaaaatcgcgcgcctaaactccgaaaatacgcccgttacgctacacgacttacaacaaatcgataacgaccgcttccatcacgatatacaatttcccgttacacacctcgataaactcgaaaacgtacacgatatacgaatatcgcacgccccgcaaaataaacaactctcgcgacaaaaacttattaacgaaatccga

SEQ ID NO: 11191 - DNA, 1229 bp, Artificial Sequence
  chemically treated genomic DNA (Homo sapiens) CpG-island No: 11191
ggggagtttaaaaggtttaggttcgaattttttcgatttttttttgagttttggagtaataattttaatatgcgtgattttaaaatagggtattcgcgtttgtttttttcggatggagcgatcgtttttttattagttcgtaaatgggggttatcgttagagttaggtgcgaggaatagcgagtttattgtaggttttaatcgggaatttggtatttacggttggttgggaagggacgtttttcgcgtagaggttgagagtttcgcgtaggcgtaatgttttcgttttttttggtttcgttttttcggggtttggtcgtagggaatcgcggatgcgtatgcgtttttagttttcgggatcgcggggaacgtggatttcgaataagggtaattgcggattttttcgtgggaagaaagggagggaagcggaagggaaaaagcgtatgtgtagtagtacgcggtagtttcgtatattttttcgaagcgcgttttttgcgcgtgcgtcgttttggtttagtgtttttggttgtaggaatggttggaattattcggtttttagtcggagttttcggcgcgtagttagtagttgcgcgttatttggttcgcggagggtttggcggacgggttgaattgtagtagttcggcgattagggttttgtagcgttcggatagttcgaggttttcgggatagagtacgtcgcgtttttggcgtcggggtaggtcggcgatgttcgagtcgtcgaagggtatgtattcggtgattatgacgtagagtacgacgtttatgttttatatatcgtattttttggggtcgtaggggatgtttaggagtatttcgggtgacgcgtaggcggttgagtcgtagtaggtggtgtttaggtttgggtagttatgggtttggcggtcgaagtcgaagtcggtgagtttgacgcggcgttcgttcgggtttagtagtacgttttcgtatttgaggtcgcggtgtattaggtgatgatcgtgtaggtagcgtacggcgtcggcgatttgcgtaaagaggtcgcgcgtttgaatttcggggatgcgttcgttgcgttgtacggtttgtagtaggtcggtggcggtcgtttttattacgatgtatagtttttcgttgtatatttcgatgaattcgaagacgtgtacgatgtgcgggtgtcgtacgtttcgtaggatggatagttttcgcggtaggaatttgttgacgaagttcgg

SEQ ID NO: 11192 - DNA, 1229 bp, Artificial Sequence
  chemically treated genomic DNA (Homo sapiens) CpG-island No: 11192
ccgaacttcgtcaacaaattcctaccgcgaaaactatccatcctacgaaacgtacgacacccgcacatcgtacacgtcttcgaattcatcgaaatatacaacgaaaaactatacatcgtaataaaaacgaccgccaccgacctactacaaaccgtacaacgcaacgaacgcatccccgaaattcaaacgcgcgacctctttacgcaaatcgccgacgccgtacgctacctacacgatcatcacctaatacaccgcgacctcaaatacgaaaacgtactactaaacccgaacgaacgccgcgtcaaactcaccgacttcgacttcgaccgccaaacccataactacccaaacctaaacaccacctactacgactcaaccgcctacgcgtcacccgaaatactcctaaacatcccctacgaccccaaaaaatacgatatataaaacataaacgtcgtactctacgtcataatcaccgaatacatacccttcgacgactcgaacatcgccgacctaccccgacgccaaaaacgcgacgtactctatcccgaaaacctcgaactatccgaacgctacaaaaccctaatcgccgaactactacaattcaacccgtccgccaaaccctccgcgaaccaaataacgcgcaactactaactacgcgccgaaaactccgactaaaaaccgaataattccaaccattcctacaaccaaaaacactaaaccaaaacgacgcacgcgcaaaaaacgcgcttcgaaaaaatatacgaaactaccgcgtactactacacatacgctttttcccttccgcttccctccctttcttcccacgaaaaaatccgcaattacccttattcgaaatccacgttccccgcgatcccgaaaactaaaaacgcatacgcatccgcgattccctacgaccaaaccccgaaaaaacgaaaccaaaaaaaacgaaaacattacgcctacgcgaaactctcaacctctacgcgaaaaacgtcccttcccaaccaaccgtaaataccaaattcccgattaaaacctacaataaactcgctattcctcgcacctaactctaacgataacccccatttacgaactaataaaaaaacgatcgctccatccgaaaaaaacaaacgcgaataccctattttaaaatcacgcatattaaaattattactccaaaactcaaaaaaaaatcgaaaaaattcgaacctaaaccttttaaactcccc

SEQ ID NO: 11193 - DNA, 548 bp, Artificial Sequence
  chemically treated genomic DNA (Homo sapiens) CpG-island No: 11193
gtgaggcggtggcgaaagcggtgggtattaaaggcgattatttgtcggatgtggtggatgttattgtaggatttgggcgcgatgtttttgtattggttttagttcggtgtcgcgtgcggatgttggagcgtaatttagtggttgtcgcgttattcgacgacggtttggcgcgtggttatgcggatgcggaaatcggcggttggttgtaggagcggttgtagttaatttacgtttttagtttgacggcgttgattgatattatttcgcgttcgtaggtggtttatttcgattcgatgttttcgtataagtagaaaagcgcgttagtgaaaaaagagatgcgtgttttttagtcgttggtgggatcggattttgatgtcgatggattattggagtttgtacgtttgttggcgattaaacgcgtggtggtaaagcgttcggattacgcgttatcgttggcgaatgtcgttacgttaaacgcggtagttattaaagggtatcgttttgatatttatgtaggtacgttagtgtaaaattaaaatagggtagcg

SEQ ID NO: 11194 - DNA, 548 bp, Artificial Sequence
  chemically treated genomic DNA (Homo sapiens) CpG-island No: 11194
cgctaccctattttaattttacactaacgtacctacataaatatcaaaacgataccctttaataactaccgcgtttaacgtaacgacattcgccaacgataacgcgtaatccgaacgctttaccaccacgcgtttaatcgccaacaaacgtacaaactccaataatccatcgacatcaaaatccgatcccaccaacgactaaaaaacacgcatctcttttttcactaacgcgcttttctacttatacgaaaacatcgaatcgaaataaaccacctacgaacgcgaaataatatcaatcaacgccgtcaaactaaaaacgtaaattaactacaaccgctcctacaaccaaccgccgatttccgcatccgcataaccacgcgccaaaccgtcgtcgaataacgcgacaaccactaaattacgctccaacatccgcacgcgacaccgaactaaaaccaatacaaaaacatcgcgcccaaatcctacaataacatccaccacatccgacaaataatcgcctttaatacccaccgctttcgccaccgcctcac

SEQ ID NO: 11195 - DNA, 548 bp, Artificial Sequence
  chemically treated genomic DNA (Homo sapiens) CpG-island No: 11195
cgttattttgttttagttttatattggcgtatttgtatagatattaaagcgatgttttttagtgattatcgcgtttggcgtggcgatattcgttagcggtggcgcgtagttcgggcgttttattattacgcgtttggtcgttagtaagcgtgtaggttttagtaatttatcggtattaagattcggttttattagcgattgaaagatacgtatttttttttttattagcgcgtttttttgtttatgcgggaatatcgggtcgagataaattatttgcgggcgcggggtaatattagttagcgtcgttaggttggaggcgtgaattaattgtaatcgtttttgtaattagtcgtcgattttcgtattcgtataattacgcgttaggtcgtcgtcgagtagcgcggtaattattggattacgttttagtattcgtacgcggtatcgagttgaagttagtataaaggtatcgcgtttaagttttgtagtggtatttattatattcggtaaataatcgtttttaatgtttatcgttttcgttatcgttttat

SEQ ID NO: 11196 - DNA, 548 bp, Artificial Sequence
  chemically treated genomic DNA (Homo sapiens) CpG-island No: 11196
ataaaacgataacgaaaacgataaacattaaaaacgattatttaccgaatataataaataccactacaaaacttaaacgcgatacctttatactaacttcaactcgataccgcgtacgaatactaaaacgtaatccaataattaccgcgctactcgacgacgacctaacgcgtaattatacgaatacgaaaatcgacgactaattacaaaaacgattacaattaattcacgcctccaacctaacgacgctaactaatattaccccgcgcccgcaaataatttatctcgacccgatattcccgcataaacaaaaaaacgcgctaataaaaaaaaaaatacgtatctttcaatcgctaataaaaccgaatcttaataccgataaattactaaaacctacacgcttactaacgaccaaacgcgtaataataaaacgcccgaactacgcgccaccgctaacgaatatcgccacgccaaacgcgataatcactaaaaaacatcgctttaatatctatacaaatacgccaatataaaactaaaacaaaataacg

SEQ ID NO: 11197 - DNA, 686 bp, Artificial Sequence
  chemically treated genomic DNA (Homo sapiens) CpG-island No: 11197
  misc_feature (249)..(249): n is either a, c, g or t
  misc_feature (491)..(491): n is either a, c, g or t
tggcggcgttgagtgattttttcggtatcggggatttttagagtcgttgtatattagaatgttttgacgcgggattagttaacgtcgacgttatttttggtttgacggaagtggatattgttgtcggtgataaagcggcggtacgtagttagttggcgaaattgttcgttatcgataacgtttcgttgaatatatagcggcgcgtggcgtggtataggcgtatttggcgatatcgtagtagcgtacgancgtttaataagttgatttcgtagtaaaattttagttatcgtcgatggaaagcgcgatggtgttgcgtgatggtgcgaagtttgaagcgtaggcgggcgatttaacgtaggcgttggaaatttataaagacgttatggtcgtattcggtgtgattacgacgcgttcgtaggataacgatatttttattcgattgattcgtaacgacgagaaagatgattggttgaaacgtggcgtgcgtacgnatgcggcggatttttatcgttagtaggattttaacgttatttttgagtacgattattggggttcgagcggtatcggtggttatttcgatttgaaagcgtatattattatgttgtaggtggatgcgtcgtattttgacgggcggatgttttttcgtagtgatttcgttaatatgaacgtcggtagtttttttatta

SEQ ID NO: 11198 - DNA, 686 bp, Artificial Sequence
  chemically treated genomic DNA (Homo sapiens) CpG-island No: 11198
  misc_feature (196)..(196): n is either a, c, g or t
  misc_feature (438)..(438): n is either a, c, g or t
taataaaaaaactaccgacgttcatattaacgaaatcactacgaaaaaacatccgcccgtcaaaatacgacgcatccacctacaacataataatatacgctttcaaatcgaaataaccaccgataccgctcgaaccccaataatcgtactcaaaaataacgttaaaatcctactaacgataaaaatccgccgcatncgtacgcacgccacgtttcaaccaatcatctttctcgtcgttacgaatcaatcgaataaaaatatcgttatcctacgaacgcgtcgtaatcacaccgaatacgaccataacgtctttataaatttccaacgcctacgttaaatcgcccgcctacgcttcaaacttcgcaccatcacgcaacaccatcgcgctttccatcgacgataactaaaattttactacgaaatcaacttattaaacgntcgtacgctactacgatatcgccaaatacgcctataccacgccacgcgccgctatatattcaacgaaacgttatcgataacgaacaatttcgccaactaactacgtaccgccgctttatcaccgacaacaatatccacttccgtcaaaccaaaaataacgtcgacgttaactaatcccgcgtcaaaacattctaatatacaacgactctaaaaatccccgataccgaaaaaatcactcaacgccgcca

SEQ ID NO: 11199 - DNA, 686 bp, Artificial Sequence
  chemically treated genomic DNA (Homo sapiens) CpG-island No: 11199
  misc_feature (196)..(196): n is either a, c, g or t
  misc_feature (438)..(438): n is either a, c, g or t
tagtggagaaattgtcgacgtttatattgacgaaattattgcgaaagaatattcgttcgttagaatacggcgtatttatttgtaatatggtagtgtgcgtttttagatcggagtaattatcggtgtcgttcgaattttagtaatcgtgtttaagggtgacgttaagattttgttggcgatagaggttcgtcgtatncgtgcgtacgttacgttttagttagttatttttttcgtcgttacgggttagtcgggtaaaggtgtcgttattttgcggacgcgtcgtagttatatcggatgcgattatggcgtttttgtaggtttttagcgtttgcgttggatcgttcgtttgcgttttaaatttcgtattattacgtagtattatcgcgttttttatcgacggtggttgagattttgttgcgggattaatttattaaacgntcgtgcgttgttgcggtatcgttaagtgcgtttgtgttacgttacgcgtcgttgtgtgtttagcgaggcgttatcggtagcgggtagtttcgttagttggttacgtgtcgtcgttttgttatcggtagtaatatttattttcgttagattaagaatggcgtcggcgttagttggtttcgcgttaggatattttgatatgtagcgattttagagattttcggtatcggaaagattatttagcgtcgtta

SEQ ID NO: 11200 - DNA, 686 bp, Artificial Sequence
  chemically treated genomic DNA (Homo sapiens) CpG-island No: 11200
  misc_feature (249)..(249): n is either a, c, g or t
  misc_feature (491)..(491): n is either a, c, g or t
taacgacgctaaataatctttccgataccgaaaatctctaaaatcgctacatatcaaaatatcctaacgcgaaaccaactaacgccgacgccattcttaatctaacgaaaataaatattactaccgataacaaaacgacgacacgtaaccaactaacgaaactacccgctaccgataacgcctcgctaaacacacaacgacgcgtaacgtaacacaaacgcacttaacgataccgcaacaacgcacgancgtttaataaattaatcccgcaacaaaatctcaaccaccgtcgataaaaaacgcgataatactacgtaataatacgaaatttaaaacgcaaacgaacgatccaacgcaaacgctaaaaacctacaaaaacgccataatcgcatccgatataactacgacgcgtccgcaaaataacgacacctttacccgactaacccgtaacgacgaaaaaaataactaactaaaacgtaacgtacgcacgnatacgacgaacctctatcgccaacaaaatcttaacgtcacccttaaacacgattactaaaattcgaacgacaccgataattactccgatctaaaaacgcacactaccatattacaaataaatacgccgtattctaacgaacgaatattctttcgcaataatttcgtcaatataaacgtcgacaatttctccacta

SEQ ID NO: 11201 - DNA, 1313 bp, Artificial Sequence
  chemically treated genomic DNA (Homo sapiens) CpG-island No: 11201
  misc_feature (670)..(671): n is either a, c, g or t
  misc_feature (677)..(677): n is either a, c, g or t
  misc_feature (698)..(698): n is either a, c, g or t
  misc_feature (707)..(707): n is either a, c, g or t
gtgcgggggatcggcgtggcggttatgattaattgatgcggatggaagttttgttgttggttttttttttataatgttagacgttgatgtacgttaaaacgatgttgttcgtcgataattattagcgttaggtcgttaaattgtatttgtttttggaagatggcgtgtgtatcgataattatttgtatttgatcgttggcgatggttttttgttgtgttagtcgtgttttatttttttgtttatcggcgagttagtttatttcgatatcgagcggtgtaaattagttgcggaagttattggcgtgttgttcggcgagtaattcggttggtgttattaatgttatttgtttgtcgtgggtaatcgtacgtaacgcggcgagggcggcgattagcgttttatcggaatttatatcgttttgtattagacgtattatcggtatatttagcgttatatcgcgttcgattttcgttattacgcgtgtttgtgcgttcgttggtttgaacggtaaggcggcgaggagtttattttttagcgtgttattggcgtttagcggttgggtatgaaaacgttgtgtttcggtacgtaaggttaatatgttgaggttgtgcgttagtagttttttagaattagacgacgtgcgtcggatgttgttcggttttagatcgttannttgtancgtcggtggcggggcgtgtanagtgcgtancgttttcggtagcgttattatttttgtgatagtttcggcgttaggatttttttaatggcgtagttgtcgagtagatttagcgtttgtcgttaatttacgtagcgtgttttgttttacgtttttcgttgttggataaatcggcgtgagcgttttcgtaattttggcgtgttgagatcgatttgtacgcggtatttcgggtggattattttcgtattatatttatcgcgttttggttcgttataagttagtatacggcggttcgtcgttaggttattttttattgtcgcgttgaaattgaaaaagcgtatggtgaggatgtcggaatcgtcgttgatttggtaggttattattcgtcgatcgtcgaaggagatattgtagtttagtatttcgttttttatcgtggtataaacgttcggtagtagtttttcgatggggtagagatgggtgcgattttcgtagcgtaggggaaggtgtaagagtagattttgtacggtatgtaggttgattttcgttagtttgttattaagtgttgcgttaacgttcgttagggaattgagtgggatagtatttaataggcgattttttatggtatttattttgtagttt

SEQ ID NO: 11202 - DNA, 1313 bp, Artificial Sequence
  chemically treated genomic DNA (Homo sapiens) CpG-island No: 11202
  misc_feature (607)..(607): n is either a, c, g or t
  misc_feature (616)..(616): n is either a, c, g or t
  misc_feature (637)..(637): n is either a, c, g or t
  misc_feature (643)..(644): n is either a, c, g or t
aaactacaaaataaataccataaaaaatcgcctattaaatactatcccactcaattccctaacgaacgttaacgcaacacttaataacaaactaacgaaaatcaacctacataccgtacaaaatctactcttacaccttcccctacgctacgaaaatcgcacccatctctaccccatcgaaaaactactaccgaacgtttataccacgataaaaaacgaaatactaaactacaatatctccttcgacgatcgacgaataataacctaccaaatcaacgacgattccgacatcctcaccatacgctttttcaatttcaacgcgacaataaaaaataacctaacgacgaaccgccgtatactaacttataacgaaccaaaacgcgataaatataatacgaaaataatccacccgaaataccgcgtacaaatcgatctcaacacgccaaaattacgaaaacgctcacgccgatttatccaacaacgaaaaacgtaaaacaaaacacgctacgtaaattaacgacaaacgctaaatctactcgacaactacgccattaaaaaaatcctaacgccgaaactatcacaaaaataataacgctaccgaaaacgntacgcactntacacgccccgccaccgacgntacaanntaacgatctaaaaccgaacaacatccgacgcacgtcgtctaattctaaaaaactactaacgcacaacctcaacatattaaccttacgtaccgaaacacaacgttttcatacccaaccgctaaacgccaataacacgctaaaaaataaactcctcgccgccttaccgttcaaaccaacgaacgcacaaacacgcgtaataacgaaaatcgaacgcgatataacgctaaatataccgataatacgtctaatacaaaacgatataaattccgataaaacgctaatcgccgccctcgccgcgttacgtacgattacccacgacaaacaaataacattaataacaccaaccgaattactcgccgaacaacacgccaataacttccgcaactaatttacaccgctcgatatcgaaataaactaactcgccgataaacaaaaaaataaaacacgactaacacaacaaaaaaccatcgccaacgatcaaatacaaataattatcgatacacacgccatcttccaaaaacaaatacaatttaacgacctaacgctaataattatcgacgaacaacatcgttttaacgtacatcaacgtctaacattataaaaaaaaaaccaacaacaaaacttccatccgcatcaattaatcataaccgccacgccgatcccccgcac

SEQ ID NO: 11203 - DNA, 1313 bp, Artificial Sequence
  chemically treated genomic DNA (Homo sapiens) CpG-island No: 11203
  misc_feature (607)..(607): n is either a, c, g or t
  misc_feature (616)..(616): n is either a, c, g or t
  misc_feature (637)..(637): n is either a, c, g or t
  misc_feature (643)..(644): n is either a, c, g or t
aggttgtagggtaagtgttatgaaaggtcgtttgttagatgttgttttatttagttttttaacgggcgttggcgtagtatttagtaataaattggcgaaaattaatttgtatatcgtgtaggatttatttttatatttttttttgcgttacgaagatcgtatttatttttattttatcggagaattattgtcgggcgtttatgttacggtggaaggcgaagtgttgaattgtaatatttttttcggcggtcggcggatgatgatttgttagattagcgacggtttcggtatttttattatgcgtttttttaattttagcgcggtaatgaaaaatagtttggcggcgggtcgtcgtgtattggtttatggcgaattaaagcgcggtaaatatggtgcggagatgatttattcggaatatcgcgtgtaggtcgattttagtacgttagaattacggaaacgtttacgtcggtttatttaataacggaaggcgtaaagtaaggtacgttgcgtaaattaacgataagcgttggatttgttcgataattgcgttattgaagaaattttggcgtcgggattgttataagaatgatgacgttatcggaagcgntgcgtattntgtacgtttcgttatcgacgntatagnntagcgatttgaaatcgggtagtattcggcgtacgtcgtttgattttgaagaattgttggcgtataattttagtatgttagttttacgtgtcggagtatagcgtttttatgtttagtcgttgagcgttaatgatacgttgaaaaataaatttttcgtcgttttatcgtttaagttaacgggcgtataggtacgcgtagtggcggagatcgagcgcgatatggcgttggatgtgtcgatgatgcgtttggtgtagggcgatgtaggtttcggtaaaacgttggtcgtcgttttcgtcgcgttgcgtgcgattgtttacggtaaataggtagtattgatggtattaatcgaattattcgtcgagtagtacgttaataattttcgtaattggtttgtatcgttcggtatcgaagtgggttggttcgtcggtaagtagaaaggtaaagtacggttggtatagtaggaagttatcgttagcggttaggtgtagatgattgtcggtatatacgttattttttaggaataggtgtagtttaacggtttggcgttggtgattatcgacgaatagtatcgttttggcgtgtattagcgtttggtattgtgggagaaaggttagtagtagggtttttattcgtattagttgattatgatcgttacgtcgatttttcgtat

SEQ ID NO: 11204 - DNA, 1313 bp, Artificial Sequence
  chemically treated genomic DNA (Homo sapiens) CpG-island No: 11204
  misc_feature (670)..(671): n is either a, c, g or t
  misc_feature (677)..(677): n is either a, c, g or t
  misc_feature (698)..(698): n is either a, c, g or t
  misc_feature (707)..(707): n is either a, c, g or t
atacgaaaaatcgacgtaacgatcataatcaactaatacgaataaaaaccctactactaacctttctcccacaataccaaacgctaatacacgccaaaacgatactattcgtcgataatcaccaacgccaaaccgttaaactacacctattcctaaaaaataacgtatataccgacaatcatctacacctaaccgctaacgataacttcctactataccaaccgtactttacctttctacttaccgacgaaccaacccacttcgataccgaacgatacaaaccaattacgaaaattattaacgtactactcgacgaataattcgattaataccatcaatactacctatttaccgtaaacaatcgcacgcaacgcgacgaaaacgacgaccaacgttttaccgaaacctacatcgccctacaccaaacgcatcatcgacacatccaacgccatatcgcgctcgatctccgccactacgcgtacctatacgcccgttaacttaaacgataaaacgacgaaaaatttatttttcaacgtatcattaacgctcaacgactaaacataaaaacgctatactccgacacgtaaaactaacatactaaaattatacgccaacaattcttcaaaatcaaacgacgtacgccgaatactacccgatttcaaatcgctannctatancgtcgataacgaaacgtacanaatacgcancgcttccgataacgtcatcattcttataacaatcccgacgccaaaatttcttcaataacgcaattatcgaacaaatccaacgcttatcgttaatttacgcaacgtaccttactttacgccttccgttattaaataaaccgacgtaaacgtttccgtaattctaacgtactaaaatcgacctacacgcgatattccgaataaatcatctccgcaccatatttaccgcgctttaattcgccataaaccaatacacgacgacccgccgccaaactatttttcattaccgcgctaaaattaaaaaaacgcataataaaaataccgaaaccgtcgctaatctaacaaatcatcatccgccgaccgccgaaaaaaatattacaattcaacacttcgccttccaccgtaacataaacgcccgacaataattctccgataaaataaaaataaatacgatcttcgtaacgcaaaaaaaaatataaaaataaatcctacacgatatacaaattaattttcgccaatttattactaaatactacgccaacgcccgttaaaaaactaaataaaacaacatctaacaaacgacctttcataacacttaccctacaacct

SEQ ID NO: 11205 - DNA, 740 bp, Artificial Sequence
  chemically treated genomic DNA (Homo sapiens) CpG-island No: 11205
aattgcgttaggcgagcggaatgagttttagcgtggttgttttgttgatcgttttgtcggtggttattatgggcgggttggcgttggtcggaagttggttttattagtatgttagcgaacgtcgtagtgtcgttattagtttgttgttgattgtcgtcggtgtattgatgcgtgattttattcgtaaagtgcgttgttgtttaacgatgtttggtggggtggggatcggtattatttaggcggtgatgttttcggtgattaaacggcggttttagtagcgtacgttattggtgatggggttgtggttcgcggttttgatgggcggcggtgggtttggtgtcgttataacgttttggttagtttaatatagcgaaatttggtattaaatattcgtttggtgggcgttgttgtcgttgttgcgttttttgtttggtggtggtaaagcgttcgtagggtcgtttttttttataagataataattatttcggttcgcgtggtatttatttttcgcgcgtggacgttgggtgtttatttcggtttgattaacggcggttattaagtttgattgtttggttattcgttttttatattgagattggtgtagcgcgtagtatagcggtttttattggtattgatgacgttgggtaagcgtagagttttgttgattttgttatgttagtttagtatgttattaggtcgttttttttttcgttacgggatattttgtatattatgaattg

SEQ ID NO: 11206 - DNA, 740 bp, Artificial Sequence
  chemically treated genomic DNA (Homo sapiens) CpG-island No: 11206
caattcataatatacaaaatatcccgtaacgaaaaaaaaaacgacctaataacatactaaactaacataacaaaatcaacaaaactctacgcttacccaacgtcatcaataccaataaaaaccgctatactacgcgctacaccaatctcaatataaaaaacgaataaccaaacaatcaaacttaataaccgccgttaatcaaaccgaaataaacacccaacgtccacgcgcgaaaaataaataccacgcgaaccgaaataattattatcttataaaaaaaaacgaccctacgaacgctttaccaccaccaaacaaaaaacgcaacaacgacaacaacgcccaccaaacgaatatttaataccaaatttcgctatattaaactaaccaaaacgttataacgacaccaaacccaccgccgcccatcaaaaccgcgaaccacaaccccatcaccaataacgtacgctactaaaaccgccgtttaatcaccgaaaacatcaccgcctaaataataccgatccccaccccaccaaacatcgttaaacaacaacgcactttacgaataaaatcacgcatcaatacaccgacgacaatcaacaacaaactaataacgacactacgacgttcgctaacatactaataaaaccaacttccgaccaacgccaacccgcccataataaccaccgacaaaacgatcaacaaaacaaccacgctaaaactcattccgctcgcctaacgcaatt

SEQ ID NO: 11207 - DNA, 740 bp, Artificial Sequence
  chemically treated genomic DNA (Homo sapiens) CpG-island No: 11207
taatttatggtgtatagggtgtttcgtaacggaaagagaaacgatttggtggtatattagattagtatagtaggattagtaaagttttgcgtttgtttagcgttattaatgttagtaagaatcgttgtattgcgcgttgtattaattttaatatagaaagcgggtaattaggtaattaggtttggtaatcgtcgttaattagatcgaagtaaatatttagcgtttacgcgcggggagtgaatattacgcgaatcggagtggttgttgttttgtgggaagaggcgattttgcgggcgttttgttattattaggtaaagagcgtaataacggtagtagcgtttattaggcgagtgtttgatattaggtttcgttatgttgaattaattagggcgttatggcggtattaagtttatcgtcgtttattagagtcgcggattatagttttattattagtggcgtgcgttgttgaaatcgtcgtttaattatcgaaggtattatcgtttgaatgatgtcgatttttattttattaagtatcgttaagtagtagcgtattttgcgggtaaagttacgtattaatgtatcgacggtaattagtaatagattgatggcgatattgcgacgttcgttgatatgttgatgaagttagttttcggttagcgttagttcgtttatggtaattatcggtagagcggttaatagggtagttacgttaaagtttatttcgttcgtttggcgtaatt

SEQ ID NO: 11208 - DNA, 740 bp, Artificial Sequence
  chemically treated genomic DNA (Homo sapiens) CpG-island No: 11208
aattacgccaaacgaacgaaataaactttaacgtaactaccctattaaccgctctaccgataattaccataaacgaactaacgctaaccgaaaactaacttcatcaacatatcaacgaacgtcgcaatatcgccatcaatctattactaattaccgtcgatacattaatacgtaactttacccgcaaaatacgctactacttaacgatacttaataaaataaaaatcgacatcattcaaacgataataccttcgataattaaacgacgatttcaacaacgcacgccactaataataaaactataatccgcgactctaataaacgacgataaacttaataccgccataacgccctaattaattcaacataacgaaacctaatatcaaacactcgcctaataaacgctactaccgttattacgctctttacctaataataacaaaacgcccgcaaaatcgcctcttcccacaaaacaacaaccactccgattcgcgtaatattcactccccgcgcgtaaacgctaaatatttacttcgatctaattaacgacgattaccaaacctaattacctaattacccgctttctatattaaaattaatacaacgcgcaatacaacgattcttactaacattaataacgctaaacaaacgcaaaactttactaatcctactatactaatctaatataccaccaaatcgtttctctttccgttacgaaacaccctatacaccataaatta

SEQ ID NO: 11209 - DNA, 508 bp, Artificial Sequence
  chemically treated genomic DNA (Homo sapiens) CpG-island No: 11209
acggtatatcgtattgtggttgaatgtcggatttcgtattcgtgtttttgtatttttcggttgttttatcgggttgttaggattacgcgggattagtttcgaaataaacggtagtgttattgggttggtaatcgttattttacgatttggattaacggaaatttcgttttattcgaatatttttaggttattcgggaagattagcgtattttgtttagatggcggggtgaaaatgtttttatagcgtatttggtggaatattacgcggtatattagttggttaaatatggtggttttttatatattcgtatcgtttaaatttttcgtcggacggaagtttagtttagaaaacggttgagttggggttacgtaatcgtttttcgttgtattttggggaatcggttttttcggtgtcggaattattagttcgttattacgacgatcgagtataaaaatgttgtcggttttcgtcggagttaaataattggtattttttgattattaacgg

SEQ ID NO: 11210 - DNA, 508 bp, Artificial Sequence
  chemically treated genomic DNA (Homo sapiens) CpG-island No: 11210
ccgttaataatcaaaaaataccaattatttaactccgacgaaaaccgacaacatttttatactcgatcgtcgtaataacgaactaataattccgacaccgaaaaaaccgattccccaaaatacaacgaaaaacgattacgtaaccccaactcaaccgttttctaaactaaacttccgtccgacgaaaaatttaaacgatacgaatatataaaaaaccaccatatttaaccaactaatataccgcgtaatattccaccaaatacgctataaaaacattttcaccccgccatctaaacaaaatacgctaatcttcccgaataacctaaaaatattcgaataaaacgaaatttccgttaatccaaatcgtaaaataacgattaccaacccaataacactaccgtttatttcgaaactaatcccgcgtaatcctaacaacccgataaaacaaccgaaaaatacaaaaacacgaatacgaaatccgacattcaaccacaatacgatataccgt

SEQ ID NO: 11211 - DNA, 508 bp, Artificial Sequence
  chemically treated genomic DNA (Homo sapiens) CpG-island No: 11211
tcgttaatggttagaaagtgttagttatttagtttcggcgaaaatcggtaatatttttgtgttcgatcgtcgtaatggcgaattggtggtttcggtatcggaaaaatcggttttttaaggtgtagcgaaaggcgattacgtaattttaatttaatcgttttttgaattgagttttcgttcgacgaaagatttgagcggtgcggatatgtggggagttattatgtttgattaattggtgtgtcgcgtgatgttttattagatgcgttatgaaggtatttttatttcgttatttgaatagggtacgttggttttttcgggtaatttggggatgttcgaatggggcgggattttcgttgatttaaatcgtgaagtggcgattgttaatttaatggtattgtcgtttgtttcgaaattgatttcgcgtggttttggtaattcgatggagtagtcgaaagatgtaaaggtacgggtacggaattcggtatttagttatagtacggtgtatcgt

SEQ ID NO: 11212 - DNA, 508 bp, Artificial Sequence
  chemically treated genomic DNA (Homo sapiens) CpG-island No: 11212
acgatacaccgtactataactaaataccgaattccgtacccgtacctttacatctttcgactactccatcgaattaccaaaaccacgcgaaatcaatttcgaaacaaacgacaataccattaaattaacaatcgccacttcacgatttaaatcaacgaaaatcccgccccattcgaacatccccaaattacccgaaaaaaccaacgtaccctattcaaataacgaaataaaaataccttcataacgcatctaataaaacatcacgcgacacaccaattaatcaaacataataactccccacatatccgcaccgctcaaatctttcgtcgaacgaaaactcaattcaaaaaacgattaaattaaaattacgtaatcgcctttcgctacaccttaaaaaaccgatttttccgataccgaaaccaccaattcgccattacgacgatcgaacacaaaaatattaccgattttcgccgaaactaaataactaacactttctaaccattaacga

SEQ ID NO: 11213 - DNA, 556 bp, Artificial Sequence
  chemically treated genomic DNA (Homo sapiens) CpG-island No: 11213
  misc_feature (7)..(7): n is either a, c, g or t
gcgtatntttttgttcgcgtgtgcgttcggttttttcggtttcgcgtttcgtgtgttcggcgtgcgggttttgttttggcgcgtggttgtttgggtttttgttttgcgtgtgcgtttcgtcgcgtcgggttgtttcggcgcgcgcgtcgcgtgtcgcgtgttttcgtattatgtttggagtagttgttcgtttgtttcgtttttttttttgcgttgttttgattttcgttttaggttcgtttttggcggcgttcgggtgttttttttgggcgtttgggcggttgtcggttcgttgtgggtcgtttcgtgcgttcggttcgttttggcggttcgtgtttcgttttttgtgagtcgtgtcggtgcggtgcgtttcgggggtttcggggtttgcgtcggtttcggtcgcgcgttttttcgcggttgcggggttttgcgttgtttggtggtttcgtggcgggagttttttttcgggggtttcggggttttttttttcggggttttcggttttgggttttttttggtttttttcgttaaggaaattagtttatcgaagaga

SEQ ID NO: 11214 - DNA, 556 bp, Artificial Sequence
  chemically treated genomic DNA (Homo sapiens) CpG-island No: 11214
  misc_feature (550)..(550): n is either a, c, g or t
tctcttcgataaactaatttccttaacgaaaaaaaccaaaaaaaacccaaaaccgaaaaccccgaaaaaaaaaaccccgaaacccccgaaaaaaaactcccgccacgaaaccaccaaacaacgcaaaaccccgcaaccgcgaaaaaacgcgcgaccgaaaccgacgcaaaccccgaaacccccgaaacgcaccgcaccgacacgactcacaaaaaacgaaacacgaaccgccaaaacgaaccgaacgcacgaaacgacccacaacgaaccgacaaccgcccaaacgcccaaaaaaaacacccgaacgccgccaaaaacgaacctaaaacgaaaatcaaaacaacgcaaaaaaaaaaacgaaacaaacgaacaactactccaaacataatacgaaaacacgcgacacgcgacgcgcgcgccgaaacaacccgacgcgacgaaacgcacacgcaaaacaaaaacccaaacaaccacgcgccaaaacaaaacccgcacgccgaacacacgaaacgcgaaaccgaaaaaaccgaacgcacacgcgaacaaaaanatacgc

SEQ ID NO: 11215 - DNA, 556 bp, Artificial Sequence
  chemically treated genomic DNA (Homo sapiens) CpG-island No: 11215
  misc_feature (550)..(550): n is either a, c, g or t
ttttttcgatggattgatttttttggcgggggaaattaaagggggtttaaagtcgggaatttcggggaaaaaagtttcgaaattttcgggaggggattttcgttacggaattattaagtaacgtaaggtttcgtagtcgcgaggagacgcgcgatcgggatcggcgtaggtttcggggttttcggggcgtatcgtatcgatacgatttataggagacggggtacgggtcgttagggcgagtcgggcgtacgaagcggtttatagcggatcggtaatcgtttaagcgtttaaagaagatattcgggcgtcgttaaagacgggtttggggcggagattagggtagcgtaaagggggagacgaggtaaacgggtagttgttttaggtatgatgcgggggtacgcggtacgcggcgcgcgcgtcggagtagttcggcgcgacggagcgtatacgtaaggtaggagtttaggtagttacgcgttaagataagattcgtacgtcgggtatacgaggcgcggagtcggagggatcgggcgtatacgcgagtaggggngtacgt

SEQ ID NO: 11216 - DNA, 556 bp, Artificial Sequence
  chemically treated genomic DNA (Homo sapiens) CpG-island No: 11216
  misc_feature (7)..(7): n is either a, c, g or t
acgtacncccctactcgcgtatacgcccgatccctccgactccgcgcctcgtatacccgacgtacgaatcttatcttaacgcgtaactacctaaactcctaccttacgtatacgctccgtcgcgccgaactactccgacgcgcgcgccgcgtaccgcgtacccccgcatcatacctaaaacaactacccgtttacctcgtctccccctttacgctaccctaatctccgccccaaacccgtctttaacgacgcccgaatatcttctttaaacgcttaaacgattaccgatccgctataaaccgcttcgtacgcccgactcgccctaacgacccgtaccccgtctcctataaatcgtatcgatacgatacgccccgaaaaccccgaaacctacgccgatcccgatcgcgcgtctcctcgcgactacgaaaccttacgttacttaataattccgtaacgaaaatcccctcccgaaaatttcgaaacttttttccccgaaattcccgactttaaaccccctttaatttcccccgccaaaaaaatcaatccatcgaaaaaa

SEQ ID NO: 11217 - DNA, 803 bp, Artificial Sequence
  chemically treated genomic DNA (Homo sapiens) CpG-island No: 11217
ggttttcgttgtcgtcgaatttataacgttaggtgattcgatttttcggttgtacggtttcggttttatcgatattcgttagatttattattagacgcggacgtatttggaaggggttaaaatcggaattcggtttttgaattattttttcggtaattcgtaaggtggtatcgtttacgttaatggtgtcgttcgtttttaggttaagtagtgttattaggcgtggggttagtaatacgttgttcgtttgcggttttaggttagggggattagtttgtagatcgttatatatcgggtagatattatttatcgttttgacgttcgttagttgcggtgtgtcgtttgtaaaggttattgtggcgaaagttagttgtttgtcgatttttaggtcgcgtttttgcgtttttttagttacgtttgggtatttcgcgtgaattgcgtaacgtcgatggttcgttataaatttacggttttgttggtttaagtttttttttatgcgatcgttgatattgtttaacgttatacggtaggttatcgttaggtttagcgttacgtagataattaatagcgacggcggacgtatttcgcgttagaataacgtgtaattatgttttttttgtaattgtcgtttataagttggtatgagattagttaagtcggcgttattattacgaaattattttcgtgtttcgcggattttcggtagagggttagttaatacgtcgatacgtcgatgtatatgaatgttagttacgacgtcgggcggaaaattttttttaggattttcgcgtacgaaattagtt

SEQ ID NO: 11218 - DNA, 803 bp, Artificial Sequence
  chemically treated genomic DNA (Homo sapiens) CpG-island No: 11218
aactaatttcgtacgcgaaaatcctaaaaaaaattttccgcccgacgtcgtaactaacattcatatacatcgacgtatcgacgtattaactaaccctctaccgaaaatccgcgaaacacgaaaataatttcgtaataataacgccgacttaactaatctcataccaacttataaacgacaattacaaaaaaaacataattacacgttattctaacgcgaaatacgtccgccgtcgctattaattatctacgtaacgctaaacctaacgataacctaccgtataacgttaaacaatatcaacgatcgcataaaaaaaaacttaaaccaacaaaaccgtaaatttataacgaaccatcgacgttacgcaattcacgcgaaatacccaaacgtaactaaaaaaacgcaaaaacgcgacctaaaaatcgacaaacaactaactttcgccacaataacctttacaaacgacacaccgcaactaacgaacgtcaaaacgataaataatatctacccgatatataacgatctacaaactaatccccctaacctaaaaccgcaaacgaacaacgtattactaaccccacgcctaataacactacttaacctaaaaacgaacgacaccattaacgtaaacgataccaccttacgaattaccgaaaaaataattcaaaaaccgaattccgattttaaccccttccaaatacgtccgcgtctaataataaatctaacgaatatcgataaaaccgaaaccgtacaaccgaaaaatcgaatcacctaacgttataaattcgacgacaacgaaaacc

SEQ ID NO: 11219 - DNA, 803 bp, Artificial Sequence
  chemically treated genomic DNA (Homo sapiens) CpG-island No: 11219
ggttgatttcgtacgcggaaattttgaagaaagtttttcgttcgacgtcgtggttggtatttatatgtatcgacgtatcgacgtattgattgattttttgtcggaagttcgcgaagtacgggagtggtttcgtagtgataacgtcgatttgattgattttatgttaatttgtgaacggtagttgtagaggaagtatgattgtacgttgttttggcgcgaaatgcgttcgtcgtcgttattaattgtttgcgtggcgttaagtttggcggtggtttgtcgtgtggcgttgggtaatattagcgatcgtatggagaagggtttaagttagtaaagtcgtgagtttatggcgggttatcggcgttgcgtagtttacgcgaagtgtttaagcgtggttggaggaacgtaaaagcgcggtttgaaagtcggtaagtagttgattttcgttataatgatttttgtaggcgatatatcgtagttggcgaacgttaaagcggtggatgatatttattcgatgtatggcgatttgtaaattaatttttttggtttgaaatcgtaggcgggtagcgtattgttggttttacgtttgatggtattgtttaatttgaaaacgggcgatattattgacgtgggcgatgttattttgcggattgtcggagaagtgatttaggaatcggatttcggttttaattttttttagatgcgttcgcgtttgatgatgaatttggcggatgtcgataaaatcggagtcgtgtagtcggggagtcgggttatttggcgttataaattcggcggtaacgagaatt

SEQ ID NO: 11220 - DNA, 803 bp, Artificial Sequence
  chemically treated genomic DNA (Homo sapiens) CpG-island No: 11220
aattctcgttaccgccgaatttataacgccaaataacccgactccccgactacacgactccgattttatcgacatccgccaaattcatcatcaaacgcgaacgcatctaaaaaaaattaaaaccgaaatccgattcctaaatcacttctccgacaatccgcaaaataacatcgcccacgtcaataatatcgcccgttttcaaattaaacaataccatcaaacgtaaaaccaacaatacgctacccgcctacgatttcaaaccaaaaaaattaatttacaaatcgccatacatcgaataaatatcatccaccgctttaacgttcgccaactacgatatatcgcctacaaaaatcattataacgaaaatcaactacttaccgactttcaaaccgcgcttttacgttcctccaaccacgcttaaacacttcgcgtaaactacgcaacgccgataacccgccataaactcacgactttactaacttaaacccttctccatacgatcgctaatattacccaacgccacacgacaaaccaccgccaaacttaacgccacgcaaacaattaataacgacgacgaacgcatttcgcgccaaaacaacgtacaatcatacttcctctacaactaccgttcacaaattaacataaaatcaatcaaatcgacgttatcactacgaaaccactcccgtacttcgcgaacttccgacaaaaaatcaatcaatacgtcgatacgtcgatacatataaataccaaccacgacgtcgaacgaaaaactttcttcaaaatttccgcgtacgaaatcaacc

SEQ ID NO: 11221 - DNA, 764 bp, Artificial Sequence
  chemically treated genomic DNA (Homo sapiens) CpG-island No: 11221
ggttgcggataggggtcgggggcgcgttcgggtcggtgtcgcgtggtgggagtagtaggcgcgtaggtaggcggggagttttcgcgtatcgtagttcgcgggtgattattatgcggcggtagttgttttttgcgcggtgacggcgtttttaattgattttattatttttttttcgtaaggtgaagtgcggtcgttcgcgggttcgggcgcgcgagaggcggttggtagtcgcgggtcggcgggggtagcgttcggtttcggggtggtattatcgtcgggcgtcgtttaacgaacgtaggcggcgggaggttcggcggcggggttcgcgtttttgtatcgcgatcggttagaaaatatttcggggttgggcggcgtttcggagacgtatttttttgttatttttatcgtttttggtaacgattattaatgttattatgttttatttttttttattttttttcgtttttagagtcgcgttcgcgcgttcgatttttaggcgtttcgttttttttggaattaataataatgatttttaattaattttttgttagggttgtttgttcgtgaatggggcgttttttcggttcgcgggcggtaggcgttttagttcgggcggggggttagttttcgttttttcggtcggattcgcgggggttcgtaattcgttcgggcgtcggttgggggtggtttcgtagttttttcggtttttttttaggatgaaattcgttttttttggaggagagagggtagagacggttcgagaa

SEQ ID NO: 11222 - DNA, 764 bp, Artificial Sequence
  chemically treated genomic DNA (Homo sapiens) CpG-island No: 11222
ttctcgaaccgtctctaccctctctcctccaaaaaaaacgaatttcatcctaaaaaaaaaccgaaaaaactacgaaaccacccccaaccgacgcccgaacgaattacgaacccccgcgaatccgaccgaaaaaacgaaaactaaccccccgcccgaactaaaacgcctaccgcccgcgaaccgaaaaaacgccccattcacgaacaaacaaccctaacaaaaaattaattaaaaatcattattattaattccaaaaaaaacgaaacgcctaaaaatcgaacgcgcgaacgcgactctaaaaacgaaaaaaaataaaaaaaaataaaacataataacattaataatcgttaccaaaaacgataaaaataacaaaaaaatacgtctccgaaacgccgcccaaccccgaaatattttctaaccgatcgcgatacaaaaacgcgaaccccgccgccgaacctcccgccgcctacgttcgttaaacgacgcccgacgataataccaccccgaaaccgaacgctacccccgccgacccgcgactaccaaccgcctctcgcgcgcccgaacccgcgaacgaccgcacttcaccttacgaaaaaaaaataataaaatcaattaaaaacgccgtcaccgcgcaaaaaacaactaccgccgcataataatcacccgcgaactacgatacgcgaaaactccccgcctacctacgcgcctactactcccaccacgcgacaccgacccgaacgcgcccccgacccctatccgcaacc

SEQ ID NO: 11223 - DNA, 764 bp, Artificial Sequence
  chemically treated genomic DNA (Homo sapiens) CpG-island No: 11223
ttttcggatcgtttttgtttttttttttttagagagggcgagttttattttggagggaggtcgggggagttgcgaggttatttttagtcggcgttcgggcggattgcgagttttcgcgggttcggtcgggggagcggagattggtttttcgttcgggttggggcgtttgtcgttcgcgagtcggaagagcgttttatttacgagtaggtagttttggtagagggttaattgaggattattgttgttggttttaggaggagcgaagcgtttggagatcgggcgcgcgggcgcggttttgggagcgggggaaggtgaggggaaatgggatatgatggtattaataatcgttattaaagacggtgggagtaataaaggaatgcgttttcgagacgtcgtttagtttcggggtgttttttggtcggtcgcggtgtaggaacgcgagtttcgtcgtcgagtttttcgtcgtttgcgttcgttgggcggcgttcggcggtagtgttatttcgaggtcgagcgttgttttcgtcggttcgcggttgttagtcgtttttcgcgcgttcgggttcgcgagcggtcgtattttattttacggaggggagataatgagattaattagaggcgtcgttatcgcgtaggagatagttgtcgtcgtatagtaattattcgcgggttgcggtgcgcgggggtttttcgtttatttgcgcgtttgttgtttttattacgcggtatcgattcgggcgcgttttcggtttttgttcgtagtt

SEQ ID NO: 11224 - DNA, 764 bp, Artificial Sequence
  chemically treated genomic DNA (Homo sapiens) CpG-island No: 11224
aactacgaacaaaaaccgaaaacgcgcccgaatcgataccgcgtaataaaaacaacaaacgcgcaaataaacgaaaaacccccgcgcaccgcaacccgcgaataattactatacgacgacaactatctcctacgcgataacgacgcctctaattaatctcattatctcccctccgtaaaataaaatacgaccgctcgcgaacccgaacgcgcgaaaaacgactaacaaccgcgaaccgacgaaaacaacgctcgacctcgaaataacactaccgccgaacgccgcccaacgaacgcaaacgacgaaaaactcgacgacgaaactcgcgttcctacaccgcgaccgaccaaaaaacaccccgaaactaaacgacgtctcgaaaacgcattcctttattactcccaccgtctttaataacgattattaataccatcatatcccatttcccctcaccttcccccgctcccaaaaccgcgcccgcgcgcccgatctccaaacgcttcgctcctcctaaaaccaacaacaataatcctcaattaaccctctaccaaaactacctactcgtaaataaaacgctcttccgactcgcgaacgacaaacgccccaacccgaacgaaaaaccaatctccgctcccccgaccgaacccgcgaaaactcgcaatccgcccgaacgccgactaaaaataacctcgcaactcccccgacctccctccaaaataaaactcgccctctctaaaaaaaaaaaaacaaaaacgatccgaaaa

SEQ ID NO: 11225 - DNA, 501 bp, Artificial Sequence
  chemically treated genomic DNA (Homo sapiens) CpG-island No: 11225
tgtttcgtcgttgttagagtttttgttaggtttgcgcgcgttgtgcgacgaatttggcgcgttgttgattatcgatgaagtgatgatcggttttcgcgtagcgttagttggcgtataggattattacggcgtagtgttagatttaatttgtttcggtaaaattatcggcggtggaatgtcggtaggcgtattcggtggtcgtcgtgatgtaatggatgcgttggcgtcgacgggttcggtttattaggcgggtacgtttttcggtaattcgattgcgatggtagcgggtttcgtttgtttgaatgaagtcgcgtagtcgggcgtttacgaaacgttggatgagttgataagacgtttggtagaaagtttgttggaagcggttgaagaagtcggaatttcgttggtcgtttattacgttggcggtttgttcggtattttttttatcgatatcgagttcgtgacgtgttattaagatgtgatgagttgtgacgtggaacgttt

SEQ ID NO: 11226 - DNA, 501 bp, Artificial Sequence
  chemically treated genomic DNA (Homo sapiens) CpG-island No: 11226
aaacgttccacgtcacaactcatcacatcttaataacacgtcacgaactcgatatcgataaaaaaaataccgaacaaaccgccaacgtaataaacgaccaacgaaattccgacttcttcaaccgcttccaacaaactttctaccaaacgtcttatcaactcatccaacgtttcgtaaacgcccgactacgcgacttcattcaaacaaacgaaacccgctaccatcgcaatcgaattaccgaaaaacgtacccgcctaataaaccgaacccgtcgacgccaacgcatccattacatcacgacgaccaccgaatacgcctaccgacattccaccgccgataattttaccgaaacaaattaaatctaacactacgccgtaataatcctatacgccaactaacgctacgcgaaaaccgatcatcacttcatcgataatcaacaacgcgccaaattcgtcgcacaacgcgcgcaaacctaacaaaaactctaacaacgacgaaaca

SEQ ID NO: 11227 - DNA, 501 bp, Artificial Sequence
  chemically treated genomic DNA (Homo sapiens) CpG-island No: 11227
aagcgttttacgttatagtttattatattttgataatacgttacggattcggtgtcggtaaagaaaatgtcgaataggtcgttaacgtgataaacgattagcggagtttcggtttttttagtcgtttttagtagattttttgttagacgttttgttagtttatttagcgtttcgtgaacgttcggttgcgcgattttatttagataggcgaagttcgttgttatcgtaatcgggttatcggaaagcgtattcgtttgatagatcggattcgtcggcgttagcgtatttattatattacgacgattatcgaatgcgtttatcggtattttatcgtcgatgattttgtcgaggtaggttaaatttggtattacgtcgtaataattttgtgcgttagttagcgttacgcggaaatcggttattattttatcgatgattagtaacgcgttaaattcgtcgtatagcgcgcgtagatttggtaggaattttggtagcggcggaata

SEQ ID NO: 11228 - DNA, 501 bp, Artificial Sequence
  chemically treated genomic DNA (Homo sapiens) CpG-island No: 11228
tattccgccgctaccaaaattcctaccaaatctacgcgcgctatacgacgaatttaacgcgttactaatcatcgataaaataataaccgatttccgcgtaacgctaactaacgcacaaaattattacgacgtaataccaaatttaacctacctcgacaaaatcatcgacgataaaataccgataaacgcattcgataatcgtcgtaatataataaatacgctaacgccgacgaatccgatctatcaaacgaatacgctttccgataacccgattacgataacaacgaacttcgcctatctaaataaaatcgcgcaaccgaacgttcacgaaacgctaaataaactaacaaaacgtctaacaaaaaatctactaaaaacgactaaaaaaaccgaaactccgctaatcgtttatcacgttaacgacctattcgacattttctttaccgacaccgaatccgtaacgtattatcaaaatataataaactataacgtaaaacgctt

SEQ ID NO: 11229 - DNA, 848 bp, Artificial Sequence
  chemically treated genomic DNA (Homo sapiens) CpG-island No: 11229
  misc_feature (62)..(62): n is either a, c, g or t
  misc_feature (341)..(341): n is either a, c, g or t
  misc_feature (346)..(347): n is either a, c, g or t
tggtggtcggtagtacgttataggagatgttcgacgcgggttattagtaggtagggcggtgnttttttgtgtttttgtattcgtaaacgtatgaagagtatgcgttggtacgtatcgaacggaaattcggtttcggttatatcggttttatttgttatgtcgtatcggatgttacgttggaagatgattttaagcgtcgcgttttgattattaatgcgttggtttaggacgataacggcgagattatcgattcgtataacggtttgggcgatttgtaaaatcgtttgttgcgttatgtttttttcgtttttggcgaagattcgttacgcgtattgcgttgngcgtnntttgttgcgcgttatgtttatttcggttttcgtattgtcgatgaaattttggcgttgatgcgcgagatgatttatgcgggtgaattggaatatttgacgtttgaacgggtatggaaagagacggaaagcgtttttattattcgtaatttataggtgtttttttaggtattgcgcgattgcggcgtattgcgtgtttattttcggaaattgacgtattgtttggcgtttcggtttttgttaagtggtattcggaaatcgatacgggtatttatattttaatgacgtttttaatggcggcgatgttgagttcgtagtcgatgttcgtttcgtaattttatgttacgatttcggtaaagggttgacgtcgttagaattttggtcgcgttattatggttatggttcggcgggtgttaagttagtggaataattatgttagcgtttgcgcgtgttaaatgaaattcgcgatttagttagattggtggttgagttttacgattttat

SEQ ID NO: 11230 - DNA, 848 bp, Artificial Sequence
  chemically treated genomic DNA (Homo sapiens) CpG-island No: 11230
  misc_feature (502)..(503): n is either a, c, g or t
  misc_feature (508)..(508): n is either a, c, g or t
  misc_feature (787)..(787): n is either a, c, g or t
ataaaatcgtaaaactcaaccaccaatctaactaaatcgcgaatttcatttaacacgcgcaaacgctaacataattattccactaacttaacacccgccgaaccataaccataataacgcgaccaaaattctaacgacgtcaaccctttaccgaaatcgtaacataaaattacgaaacgaacatcgactacgaactcaacatcgccgccattaaaaacgtcattaaaatataaatacccgtatcgatttccgaataccacttaacaaaaaccgaaacgccaaacaatacgtcaatttccgaaaataaacacgcaatacgccgcaatcgcgcaatacctaaaaaaacacctataaattacgaataataaaaacgctttccgtctctttccatacccgttcaaacgtcaaatattccaattcacccgcataaatcatctcgcgcatcaacgccaaaatttcatcgacaatacgaaaaccgaaataaacataacgcgcaacaaannacgcncaacgcaatacgcgtaacgaatcttcgccaaaaacgaaaaaaacataacgcaacaaacgattttacaaatcgcccaaaccgttatacgaatcgataatctcgccgttatcgtcctaaaccaacgcattaataatcaaaacgcgacgcttaaaatcatcttccaacgtaacatccgatacgacataacaaataaaaccgatataaccgaaaccgaatttccgttcgatacgtaccaacgcatactcttcatacgtttacgaatacaaaaacacaaaaaancaccgccctacctactaataacccgcgtcgaacatctcctataacgtactaccgaccacca

SEQ ID NO: 11231 - DNA, 848 bp, Artificial Sequence
  chemically treated genomic DNA (Homo sapiens) CpG-island No: 11231
  misc_feature (502)..(503): n is either a, c, g or t
  misc_feature (508)..(508): n is either a, c, g or t
  misc_feature (787)..(787): n is either a, c, g or t
atgagatcgtgaaatttagttattagtttggttaaatcgcgaattttatttggtacgcgtagacgttggtatagttgttttattaatttaatattcgtcgggttatgattatgatgacgcggttagagttttggcggcgttagttttttatcgagatcgtggtataaagttgcgaaacggatatcgattgcggatttagtatcgtcgttattgagagcgttattaaggtatgaatattcgtatcgattttcggatgttatttggtaggggtcggaacgttaaatagtgcgttaattttcgggaataaatacgtagtgcgtcgtaatcgcgtagtatttggaagaatatttgtggattgcgggtggtgagggcgtttttcgtttttttttatattcgtttaggcgttaggtgttttagtttattcgtatgggttatttcgcgtattaacgttagagttttatcggtaatacgaaaatcgaggtgggtataacgcgtagtaaannacgtntagcgtaatacgcgtaacggattttcgttaaaagcgggggaaatatggcgtaatagacgattttgtagatcgtttagatcgttgtacgggtcgataatttcgtcgttatcgttttgggttagcgtattaatggttagaacgcgacgtttaagattattttttagcgtgatattcggtgcggtatagtaagtaaaatcggtgtaatcggaatcggattttcgttcggtacgtgttagcgtatattttttatgcgtttgcggatgtagaaatataggaaantatcgttttatttgttggtagttcgcgtcgagtattttttgtggcgtattgtcgattatta

SEQ ID NO: 11232 - DNA, 848 bp, Artificial Sequence
  chemically treated genomic DNA (Homo sapiens) CpG-island No: 11232
  misc_feature (62)..(62): n is either a, c, g or t
  misc_feature (341)..(341): n is either a, c, g or t
  misc_feature (346)..(347): n is either a, c, g or t
taataatcgacaatacgccacaaaaaatactcgacgcgaactaccaacaaataaaacgatantttcctatatttctacatccgcaaacgcataaaaaatatacgctaacacgtaccgaacgaaaatccgattccgattacaccgattttacttactataccgcaccgaatatcacgctaaaaaataatcttaaacgtcgcgttctaaccattaatacgctaacccaaaacgataacgacgaaattatcgacccgtacaacgatctaaacgatctacaaaatcgtctattacgccatatttcccccgcttttaacgaaaatccgttacgcgtattacgctanacgtnntttactacgcgttatacccacctcgattttcgtattaccgataaaactctaacgttaatacgcgaaataacccatacgaataaactaaaacacctaacgcctaaacgaatataaaaaaaaacgaaaaacgccctcaccacccgcaatccacaaatattcttccaaatactacgcgattacgacgcactacgtatttattcccgaaaattaacgcactatttaacgttccgacccctaccaaataacatccgaaaatcgatacgaatattcataccttaataacgctctcaataacgacgatactaaatccgcaatcgatatccgtttcgcaactttataccacgatctcgataaaaaactaacgccgccaaaactctaaccgcgtcatcataatcataacccgacgaatattaaattaataaaacaactataccaacgtctacgcgtaccaaataaaattcgcgatttaaccaaactaataactaaatttcacgatctcat

SEQ ID NO: 11233 - DNA, 780 bp, Artificial Sequence
  chemically treated genomic DNA (Homo sapiens) CpG-island No: 11233
  misc_feature (744)..(744): n is either a, c, g or t
  misc_feature (756)..(756): n is either a, c, g or t
gttggtagcgcgtcgtggatatggcggcgtattgggtgtcgacgcgttgattttcgtcgatttcgttatgttggagtacgtcgtcgaggttattcgtatattgagcgttacgtatcggtgtaggtttcggcgattaatgaagaggcgattaatttttattatcgtattttgacgttgttcgcgtggtgttgtcgcgcgtgttgtcgagttattaggtgaaataattggtacgggttatatttgtattattggaagtttttgttttcggtagtttgtgtattatgtcggaaggtcgttgttatttgtcgtcgtatttgacgggtgagtcgtttaatattatatgcgcgtgtttttcggttcgtttcgtgcgttggtaataaacgtcgtaggggttggaatttcgtttgaacgaagtgttgatcgatcgttattaggacggcgaaaacgtaggttattcgacgttatgtaaagggcgttatttggtggacggcgagcgttattacgcgttggaagaattaattagttttaatattttggaattgttgtcggagttaatggcggcgaatattgtttcggtgaaaattgaaggtcgttagcgtagttcggcgtatgttagttaggtggcgaaagtttggcgttaggttatcgatcgttgtaaggtcgattcgtaaaattttgtatcgtaaaacgcgtggatggagacgttgggtcgatgttcgaaggtacgtaaaatatttttggcgnttattatcgtanatggtagtgagaaaagtaatgaaa

SEQ ID NO: 11234 - DNA, 780 bp, Artificial Sequence
  chemically treated genomic DNA (Homo sapiens) CpG-island No: 11234
  misc_feature (25)..(25): n is either a, c, g or t
  misc_feature (37)..(37): n is either a, c, g or t
tttcattacttttctcactaccatntacgataataancgccaaaaatattttacgtaccttcgaacatcgacccaacgtctccatccacgcgttttacgatacaaaattttacgaatcgaccttacaacgatcgataacctaacgccaaactttcgccacctaactaacatacgccgaactacgctaacgaccttcaattttcaccgaaacaatattcgccgccattaactccgacaacaattccaaaatattaaaactaattaattcttccaacgcgtaataacgctcgccgtccaccaaataacgccctttacataacgtcgaataacctacgttttcgccgtcctaataacgatcgatcaacacttcgttcaaacgaaattccaacccctacgacgtttattaccaacgcacgaaacgaaccgaaaaacacgcgcatataatattaaacgactcacccgtcaaatacgacgacaaataacaacgaccttccgacataatacacaaactaccgaaaacaaaaacttccaataatacaaatataacccgtaccaattatttcacctaataactcgacaacacgcgcgacaacaccacgcgaacaacgtcaaaatacgataataaaaattaatcgcctcttcattaatcgccgaaacctacaccgatacgtaacgctcaatatacgaataacctcgacgacgtactccaacataacgaaatcgacgaaaatcaacgcgtcgacacccaatacgccgccatatccacgacgcgctaccaac

SEQ ID NO: 11235 - DNA, 780 bp, Artificial Sequence
  chemically treated genomic DNA (Homo sapiens) CpG-island No: 11235
  misc_feature (25)..(25): n is either a, c, g or t
  misc_feature (37)..(37): n is either a, c, g or t
ttttattgttttttttattgttatntacggtgatagncgttaagagtgttttgcgtgttttcggatatcgatttagcgtttttatttacgcgttttgcggtataaagttttgcggatcggttttataacggtcgatagtttgacgttagattttcgttatttggttgatatacgtcgggttacgttggcggtttttaatttttatcgaagtaatattcgtcgttattaatttcggtagtagttttagggtattgagattggttggtttttttagcgcgtgatagcgttcgtcgtttattagataacgttttttatatagcgtcggataatttgcgttttcgtcgttttgataacggtcgattagtatttcgtttaggcgggattttagtttttgcggcgtttgttgttagcgtacgaaacgggtcggagaatacgcgtatatggtgttgggcgatttattcgttagatacgacgatagatagtaacgatttttcgatataatgtataggttgtcgaaagtaaagatttttagtggtataggtgtgattcgtgttagttgttttatttgatgattcgataatacgcgcggtagtattacgcgagtaacgttaaaatgcgatgataaaggttaatcgtttttttattggtcgtcgaagtttgtatcgatacgtggcgtttaatatgcggataatttcggcggcgtattttagtatggcgaggtcggcgaggattagcgcgtcggtatttagtgcgtcgttatatttacggcgcgttgttaat

SEQ ID NO: 11236 - DNA, 780 bp, Artificial Sequence
  chemically treated genomic DNA (Homo sapiens) CpG-island No: 11236
  misc_feature (744)..(744): n is either a, c, g or t
  misc_feature (756)..(756): n is either a, c, g or t
attaacaacgcgccgtaaatataacgacgcactaaataccgacgcgctaatcctcgccgacctcgccatactaaaatacgccgccgaaattatccgcatattaaacgccacgtatcgatacaaacttcgacgaccaataaaaaaacgattaacctttatcatcgcattttaacgttactcgcgtaatactaccgcgcgtattatcgaatcatcaaataaaacaactaacacgaatcacacctataccactaaaaatctttactttcgacaacctatacattatatcgaaaaatcgttactatctatcgtcgtatctaacgaataaatcgcccaacaccatatacgcgtattctccgacccgtttcgtacgctaacaacaaacgccgcaaaaactaaaatcccgcctaaacgaaatactaatcgaccgttatcaaaacgacgaaaacgcaaattatccgacgctatataaaaaacgttatctaataaacgacgaacgctatcacgcgctaaaaaaaccaaccaatctcaataccctaaaactactaccgaaattaataacgacgaatattacttcgataaaaattaaaaaccgccaacgtaacccgacgtatatcaaccaaataacgaaaatctaacgtcaaactatcgaccgttataaaaccgatccgcaaaactttataccgcaaaacgcgtaaataaaaacgctaaatcgatatccgaaaacacgcaaaacactcttaacgnctatcaccgtanataacaataaaaaaaacaataaaa

SEQ ID NO: 11237 - DNA, 634 bp, Artificial Sequence
  chemically treated genomic DNA (Homo sapiens) CpG-island No: 11237
gttggcgagggtggtaattagtattaacgttagggtgtaattttcgggaattttaaagtgtagcgttacgttcgtaatgattaattcgattacggtttttacggagcgatttataatttttagacgggttgcgttatagttattttgtgttattagtaatatcgttattaggatttagtacgatttcggtagatgtagcgcggtgtttattaggttggtaacgtttaatattatattgagtcgttcggtaattgcgtaggcgtcggagattttagtgatagataattttttagcgtcggaagtaatggtattcgtcgttgtttatcggttagtaagttacgggtatagagcggtttttgggtgcgtagtacgtaggcgatgcggttgaaatgttagtagtagaattgtttaatcggattattcggatgttggcgggcgattttttttagtgcgttaatttgtttttttatcgtaaaacgcgttggtaggcgatggtaaagaatgttattagttagtacgcgtaggcgagcggcgacggtttgcgtattttagcggataatttttttcgtatggttacgttcgattagtttttgtatttttttcggttgatgtaaattgatcgaaatatgttttt

SEQ ID NO: 11238 - DNA, 634 bp, Artificial Sequence
  chemically treated genomic DNA (Homo sapiens) CpG-island No: 11238
aaaaacatatttcgatcaatttacatcaaccgaaaaaaatacaaaaactaatcgaacgtaaccatacgaaaaaaattatccgctaaaatacgcaaaccgtcgccgctcgcctacgcgtactaactaataacattctttaccatcgcctaccaacgcgttttacgataaaaaaacaaattaacgcactaaaaaaaatcgcccgccaacatccgaataatccgattaaacaattctactactaacatttcaaccgcatcgcctacgtactacgcacccaaaaaccgctctatacccgtaacttactaaccgataaacaacgacgaataccattacttccgacgctaaaaaattatctatcactaaaatctccgacgcctacgcaattaccgaacgactcaatataatattaaacgttaccaacctaataaacaccgcgctacatctaccgaaatcgtactaaatcctaataacgatattactaataacacaaaataactataacgcaacccgtctaaaaattataaatcgctccgtaaaaaccgtaatcgaattaatcattacgaacgtaacgctacactttaaaattcccgaaaattacaccctaacgttaatactaattaccaccctcgccaac

SEQ ID NO: 11239 - DNA, 634 bp, Artificial Sequence
  chemically treated genomic DNA (Homo sapiens) CpG-island No: 11239
aggaatatatttcggttagtttgtattagtcggaagaagtgtaaaagttggtcgagcgtagttatgcggaagaagttattcgttggaatgcgtaaatcgtcgtcgttcgtttgcgcgtgttggttgatgatattttttattatcgtttgttaacgcgttttacgatggaaaagtaaattggcgtattggaaaaaatcgttcgttagtattcggataattcggttgggtaattttgttattggtattttagtcgtatcgtttgcgtgttgcgtatttaaaaatcgttttatgttcgtgatttattggtcgataaatagcggcgaatgttattattttcggcgttgaaaagttatttgttattaaagttttcggcgtttacgtaattgtcggacgatttagtgtgatgttaagcgttgttagtttgatgggtatcgcgttgtatttgtcgaagtcgtattggattttgatgacggtattgttggtgatataaaatggttatggcgtaattcgtttgaggattgtgaatcgtttcgtgggaatcgtggtcgggttaattattgcgggcgtggcgttgtattttaaaattttcgaaggttatattttgacgttgatgttgattattattttcgttagt

SEQ ID NO: 11240 - DNA, 634 bp, Artificial Sequence
  chemically treated genomic DNA (Homo sapiens) CpG-island No: 11240
actaacgaaaataataatcaacatcaacgtcaaaatataaccttcgaaaattttaaaatacaacgccacgcccgcaataattaacccgaccacgattcccacgaaacgattcacaatcctcaaacgaattacgccataaccattttatatcaccaacaataccgtcatcaaaatccaatacgacttcgacaaatacaacgcgatacccatcaaactaacaacgcttaacatcacactaaatcgtccgacaattacgtaaacgccgaaaactttaataacaaataacttttcaacgccgaaaataataacattcgccgctatttatcgaccaataaatcacgaacataaaacgatttttaaatacgcaacacgcaaacgatacgactaaaataccaataacaaaattacccaaccgaattatccgaatactaacgaacgattttttccaatacgccaatttacttttccatcgtaaaacgcgttaacaaacgataataaaaaatatcatcaaccaacacgcgcaaacgaacgacgacgatttacgcattccaacgaataacttcttccgcataactacgctcgaccaacttttacacttcttccgactaatacaaactaaccgaaatatattcct

SEQ ID NO: 11241 - DNA, 708 bp, Artificial Sequence
  chemically treated genomic DNA (Homo sapiens) CpG-island No: 11241
  misc_feature (657)..(657): n is either a, c, g or t
agttagcgcgtcgttggcgttgaatatttttatttagtcgttatcgataatggttagttttcgggtatttgtttcgttgatttagataatcggtttatcgcgagagagcgttagtattagtaggtttttattgtaggttgagtgaatgttttatttttggtgcggcgttaggaagttaagtgtttttttcgggaagtcgtttggcggtatttggcgtattttattgacgttacgggtgtcgataggcgggcgataagttattaggtttttattaaaagtacgtatttacggatgattttgatagagttgttggcgtttcgatagcgtgcgttacggaattaatttatgaacgttggtgtatttcgcgttataggagacgtgatcgttttttagatcggattaggtggggttggagataattttacgcggttgcgtttgaatatcgcgaaagcgaattttttcgttttttttgtgtagcgttagatgggtatgttcgcgttcggtgatttcgtttagcgtttgttacgttttgattgtaatatgatcgttggttttcggtgttagtgttagaattatttttgaagcgttaatggcggtgttaattagcggacgtttttgtgtcgggttattacgtttggtgtaattgagtttgtttangaaatcgattttattttgggtattttacgaaattttttatcgttattgtta

SEQ ID NO: 11242 - DNA, 708 bp, Artificial Sequence
  chemically treated genomic DNA (Homo sapiens) CpG-island No: 11242
  misc_feature (52)..(52): n is either a, c, g or t
taacaataacgataaaaaatttcgtaaaatacccaaaataaaatcgatttcntaaacaaactcaattacaccaaacgtaataacccgacacaaaaacgtccgctaattaacaccgccattaacgcttcaaaaataattctaacactaacaccgaaaaccaacgatcatattacaatcaaaacgtaacaaacgctaaacgaaatcaccgaacgcgaacatacccatctaacgctacacaaaaaaaacgaaaaaattcgctttcgcgatattcaaacgcaaccgcgtaaaattatctccaaccccacctaatccgatctaaaaaacgatcacgtctcctataacgcgaaatacaccaacgttcataaattaattccgtaacgcacgctatcgaaacgccaacaactctatcaaaatcatccgtaaatacgtacttttaataaaaacctaataacttatcgcccgcctatcgacacccgtaacgtcaataaaatacgccaaataccgccaaacgacttcccgaaaaaaacacttaacttcctaacgccgcaccaaaaataaaacattcactcaacctacaataaaaacctactaatactaacgctctctcgcgataaaccgattatctaaatcaacgaaacaaatacccgaaaactaaccattatcgataacgactaaataaaaatattcaacgccaacgacgcgctaact

SEQ ID NO: 11243 - DNA, 708 bp, Artificial Sequence
  chemically treated genomic DNA (Homo sapiens) CpG-island No: 11243
  misc_feature (52)..(52): n is either a, c, g or t
tggtaatggcggtaaaggatttcgtggaatatttaggatgaaatcgattttntgggtaaatttaattatattaagcgtgatggttcggtataggggcgttcgttgattgatatcgttattgacgttttagaagtgattttggtattggtatcggaaattaacggttatgttgtagttaaagcgtggtaggcgttgggcgagattatcgggcgcgaatatatttatttggcgttgtataaagaggacgagaagattcgttttcgcgatatttaggcgtagtcgcgtaaaattatttttagttttatttggttcggtttggaaagcgattacgttttttataacgcgggatatattaacgtttatgagttaatttcgtggcgtacgttgtcgggacgttagtagttttattaggattattcgtggatgcgtgtttttggtgaaagtttggtggtttatcgttcgtttatcgatattcgtagcgttagtgagatgcgttagatatcgttaaacggtttttcggaaaaagtatttaattttttgacgtcgtattagaaatggggtatttatttaatttatagtgaaaatttgttaatgttgacgttttttcgcggtggatcgattgtttggattagcgaaatagatgttcgagaattgattattgtcgataacgattgggtggaagtatttaacgttaacggcgcgttgatt

SEQ ID NO: 11244 - DNA, 708 bp, Artificial Sequence
  chemically treated genomic DNA (Homo sapiens) CpG-island No: 11244
  misc_feature (657)..(657): n is either a, c, g or t
aatcaacgcgccgttaacgttaaatacttccacccaatcgttatcgacaataatcaattctcgaacatctatttcgctaatccaaacaatcgatccaccgcgaaaaaacgtcaacattaacaaattttcactataaattaaataaataccccatttctaatacgacgtcaaaaaattaaatactttttccgaaaaaccgtttaacgatatctaacgcatctcactaacgctacgaatatcgataaacgaacgataaaccaccaaactttcaccaaaaacacgcatccacgaataatcctaataaaactactaacgtcccgacaacgtacgccacgaaattaactcataaacgttaatatatcccgcgttataaaaaacgtaatcgctttccaaaccgaaccaaataaaactaaaaataattttacgcgactacgcctaaatatcgcgaaaacgaatcttctcgtcctctttatacaacgccaaataaatatattcgcgcccgataatctcgcccaacgcctaccacgctttaactacaacataaccgttaatttccgataccaataccaaaatcacttctaaaacgtcaataacgatatcaatcaacgaacgcccctataccgaaccatcacgcttaatataattaaatttacccanaaaatcgatttcatcctaaatattccacgaaatcctttaccgccattacca

SEQ ID NO: 11245 - DNA, 530 bp, Artificial Sequence
  chemically treated genomic DNA (Homo sapiens) CpG-island No: 11245
  misc_feature (394)..(394): n is either a, c, g or t
ttattatgcgcgtggtcgatattatgttggcgttgtaagtttgttgttggcgttggtgttggtggtaattttcggttcgtcgattggtaacgtcgcgttggtattgattttcgttgttttgtcgtattatgtgttttaattcgcgtcgtcgtgttggtggaagttaatcgcgattacgttatcgcgtttcgttggcgggtgtcggggcgatgcgttagatgtttattaatattttttcgaattgttttgcgtcgttgattgtttaggcgtcgttcggtttttttaacgttattttcgatatggttgtttttggttttttcggtatgggggtatagcgttaacgtttgagtggggtattatgtttttcgacgtgttgtagttcgcgtaaagtttntgggtgggtcgtgattttttcgggtttggcgattttgttgacggtgttggtatttaatttgatgggtgacggtttgcgtgacgcgttcgattttaaattgaagtagtaagaggttcgagatggcgttattaaatgt

SEQ ID NO: 11246 - DNA, 530 bp, Artificial Sequence
  chemically treated genomic DNA (Homo sapiens) CpG-island No: 11246
  misc_feature (137)..(137): n is either a, c, g or t
acatttaataacgccatctcgaacctcttactacttcaatttaaaatcgaacgcgtcacgcaaaccgtcacccatcaaattaaataccaacaccgtcaacaaaatcgccaaacccgaaaaaatcacgacccacccanaaactttacgcgaactacaacacgtcgaaaaacataataccccactcaaacgttaacgctatacccccataccgaaaaaaccaaaaacaaccatatcgaaaataacgttaaaaaaaccgaacgacgcctaaacaatcaacgacgcaaaacaattcgaaaaaatattaataaacatctaacgcatcgccccgacacccgccaacgaaacgcgataacgtaatcgcgattaacttccaccaacacgacgacgcgaattaaaacacataatacgacaaaacaacgaaaatcaataccaacgcgacgttaccaatcgacgaaccgaaaattaccaccaacaccaacgccaacaacaaacttacaacgccaacataatatcgaccacgcgcataataa

SEQ ID NO: 11247 - DNA, 530 bp, Artificial Sequence
  chemically treated genomic DNA (Homo sapiens) CpG-island No: 11247
  misc_feature (137)..(137): n is either a, c, g or t
atatttaataacgttatttcgaattttttattgttttagtttgggatcgagcgcgttacgtagatcgttatttattaggttaaatgttagtatcgttagtaggatcgttagattcgggaaggttacgatttatttangggttttgcgcgaattgtaatacgtcggagagtatggtgttttatttaggcgttggcgttgtgtttttatgtcgaggaaattaagagtagttatatcgagaatggcgttagagaaatcgagcgacgtttgaataattagcggcgtaaggtagttcgggaagatgttaataaatatttgacgtatcgtttcggtattcgttagcgagacgcggtgacgtaatcgcggttaatttttattagtacggcggcgcgggttaaggtatatagtgcggtaaggtaacgaaggttagtgttagcgcggcgttattaatcgacgggtcgaaaattgttattagtattagcgttagtagtagatttgtagcgttagtatgatatcgattacgcgtataatga

SEQ ID NO: 11248 - DNA, 530 bp, Artificial Sequence
  chemically treated genomic DNA (Homo sapiens) CpG-island No: 11248
  misc_feature (394)..(394): n is either a, c, g or t
tcattatacgcgtaatcgatatcatactaacgctacaaatctactactaacgctaatactaataacaattttcgacccgtcgattaataacgccgcgctaacactaaccttcgttaccttaccgcactatataccttaacccgcgccgccgtactaataaaaattaaccgcgattacgtcaccgcgtctcgctaacgaataccgaaacgatacgtcaaatatttattaacatcttcccgaactaccttacgccgctaattattcaaacgtcgctcgatttctctaacgccattctcgatataactactcttaatttcctcgacataaaaacacaacgccaacgcctaaataaaacaccatactctccgacgtattacaattcgcgcaaaacccntaaataaatcgtaaccttcccgaatctaacgatcctactaacgatactaacatttaacctaataaataacgatctacgtaacgcgctcgatcccaaactaaaacaataaaaaattcgaaataacgttattaaatat

SEQ ID NO: 11249 - DNA, 880 bp, Artificial Sequence
  chemically treated genomic DNA (Homo sapiens) CpG-island No: 11249
gtcgttagtattttcgttagcgttcgcgagacgtcgagggatttattttgaaacgcggcgtaatcgttagtgcgtgttcgaatttgtgaggggacgcgtttaattatttttacgtttagcgtaggaaagataagcgaatattcggtttcggttaacgtcgcgttcgttaatgcgatttatgtatttggggtttgtagagtagtaataagtttatcgtttttataagtagagagataatcgttatttttacgtcgttaaaacggttcggtatttagttaaatatgacgcgtattacgataaatgcgtcgttaaacgcggtaagagtaaagttcgttatcgtttattttttgttggtaaagtagagcgaaacgaaagtttcgataatagtaaaattaacgttttgtagtgttagatttaattttggtttttagataagttcgataacgttttatagcgatggacgttttttcgttaggtcggttattttgcgtattgtgtcgttataggtttacgttagtacgggtaatattattgtggtgatcgttagtgcggtaaaattcgtaatggttatgaattaataggttaagcggcgattaatagcgagggtattttaaatcgttatttcgttttatgatattattttgttcgagttgttttggttttacgatgttaagtttttaggttaggacgtttgtaattatttgtttttataaagtaagaattaacgtcgacgataataggtagattgacggttcgagtagtaaatcgcgtatataagcgcgtagttagtatattatattttgagtcgaagttttatatatgttggtatgcggttataggttacgtatagaatgatcgaggatcgttagttttatatatt

SEQ ID NO: 11250 - DNA, 880 bp, Artificial Sequence
  chemically treated genomic DNA (Homo sapiens) CpG-island No: 11250
aatatataaaactaacgatcctcgatcattctatacgtaacctataaccgcataccaacatatataaaacttcgactcaaaatataatatactaactacgcgcttatatacgcgatttactactcgaaccgtcaatctacctattatcgtcgacgttaattcttactttataaaaacaaataattacaaacgtcctaacctaaaaacttaacatcgtaaaaccaaaacaactcgaacaaaataatatcataaaacgaaataacgatttaaaataccctcgctattaatcgccgcttaacctattaattcataaccattacgaattttaccgcactaacgatcaccacaataatattacccgtactaacgtaaacctataacgacacaatacgcaaaataaccgacctaacgaaaaaacgtccatcgctataaaacgttatcgaacttatctaaaaaccaaaattaaatctaacactacaaaacgttaattttactattatcgaaactttcgtttcgctctactttaccaacaaaaaataaacgataacgaactttactcttaccgcgtttaacgacgcatttatcgtaatacgcgtcatatttaactaaataccgaaccgttttaacgacgtaaaaataacgattatctctctacttataaaaacgataaacttattactactctacaaaccccaaatacataaatcgcattaacgaacgcgacgttaaccgaaaccgaatattcgcttatctttcctacgctaaacgtaaaaataattaaacgcgtcccctcacaaattcgaacacgcactaacgattacgccgcgtttcaaaataaatccctcgacgtctcgcgaacgctaacgaaaatactaacgac

SEQ ID NO: 11251 - DNA, 880 bp, Artificial Sequence
  chemically treated genomic DNA (Homo sapiens) CpG-island No: 11251
gatgtatgaaattggcgattttcgattattttgtacgtgatttgtagtcgtatgttaatatatgtgaaatttcggtttaggatgtagtgtgttggttgcgcgtttgtgtgcgcgatttgttgttcgaatcgttaatttgtttgttgtcgtcggcgttgatttttgttttgtgaaagtaggtaattataggcgttttgatttggggatttggtatcgtagggttaaaataattcgggtaaagtgatgttatggaacggaatggcgatttaaggtgttttcgttgttggtcgtcgtttggtttgttgatttatagttattacgggttttgtcgtattggcgattattataatggtattattcgtattggcgtgggtttgtaacggtatagtgcgtaaagtaatcggtttggcgggagaacgtttatcgttgtggagcgttgtcgggtttatttggaaattagggttaggtttggtattataaggcgttggttttgttgttatcgggattttcgtttcgttttattttgttagtaaaggatgggcgatggcgggttttatttttatcgcgtttggcggcgtatttgtcgtgatgcgcgttatgtttggttggatgtcggatcgttttggcggcgtgaaagtggcgattgtttttttgtttgtagaaacggtgggtttgttgttgttttgtaagttttaggtgtatgggtcgtattagcgggcgcggcgttaatcggagtcggatgttcgtttattttttttgcgttgggcgtggaggtggttaaacgcgtttttttataagttcgggtacgtattggcggttacgtcgcgttttaggatgagtttttcggcgtttcgcgggcgttggcgggaatgttggcgat

SEQ ID NO: 11252 - DNA, 880 bp, Artificial Sequence
  chemically treated genomic DNA (Homo sapiens) CpG-island No: 11252
atcgccaacattcccgccaacgcccgcgaaacgccgaaaaactcatcctaaaacgcgacgtaaccgccaatacgtacccgaacttataaaaaaacgcgtttaaccacctccacgcccaacgcaaaaaaaataaacgaacatccgactccgattaacgccgcgcccgctaatacgacccatacacctaaaacttacaaaacaacaacaaacccaccgtttctacaaacaaaaaaacaatcgccactttcacgccgccaaaacgatccgacatccaaccaaacataacgcgcatcacgacaaatacgccgccaaacgcgataaaaataaaacccgccatcgcccatcctttactaacaaaataaaacgaaacgaaaatcccgataacaacaaaaccaacgccttataataccaaacctaaccctaatttccaaataaacccgacaacgctccacaacgataaacgttctcccgccaaaccgattactttacgcactataccgttacaaacccacgccaatacgaataataccattataataatcgccaatacgacaaaacccgtaataactataaatcaacaaaccaaacgacgaccaacaacgaaaacaccttaaatcgccattccgttccataacatcactttacccgaattattttaaccctacgataccaaatccccaaatcaaaacgcctataattacctactttcacaaaacaaaaatcaacgccgacgacaacaaacaaattaacgattcgaacaacaaatcgcgcacacaaacgcgcaaccaacacactacatcctaaaccgaaatttcacatatattaacatacgactacaaatcacgtacaaaataatcgaaaatcgccaatttcatacatc

SEQ ID NO: 11253 - DNA, 730 bp, Artificial Sequence
  chemically treated genomic DNA (Homo sapiens) CpG-island No: 11253
gatgtagcgattcggcgtagatgagttggttggattaatcgttagtagtgaatttattggtcgcgaaacgtttgttataaatgttgggggtattggagggtgaacggtttagtgcgtaagggtaaaaaatggtagcgttgggtaacgattcgcgtttagtttaatgttggttagcgcgaagaacgacgacgaagttgttatcgcggtaaaaattgtcgtatttttcgaagagtcgttacggatgggtaatagtgatttgggcgtggcgttttcgcgtaattaattagtttggtagtaacgtagttagtaattgttaaaacgtttaaacgtacgtgtcggtgaggtagatagttcgtttatcgcgtcgttatttgtcggggcgtttgtcgatcgtattgttcgtcgtcgtgggtaagatggacgttattaattggtaaacggtatgggagcgatgttcgatgttaacgacgcgttaagtcgttacgaatggttgatcgtatcgttattattgtagggtagcgttcgtcggatgttcggattttattggcgttgttggtcgatattgatgagttagtataacgttattcgtagttgtgtatatagttttgatattgtggagtgggatgatttttatgtacgttgaaatttgggcgtcgttataaatcggttattgacggtgaaagtgtagcgttgcgaaaacgttaaaagatagttgtattagcgattttaa

SEQ ID NO: 11254 - DNA, 730 bp, Artificial Sequence
  chemically treated genomic DNA (Homo sapiens) CpG-island No: 11254
ttaaaatcgctaatacaactatcttttaacgttttcgcaacgctacactttcaccgtcaataaccgatttataacgacgcccaaatttcaacgtacataaaaatcatcccactccacaatatcaaaactatatacacaactacgaataacgttatactaactcatcaatatcgaccaacaacgccaataaaatccgaacatccgacgaacgctaccctacaataataacgatacgatcaaccattcgtaacgacttaacgcgtcgttaacatcgaacatcgctcccataccgtttaccaattaataacgtccatcttacccacgacgacgaacaatacgatcgacaaacgccccgacaaataacgacgcgataaacgaactatctacctcaccgacacgtacgtttaaacgttttaacaattactaactacgttactaccaaactaattaattacgcgaaaacgccacgcccaaatcactattacccatccgtaacgactcttcgaaaaatacgacaatttttaccgcgataacaacttcgtcgtcgttcttcgcgctaaccaacattaaactaaacgcgaatcgttacccaacgctaccattttttacccttacgcactaaaccgttcaccctccaatacccccaacatttataacaaacgtttcgcgaccaataaattcactactaacgattaatccaaccaactcatctacgccgaatcgctacatc

SEQ ID NO: 11255 - DNA, 730 bp, Artificial Sequence
  chemically treated genomic DNA (Homo sapiens) CpG-island No: 11255
ttaagatcgttgatgtaattgttttttgacgttttcgtagcgttgtatttttatcgttaatgatcgatttgtagcgacgtttaggttttagcgtatatgggggttattttattttatagtgttagaattgtgtatatagttgcgggtagcgttgtattaatttattaatatcgattagtagcgttagtaaaattcgagtattcggcgagcgttgttttgtaataataacggtgcgattaattattcgtggcggtttagcgcgtcgttggtatcgagtatcgtttttatgtcgtttgttagttgatagcgtttattttgtttacggcgacgagtaatgcgatcggtaaacgtttcggtaagtagcggcgcgataagcgaattgtttgttttatcgatacgtacgtttaagcgttttaatagttgttgattacgttgttgttaggttggttgattgcgcgaaaacgttacgtttaggttattattgtttattcgtggcggtttttcgagaaatgcggtaatttttgtcgcggtagtagtttcgtcgtcgtttttcgcgttaattagtattaggttaaacgcggatcgttatttagcgttgttattttttgtttttgcgtattaagtcgtttattttttagtgtttttagtatttgtaatagacgtttcgcggttagtagatttattattggcggttgatttagttagtttatttgcgtcggatcgttgtatt

SEQ ID NO: 11256 - DNA, 730 bp, Artificial Sequence
  chemically treated genomic DNA (Homo sapiens) CpG-island No: 11256
aatacaacgatccgacgcaaataaactaactaaatcaaccgccaataataaatctactaaccgcgaaacgtctattacaaatactaaaaacactaaaaaataaacgacttaatacgcaaaaacaaaaaataacaacgctaaataacgatccgcgtttaacctaatactaattaacgcgaaaaacgacgacgaaactactaccgcgacaaaaattaccgcatttctcgaaaaaccgccacgaataaacaataataacctaaacgtaacgttttcgcgcaatcaaccaacctaacaacaacgtaatcaacaactattaaaacgcttaaacgtacgtatcgataaaacaaacaattcgcttatcgcgccgctacttaccgaaacgtttaccgatcgcattactcgtcgccgtaaacaaaataaacgctatcaactaacaaacgacataaaaacgatactcgataccaacgacgcgctaaaccgccacgaataattaatcgcaccgttattattacaaaacaacgctcgccgaatactcgaattttactaacgctactaatcgatattaataaattaatacaacgctacccgcaactatatacacaattctaacactataaaataaaataacccccatatacgctaaaacctaaacgtcgctacaaatcgatcattaacgataaaaatacaacgctacgaaaacgtcaaaaaacaattacatcaacgatcttaa

SEQ ID NO: 11257 - DNA, 681 bp, Artificial Sequence
  chemically treated genomic DNA (Homo sapiens) CpG-island No: 11257
  misc_feature (653)..(653): n is either a, c, g or t
  misc_feature (658)..(658): n is either a, c, g or t
  misc_feature (662)..(662): n is either a, c, g or t
  misc_feature (664)..(664): n is either a, c, g or t
gaaatcgttaagattgttatttatcgcgtgggcgtattcgtaaaggattagcgggcgcgtttttttaggtagcgaaagttattttttgatggattatttcggtatagtcgggaagggttggtttttatttacgcgcgcgtatatcgggtaaataatatcggtggtcgtggtgtcggtttcgtcgtttttatattgtatcgggcgggaaggatcgatagatttgatttagcgatatagcgcgtcgtgattagcgtcgtggtttgatttattttttagcgattagatgattatattcgggtgattacgatcgcgttgtattattcgcgttacgcgttcgtttatcgtcggtagttagcgcggattatcggttagacgatttattggtattatgtcgtgggttttaatattggttttatttattatatataggtcgtagcggtcgtatagcgtgtattatagcggatggttcggataatgcgaatagcgtacggcgttaaagttgttttgttttattagtaggatattttgtattatcgtttgtttatttatgatttgattatgtagaggatgatgttcgtgacggttaacgtttcgaattagttacggtttgtcgtttagtagtagtagaggttttgatttgtagtagtgatagnttttncgananaaggtaggattttaaaa

SEQ ID NO: 11258 - DNA, 681 bp, Artificial Sequence
  chemically treated genomic DNA (Homo sapiens) CpG-island No: 11258
  misc_feature (18)..(18): n is either a, c, g or t
  misc_feature (20)..(20): n is either a, c, g or t
  misc_feature (24)..(24): n is either a, c, g or t
  misc_feature (29)..(29): n is either a, c, g or t
ttttaaaatcctaccttntntcgnaaaanctatcactactacaaatcaaaacctctactactactaaacgacaaaccgtaactaattcgaaacgttaaccgtcacgaacatcatcctctacataatcaaatcataaataaacaaacgataatacaaaatatcctactaataaaacaaaacaactttaacgccgtacgctattcgcattatccgaaccatccgctataatacacgctatacgaccgctacgacctatatataataaataaaaccaatattaaaacccacgacataataccaataaatcgtctaaccgataatccgcgctaactaccgacgataaacgaacgcgtaacgcgaataatacaacgcgatcgtaatcacccgaatataatcatctaatcgctaaaaaataaatcaaaccacgacgctaatcacgacgcgctatatcgctaaatcaaatctatcgatccttcccgcccgatacaatataaaaacgacgaaaccgacaccacgaccaccgatattatttacccgatatacgcgcgcgtaaataaaaaccaacccttcccgactataccgaaataatccatcaaaaaataactttcgctacctaaaaaaacgcgcccgctaatcctttacgaatacgcccacgcgataaataacaatcttaacgatttc

SEQ ID NO: 11259 - DNA, 681 bp, Artificial Sequence
  chemically treated genomic DNA (Homo sapiens) CpG-island No: 11259
  misc_feature (18)..(18): n is either a, c, g or t
  misc_feature (20)..(20): n is either a, c, g or t
  misc_feature (24)..(24): n is either a, c, g or t
  misc_feature (29)..(29): n is either a, c, g or t
ttttggggttttgttttntntcgnagaanttattattgttgtaggttaaaatttttgttgttgttgaacggtaagtcgtggttgattcgaggcgttaatcgttacgagtattattttttgtatggttaggttatggatgagtagacgatggtgtaggatattttgttgatgaagtagaataattttaacgtcgtgcgttgttcgtattattcgaattattcgttgtggtatacgttgtgcgatcgttacggtttgtatgtggtggatgaagttaatattgaaatttacggtatggtgttaatgaatcgtttgatcgatgattcgcgttggttatcggcgatgagcgaacgcgtaacgcgaatggtgtagcgcgatcgtaattattcgagtgtgattatttggtcgttggggaatgaattaggttacggcgttaattacgacgcgttgtatcgttggattaaatttgtcgatttttttcgttcggtgtagtatgaaggcggcggagtcgatattacggttatcgatattatttgttcgatgtacgcgcgcgtggatgaagattagtttttttcggttgtgtcgaaatggtttattaaaaaatggttttcgttatttggagagacgcgttcgttgattttttgcgaatacgtttacgcgatgggtaatagttttggcggtttt

SEQ ID NO: 11260 - DNA, 681 bp, Artificial Sequence
  chemically treated genomic DNA (Homo sapiens) CpG-island No: 11260
  misc_feature (653)..(653): n is either a, c, g or t
  misc_feature (658)..(658): n is either a, c, g or t
  misc_feature (662)..(662): n is either a, c, g or t
  misc_feature (664)..(664): n is either a, c, g or t
aaaaccgccaaaactattacccatcgcgtaaacgtattcgcaaaaaatcaacgaacgcgtctctccaaataacgaaaaccattttttaataaaccatttcgacacaaccgaaaaaaactaatcttcatccacgcgcgcgtacatcgaacaaataatatcgataaccgtaatatcgactccgccgccttcatactacaccgaacgaaaaaaatcgacaaatttaatccaacgatacaacgcgtcgtaattaacgccgtaacctaattcattccccaacgaccaaataatcacactcgaataattacgatcgcgctacaccattcgcgttacgcgttcgctcatcgccgataaccaacgcgaatcatcgatcaaacgattcattaacaccataccgtaaatttcaatattaacttcatccaccacatacaaaccgtaacgatcgcacaacgtataccacaacgaataattcgaataatacgaacaacgcacgacgttaaaattattctacttcatcaacaaaatatcctacaccatcgtctactcatccataacctaaccatacaaaaaataatactcgtaacgattaacgcctcgaatcaaccacgacttaccgttcaacaacaacaaaaattttaacctacaacaataataanttctncgananaaaacaaaaccccaaaa

SEQ ID NO: 11261 - DNA, 958 bp, Artificial Sequence
  chemically treated genomic DNA (Homo sapiens) CpG-island No: 11261
  misc_feature (802)..(802): n is either a, c, g or t
  misc_feature (825)..(825): n is either a, c, g or t
  misc_feature (831)..(831): n is either a, c, g or t
  misc_feature (836)..(836): n is either a, c, g or t
  misc_feature (842)..(843): n is either a, c, g or t
  misc_feature (886)..(886): n is either a, c, g or t
  misc_feature (893)..(893): n is either a, c, g or t
  misc_feature (907)..(907): n is either a, c, g or t
  misc_feature (925)..(925): n is either a, c, g or t
  misc_feature (941)..(941): n is either a, c, g or t
  misc_feature (954)..(954): n is either a, c, g or t
ttagacggttatcgaggtatgcggttttatcgttatatggttttggttcggggtcgtgtaggtagtattaatttttatcgtagcggaggtgaaagtttcgttaaagttatcgacgtttttgtcgggcgtgtttttcggcggttgattgacggtttgtttttcgttcgttagggagtaagtttttttattacggcgatagtgtgtttgtaatagcgaggtcgtcgttggcgtttgttcgaaggattcggttattattagcgtaatggtttgatgatagtgtttaatagtggggtcgtttaatagtttggcggtgtttttgtcgtttttgtcgagtgtttcggcgttattggcggtaatgatagttagtacgttcggcgttttttgcgcggcgttcgtattaagggcggtgaggcgttttttggtaatggcggaatcgacgatatagttataggcggcgttgggggtttttttatgttattcgtaggcgtagcgtgtcgtgtcggtagtttttagcggttcgtcgatgcggttatggggacgatcgataatttttagttgatcgatcgggtttttttttgcgggtttattaaattttatgtttgtgttttcgttttagttagtacggaggtaagcgttcgtttcgttaataggagtttaaaggtgtttttagcggtgggatgggcgttggcgaatagcgtgttatatacggtttgcgttttttgggatagttgagtattcgtagttttaatgcgttagggtttatgtgttatttttgttagcgcgacgcgttcgttgtcgttangttgaataatcgtcgcgacgatnataggntaaangcgtanngaggcgtatcgcgtattttacggtagatatgttttcggcgagncggtgangtgacgttacgtancgatgagtttattggaantaggcggttttatgtncggtttttttcgnaggt

SEQ ID NO: 11262 - DNA, 958 bp, Artificial Sequence
  chemically treated genomic DNA (Homo sapiens) CpG-island No: 11262
  misc_feature (5)..(5): n is either a, c, g or t
  misc_feature (18)..(18): n is either a, c, g or t
  misc_feature (34)..(34): n is either a, c, g or t
  misc_feature (52)..(52): n is either a, c, g or t
  misc_feature (66)..(66): n is either a, c, g or t
  misc_feature (73)..(73): n is either a, c, g or t
  misc_feature (116)..(117): n is either a, c, g or t
  misc_feature (123)..(123): n is either a, c, g or t
  misc_feature (128)..(128): n is either a, c, g or t
  misc_feature (134)..(134): n is either a, c, g or t
  misc_feature (157)..(157): n is either a, c, g or t
acctncgaaaaaaaccgnacataaaaccgcctanttccaataaactcatcgntacgtaacgtcacntcaccgnctcgccgaaaacatatctaccgtaaaatacgcgatacgcctcnntacgcntttancctatnatcgtcgcgacgattattcaacntaacgacaacgaacgcgtcgcgctaacaaaaataacacataaaccctaacgcattaaaactacgaatactcaactatcccaaaaaacgcaaaccgtatataacacgctattcgccaacgcccatcccaccgctaaaaacacctttaaactcctattaacgaaacgaacgcttacctccgtactaactaaaacgaaaacacaaacataaaatttaataaacccgcaaaaaaaaacccgatcgatcaactaaaaattatcgatcgtccccataaccgcatcgacgaaccgctaaaaactaccgacacgacacgctacgcctacgaataacataaaaaaacccccaacgccgcctataactatatcgtcgattccgccattaccaaaaaacgcctcaccgcccttaatacgaacgccgcgcaaaaaacgccgaacgtactaactatcattaccgccaataacgccgaaacactcgacaaaaacgacaaaaacaccgccaaactattaaacgaccccactattaaacactatcatcaaaccattacgctaataataaccgaatccttcgaacaaacgccaacgacgacctcgctattacaaacacactatcgccgtaataaaaaaacttactccctaacgaacgaaaaacaaaccgtcaatcaaccgccgaaaaacacgcccgacaaaaacgtcgataactttaacgaaactttcacctccgctacgataaaaattaatactacctacacgaccccgaaccaaaaccatataacgataaaaccgcatacctcgataaccgtctaa

SEQ ID NO: 11263 - DNA, 958 bp, Artificial Sequence
  chemically treated genomic DNA (Homo sapiens) CpG-island No: 11263
  misc_feature (5)..(5): n is either a, c, g or t
  misc_feature (18)..(18): n is either a, c, g or t
  misc_feature (34)..(34): n is either a, c, g or t
  misc_feature (52)..(52): n is either a, c, g or t
  misc_feature (66)..(66): n is either a, c, g or t
  misc_feature (73)..(73): n is either a, c, g or t
  misc_feature (116)..(117): n is either a, c, g or t
  misc_feature (123)..(123): n is either a, c, g or t
  misc_feature (128)..(128): n is either a, c, g or t
  misc_feature (134)..(134): n is either a, c, g or t
  misc_feature (157)..(157): n is either a, c, g or t
atttncggaaaaagtcgnatatgaaatcgtttgnttttagtgagtttatcgntgcgtgacgttatnttatcgnttcgtcgaaaatatatttatcgtaaggtgcgcgatgcgttttnntacgtntttgntttgtnatcgtcgcggcgattatttagtntgacggtagcgggcgcgtcgcgttggtaggagtagtatataagttttggcgtattgaggttgcggatgtttagttattttagggggcgtaggtcgtatatgatacgttgttcgttagcgtttattttatcgttgaaaatatttttaaatttttgttggcgaagcgaacgtttgttttcgtattggttgaagcgagggtataggtatgaaatttgataaattcgtaggggaaaattcgatcgattagttgaaggttgtcggtcgtttttatgatcgtatcgacggatcgttgaaaattatcggtacggtacgttacgtttacgaatggtatgaagaagtttttaacgtcgtttatggttatatcgtcggtttcgttattgttaaaggacgttttatcgtttttgatacggacgtcgcgtaaaaagcgtcgggcgtattggttgttattatcgttagtaacgtcggggtattcggtaaaggcgataaaaatatcgttaggttgttaggcggttttattattgagtattattattaggttattgcgttggtagtggtcgagtttttcgaataggcgttagcggcggtttcgttgttgtaggtatattatcgtcgtaataaaggagtttattttttggcggacgaaaaataggtcgttaattagtcgtcggaagatacgttcgataaaaacgtcggtgattttgacggggtttttattttcgttgcggtgaagattgatgttatttatacgatttcggattagagttatatggcgatggagtcgtatgtttcgatggtcgtttgg

SEQ ID NO: 11264 - DNA, 958 bp, Artificial Sequence
  chemically treated genomic DNA (Homo sapiens) CpG-island No: 11264
  misc_feature (802)..(802): n is either a, c, g or t
  misc_feature (825)..(825): n is either a, c, g or t
  misc_feature (831)..(831): n is either a, c, g or t
  misc_feature (836)..(836): n is either a, c, g or t
  misc_feature (842)..(843): n is either a, c, g or t
  misc_feature (886)..(886): n is either a, c, g or t
  misc_feature (893)..(893): n is either a, c, g or t
  misc_feature (907)..(907): n is either a, c, g or t
  misc_feature (925)..(925): n is either a, c, g or t
  misc_feature (941)..(941): n is either a, c, g or t
  misc_feature (954)..(954): n is either a, c, g or t
ccaaacgaccatcgaaacatacgactccatcgccatataactctaatccgaaatcgtataaataacatcaatcttcaccgcaacgaaaataaaaaccccgtcaaaatcaccgacgtttttatcgaacgtatcttccgacgactaattaacgacctatttttcgtccgccaaaaaataaactcctttattacgacgataatatacctacaacaacgaaaccgccgctaacgcctattcgaaaaactcgaccactaccaacgcaataacctaataataatactcaataataaaaccgcctaacaacctaacgatatttttatcgcctttaccgaataccccgacgttactaacgataataacaaccaatacgcccgacgctttttacgcgacgtccgtatcaaaaacgataaaacgtcctttaacaataacgaaaccgacgatataaccataaacgacgttaaaaacttcttcataccattcgtaaacgtaacgtaccgtaccgataattttcaacgatccgtcgatacgatcataaaaacgaccgacaaccttcaactaatcgatcgaattttcccctacgaatttatcaaatttcatacctataccctcgcttcaaccaatacgaaaacaaacgttcgcttcgccaacaaaaatttaaaaatattttcaacgataaaataaacgctaacgaacaacgtatcatatacgacctacgccccctaaaataactaaacatccgcaacctcaatacgccaaaacttatatactactcctaccaacgcgacgcgcccgctaccgtcanactaaataatcgccgcgacgatnacaaancaaanacgtannaaaacgcatcgcgcaccttacgataaatatattttcgacgaancgataanataacgtcacgcancgataaactcactaaaancaaacgatttcatatncgactttttccgnaaat

SEQ ID NO: 11265 - DNA, 791 bp, Artificial Sequence
  chemically treated genomic DNA (Homo sapiens) CpG-island No: 11265
cgtatttagaatttttacggatgtttttgggcgacgttgaaattgttttgattcgcgaataattgggttggaaatatgcgtcgttcgaaatttcgtttgaaatttatgtttagtgggatgcgaaagaagtaggttaggcgaaagaattcgtatggaacgagaaattcgttgtttacgcgaaagtttattcgtaggaagtcgttgaatttattcgtcgtatgaaaggcgaaatgtcgtttgatttcgacgttaaagcgaaagagtttatcgttaaattgtaggttaattcggcgaaaatcgttagtcgtaaagcgttttagaatgttatcgaagcgttcggttcgttgttgtcggaatttttcggcggttttgttgatttggcgtcgtttaatttgattttgtggtttggttttaaagtaattaacgaagatgttgcgggtaattatatttattacggtgttcgcgagttcggtatgatcgcgattgttaacggtatttttttgtacggtggttttttgtcgtatatttttatttttttgatgttcgtggaatacgtacgtaacgtcgtacgtatggcgcgttgatgaatatcgtagggatggtttaaatattatttttggtttggggaaacggcgattatagtcgttggtagtgtttttgcgtaatcgatattaatgggcgtgatagtgaacgcggtcggatcggtgaggggggcgcgttattttttaattgacgaaataagaagaattgcggttgtaaatcggcgggttttgcgaataaggtttaagaaa

SEQ ID NO: 11266 - DNA, 791 bp, Artificial Sequence
  chemically treated genomic DNA (Homo sapiens) CpG-island No: 11266
tttcttaaaccttattcgcaaaacccgccgatttacaaccgcaattcttcttatttcgtcaattaaaaaataacgcgcccccctcaccgatccgaccgcgttcactatcacgcccattaatatcgattacgcaaaaacactaccaacgactataatcgccgtttccccaaaccaaaaataatatttaaaccatccctacgatattcatcaacgcgccatacgtacgacgttacgtacgtattccacgaacatcaaaaaaataaaaatatacgacaaaaaaccaccgtacaaaaaaataccgttaacaatcgcgatcataccgaactcgcgaacaccgtaataaatataattacccgcaacatcttcgttaattactttaaaaccaaaccacaaaatcaaattaaacgacgccaaatcaacaaaaccgccgaaaaattccgacaacaacgaaccgaacgcttcgataacattctaaaacgctttacgactaacgattttcgccgaattaacctacaatttaacgataaactctttcgctttaacgtcgaaatcaaacgacatttcgcctttcatacgacgaataaattcaacgacttcctacgaataaactttcgcgtaaacaacgaatttctcgttccatacgaattctttcgcctaacctacttctttcgcatcccactaaacataaatttcaaacgaaatttcgaacgacgcatatttccaacccaattattcgcgaatcaaaacaatttcaacgtcgcccaaaaacatccgtaaaaattctaaatacg

SEQ ID NO: 11267 - DNA, 791 bp, Artificial Sequence
  chemically treated genomic DNA (Homo sapiens) CpG-island No: 11267
ttttttggattttattcgtagaattcgtcggtttataatcgtaattttttttatttcgttagttgagaagtaacgcgttttttttatcgattcggtcgcgtttattgttacgtttattaatatcggttacgtaaaaatattgttaacggttgtagtcgtcgtttttttagattaagaatggtgtttaaattatttttgcggtgtttattagcgcgttatacgtacggcgttacgtgcgtattttacgaatattaggaaggtggaggtgtacggtaggaagttatcgtgtagggagatatcgttagtaatcgcggttatatcgaattcgcgaatatcgtagtggatgtagttattcgtagtattttcgttgattgttttagaattagattatagggttaggttagacggcgttaggttagtagaatcgtcgaggaatttcggtaatagcggatcgaacgtttcgatagtattttgagacgttttacggttggcgattttcgtcggattagtttgtagtttagcgatgaattttttcgttttagcgtcgaagttagacggtatttcgttttttatacggcgggtaaatttagcggttttttgcggataagttttcgcgtaagtagcgaatttttcgttttatgcggattttttcgtttggtttgtttttttcgtattttattgagtatagattttagacgggatttcgaacggcgtatatttttagtttagttgttcgcgggttagggtaattttagcgtcgtttagaggtattcgtgggagttttgggtacg

SEQ ID NO: 11268 - DNA, 791 bp, Artificial Sequence
  chemically treated genomic DNA (Homo sapiens) CpG-island No: 11268
cgtacccaaaactcccacgaatacctctaaacgacgctaaaattaccctaacccgcgaacaactaaactaaaaatatacgccgttcgaaatcccgtctaaaatctatactcaataaaatacgaaaaaaacaaaccaaacgaaaaaatccgcataaaacgaaaaattcgctacttacgcgaaaacttatccgcaaaaaaccgctaaatttacccgccgtataaaaaacgaaataccgtctaacttcgacgctaaaacgaaaaaattcatcgctaaactacaaactaatccgacgaaaatcgccaaccgtaaaacgtctcaaaatactatcgaaacgttcgatccgctattaccgaaattcctcgacgattctactaacctaacgccgtctaacctaaccctataatctaattctaaaacaatcaacgaaaatactacgaataactacatccactacgatattcgcgaattcgatataaccgcgattactaacgatatctccctacacgataacttcctaccgtacacctccaccttcctaatattcgtaaaatacgcacgtaacgccgtacgtataacgcgctaataaacaccgcaaaaataatttaaacaccattcttaatctaaaaaaacgacgactacaaccgttaacaatatttttacgtaaccgatattaataaacgtaacaataaacgcgaccgaatcgataaaaaaaacgcgttacttctcaactaacgaaataaaaaaaattacgattataaaccgacgaattctacgaataaaatccaaaaaa

SEQ ID NO: 11269 - DNA, 700 bp, Artificial Sequence
  chemically treated genomic DNA (Homo sapiens) CpG-island No: 11269
cgcgttattattagcgaggtgagaatcgcgtcgatgatcgttatgataatggttatcgtatcggggataatgaagtgttggttaatcgtcgtcgggttaaattagtagcgggtttgtatattaataagcggtttaaaagtttgttcgttgtttttcgttcgttgtatttgttagatttgttagattttttcgatatatttttgtataaagttagcggtattcggtttattgtcgtcggtgattatttgaatcggtgcggtggcgttggcgcgttttatttgtttcgtaaaatttatcggaataattattagatcgcgaatttttttcgtttgtattttggcgattagtttttgacggttatcgttgatggtggcgtcgatgtagggcgaatcggttatggtgtgggtgaaatttagcgtcgtttcgttacgttgttttagtaaaatttcgattcgtagtttgttggagtcgaggttaatgtcgtaattaaaaataaatagtagtagtagcgggattattatcgtaattagttagttattcggatcgcgaacgatttgtcgcgtttttttaacgtatagcgttcgtacgcgacggtaggataggatcgggttatttattgttatgttttttattttagtcgtggattaattgaataaaggttttttttatggtgggatcggggttgtttatcgttagtcga

SEQ ID NO: 11270 - DNA, 700 bp, Artificial Sequence
  chemically treated genomic DNA (Homo sapiens) CpG-island No: 11270
tcgactaacgataaacaaccccgatcccaccataaaaaaaacctttattcaattaatccacgactaaaataaaaaacataacaataaataacccgatcctatcctaccgtcgcgtacgaacgctatacgttaaaaaaacgcgacaaatcgttcgcgatccgaataactaactaattacgataataatcccgctactactactatttatttttaattacgacattaacctcgactccaacaaactacgaatcgaaattttactaaaacaacgtaacgaaacgacgctaaatttcacccacaccataaccgattcgccctacatcgacgccaccatcaacgataaccgtcaaaaactaatcgccaaaatacaaacgaaaaaaattcgcgatctaataattattccgataaattttacgaaacaaataaaacgcgccaacgccaccgcaccgattcaaataatcaccgacgacaataaaccgaataccgctaactttatacaaaaatatatcgaaaaaatctaacaaatctaacaaatacaacgaacgaaaaacaacgaacaaacttttaaaccgcttattaatatacaaacccgctactaatttaacccgacgacgattaaccaacacttcattatccccgatacgataaccattatcataacgatcatcgacgcgattctcacctcgctaataataacgcg

SEQ ID NO: 11271 - DNA, 700 bp, Artificial Sequence
  chemically treated genomic DNA (Homo sapiens) CpG-island No: 11271
tcggttaacgatgagtaatttcgattttattatggagaaagtttttatttagttgatttacgattgggataaggagtatagtaatgagtaattcgattttgttttgtcgtcgcgtacgggcgttgtgcgttaaagagacgcggtagatcgttcgcgattcgagtagttggttgattgcggtagtgatttcgttgttattgttgtttatttttggttacggtattaatttcgattttagtaagttgcgggtcgggattttattggaatagcgtagcgaagcggcgttggattttatttatattatgatcggttcgttttatatcgacgttattattagcgataatcgttaggaattgatcgttaaaatgtaggcggggaaaattcgcggtttggtggttatttcggtggattttgcggaatagatggagcgcgttaacgttatcgtatcgatttaggtgattatcgacggtagtgagtcgaatatcgttaattttgtataggggtatgtcgaagggatttggtagatttggtaaatgtagcgagcggaggataacgggtagatttttgaatcgtttattgatgtataaattcgttattggtttaattcggcggcgattagttagtattttattattttcggtgcggtgattattattatgacggttatcggcgcgatttttatttcgttggtggtggcgcg

SEQ ID NO: 11272 - DNA, 700 bp, Artificial Sequence
  chemically treated genomic DNA (Homo sapiens) CpG-island No: 11272
cgcgccaccaccaacgaaataaaaatcgcgccgataaccgtcataataataatcaccgcaccgaaaataataaaatactaactaatcgccgccgaattaaaccaataacgaatttatacatcaataaacgattcaaaaatctacccgttatcctccgctcgctacatttaccaaatctaccaaatcccttcgacatacccctatacaaaattaacgatattcgactcactaccgtcgataatcacctaaatcgatacgataacgttaacgcgctccatctattccgcaaaatccaccgaaataaccaccaaaccgcgaattttccccgcctacattttaacgatcaattcctaacgattatcgctaataataacgtcgatataaaacgaaccgatcataatataaataaaatccaacgccgcttcgctacgctattccaataaaatcccgacccgcaacttactaaaatcgaaattaataccgtaaccaaaaataaacaacaataacaacgaaatcactaccgcaatcaaccaactactcgaatcgcgaacgatctaccgcgtctctttaacgcacaacgcccgtacgcgacgacaaaacaaaatcgaattactcattactatactccttatcccaatcgtaaatcaactaaataaaaactttctccataataaaatcgaaattactcatcgttaaccga

SEQ ID NO: 11273 - DNA, 972 bp, Artificial Sequence
  chemically treated genomic DNA (Homo sapiens) CpG-island No: 11273
  misc_feature (930)..(930): n is either a, c, g or t
  misc_feature (932)..(932): n is either a, c, g or t
tttttacgtagtcggtaattagttgcgtattatttattagatacgtattagatatgtcgttttgtattcggttagacggtaagcgatatttaggtttgattttatatattcgcgcggttttgtaagtttttatattgcggtaagtcgttcgatcgttatcgttagtgtaatttaacggatgtttttaattagatcgttataagttttatatgttgtaggttttcgggaagattacgttgttgaagtcgattttcgcgcgtttgacgtcgtagtagggggaaatttattacgagaatcgttcgttgtatgtaatgagcgaggtcgatcgtcgtcgtttgttgcgtatcgaatggggcgtggtgtattagtatttattcgacggtttgcgtcgttagtgtcggtaggcggtaatatcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaatttcgcggtggtgattgttatttatgatttaggcgtcgtcgtttgttgggatatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcgcgtaaacgtttattcgggttataaatgcgtttttcgtagtcggataagacgcgtcggtnanttcgataatcggaatacgaggcgaaaatattaattataaa

SEQ ID NO: 11274 - DNA, 972 bp, Artificial Sequence
  chemically treated genomic DNA (Homo sapiens) CpG-island No: 11274
  misc_feature (41)..(41): n is either a, c, g or t
  misc_feature (43)..(43): n is either a, c, g or t
tttataattaatattttcgcctcgtattccgattatcgaantnaccgacgcgtcttatccgactacgaaaaacgcatttataacccgaataaacgtttacgcgcatccgacaccgactcaattctacaaaaccgataacaccaacaactatatatacgaataatacgaatcgtcgaacacgcgatcgattaacccactctccaccacttacccctacttcatcaccaacaaacgatatcccaacaaacgacgacgcctaaatcataaataacaatcaccaccgcgaaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgatattaccgcctaccgacactaacgacgcaaaccgtcgaataaatactaatacaccacgccccattcgatacgcaacaaacgacgacgatcgacctcgctcattacatacaacgaacgattctcgtaataaatttccccctactacgacgtcaaacgcgcgaaaatcgacttcaacaacgtaatcttcccgaaaacctacaacatataaaacttataacgatctaattaaaaacatccgttaaattacactaacgataacgatcgaacgacttaccgcaatataaaaacttacaaaaccgcgcgaatatataaaatcaaacctaaatatcgcttaccgtctaaccgaatacaaaacgacatatctaatacgtatctaataaataatacgcaactaattaccgactacgtaaaaa

SEQ ID NO: 11275 - DNA, 972 bp, Artificial Sequence
  chemically treated genomic DNA (Homo sapiens) CpG-island No: 11275
  misc_feature (41)..(41): n is either a, c, g or t
  misc_feature (43)..(43): n is either a, c, g or t
tttgtagttaatattttcgtttcgtgtttcggttgtcggantngtcgacgcgttttattcgattacggggagcgtatttgtagttcggataagcgtttacgcgtattcggtatcggtttaattttgtaaaatcgatgatattagtagttgtgtatacggatgatgcgggtcgtcgagtacgcggtcggttaatttattttttattatttgtttttgttttattattagtaaacggtgttttagtaggcggcgacgtttaaattatgggtgataattattatcgcgaggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgatattgtcgtttgtcgatattggcggcgtaggtcgtcgagtggatgttgatgtattacgttttattcggtacgtagtaggcgacggcggtcggtttcgtttattgtatatagcgaacggttttcgtagtgaatttttttttgttgcggcgttaggcgcgcggagatcgattttagtagcgtggttttttcgaggatttgtagtatatgaagtttgtggcggtttgattgaaaatattcgttaggttgtattggcgatagcgatcgggcggtttgtcgtagtgtgaaagtttgtagagtcgcgcggatatgtgagattaaatttgaatgtcgtttgtcgtttgatcgggtgtagaacggtatgtttggtgcgtgtttgatgggtaatgcgtagttggttgtcgattgcgtgaaag

SEQ ID NO: 11276 - DNA, 972 bp, Artificial Sequence
  chemically treated genomic DNA (Homo sapiens) CpG-island No: 11276
  misc_feature (930)..(930): n is either a, c, g or t
  misc_feature (932)..(932): n is either a, c, g or t
ctttcacgcaatcgacaaccaactacgcattacccatcaaacacgcaccaaacataccgttctacacccgatcaaacgacaaacgacattcaaatttaatctcacatatccgcgcgactctacaaactttcacactacgacaaaccgcccgatcgctatcgccaatacaacctaacgaatattttcaatcaaaccgccacaaacttcatatactacaaatcctcgaaaaaaccacgctactaaaatcgatctccgcgcgcctaacgccgcaacaaaaaaaaattcactacgaaaaccgttcgctatatacaataaacgaaaccgaccgccgtcgcctactacgtaccgaataaaacgtaatacatcaacatccactcgacgacctacgccgccaatatcgacaaacgacaatatcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacctcgcgataataattatcacccataatttaaacgtcgccgcctactaaaacaccgtttactaataataaaacaaaaacaaataataaaaaataaattaaccgaccgcgtactcgacgacccgcatcatccgtatacacaactactaatatcatcgattttacaaaattaaaccgataccgaatacgcgtaaacgcttatccgaactacaaatacgctccccgtaatcgaataaaacgcgtcgacnantccgacaaccgaaacacgaaacgaaaatattaactacaaa

SEQ ID NO: 11277 - DNA, 596 bp, Artificial Sequence
  chemically treated genomic DNA (Homo sapiens) CpG-island No: 11277
acgcgtcgtcggtttatatggtaaacgttagtttagtaggtttcgtatcgattatcgttagattttttttttgtacggcgggaaggattggtattttggtttcgtggtaggcgcgaggatttattaggtacgaggtgattttgttaacgaagatttgatcgagataggtttgattgtagttaatataagtgttgattttatcggttcgtttcgattgcgtttttgatagtagtttcgtattagtaagaaacggtcgcgttatcgatattatatcggtatcgtcgtcgagagaatatcgtcggtaatttgcggatcgttaattcggttggtggttattagcggtagtgtacgtggttttttagtttgcgcgtgattagttaaatgcgtcgcggtacgggtttggtaatggtcggaatacgtgttttatgttagtaatgttcgtgttgataatggtcgcgttttcgttttaatggtttgcgtattttatcgttttcgtaaagtttttcgttttcgattaggttagtattatagtcggtaataataagaagttttgttaatttttttatcgacgtattattttacgtaatcgtatcgtt

SEQ ID NO: 11278 - DNA, 596 bp, Artificial Sequence
  chemically treated genomic DNA (Homo sapiens) CpG-island No: 11278
aacgatacgattacgtaaaataatacgtcgataaaaaaattaacaaaacttcttattattaccgactataatactaacctaatcgaaaacgaaaaactttacgaaaacgataaaatacgcaaaccattaaaacgaaaacgcgaccattatcaacacgaacattactaacataaaacacgtattccgaccattaccaaacccgtaccgcgacgcatttaactaatcacgcgcaaactaaaaaaccacgtacactaccgctaataaccaccaaccgaattaacgatccgcaaattaccgacgatattctctcgacgacgataccgatataatatcgataacgcgaccgtttcttactaatacgaaactactatcaaaaacgcaatcgaaacgaaccgataaaatcaacacttatattaactacaatcaaacctatctcgatcaaatcttcgttaacaaaatcacctcgtacctaataaatcctcgcgcctaccacgaaaccaaaataccaatccttcccgccgtacaaaaaaaaaatctaacgataatcgatacgaaacctactaaactaacgtttaccatataaaccgacgacgcgt

SEQ ID NO: 11279 - DNA, 596 bp, Artificial Sequence
  chemically treated genomic DNA (Homo sapiens) CpG-island No: 11279
aacgatgcgattgcgtagaatagtgcgtcggtgggaaggttggtaagattttttattattatcgattgtgatgttgatttggtcgaagacgggggattttgcgaaaacggtagagtgcgtaggttattgaagcgggggcgcgattattattaatacgggtattgttggtatgaagtacgtatttcgattattgttaagttcgtgtcgcggcgtatttagttggttacgcgtaaattgaaaggttacgtgtattgtcgttggtaattattaatcggattaacgattcgtaggttgtcgacgatattttttcgacggcgatgtcgatatggtatcgatggcgcgatcgttttttgttgatgcggagttgttgttaaaagcgtaatcgggacgagtcgatgagattaatatttgtattggttgtaattaggtttgtttcgattaaattttcgttggtaaagttatttcgtgtttggtgaattttcgcgtttgttacgaaattaaaatgttaatttttttcgtcgtgtagaaaaaaaatttggcggtggtcggtgcgggatttgttgggttggcgtttgttatgtaagtcggcggcgcgt

SEQ ID NO: 11280 - DNA, 596 bp, Artificial Sequence
  chemically treated genomic DNA (Homo sapiens) CpG-island No: 11280
acgcgccgccgacttacataacaaacgccaacccaacaaatcccgcaccgaccaccgccaaattttttttctacacgacgaaaaaaattaacattttaatttcgtaacaaacgcgaaaattcaccaaacacgaaataactttaccaacgaaaatttaatcgaaacaaacctaattacaaccaatacaaatattaatctcatcgactcgtcccgattacgcttttaacaacaactccgcatcaacaaaaaacgatcgcgccatcgataccatatcgacatcgccgtcgaaaaaatatcgtcgacaacctacgaatcgttaatccgattaataattaccaacgacaatacacgtaacctttcaatttacgcgtaaccaactaaatacgccgcgacacgaacttaacaataatcgaaatacgtacttcataccaacaatacccgtattaataataatcgcgcccccgcttcaataacctacgcactctaccgttttcgcaaaatcccccgtcttcgaccaaatcaacatcacaatcgataataataaaaaatcttaccaaccttcccaccgacgcactattctacgcaatcgcatcgtt

SEQ ID NO: 11281 - DNA, 672 bp, Artificial Sequence
  chemically treated genomic DNA (Homo sapiens) CpG-island No: 11281
tgtcgatgaaatttggaacgaatgtaacgaattgttggcgtaggataattttttcgcgcgcggtattatgtagtagatgaacgtgaaaatggtcggtattatcgatgattcgatcgattttttggagtattacgtagagatcgttaaagacggtttttttattattaaagtgttgtcgagttggcgttcggataaagtttttaatatcgaataggcgatttttaacgattatatggcgaagttgggcgaagttttcgatatcgatattcgtcgttttgttgatttgtaaattgttttgattaaacgtttggattatttcgtcgtttacggttgtaaagtgtttgattacgcgttggatgtggtgatgtttgttgaagcgaacgaagcggaattggatagtattttggcgcgtcgtttggttggcgaaattttgagcgagtacgaagtggcgtagtttaaaattgcggtattggtgttttttggtgtcgaatatgtacgtcgcggttgggtatagtagtattatattggcgcgttgcgtaataataatttgcgttagtttaaattgttggggtcggatgtaggttttgattttattaacgatcgttcgatggcggaagagttgtttaagttgttgagtaagtagaatgaagaaaatttgttgtcgaaaattat

SEQ ID NO: 11282 - DNA, 672 bp, Artificial Sequence
  chemically treated genomic DNA (Homo sapiens) CpG-island No: 11282
ataattttcgacaacaaattttcttcattctacttactcaacaacttaaacaactcttccgccatcgaacgatcgttaataaaatcaaaacctacatccgaccccaacaatttaaactaacgcaaattattattacgcaacgcgccaatataatactactatacccaaccgcgacgtacatattcgacaccaaaaaacaccaataccgcaattttaaactacgccacttcgtactcgctcaaaatttcgccaaccaaacgacgcgccaaaatactatccaattccgcttcgttcgcttcaacaaacatcaccacatccaacgcgtaatcaaacactttacaaccgtaaacgacgaaataatccaaacgtttaatcaaaacaatttacaaatcaacaaaacgacgaatatcgatatcgaaaacttcgcccaacttcgccatataatcgttaaaaatcgcctattcgatattaaaaactttatccgaacgccaactcgacaacactttaataataaaaaaaccgtctttaacgatctctacgtaatactccaaaaaatcgatcgaatcatcgataataccgaccattttcacgttcatctactacataataccgcgcgcgaaaaaattatcctacgccaacaattcgttacattcgttccaaatttcatcgaca

SEQ ID NO: 11283 - DNA, 672 bp, Artificial Sequence
  chemically treated genomic DNA (Homo sapiens) CpG-island No: 11283
atggttttcggtagtaggttttttttattttgtttgtttagtaatttagatagttttttcgttatcggacggtcgttgatggagttaaagtttatattcggttttagtagtttgaattgacgtaggttgttattacgtagcgcgttaatgtggtattgttgtatttagtcgcgacgtgtatattcggtattaaggaatattagtatcgtagttttgaattgcgttatttcgtgttcgtttagggtttcgttagttagacggcgcgttagaatgttgtttagtttcgtttcgttcgttttagtaaatattattatatttagcgcgtggttagatattttatagtcgtgagcggcgaagtgatttagacgtttggttagggtagtttgtaggttagtaaagcggcgaatgtcggtatcggaaatttcgtttagtttcgttatgtagtcgttaaaggtcgtttgttcgatgttgaaggttttgttcggacgttagttcggtagtattttgatggtgaaagagtcgtttttggcgatttttgcgtgatgttttagagaatcgatcgggttatcggtggtgtcgattatttttacgtttatttgttgtatgatgtcgcgcgcggagaagttattttgcgttagtagttcgttatattcgttttagattttatcggta

SEQ ID NO: 11284 - DNA, 672 bp, Artificial Sequence
  chemically treated genomic DNA (Homo sapiens) CpG-island No: 11284
taccgataaaatctaaaacgaatataacgaactactaacgcaaaataacttctccgcgcgcgacatcatacaacaaataaacgtaaaaataatcgacaccaccgataacccgatcgattctctaaaacatcacgcaaaaatcgccaaaaacgactctttcaccatcaaaatactaccgaactaacgtccgaacaaaaccttcaacatcgaacaaacgacctttaacgactacataacgaaactaaacgaaatttccgataccgacattcgccgctttactaacctacaaactaccctaaccaaacgtctaaatcacttcgccgctcacgactataaaatatctaaccacgcgctaaatataataatatttactaaaacgaacgaaacgaaactaaacaacattctaacgcgccgtctaactaacgaaaccctaaacgaacacgaaataacgcaattcaaaactacgatactaatattccttaataccgaatatacacgtcgcgactaaatacaacaataccacattaacgcgctacgtaataacaacctacgtcaattcaaactactaaaaccgaatataaactttaactccatcaacgaccgtccgataacgaaaaaactatctaaattactaaacaaacaaaataaaaaaaacctactaccgaaaaccat

SEQ ID NO: 11285 - DNA, 521 bp, Artificial Sequence
  chemically treated genomic DNA (Homo sapiens) CpG-island No: 11285
ggtagtgataattcgaatattagtgagtgcgtttatttcggttttttcgtattaggagtagttttttttagttttttagcgtttacggtagatagggatcgaattgttttacgacgttttaaatttagttcgcgtattattttaaatggcgaatagtatagtttttgggatttattttagttttaggatgtgatgagtcgatatcgaggtgttaaatatcgtcgtcgatatgaatttttgggcggtattagtttgttattttcggagtattttttattcgttgagcgatggtttttttatttagaattatcggattattatgatttgttttcgtatttgttcgcgtcgttacgttcgtagttaagttggtttatgtattgtattaattttttgatgttcgagtaggattatgtaagtttcgtgttttttcgttattttttaggaggagaacgttttagttaaattatttatagatattgttcgtaagtcggattacggttaacgttagaatattaaatagt

SEQ ID NO: 11286 - DNA, 521 bp, Artificial Sequence
  chemically treated genomic DNA (Homo sapiens) CpG-island No: 11286
actatttaatattctaacgttaaccgtaatccgacttacgaacaatatctataaataatttaactaaaacgttctcctcctaaaaaataacgaaaaaacacgaaacttacataatcctactcgaacatcaaaaaattaatacaatacataaaccaacttaactacgaacgtaacgacgcgaacaaatacgaaaacaaatcataataatccgataattctaaataaaaaaaccatcgctcaacgaataaaaaatactccgaaaataacaaactaataccgcccaaaaattcatatcgacgacgatatttaacacctcgatatcgactcatcacatcctaaaactaaaataaatcccaaaaactatactattcgccatttaaaataatacgcgaactaaatttaaaacgtcgtaaaacaattcgatccctatctaccgtaaacgctaaaaaactaaaaaaaactactcctaatacgaaaaaaccgaaataaacgcactcactaatattcgaattatcactacc

SEQ ID NO: 11287 - DNA, 521 bp, Artificial Sequence
  chemically treated genomic DNA (Homo sapiens) CpG-island No: 11287
attgtttgatgttttaacgttgatcgtaattcggtttgcggatagtgtttgtgggtagtttgattggggcgttttttttttaaagagtaacggaggagtacgaagtttgtataattttgttcggatattaggaggttagtgtaatgtataagttagtttgattgcgagcgtgacggcgcgagtaggtgcgaaagtaggttatagtgattcggtggttttgaatggaagggttatcgtttaacggataaaaggtatttcggggataataggttgatatcgtttaagagtttatatcgacggcggtgtttggtatttcgatgtcggtttattatattttggggttgaagtaggttttaagggttatgttgttcgttatttaaagtggtacgcgagttgggtttagaacgtcgtgagatagttcggtttttatttgtcgtgggcgttggagaattgaggggggttgtttttagtacgagaggatcggagtggacgtatttattggtgttcgggttgttattgtt

SEQ ID NO: 11288 - DNA, 521 bp, Artificial Sequence
  chemically treated genomic DNA (Homo sapiens) CpG-island No: 11288
aacaataacaacccgaacaccaataaatacgtccactccgatcctctcgtactaaaaacaacccccctcaattctccaacgcccacgacaaataaaaaccgaactatctcacgacgttctaaacccaactcgcgtaccactttaaataacgaacaacataacccttaaaacctacttcaaccccaaaatataataaaccgacatcgaaataccaaacaccgccgtcgatataaactcttaaacgatatcaacctattatccccgaaataccttttatccgttaaacgataacccttccattcaaaaccaccgaatcactataacctactttcgcacctactcgcgccgtcacgctcgcaatcaaactaacttatacattacactaacctcctaatatccgaacaaaattatacaaacttcgtactcctccgttactctttaaaaaaaaaacgccccaatcaaactacccacaaacactatccgcaaaccgaattacgatcaacgttaaaacatcaaacaat

SEQ ID NO: 11289 - DNA, 805 bp, Artificial Sequence
  chemically treated genomic DNA (Homo sapiens) CpG-island No: 11289
  misc_feature (5)..(5): n is either a, c, g or t
  misc_feature (164)..(164): n is either a, c, g or t
ttgtngcgaggtgtgtgtgggatgttgggggtggggtgtgggggtggttttggggttttgtgggtgcggtttggttgtgttgtgggtgggggggggggggttgggtggggtgggtgggtgggggggggtgggggcgggggggggcgattgggggggtggggggntggtgtttgtggggtgggggtcgcgggtttcgttttcgggttcggcgtggtgcgtttgtgtttcgggttggggggttttcgggtcgtcgcggtgcggggttcggtcgggcgcgcgcggtcgcgggtggtgcgtgcgggtttcgacggggtgttttggtgcgttggcgtcgtgggcgtcgcgtgtcgcgcggtttggcgttgggggtgcgcggtgggcgtcgtcgcgtggggcggcgggcgcggggtgtttttacggtgcggggcggggggattagcgtggatgtcggcgcgtggtaagtagaacgggtgcggtatagaagtagatgcgggaggagttcgcgggttatttatcgcggtgtaaggttacgtcgtaaggagggttgagtcgggggcggagacgggggcgcgttgcgaaaggggtcgagggatgagagaaggaatcggggggagttacggagttttatttgtaggaggggcgagggatcgataagtcgggttaggggggttaggggggcgtagtaggtgatggcgggacgcggacggaaagagagagggagggaggaggaagtcgagtagggatttagtttaaaggggtaaagtagtggaaaacgggggcgcgttgggttcgggagggattagaa

SEQ ID NO: 11290 - DNA, 805 bp, Artificial Sequence
  chemically treated genomic DNA (Homo sapiens) CpG-island No: 11290
  misc_feature (642)..(642): n is either a, c, g or t
  misc_feature (801)..(801): n is either a, c, g or t
ttctaatccctcccgaacccaacgcgcccccgttttccactactttacccctttaaactaaatccctactcgacttcctcctccctccctctctctttccgtccgcgtcccgccatcacctactacgcccccctaacccccctaacccgacttatcgatccctcgcccctcctacaaataaaactccgtaactccccccgattccttctctcatccctcgacccctttcgcaacgcgcccccgtctccgcccccgactcaaccctccttacgacgtaaccttacaccgcgataaataacccgcgaactcctcccgcatctacttctataccgcacccgttctacttaccacgcgccgacatccacgctaatccccccgccccgcaccgtaaaaacaccccgcgcccgccgccccacgcgacgacgcccaccgcgcacccccaacgccaaaccgcgcgacacgcgacgcccacgacgccaacgcaccaaaacaccccgtcgaaacccgcacgcaccacccgcgaccgcgcgcgcccgaccgaaccccgcaccgcgacgacccgaaaaccccccaacccgaaacacaaacgcaccacgccgaacccgaaaacgaaacccgcgacccccaccccacaaacaccanccccccacccccccaatcgcccccccccgcccccacccccccccacccacccaccccacccaacccccccccccccacccacaacacaaccaaaccgcacccacaaaaccccaaaaccacccccacaccccacccccaacatcccacacacacctcgcnacaa

SEQ ID NO: 11291 - DNA, 805 bp, Artificial Sequence
  chemically treated genomic DNA (Homo sapiens) CpG-island No: 11291
  misc_feature (642)..(642): n is either a, c, g or t
  misc_feature (801)..(801): n is either a, c, g or t
ttttggtttttttcgggtttaacgcgttttcgttttttattattttgtttttttgggttaggtttttgttcggttttttttttttttttttttttttttcgttcgcgtttcgttattatttgttgcgtttttttggtttttttagttcgatttatcggtttttcgttttttttgtaggtgggatttcgtggtttttttcgatttttttttttatttttcggtttttttcgtagcgcgttttcgttttcgttttcggtttaattttttttgcggcgtgattttatatcgcggtgggtgattcgcgggtttttttcgtatttatttttgtgtcgtattcgttttgtttgttacgcgtcggtatttacgttggttttttcgtttcgtatcgtgggggtatttcgcgttcgtcgttttacgcggcggcgtttatcgcgtatttttagcgttaaatcgcgcggtacgcgacgtttacgacgttagcgtattagggtatttcgtcggagttcgtacgtattattcgcgatcgcgcgcgttcgatcgggtttcgtatcgcggcgattcgggggttttttagttcggagtataagcgtattacgtcgggttcggaggcgggattcgcggtttttattttataaatattanttttttatttttttagtcgttttttttcgtttttatttttttttatttatttattttatttaatttttttttttttatttataatataattaaatcgtatttataaaattttaaaattatttttatattttatttttaatattttatatatatttcgtnataa

SEQ ID NO: 11292 - DNA, 805 bp, Artificial Sequence
  chemically treated genomic DNA (Homo sapiens) CpG-island No: 11292
  misc_feature (5)..(5): n is either a, c, g or t
  misc_feature (164)..(164): n is either a, c, g or t
ttatnacgaaatatatataaaatattaaaaataaaatataaaaataattttaaaattttataaatacgatttaattatattataaataaaaaaaaaaaaattaaataaaataaataaataaaaaaaaataaaaacgaaaaaaaacgactaaaaaaataaaaaantaatatttataaaataaaaaccgcgaatcccgcctccgaacccgacgtaatacgcttatactccgaactaaaaaacccccgaatcgccgcgatacgaaacccgatcgaacgcgcgcgatcgcgaataatacgtacgaactccgacgaaataccctaatacgctaacgtcgtaaacgtcgcgtaccgcgcgatttaacgctaaaaatacgcgataaacgccgccgcgtaaaacgacgaacgcgaaatacccccacgatacgaaacgaaaaaaccaacgtaaataccgacgcgtaacaaacaaaacgaatacgacacaaaaataaatacgaaaaaaacccgcgaatcacccaccgcgatataaaatcacgccgcaaaaaaaattaaaccgaaaacgaaaacgaaaacgcgctacgaaaaaaaccgaaaaataaaaaaaaaaatcgaaaaaaaccacgaaatcccacctacaaaaaaaacgaaaaaccgataaatcgaactaaaaaaaccaaaaaaacgcaacaaataataacgaaacgcgaacgaaaaaaaaaaaaaaaaaaaaaaaaaaccgaacaaaaacctaacccaaaaaaacaaaataataaaaaacgaaaacgcgttaaacccgaaaaaaaccaaaa

SEQ ID NO: 11293 - DNA, 1165 bp, Artificial Sequence
  chemically treated genomic DNA (Homo sapiens) CpG-island No: 11293
tagcgtcgtacgttttttcgcggttacgcgtgttcgtcgcggtttcgttataatacgcgttgtttagttagttatcgatatcgtagcgcggcgttttttagacgtttcgtttgtgcgttatagttatttttcggcgtttttattatgttttgtattgtattatatttgttaacgacggtagagcgtttcgttaatattttgttatatttattatcgtttacgattttattgattcggtcggtgttattcgttacgttggcgtttttatatcgtcgtattgttttttttattagttttattacgttatgtcggtatattattattgcgcgcgtattgtttatatttttagtcggttgtttcgtcgtatatttatattacgagtttgacgatcgagtaacgtcgtttttttgttttgtagtgttttataattttcgtgaattgtattatcgattattatattttagttcgcgattcgcgattttcggtgttaaacggtagcgcgatattttttttatggtcgatagcgattaagttatcgttatcgttaagcgtagggagtttttttattattattcgttcgtatgttttcgacgagatttaattcgtcgtaatttattaacgcggcgatgttatatgtcgttagtacgcggatgaagatttcgttcgtgtcggaataagaaatcgttatattggcgttattggcgtagtattcggtatttattaagggattatcgttaattcgtcggggaaatttatgggttatttcgtttgtggacgtggttgtcgttaaattgtcgtttaaatttaacgttacggtttttacggtgtttattttttgttttttatttagtggcgtatcgttatggtcgaggacggttgttttttttttgcgcgttgttagtagttgtttataacgtaaagacgtggagaaaattttcggcgagacgcgttttatgttacgagtaaacgtaaaattttttgttttttcgttaattattattatatgcgggttttgttttattattagtcgggcggtaagaatcggatacgtagatgaataaagttcgtatcgtaacggtttttagggtgttattattattatataggcgtttagtttaggggttttattaatcgtaaagatagtttaatttcggcgttaaaaatg

SEQ ID NO: 11294 - DNA, 1165 bp, Artificial Sequence
  chemically treated genomic DNA (Homo sapiens) CpG-island No: 11294
catttttaacgccgaaattaaactatctttacgattaataaaacccctaaactaaacgcctatataataataataacaccctaaaaaccgttacgatacgaactttattcatctacgtatccgattcttaccgcccgactaataataaaacaaaacccgcatataataataattaacgaaaaaacaaaaaattttacgtttactcgtaacataaaacgcgtctcgccgaaaattttctccacgtctttacgttataaacaactactaacaacgcgcaaaaaaaaaacaaccgtcctcgaccataacgatacgccactaaataaaaaacaaaaaataaacaccgtaaaaaccgtaacgttaaatttaaacgacaatttaacgacaaccacgtccacaaacgaaataacccataaatttccccgacgaattaacgataatcccttaataaataccgaatactacgccaataacgccaatataacgatttcttattccgacacgaacgaaatcttcatccgcgtactaacgacatataacatcgccgcgttaataaattacgacgaattaaatctcgtcgaaaacatacgaacgaataataataaaaaaactccctacgcttaacgataacgataacttaatcgctatcgaccataaaaaaaatatcgcgctaccgtttaacaccgaaaatcgcgaatcgcgaactaaaatataataatcgataatacaattcacgaaaattataaaacactacaaaacaaaaaaacgacgttactcgatcgtcaaactcgtaatataaatatacgacgaaacaaccgactaaaaatataaacaatacgcgcgcaataataatataccgacataacgtaataaaactaataaaaaaaacaatacgacgatataaaaacgccaacgtaacgaataacaccgaccgaatcaataaaatcgtaaacgataataaatataacaaaatattaacgaaacgctctaccgtcgttaacaaatataatacaatacaaaacataataaaaacgccgaaaaataactataacgcacaaacgaaacgtctaaaaaacgccgcgctacgatatcgataactaactaaacaacgcgtattataacgaaaccgcgacgaacacgcgtaaccgcgaaaaaacgtacgacgcta

SEQ ID NO: 11295 - DNA, 1165 bp, Artificial Sequence
  chemically treated genomic DNA (Homo sapiens) CpG-island No: 11295
tatttttaacgtcggaattgggttgtttttacggttgatgaaatttttgaattggacgtttgtgtgatgatggtaatattttgaaagtcgttgcggtgcgggttttatttatttgcgtattcggtttttgtcgttcggttggtgatggagtaaagttcgtatgtgatgatgattggcgaaggggtagaaaattttgcgtttgttcgtggtatggagcgcgtttcgtcggagattttttttacgtttttgcgttatgaataattattggtagcgcgtaaggaaggggtaatcgttttcgattatagcggtgcgttattggatgaaaaatagaaaatgggtatcgtggaggtcgtggcgttggatttagacggtaatttggcggtagttacgtttataggcggaatgatttataaattttttcgacgagttggcgatagttttttagtgggtgtcggatgttacgttaataacgttagtgtggcggttttttgtttcggtacgggcgaagtttttattcgcgtgttggcggtatatgatatcgtcgcgttaatggattacggcggattaagtttcgtcggaagtatgcgagcgggtagtaatggaaaaattttttgcgtttggcggtagcggtggtttaatcgttatcgattatgaagggaatgtcgcgttatcgtttaatatcgaagatcgcgaatcgcgagttagggtgtagtagtcggtagtgtagtttacgagggttgtggagtattgtaaggtagggaggcgacgttattcggtcgttaggttcgtggtgtggatgtgcggcggagtaatcgattgagggtgtgggtagtgcgcgcgtagtagtggtgtatcgatatggcgtgatgaggttggtaaagggggtagtgcgacggtgtaggagcgttaacgtaacgaatagtatcggtcggattagtgaggtcgtgggcgatggtaggtgtggtagggtattagcgaagcgttttgtcgtcgttgatagatgtagtgtagtatagggtatggtgagagcgtcggagagtggttgtggcgtatagacggagcgtttgaggagcgtcgcgttgcggtgtcggtggttgattgagtagcgcgtgttgtagcggagtcgcggcggatacgcgtgatcgcgggagggcgtacggcgtta

SEQ ID NO: 11296 - DNA, 1165 bp, Artificial Sequence
  chemically treated genomic DNA (Homo sapiens) CpG-island No: 11296
taacgccgtacgccctcccgcgatcacgcgtatccgccgcgactccgctacaacacgcgctactcaatcaaccaccgacaccgcaacgcgacgctcctcaaacgctccgtctatacgccacaaccactctccgacgctctcaccataccctatactacactacatctatcaacgacgacaaaacgcttcgctaataccctaccacacctaccatcgcccacgacctcactaatccgaccgatactattcgttacgttaacgctcctacaccgtcgcactaccccctttaccaacctcatcacgccatatcgatacaccactactacgcgcgcactacccacaccctcaatcgattactccgccgcacatccacaccacgaacctaacgaccgaataacgtcgcctccctaccttacaatactccacaaccctcgtaaactacactaccgactactacaccctaactcgcgattcgcgatcttcgatattaaacgataacgcgacattcccttcataatcgataacgattaaaccaccgctaccgccaaacgcaaaaaatttttccattactacccgctcgcatacttccgacgaaacttaatccgccgtaatccattaacgcgacgatatcatataccgccaacacgcgaataaaaacttcgcccgtaccgaaacaaaaaaccgccacactaacgttattaacgtaacatccgacacccactaaaaaactatcgccaactcgtcgaaaaaatttataaatcattccgcctataaacgtaactaccgccaaattaccgtctaaatccaacgccacgacctccacgatacccattttctatttttcatccaataacgcaccgctataatcgaaaacgattaccccttccttacgcgctaccaataattattcataacgcaaaaacgtaaaaaaaatctccgacgaaacgcgctccataccacgaacaaacgcaaaattttctaccccttcgccaatcatcatcacatacgaactttactccatcaccaaccgaacgacaaaaaccgaatacgcaaataaataaaacccgcaccgcaacgactttcaaaatattaccatcatcacacaaacgtccaattcaaaaatttcatcaaccgtaaaaacaacccaattccgacgttaaaaata

SEQ ID NO: 11297 - DNA, 778 bp, Artificial Sequence
  chemically treated genomic DNA (Homo sapiens) CpG-island No: 11297
acgggtcgtcgttgaagggcgggaaattatataaattaaggaggaggaatatacggttcgtcgttaaaaggtcggaaaatttcgatgttaagggttagggtttagcgtttcgtttttaaaaggtcgggaacgtttcgagttcgaggtttcgggtatttaatcgttcggtttataaagggttcgggtataatttcgtggttttacggtacggcggggcgagtagtggttcgcggcgattgagtcgttcgtcgtaaggttcgtatgggcgtagtcggtttaggggtggtttattcgggttgagttcgtcggtttaaggtatttagggatagatatcgcgaggattatagtgcgtggcgtaggagtgtttcgcggggacgcgcgtgaggcgaagagacgtattcggaggtacgtggttcggtttttaaggggatagaggttgtcgtgtggtcgtcgttgtgtgcggagcgtttacgtacggagcgtacgttatcgcgaggaatgcgttggcgtgagtgttaggagtagcgttgcgcgacgatcgcgtttttaagttacgtcgtcgcggtgacgagtgcggagagtgacggagagtagatgacgcgtacgacgtgtgacgaatatagtttcggcgttattagtttcggagtcgggtgttgtaggagcggtcggcggtagagtcgttcgattaggtaggttattattcggtgtgagttcgtttgaggagtagcgagatggtggtgaagtagtgtgatatcggttagtgtgtttataagttacg

SEQ ID NO: 11298 - DNA, 778 bp, Artificial Sequence
  chemically treated genomic DNA (Homo sapiens) CpG-island No: 11298
cgtaacttataaacacactaaccgatatcacactacttcaccaccatctcgctactcctcaaacgaactcacaccgaataataacctacctaatcgaacgactctaccgccgaccgctcctacaacacccgactccgaaactaataacgccgaaactatattcgtcacacgtcgtacgcgtcatctactctccgtcactctccgcactcgtcaccgcgacgacgtaacttaaaaacgcgatcgtcgcgcaacgctactcctaacactcacgccaacgcattcctcgcgataacgtacgctccgtacgtaaacgctccgcacacaacgacgaccacacgacaacctctatccccttaaaaaccgaaccacgtacctccgaatacgtctcttcgcctcacgcgcgtccccgcgaaacactcctacgccacgcactataatcctcgcgatatctatccctaaataccttaaaccgacgaactcaacccgaataaaccacccctaaaccgactacgcccatacgaaccttacgacgaacgactcaatcgccgcgaaccactactcgccccgccgtaccgtaaaaccacgaaattatacccgaaccctttataaaccgaacgattaaatacccgaaacctcgaactcgaaacgttcccgaccttttaaaaacgaaacgctaaaccctaacccttaacatcgaaattttccgaccttttaacgacgaaccgtatattcctcctccttaatttatataatttcccgcccttcaacgacgacccgt

SEQ ID NO: 11299 - DNA, 778 bp, Artificial Sequence
  chemically treated genomic DNA (Homo sapiens) CpG-island No: 11299
cgtggtttatgaatatattagtcggtgttatattgttttattattatttcgttgttttttaagcgagtttatatcgggtggtggtttgtttggtcggacgattttgtcgtcgatcgtttttgtaatattcggtttcgaagttagtgacgtcggggttgtgttcgttatacgtcgtgcgcgttatttgtttttcgttatttttcgtattcgttatcgcggcggcgtgatttgggggcgcggtcgtcgcgtagcgttgtttttagtatttacgttaacgtatttttcgcgatgacgtgcgtttcgtacgtgggcgtttcgtatatagcggcgattatacgataatttttgtttttttgggggtcgaattacgtgttttcgggtgcgttttttcgttttacgcgcgttttcgcgagatatttttgcgttacgtattgtggttttcgcggtgtttgtttttgggtgttttgagtcgacgggtttagttcgggtgagttatttttgaatcggttgcgtttatgcgggttttacggcgggcggtttagtcgtcgcgggttattgttcgtttcgtcgtatcgtggggttacggggttgtgttcgggttttttgtgggtcgggcggttgggtattcgaaatttcgggttcgaggcgttttcggttttttgaaggcggggcgttgaattttgatttttggtatcggggtttttcggttttttaacggcgggtcgtgtgttttttttttttggtttgtgtggtttttcgttttttaacggcggttcgt

SEQ ID NO: 11300 - DNA, 778 bp, Artificial Sequence
  chemically treated genomic DNA (Homo sapiens) CpG-island No: 11300
acgaaccgccgttaaaaaacgaaaaaccacacaaaccaaaaaaaaaaaacacacgacccgccgttaaaaaaccgaaaaaccccgataccaaaaatcaaaattcaacgccccgccttcaaaaaaccgaaaacgcctcgaacccgaaatttcgaatacccaaccgcccgacccacaaaaaacccgaacacaaccccgtaaccccacgatacgacgaaacgaacaataacccgcgacgactaaaccgcccgccgtaaaacccgcataaacgcaaccgattcaaaaataactcacccgaactaaacccgtcgactcaaaacacccaaaaacaaacaccgcgaaaaccacaatacgtaacgcaaaaatatctcgcgaaaacgcgcgtaaaacgaaaaaacgcacccgaaaacacgtaattcgacccccaaaaaaacaaaaattatcgtataatcgccgctatatacgaaacgcccacgtacgaaacgcacgtcatcgcgaaaaatacgttaacgtaaatactaaaaacaacgctacgcgacgaccgcgcccccaaatcacgccgccgcgataacgaatacgaaaaataacgaaaaacaaataacgcgcacgacgtataacgaacacaaccccgacgtcactaacttcgaaaccgaatattacaaaaacgatcgacgacaaaatcgtccgaccaaacaaaccaccacccgatataaactcgcttaaaaaacaacgaaataataataaaacaatataacaccgactaatatattcataaaccacg

SEQ ID NO: 11301 - DNA, 520 bp, Artificial Sequence
  chemically treated genomic DNA (Homo sapiens) CpG-island No: 11301
atatgttcggagcgcggggtggtgataggtcgtgagcggggtacgacgagatacggcgtataatatacggcggtgtgttatggtggtttgcgtagatagtgtaggagagcgatattttgcgcgcgatagtggtgtggagagttatagtattagtgtttagattgtcgttggtcgtatcgaggtttagtcgtttcggacgtttgttgcgagtgttatatagatttatacgagtggtggtgcgacgtagaggacgacgtgtattggaagttatggcgtagtcgagtagtggtcgatacgcgtttgtagtgcggtggtgggtttgagacgcgatgcgtggatacgtgagacgcgtcgtcggtttttatgacgtatagaagcgtggagtgagcgaggagtgtagtgagcgcgaggatcgtcggacggtgcggcgtgttatacgttatacgtcgttgtgcgggatatagaacgttttttaaatttcgagaatgtttttaaattagtaagtttttattaaaatttt

SEQ ID NO: 11302 - DNA, 520 bp, Artificial Sequence
  chemically treated genomic DNA (Homo sapiens) CpG-island No: 11302
aaaattttaataaaaacttactaatttaaaaacattctcgaaatttaaaaaacgttctatatcccgcacaacgacgtataacgtataacacgccgcaccgtccgacgatcctcgcgctcactacactcctcgctcactccacgcttctatacgtcataaaaaccgacgacgcgtctcacgtatccacgcatcgcgtctcaaacccaccaccgcactacaaacgcgtatcgaccactactcgactacgccataacttccaatacacgtcgtcctctacgtcgcaccaccactcgtataaatctatataacactcgcaacaaacgtccgaaacgactaaacctcgatacgaccaacgacaatctaaacactaatactataactctccacaccactatcgcgcgcaaaatatcgctctcctacactatctacgcaaaccaccataacacaccgccgtatattatacgccgtatctcgtcgtaccccgctcacgacctatcaccaccccgcgctccgaacatat

SEQ ID NO: 11303 - DNA, 520 bp, Artificial Sequence
  chemically treated genomic DNA (Homo sapiens) CpG-island No: 11303
aggattttaatgggggtttattgatttaaaaatattttcgggatttggggaacgttttgtatttcgtataacgacgtgtggcgtgtgatacgtcgtatcgttcgacgattttcgcgtttattgtatttttcgtttattttacgtttttgtgcgttatgagagtcgacgacgcgttttacgtgtttacgtatcgcgttttaggtttattatcgtattgtaggcgcgtgtcgattattgttcgattgcgttatggtttttagtgtacgtcgttttttgcgtcgtattattattcgtgtgggtttgtgtagtattcgtagtagacgttcgagacgattagatttcgatgcggttagcgatagtttgagtattggtgttgtggttttttatattattgtcgcgcgtaaggtgtcgtttttttgtattgtttgcgtagattattataatatatcgtcgtgtgttgtgcgtcgtgtttcgtcgtgtttcgtttacggtttattattatttcgcgtttcgagtatgt

SEQ ID NO: 11304 - DNA, 520 bp, Artificial Sequence
  chemically treated genomic DNA (Homo sapiens) CpG-island No: 11304
acatactcgaaacgcgaaataataataaaccgtaaacgaaacacgacgaaacacgacgcacaacacacgacgatatattataataatctacgcaaacaatacaaaaaaacgacaccttacgcgcgacaataatataaaaaaccacaacaccaatactcaaactatcgctaaccgcatcgaaatctaatcgtctcgaacgtctactacgaatactacacaaacccacacgaataataatacgacgcaaaaaacgacgtacactaaaaaccataacgcaatcgaacaataatcgacacgcgcctacaatacgataataaacctaaaacgcgatacgtaaacacgtaaaacgcgtcgtcgactctcataacgcacaaaaacgtaaaataaacgaaaaatacaataaacgcgaaaatcgtcgaacgatacgacgtatcacacgccacacgtcgttatacgaaatacaaaacgttccccaaatcccgaaaatatttttaaatcaataaacccccattaaaatcct

SEQ ID NO: 11305 - DNA, 519 bp, Artificial Sequence
  chemically treated genomic DNA (Homo sapiens) CpG-island No: 11305
aatagagacgggggcggggtcgcgtttgaagtacgtggttcgcgtgacgggaggaggtcgggtcggtcgcgacgaagggcggggtcgtttcgttttaacgttagaggaatgcggtggggggagggggagagagagggtttttttttttttcgttttcgcggtcggttcggacgtttttcgcgtcggcgcgtacggtcggagtacggcggaacggttttttcggcgtcgtacgttttaggtcgtcggttcggtttggtgattcgtatttttcgcgttttcggttatcgtttcgtttttatttcgttgttcggattttggttttcggtcgcgcgcggcgtcgttcgttagtgtttcggttattttttcgtatttttcgtttttagtttttattagttcggcggcgagtttgatcggtcgtttcggatcgaaaagagtagatattgggaagttttgggagagggaggggcgggttttaaagggattacgatttttttttagtttcgtggggggaagaaaaat

SEQ ID NO: 11306 - DNA, 519 bp, Artificial Sequence
  chemically treated genomic DNA (Homo sapiens) CpG-island No: 11306
atttttcttccccccacgaaactaaaaaaaaatcgtaatccctttaaaacccgcccctccctctcccaaaacttcccaatatctactcttttcgatccgaaacgaccgatcaaactcgccgccgaactaataaaaactaaaaacgaaaaatacgaaaaaataaccgaaacactaacgaacgacgccgcgcgcgaccgaaaaccaaaatccgaacaacgaaataaaaacgaaacgataaccgaaaacgcgaaaaatacgaatcaccaaaccgaaccgacgacctaaaacgtacgacgccgaaaaaaccgttccgccgtactccgaccgtacgcgccgacgcgaaaaacgtccgaaccgaccgcgaaaacgaaaaaaaaaaaaaccctctctctccccctccccccaccgcattcctctaacgttaaaacgaaacgaccccgcccttcgtcgcgaccgacccgacctcctcccgtcacgcgaaccacgtacttcaaacgcgaccccgcccccgtctctatt

SEQ ID NO: 11307 - DNA, 519 bp, Artificial Sequence
  chemically treated genomic DNA (Homo sapiens) CpG-island No: 11307
attttttttttttttacggggttgaaaaaaggtcgtggtttttttaaggttcgttttttttttttttaaaattttttagtgtttgtttttttcgattcgggacggtcggttaggttcgtcgtcgagttggtaggggttgggggcgaggggtgcgggaaggtgatcggggtattggcgggcggcgtcgcgcgcggtcgggggttagggttcgagtagcggggtgggggcggggcggtggtcgggagcgcggggggtgcgggttattaggtcgggtcggcggtttggaacgtgcggcgtcggggagatcgtttcgtcgtgtttcggtcgtgcgcgtcggcgcgaggggcgttcgggtcggtcgcgggggcggggaggggaggggttttttttttttttttttttttatcgtatttttttgacgttgggacggagcgatttcgtttttcgtcgcgatcggttcggttttttttcgttacgcgggttacgtgttttagacgcggtttcgttttcgtttttgtt

SEQ ID NO: 11308 - DNA, 519 bp, Artificial Sequence
  chemically treated genomic DNA (Homo sapiens) CpG-island No: 11308
aacaaaaacgaaaacgaaaccgcgtctaaaacacgtaacccgcgtaacgaaaaaaaaccgaaccgatcgcgacgaaaaacgaaatcgctccgtcccaacgtcaaaaaaatacgataaaaaaaaaaaaaaaaaaaaaacccctcccctccccgcccccgcgaccgacccgaacgcccctcgcgccgacgcgcacgaccgaaacacgacgaaacgatctccccgacgccgcacgttccaaaccgccgacccgacctaataacccgcaccccccgcgctcccgaccaccgccccgcccccaccccgctactcgaaccctaacccccgaccgcgcgcgacgccgcccgccaataccccgatcaccttcccgcacccctcgcccccaacccctaccaactcgacgacgaacctaaccgaccgtcccgaatcgaaaaaaacaaacactaaaaaattttaaaaaaaaaaaaaacgaaccttaaaaaaaccacgaccttttttcaaccccgtaaaaaaaaaaaaaat

SEQ ID NO: 11309 - DNA, 900 bp, Artificial Sequence
  chemically treated genomic DNA (Homo sapiens) CpG-island No: 11309
ttatttttcgaagcgttttttatttttcgttttatcgcggttatttttgggtttcggggtttgtagtatttagttaggtttcggcgcggttcgatttttttattcggattttcgatttacggtttggttttgttatgggcgcggtgttgaagtttttgaggttgttatcgatcgttttgtttcgttattaattattgtgtttcgttatcgattgttttgttttgttatcgattgttttgtttcgtgacggtattagaaatgggagtggtcgtgatagggtatagaattataatttttagtagatattgcggtcgtagacgcgttttcgtataatatttagagcgttttagttaggtaagaaagcgcgcgaggatcggattacgagttttagaaggcgtggcgttagtagttatgttggtaaagggcgttcggaaaatgtgggaacggttagagagttgtagttttttcgaatattttgattggttaggatgtagtacgagggcggggtgtgagcgatttagtatattattattgggtgaattagggggcgtggtggggaatttttcgtagggcggaagttttagaattttcggtaaagtttagttataggcgggcgattgcggggggtttttgaggcggcgggggttatggttggggtcgcgtgtttgggaaaagttgtcgacgtagatgaatggtgcgatagcggtttgggttttttgggttcggacgtagcggttttcggaggatttgggttgggcgcggagttgggttcggggttgtcgtgggtttttttcgttttcggttacgttattgaggatggggatacgtgagtgaattttaggttgttaaacggagttttaggattcggcgttatattttttattaatttttgatttttga

SEQ ID NO: 11310 - DNA, 900 bp, Artificial Sequence
  chemically treated genomic DNA (Homo sapiens) CpG-island No: 11310
tcaaaaatcaaaaattaataaaaaatataacgccgaatcctaaaactccgtttaacaacctaaaattcactcacgtatccccatcctcaataacgtaaccgaaaacgaaaaaaacccacgacaaccccgaacccaactccgcgcccaacccaaatcctccgaaaaccgctacgtccgaacccaaaaaacccaaaccgctatcgcaccattcatctacgtcgacaacttttcccaaacacgcgaccccaaccataacccccgccgcctcaaaaaccccccgcaatcgcccgcctataactaaactttaccgaaaattctaaaacttccgccctacgaaaaattccccaccacgccccctaattcacccaataataatatactaaatcgctcacaccccgccctcgtactacatcctaaccaatcaaaatattcgaaaaaactacaactctctaaccgttcccacattttccgaacgccctttaccaacataactactaacgccacgccttctaaaactcgtaatccgatcctcgcgcgctttcttacctaactaaaacgctctaaatattatacgaaaacgcgtctacgaccgcaatatctactaaaaattataattctataccctatcacgaccactcccatttctaataccgtcacgaaacaaaacaatcgataacaaaacaaaacaatcgataacgaaacacaataattaataacgaaacaaaacgatcgataacaacctcaaaaacttcaacaccgcgcccataacaaaaccaaaccgtaaatcgaaaatccgaataaaaaaatcgaaccgcgccgaaacctaactaaatactacaaaccccgaaacccaaaaataaccgcgataaaacgaaaaataaaaaacgcttcgaaaaataa

SEQ ID NO: 11311 - DNA, 900 bp, Artificial Sequence
  chemically treated genomic DNA (Homo sapiens) CpG-island No: 11311
ttagggattagagattaatgaggaatgtgacgtcgggttttagggtttcgtttggtagtttaaggtttatttacgtgtttttatttttagtgacgtagtcgaagacgaggggagtttacgatagtttcgggtttaatttcgcgtttaatttaggtttttcgggggtcgttgcgttcggatttagggagtttaggtcgttgtcgtattatttatttgcgtcggtagttttttttaagtacgcgattttagttatggttttcgtcgttttaggggtttttcgtagtcgttcgtttgtagttgggttttgtcgggagttttggagttttcgttttgcgggaaattttttattacgttttttgatttatttaatgataatatgttgaatcgtttatatttcgttttcgtattgtattttgattaattagagtattcgggaggattataattttttagtcgtttttatatttttcgggcgttttttattaatatggttgttgacgttacgttttttgggattcgtagttcggttttcgcgcgtttttttatttaattggggcgttttgggtgttgtacgaaagcgcgtttgcggtcgtaatgtttgttgagagttgtagttttgtgttttattacggttatttttatttttggtgtcgttacgggatagagtagtcggtgataggatagagtagtcggtgacgggatatagtggttggtgacgggatagagcggtcggtgatagttttaagggttttagtatcgcgtttatggtagagttagatcgtgagtcggggattcgggtaggagggtcgggtcgcgtcggggtttggttgaatgttgtaggtttcggggtttaagggtggtcgcggtggggcgggaagtagggagcgtttcggggagtgg

SEQ ID NO: 11312 - DNA, 900 bp, Artificial Sequence
  chemically treated genomic DNA (Homo sapiens) CpG-island No: 11312
ccactccccgaaacgctccctacttcccgccccaccgcgaccacccttaaaccccgaaacctacaacattcaaccaaaccccgacgcgacccgaccctcctacccgaatccccgactcacgatctaactctaccataaacgcgatactaaaacccttaaaactatcaccgaccgctctatcccgtcaccaaccactatatcccgtcaccgactactctatcctatcaccgactactctatcccgtaacgacaccaaaaataaaaataaccgtaataaaacacaaaactacaactctcaacaaacattacgaccgcaaacgcgctttcgtacaacacccaaaacgccccaattaaataaaaaaacgcgcgaaaaccgaactacgaatcccaaaaaacgtaacgtcaacaaccatattaataaaaaacgcccgaaaaatataaaaacgactaaaaaattataatcctcccgaatactctaattaatcaaaatacaatacgaaaacgaaatataaacgattcaacatattatcattaaataaatcaaaaaacgtaataaaaaatttcccgcaaaacgaaaactccaaaactcccgacaaaacccaactacaaacgaacgactacgaaaaacccctaaaacgacgaaaaccataactaaaatcgcgtacttaaaaaaaactaccgacgcaaataaataatacgacaacgacctaaactccctaaatccgaacgcaacgacccccgaaaaacctaaattaaacgcgaaattaaacccgaaactatcgtaaactcccctcgtcttcgactacgtcactaaaaataaaaacacgtaaataaaccttaaactaccaaacgaaaccctaaaacccgacgtcacattcctcattaatctctaatccctaa

SEQ ID NO: 11313 - DNA, 593 bp, Artificial Sequence
  chemically treated genomic DNA (Homo sapiens) CpG-island No: 11313
cgtttttcggtcggcgtaggcgtatttacgatcgcgggtaggttcgtcgagcgtagtttttttttgcggagttttagggcgtgtgcggttttttttgggtatgcgtagaatcgttttatgtttagttgagggagtgcgttgtagttttcgcgcgtatattcgtataggaggtttcggtttcgtttttttgtagtgaaatttttttttggattatcgttggagatgtagttttttcggggtcggaattttcgacgagttagtaaaggttataagcgtcgcgttatggacgtagttattttggatcgggaataaggcggtatttcgtttcgtttatttcgcgtttagattaattgtaaggtagcgaatttgatcgtgacgagttaattagattttgaggaaagttgatcgcgatagagtttttcgtcgtttaatcgtcgtttgtgtttcgtttttttagtgacgcgaggtagaattagttaatttttgtacggatagcgttcggaagaggttagaagttggatttagcgtgttcgcgattttatttttaggttttgtgaggtcggtggaattttggggttttttaaatttattag

SEQ ID NO: 11314 - DNA, 593 bp, Artificial Sequence
  chemically treated genomic DNA (Homo sapiens) CpG-island No: 11314
ctaataaatttaaaaaaccccaaaattccaccgacctcacaaaacctaaaaataaaatcgcgaacacgctaaatccaacttctaacctcttccgaacgctatccgtacaaaaattaactaattctacctcgcgtcactaaaaaaacgaaacacaaacgacgattaaacgacgaaaaactctatcgcgatcaactttcctcaaaatctaattaactcgtcacgatcaaattcgctaccttacaattaatctaaacgcgaaataaacgaaacgaaataccgccttattcccgatccaaaataactacgtccataacgcgacgcttataacctttactaactcgtcgaaaattccgaccccgaaaaaactacatctccaacgataatccaaaaaaaaatttcactacaaaaaaacgaaaccgaaacctcctatacgaatatacgcgcgaaaactacaacgcactccctcaactaaacataaaacgattctacgcatacccaaaaaaaaccgcacacgccctaaaactccgcaaaaaaaaactacgctcgacgaacctacccgcgatcgtaaatacgcctacgccgaccgaaaaacg

SEQ ID NO: 11315 - DNA, 593 bp, Artificial Sequence
  chemically treated genomic DNA (Homo sapiens) CpG-island No: 11315
ttggtagatttggaggattttaggattttatcgattttataggatttaaaggtgaggtcgcggatacgttgaatttagtttttagtttttttcgggcgttattcgtgtagggattggttggttttgtttcgcgttattgaagaggcgggatatagacgacgattgggcgacgaaggattttatcgcggttaattttttttaggatttgattggttcgttacggttaggttcgttgttttgtaattggtttaaacgcggagtgggcgggacgaagtgtcgttttgttttcggtttaagatggttgcgtttatggcgcggcgtttgtggtttttgttgattcgtcgggggtttcggtttcggggaggttgtatttttaacgatagtttaaggagaagttttattatagagaaacgaaatcggaattttttgtacgagtatgcgcgcgagggttatagcgtatttttttagttggatatagagcggttttgcgtatgtttagaagaggtcgtatacgttttggagtttcgtaagggggagttgcgttcggcggatttgttcgcgatcgtgagtgcgtttgcgtcggtcggggggcg

SEQ ID NO: 11316 - DNA, 593 bp, Artificial Sequence
  chemically treated genomic DNA (Homo sapiens) CpG-island No: 11316
cgccccccgaccgacgcaaacgcactcacgatcgcgaacaaatccgccgaacgcaactcccccttacgaaactccaaaacgtatacgacctcttctaaacatacgcaaaaccgctctatatccaactaaaaaaatacgctataaccctcgcgcgcatactcgtacaaaaaattccgatttcgtttctctataataaaacttctccttaaactatcgttaaaaatacaacctccccgaaaccgaaacccccgacgaatcaacaaaaaccacaaacgccgcgccataaacgcaaccatcttaaaccgaaaacaaaacgacacttcgtcccgcccactccgcgtttaaaccaattacaaaacaacgaacctaaccgtaacgaaccaatcaaatcctaaaaaaaattaaccgcgataaaatccttcgtcgcccaatcgtcgtctatatcccgcctcttcaataacgcgaaacaaaaccaaccaatccctacacgaataacgcccgaaaaaaactaaaaactaaattcaacgtatccgcgacctcacctttaaatcctataaaatcgataaaatcctaaaatcctccaaatctaccaa

SEQ ID NO: 11317 - DNA, 614 bp, Artificial Sequence
  chemically treated genomic DNA (Homo sapiens) CpG-island No: 11317
ttcggttttattttttttagtttcgtttatcgggtttatcgtttaggtattgcgttttttagtttcgttttttggtttttttagcggtttcgtttattggttatattttttagattttgtttcggtttcgttttcgtttcgttcgcgcggttttttttagttttttgggtttcgttttcgttatttacgtttttcgtaggagttgaagatgagattgcggtcgaagggcgcgcgtagatagtagcgcgttagggcgtatagcgggaatttttttttgttttcgttgttgggtaggtagcgttgagttattgcgtagagtgcgcggttttcggcgttgcggtcgcgggttagttgtagtagttatatagtgggttcgtttattatgtcgcgttaggcgcggtatattgggcggtatcgcgtgattaaggagcgtggcggtacgtggtttagtatttgtattagtagtttcgggggtagcgcgtttagggttagggatgggttcgtcggtagtcgtcgtcgcgatagtcgggcgtttatttttagtagttagagttttgtaggtcgagaggggtcggtaggcgggttagcgtagttaggttattttttttttattt

SEQ ID NO: 11318 - DNA, 614 bp, Artificial Sequence
  chemically treated genomic DNA (Homo sapiens) CpG-island No: 11318
aaataaaaaaaaaataacctaactacgctaacccgcctaccgacccctctcgacctacaaaactctaactactaaaaataaacgcccgactatcgcgacgacgactaccgacgaacccatccctaaccctaaacgcgctacccccgaaactactaatacaaatactaaaccacgtaccgccacgctccttaatcacgcgataccgcccaatataccgcgcctaacgcgacataataaacgaacccactatataactactacaactaacccgcgaccgcaacgccgaaaaccgcgcactctacgcaataactcaacgctacctacccaacaacgaaaacaaaaaaaaattcccgctatacgccctaacgcgctactatctacgcgcgcccttcgaccgcaatctcatcttcaactcctacgaaaaacgtaaataacgaaaacgaaacccaaaaaactaaaaaaaaccgcgcgaacgaaacgaaaacgaaaccgaaacaaaatctaaaaaatataaccaataaacgaaaccgctaaaaaaaccaaaaaacgaaactaaaaaacgcaatacctaaacgataaacccgataaacgaaactaaaaaaaataaaaccgaa

SEQ ID NO: 11319 - DNA, 614 bp, Artificial Sequence
  chemically treated genomic DNA (Homo sapiens) CpG-island No: 11319
aggtagggagggggtggtttggttgcgttgattcgtttatcgatttttttcgatttgtaggattttggttattggagatgggcgttcggttatcgcggcgacggttgtcggcggatttatttttggttttggacgcgttgttttcggagttgttggtgtaggtgttgagttacgtgtcgttacgttttttggttacgcgatgtcgtttagtgtgtcgcgtttggcgcgatatagtggacgggtttattgtgtggttgttgtagttggttcgcgatcgtagcgtcgagggtcgcgtattttacgtagtggtttaacgttgtttgtttagtaacgaagataaggaggagttttcgttgtgcgttttggcgcgttattgtttgcgcgcgtttttcggtcgtaattttatttttaatttttgcggagagcgtgggtgacgggggcggggtttaggaggttgaggggggtcgcgcgagcgaggcgggggcggggtcgggatagagtttgagagatgtagttaatgggcgagatcgttggaggagttagggggcggggttgagggacgtagtgtttgggcggtaggttcggtgggcggggttggagaaggtgaagtcggg

SEQ ID NO: 11320 - DNA, 614 bp, Artificial Sequence
  chemically treated genomic DNA (Homo sapiens) CpG-island No: 11320
cccgacttcaccttctccaaccccgcccaccgaacctaccgcccaaacactacgtccctcaaccccgccccctaactcctccaacgatctcgcccattaactacatctctcaaactctatcccgaccccgcccccgcctcgctcgcgcgacccccctcaacctcctaaaccccgcccccgtcacccacgctctccgcaaaaattaaaaataaaattacgaccgaaaaacgcgcgcaaacaataacgcgccaaaacgcacaacgaaaactcctccttatcttcgttactaaacaaacaacgttaaaccactacgtaaaatacgcgaccctcgacgctacgatcgcgaaccaactacaacaaccacacaataaacccgtccactatatcgcgccaaacgcgacacactaaacgacatcgcgtaaccaaaaaacgtaacgacacgtaactcaacacctacaccaacaactccgaaaacaacgcgtccaaaaccaaaaataaatccgccgacaaccgtcgccgcgataaccgaacgcccatctccaataaccaaaatcctacaaatcgaaaaaaatcgataaacgaatcaacgcaaccaaaccaccccctccctacct

SEQ ID NO: 11321 - DNA, 521 bp, Artificial Sequence
  chemically treated genomic DNA (Homo sapiens) CpG-island No: 11321
ggttcgggaaagcgacgttgcgggttatgggatttttagggattcgttttttcgggtagggtttggcgcgggaatttttttcggggcgttttagttgtgggcgagaacgggattgacgtttgggtttcgatttgggttttttatttgtttcggcgtttatttggcgggttgttcggaggcggtagtcgcggggttaagttttttttttttattttgttttgggaggtagtcgaggggtttttcgtgatcggcgtggtttagggggttttcgggacggcggtttgggcggtcggttttttttcggggcgtggcggttgtagttcggcgtcgggggcggcgatttttgagtatttagcgggcgggggcgggaggtcgtttttttttcggttgcggggtttagcgggcgcgagggcggggcgggcgggggagtttggagggttgcgtgtagcgagggggaggtttagttgtcgcgaggttagcggggagcggggttagtttcgcgtttttaggattcggggttt

SEQ ID NO: 11322 - DNA, 521 bp, Artificial Sequence
  chemically treated genomic DNA (Homo sapiens) CpG-island No: 11322
aaaccccgaatcctaaaaacgcgaaactaaccccgctccccgctaacctcgcgacaactaaacctccccctcgctacacgcaaccctccaaactcccccgcccgccccgccctcgcgcccgctaaaccccgcaaccgaaaaaaaaacgacctcccgcccccgcccgctaaatactcaaaaatcgccgcccccgacgccgaactacaaccgccacgccccgaaaaaaaaccgaccgcccaaaccgccgtcccgaaaaccccctaaaccacgccgatcacgaaaaacccctcgactacctcccaaaacaaaataaaaaaaaaaaacttaaccccgcgactaccgcctccgaacaacccgccaaataaacgccgaaacaaataaaaaacccaaatcgaaacccaaacgtcaatcccgttctcgcccacaactaaaacgccccgaaaaaaattcccgcgccaaaccctacccgaaaaaacgaatccctaaaaatcccataacccgcaacgtcgctttcccgaacc

SEQ ID NO: 11323 - DNA, 521 bp, Artificial Sequence
  chemically treated genomic DNA (Homo sapiens) CpG-island No: 11323
gggtttcggattttaggggcgcggggttggtttcgtttttcgttggtttcgcggtaattgggtttttttttcgttgtacgtagttttttaagttttttcgttcgtttcgttttcgcgttcgttgggtttcgtagtcggaggaagggcggtttttcgttttcgttcgttggatgtttagaggtcgtcgttttcggcgtcgggttgtagtcgttacgtttcgggagaggatcgatcgtttagatcgtcgtttcgagggttttttgggttacgtcgattacggggagtttttcgattgttttttagaataaagtgggaaagggaagtttagtttcgcggttgtcgttttcgagtagttcgttaggtgagcgtcgggataggtaggggatttaggtcgggatttaagcgttagtttcgttttcgtttatagttggggcgtttcgggaaggattttcgcgttaggttttgttcggaggggcgggtttttgggagttttataattcgtagcgtcgttttttcgggtt

SEQ ID NO: 11324 - DNA, 521 bp, Artificial Sequence
  chemically treated genomic DNA (Homo sapiens) CpG-island No: 11324
aacccgaaaaaacgacgctacgaattataaaactcccaaaaacccgcccctccgaacaaaacctaacgcgaaaatccttcccgaaacgccccaactataaacgaaaacgaaactaacgcttaaatcccgacctaaatcccctacctatcccgacgctcacctaacgaactactcgaaaacgacaaccgcgaaactaaacttccctttcccactttattctaaaaaacaatcgaaaaactccccgtaatcgacgtaacccaaaaaaccctcgaaacgacgatctaaacgatcgatcctctcccgaaacgtaacgactacaacccgacgccgaaaacgacgacctctaaacatccaacgaacgaaaacgaaaaaccgcccttcctccgactacgaaacccaacgaacgcgaaaacgaaacgaacgaaaaaacttaaaaaactacgtacaacgaaaaaaaaacccaattaccgcgaaaccaacgaaaaacgaaaccaaccccgcgcccctaaaatccgaaaccc

SEQ ID NO: 11325 - DNA, 617 bp, Artificial Sequence
  chemically treated genomic DNA (Homo sapiens) CpG-island No: 11325
tattatcggtttaataggtgcggggaaaattattttgttggacgttatttgtttggcgttgtattacgaaatttcgcgtttttttaacgttttataatcgtaaaatgattttatgattcgcgatatcgtcgaatgtttggcggaggtggagtttgaagtgaaaggtgaagcgtatcgtgtattttggagttagaatcgggcgcgtaattaattcgacggtaatttgtaggtgttacgcgtagagtttcgcgttgcgcgacggtaaaattttcgtcgataaagtgaaagataagttggaattgatagcgacgttaatcgggttggattacgggcgttttattcgttcgatgttgtttcgtaggggtaatttgttgtttttttgaatgttaaatttaaagaacgcgcggaattgttcgaggagttaatcggtattgaaatttacgggtaaatttcggcgatggtttttgagtagtataaatcggttcgtatagagttggagaagttgtaagcgtagttagcggcgttacgtttttacgtcggaataagtgtaatcgttgatagcgagtttgtaggtatttattgacgaagaaaaatagttaattatcgcgtagtagtat

SEQ ID NO: 11326 - DNA, 617 bp, Artificial Sequence
  chemically treated genomic DNA (Homo sapiens) CpG-island No: 11326
atactactacgcgataattaactatttttcttcgtcaataaatacctacaaactcgctatcaacgattacacttattccgacgtaaaaacgtaacgccgctaactacgcttacaacttctccaactctatacgaaccgatttatactactcaaaaaccatcgccgaaatttacccgtaaatttcaataccgattaactcctcgaacaattccgcgcgttctttaaatttaacattcaaaaaaacaacaaattacccctacgaaacaacatcgaacgaataaaacgcccgtaatccaacccgattaacgtcgctatcaattccaacttatctttcactttatcgacgaaaattttaccgtcgcgcaacgcgaaactctacgcgtaacacctacaaattaccgtcgaattaattacgcgcccgattctaactccaaaatacacgatacgcttcacctttcacttcaaactccacctccgccaaacattcgacgatatcgcgaatcataaaatcattttacgattataaaacgttaaaaaaacgcgaaatttcgtaatacaacgccaaacaaataacgtccaacaaaataattttccccgcacctattaaaccgataata

SEQ ID NO: 11327 - DNA, 617 bp, Artificial Sequence
  chemically treated genomic DNA (Homo sapiens) CpG-island No: 11327
atgttgttgcgcggtaattaattgttttttttcgttagtaagtatttgtaaattcgttgttagcgattgtatttgtttcggcgtgaaagcgtgacgtcgttggttgcgtttgtagtttttttagttttgtgcgggtcgatttgtgttgtttaaaaattatcgtcgagatttgttcgtagattttagtgtcggttaatttttcgagtaatttcgcgcgttttttgggtttggtatttaggaaggtagtaaattgtttttgcgaaatagtatcgaacgggtgaagcgttcgtaatttagttcggttaacgtcgttgttagttttagtttattttttattttgtcggcgagaattttgtcgtcgcgtagcgcgaggttttacgcgtggtatttgtaaattatcgtcgggttggttacgcgttcgattttggttttagaatgtacggtacgttttattttttattttaaattttattttcgttagatattcggcggtatcgcgggttatgagattattttgcgattgtgaaacgttagagagacgcggagtttcgtgatatagcgttagataaatggcgtttagtagggtggtttttttcgtatttgttgggtcggtaata

SEQ ID NO: 11328 - DNA, 617 bp, Artificial Sequence
  chemically treated genomic DNA (Homo sapiens) CpG-island No: 11328
tattaccgacccaacaaatacgaaaaaaaccaccctactaaacgccatttatctaacgctatatcacgaaactccgcgtctctctaacgtttcacaatcgcaaaataatctcataacccgcgataccgccgaatatctaacgaaaataaaatttaaaataaaaaataaaacgtaccgtacattctaaaaccaaaatcgaacgcgtaaccaacccgacgataatttacaaataccacgcgtaaaacctcgcgctacgcgacgacaaaattctcgccgacaaaataaaaaataaactaaaactaacaacgacgttaaccgaactaaattacgaacgcttcacccgttcgatactatttcgcaaaaacaatttactaccttcctaaataccaaacccaaaaaacgcgcgaaattactcgaaaaattaaccgacactaaaatctacgaacaaatctcgacgataatttttaaacaacacaaatcgacccgcacaaaactaaaaaaactacaaacgcaaccaacgacgtcacgctttcacgccgaaacaaatacaatcgctaacaacgaatttacaaatacttactaacgaaaaaaaacaattaattaccgcgcaacaacat

SEQ ID NO: 11329 - DNA, 523 bp, Artificial Sequence
  chemically treated genomic DNA (Homo sapiens) CpG-island No: 11329
cggtcgcgtcgggggcggtgtcgttcggaatcgtagtttttttgtttttttttcgtttcgcggttttttagtcgtttttattttcggcgcgggatttttatttcggtatttgtatattttatgcgttcgtagtttcgagtttgcggggttgagttattcggcgattcgaaaattttcgtcgtgatttcgcgttgttcgggcggagttttaggtggttttgggttcgcgttttcgtttcggatttttaatttttttagttttatttcgttttttttttcgtgtttaatcggtcgtcgagttataagttattttttgattcgatttggtttttatcgttcggattttcgtttagtttcggttttgttagttcgtagtattagcgagtcgcggttttttgtgcgaggtttatttttgcggttttagttgattatcgggcgtacgttagggttttgtaatttcgttttcgtattttttattttgggatagcgttgttttttgtaaagttcggttttgttttgttttg

SEQ ID NO: 11330 - DNA, 523 bp, Artificial Sequence
  chemically treated genomic DNA (Homo sapiens) CpG-island No: 11330
caaaacaaaacaaaaccgaactttacaaaaaacaacgctatcccaaaataaaaaatacgaaaacgaaattacaaaaccctaacgtacgcccgataatcaactaaaaccgcaaaaataaacctcgcacaaaaaaccgcgactcgctaatactacgaactaacaaaaccgaaactaaacgaaaatccgaacgataaaaaccaaatcgaatcaaaaaataacttataactcgacgaccgattaaacacgaaaaaaaaaacgaaataaaactaaaaaaattaaaaatccgaaacgaaaacgcgaacccaaaaccacctaaaactccgcccgaacaacgcgaaatcacgacgaaaattttcgaatcgccgaataactcaaccccgcaaactcgaaactacgaacgcataaaatatacaaataccgaaataaaaatcccgcgccgaaaataaaaacgactaaaaaaccgcgaaacgaaaaaaaaacaaaaaaactacgattccgaacgacaccgcccccgacgcgaccg

SEQ ID NO: 11331 - DNA, 523 bp, Artificial Sequence
  chemically treated genomic DNA (Homo sapiens) CpG-island No: 11331
tagggtagggtagggtcgggttttgtagggggtagcgttgttttagggtgaggggtacgggggcgggattgtaaaattttagcgtgcgttcgatgattagttggggtcgtagaggtgggtttcgtataggaggtcgcggttcgttgatattgcgagttggtaaagtcgaagttgggcgggggttcgggcggtgggagttaagtcggattagggagtggtttgtaattcggcggtcgattggatacgaagaagagagcggggtggggttgggagggttgggggttcggagcgggggcgcggatttaagattatttggagtttcgttcgggtagcgcggggttacggcgggaattttcgggtcgtcgagtgatttagtttcgtaggttcgaaattgcgggcgtatgaggtgtgtaggtatcggggtgggggtttcgcgtcggaaataggggcgattgaggggtcgcgaggcggggaggaaataggggggttgcggtttcgggcgatatcgttttcgacgcggtcg

SEQ ID NO: 11332 - DNA, 523 bp, Artificial Sequence
  chemically treated genomic DNA (Homo sapiens) CpG-island No: 11332
cgaccgcgtcgaaaacgatatcgcccgaaaccgcaacccccctatttcctccccgcctcgcgacccctcaatcgcccctatttccgacgcgaaacccccaccccgatacctacacacctcatacgcccgcaatttcgaacctacgaaactaaatcactcgacgacccgaaaattcccgccgtaaccccgcgctacccgaacgaaactccaaataatcttaaatccgcgcccccgctccgaacccccaaccctcccaaccccaccccgctctcttcttcgtatccaatcgaccgccgaattacaaaccactccctaatccgacttaactcccaccgcccgaacccccgcccaacttcgactttaccaactcgcaatatcaacgaaccgcgacctcctatacgaaacccacctctacgaccccaactaatcatcgaacgcacgctaaaattttacaatcccgcccccgtacccctcaccctaaaacaacgctaccccctacaaaacccgaccctaccctacccta

SEQ ID NO: 11333 - DNA, 977 bp, Artificial Sequence
  chemically treated genomic DNA (Homo sapiens) CpG-island No: 11333
  misc_feature (377)..(377): n is either a, c, g or t
  misc_feature (417)..(417): n is either a, c, g or t
tttattcgttataatcgataattgtatagaaagacgtagcgtagaaaattcgcgttgacggatgtagtagttagtaatgtcgatgtcgagcggcgttagacggtaaattgcgttttttttcgtttgttcgttggtaaagcggtttagtagacgttgacgtattatgtcgttgatcgcgttattggcgcgtacgtcgatggtttcgttggtttgtttaaacgtattatttatatggcggaatgtatttattagttcgtttttatttattttaaaatttagacgttcgcggtttagcgtggtaggcgacgttacgtttagcgaggatttagtcgtcgtttagtaatagtcgattggacgtcgacgtgagttaaggatanacgggacgtggttttaaaggacgttgttaaatcgttagtngggttagacgttgcgttcgttggcgtagttgttttagatagttattggcggtaggcgataatagcgttattatgtcgtcgcgggtgagttgcgaggtatttagcgttcgttttacgttagtagtcgttttgtcgttgatacgtaggcggatgtcgttttagtttagttgtcgttagcgatcgttgaaggtttttatgtcgatgtttttagaaattcggttagcgggttggtggtatgagtaaaataattgcggttgttcggttcggattgacgtgttagtaggtttgtttttatcgttagacgaaatgttttcgttatgttgacgggatcgttcgcgacggtaatcgtcgtatttattaatatcgcgtcggtttttatttttagcgtttgcggggtatggttgggaacgtcgatgttagtatcgataattatcggtattgtggtttgttggataataatttttagtatggcgcgggtttttagttttttcgaacgtcgcgtatcgttattcgatggcggtcgcgggaattcgattgggagtaaatagagtttggaatagt

SEQ ID NO: 11334 - DNA, 977 bp, Artificial Sequence
  chemically treated genomic DNA (Homo sapiens) CpG-island No: 11334
  misc_feature (561)..(561): n is either a, c, g or t
  misc_feature (601)..(601): n is either a, c, g or t
actattccaaactctatttactcccaatcgaattcccgcgaccgccatcgaataacgatacgcgacgttcgaaaaaactaaaaacccgcgccatactaaaaattattatccaacaaaccacaataccgataattatcgatactaacatcgacgttcccaaccataccccgcaaacgctaaaaataaaaaccgacgcgatattaataaatacgacgattaccgtcgcgaacgatcccgtcaacataacgaaaacatttcgtctaacgataaaaacaaacctactaacacgtcaatccgaaccgaacaaccgcaattattttactcataccaccaacccgctaaccgaatttctaaaaacatcgacataaaaaccttcaacgatcgctaacgacaactaaactaaaacgacatccgcctacgtatcaacgacaaaacgactactaacgtaaaacgaacgctaaatacctcgcaactcacccgcgacgacataataacgctattatcgcctaccgccaataactatctaaaacaactacgccaacgaacgcaacgtctaacccnactaacgatttaacaacgtcctttaaaaccacgtcccgtntatccttaactcacgtcgacgtccaatcgactattactaaacgacgactaaatcctcgctaaacgtaacgtcgcctaccacgctaaaccgcgaacgtctaaattttaaaataaataaaaacgaactaataaatacattccgccatataaataatacgtttaaacaaaccaacgaaaccatcgacgtacgcgccaataacgcgatcaacgacataatacgtcaacgtctactaaaccgctttaccaacgaacaaacgaaaaaaaacgcaatttaccgtctaacgccgctcgacatcgacattactaactactacatccgtcaacgcgaattttctacgctacgtctttctatacaattatcgattataacgaataaa

SEQ ID NO: 11335 - DNA, 977 bp, Artificial Sequence
  chemically treated genomic DNA (Homo sapiens) CpG-island No: 11335
  misc_feature (561)..(561): n is either a, c, g or t
  misc_feature (601)..(601): n is either a, c, g or t
attgttttaagttttatttgtttttaatcgaattttcgcggtcgttatcggatggcgatgcgcgacgttcggggggattggaaattcgcgttatgttggagattattatttagtaggttatagtgtcggtggttgtcgatgttggtatcggcgtttttagttatgtttcgtaggcgttggaaatgggggtcgacgcggtgttagtgaatacggcgattgtcgtcgcggacgatttcgttaatatggcgaaggtatttcgtttggcggtagaagtaggtttattggtacgttagttcggatcgggtagtcgtagttattttgtttatgttattagttcgttgatcggatttttggaggtatcggtatgaaaatttttagcgatcgttggcgataattggattgggacgatattcgtttgcgtattaacggtaaaacggttgttgacgtagagcgggcgttaaatgtttcgtaatttattcgcgacgatatgatggcgttgttatcgtttgtcgttagtggttatttggaataattgcgttaacgggcgtagcgtttgatttngttagcgatttggtaacgttttttaaaattacgtttcgtntatttttaatttacgtcgacgtttagtcggttattattggacgacgattagattttcgttggacgtgacgtcgtttattacgttaaatcgcgagcgtttggattttgagatgagtgaaggcgagttggtggatgtatttcgttatgtgagtgatgcgtttgagtaaattagcgaaattatcggcgtgcgcgttaataacgcgattaacgatatggtgcgttaacgtttgttgaatcgttttattagcgagtaggcggaagggaacgtaatttatcgtttgacgtcgttcggtatcggtattattgattattatattcgttagcgcgagttttttacgttgcgtttttttatgtagttgtcgattgtggcgggtgag

SEQ ID NO: 11336 - DNA, 977 bp, Artificial Sequence
  chemically treated genomic DNA (Homo sapiens) CpG-island No: 11336
  misc_feature (377)..(377): n is either a, c, g or t
  misc_feature (417)..(417): n is either a, c, g or t
ctcacccgccacaatcgacaactacataaaaaaacgcaacgtaaaaaactcgcgctaacgaatataataatcaataataccgataccgaacgacgtcaaacgataaattacgttcccttccgcctactcgctaataaaacgattcaacaaacgttaacgcaccatatcgttaatcgcgttattaacgcgcacgccgataatttcgctaatttactcaaacgcatcactcacataacgaaatacatccaccaactcgccttcactcatctcaaaatccaaacgctcgcgatttaacgtaataaacgacgtcacgtccaacgaaaatctaatcgtcgtccaataataaccgactaaacgtcgacgtaaattaaaaatanacgaaacgtaattttaaaaaacgttaccaaatcgctaacnaaatcaaacgctacgcccgttaacgcaattattccaaataaccactaacgacaaacgataacaacgccatcatatcgtcgcgaataaattacgaaacatttaacgcccgctctacgtcaacaaccgttttaccgttaatacgcaaacgaatatcgtcccaatccaattatcgccaacgatcgctaaaaattttcataccgatacctccaaaaatccgatcaacgaactaataacataaacaaaataactacgactacccgatccgaactaacgtaccaataaacctacttctaccgccaaacgaaataccttcgccatattaacgaaatcgtccgcgacgacaatcgccgtattcactaacaccgcgtcgacccccatttccaacgcctacgaaacataactaaaaacgccgataccaacatcgacaaccaccgacactataacctactaaataataatctccaacataacgcgaatttccaatccccccgaacgtcgcgcatcgccatccgataacgaccgcgaaaattcgattaaaaacaaataaaacttaaaacaat

SEQ ID NO: 11337 - DNA, 653 bp, Artificial Sequence
  chemically treated genomic DNA (Homo sapiens) CpG-island No: 11337
gtcgcggtaggaaaagtaaaagttacggcgtataaatgcgatttttgtgcggggcgcgaaaacggttttgtttgtgttgagaattgttcggcggacgcgttgtaattggttattgacgtcgtatttttcggtatggcgaaatttcgtcgtttggtatcgcggttaggaatattaatcgtggtatgttagtatcgcggcgtaagaaatgtcggtaatgagtaaagtcgaataaatgtaggtaacgttcgcgcgtggtcgagtcggtataaattggcgattgaagcgcgtaaaatcggttttgaagaaatttatttgttatttcgcgacgattaggtattacgtgaattatatcgttgttttaagtgcggcgagtatagcgtttgttaatggatttgttcgtagtataattatatatcgtagtggaatgaattggtgaaagtcggaaatattcgacgtcgtcgtcgagtttttttattagattaataatttgtcgtatattatcggacgcgtttgttcgtaagatcgtttgtgtgaaggcgtttgtattattcgcgatgagtacggcgcggtaattatcgttaatattgaacgttatattttagattaggcgttggcgaaaggttggcgtttttgatataagtttatgttattaa

SEQ ID NO: 11338 - DNA, 653 bp, Artificial Sequence
  chemically treated genomic DNA (Homo sapiens) CpG-island No: 11338
ttaataacataaacttatatcaaaaacgccaacctttcgccaacgcctaatctaaaatataacgttcaatattaacgataattaccgcgccgtactcatcgcgaataatacaaacgccttcacacaaacgatcttacgaacaaacgcgtccgataatatacgacaaattattaatctaataaaaaaactcgacgacgacgtcgaatatttccgactttcaccaattcattccactacgatatataattatactacgaacaaatccattaacaaacgctatactcgccgcacttaaaacaacgatataattcacgtaatacctaatcgtcgcgaaataacaaataaatttcttcaaaaccgattttacgcgcttcaatcgccaatttataccgactcgaccacgcgcgaacgttacctacatttattcgactttactcattaccgacatttcttacgccgcgatactaacataccacgattaatattcctaaccgcgataccaaacgacgaaatttcgccataccgaaaaatacgacgtcaataaccaattacaacgcgtccgccgaacaattctcaacacaaacaaaaccgttttcgcgccccgcacaaaaatcgcatttatacgccgtaacttttacttttcctaccgcgac

SEQ ID NO: 11339 - DNA, 653 bp, Artificial Sequence
  chemically treated genomic DNA (Homo sapiens) CpG-island No: 11339
ttggtgatatgagtttatgttagagacgttaatttttcgttaacgtttgatttgaaatgtagcgtttaatgttgacgatagttatcgcgtcgtgtttatcgcgaatagtataggcgtttttatataaacggttttgcgggtagacgcgttcggtaatatgcggtaggttgttggtttggtgagaaagttcgacggcggcgtcgagtgttttcggtttttattagtttattttattgcggtatatggttatgttgcgggtaggtttattgataaacgttgtgttcgtcgtatttaaggtagcggtgtagtttacgtagtgtttggtcgtcgcgaaatggtagataagtttttttaaaatcggttttgcgcgttttaatcgttagtttatgtcggttcggttacgcgcgggcgttgtttgtatttgttcgattttatttattatcggtattttttgcgtcgcggtattggtatgttacggttgatgtttttgatcgcggtgttaagcggcgggatttcgttatgtcggagagtgcgacgttagtgattagttgtagcgcgttcgtcgggtaatttttaatataggtaggatcgttttcgcgtttcgtataaaggtcgtatttatgcgtcgtggtttttattttttttgtcgcgat

SEQ ID NO: 11340 - DNA, 653 bp, Artificial Sequence
  chemically treated genomic DNA (Homo sapiens) CpG-island No: 11340
atcgcgacaaaaaaaataaaaaccacgacgcataaatacgacctttatacgaaacgcgaaaacgatcctacctatattaaaaattacccgacgaacgcgctacaactaatcactaacgtcgcactctccgacataacgaaatcccgccgcttaacaccgcgatcaaaaacatcaaccgtaacataccaataccgcgacgcaaaaaataccgataataaataaaatcgaacaaatacaaacaacgcccgcgcgtaaccgaaccgacataaactaacgattaaaacgcgcaaaaccgattttaaaaaaacttatctaccatttcgcgacgaccaaacactacgtaaactacaccgctaccttaaatacgacgaacacaacgtttatcaataaacctacccgcaacataaccatataccgcaataaaataaactaataaaaaccgaaaacactcgacgccgccgtcgaactttctcaccaaaccaacaacctaccgcatattaccgaacgcgtctacccgcaaaaccgtttatataaaaacgcctatactattcgcgataaacacgacgcgataactatcgtcaacattaaacgctacatttcaaatcaaacgttaacgaaaaattaacgtctctaacataaactcatatcaccaa

SEQ ID NO: 11341 - DNA, 525 bp, Artificial Sequence
  chemically treated genomic DNA (Homo sapiens) CpG-island No: 11341
  misc_feature (314)..(314): n is either a, c, g or t
cgcgtgttgtaggaatagcgattggaagttatcgcgtaaattaaagaggtataaagcgtcgttgttgtcgcgtaggttttgttggagtaacgataaagcgaaattcgtgtcgtatagtcgttggttaattaacgttaggtagaattggatttcgtagtaaaacgttatacgcgttttcgtttattggtttaacgaggggttatttttgcgtaatagttggatgacgatcgcgtcgtcgttgagagcgttcgagttgcgttggaatcggcgaaagttaggtatcggtttttaaagcggttatagaagcggtacgnattaatattatttaggcgtaaattcgcgtcgaagcggtataagttattgaacggcgtattgtttagatatcgatgatagcgaattgaaagtttcgcgtgacggacgcgtgtagtatcgggttgttaagtaggcgaagtgttggtttttttatgtttatatggtcggtatggaagaagggtttttgtcgtattagagtagtatcgatgaaga

SEQ ID NO: 11342 - DNA, 525 bp, Artificial Sequence
  chemically treated genomic DNA (Homo sapiens) CpG-island No: 11342
  misc_feature (212)..(212): n is either a, c, g or t
tcttcatcgatactactctaatacgacaaaaacccttcttccataccgaccatataaacataaaaaaaccaacacttcgcctacttaacaacccgatactacacgcgtccgtcacgcgaaactttcaattcgctatcatcgatatctaaacaatacgccgttcaataacttataccgcttcgacgcgaatttacgcctaaataatattaatncgtaccgcttctataaccgctttaaaaaccgatacctaactttcgccgattccaacgcaactcgaacgctctcaacgacgacgcgatcgtcatccaactattacgcaaaaataacccctcgttaaaccaataaacgaaaacgcgtataacgttttactacgaaatccaattctacctaacgttaattaaccaacgactatacgacacgaatttcgctttatcgttactccaacaaaacctacgcgacaacaacgacgctttatacctctttaatttacgcgataacttccaatcgctattcctacaacacgcg

SEQ ID NO: 11343 - DNA, 525 bp, Artificial Sequence
  chemically treated genomic DNA (Homo sapiens) CpG-island No: 11343
  misc_feature (212)..(212): n is either a, c, g or t
tttttatcgatgttgttttggtgcggtaaaaattttttttttatatcgattatgtagatataaggaaattagtatttcgtttgtttggtaattcgatattgtacgcgttcgttacgcggggtttttagttcgttgttatcgatatttgggtaatgcgtcgtttagtggtttgtgtcgtttcgacgcgggtttgcgtttgaatgatattggtncgtgtcgtttttatagtcgttttagaagtcgatatttgattttcgtcgattttagcgtagttcgggcgtttttagcggcggcgcgatcgttatttagttgttgcgtagaaatagtttttcgttgggttagtgaacgggaacgcgtatgacgttttgttacggagtttagttttgtttggcgttgattaattagcgattgtgcggtacgagtttcgttttgtcgttgttttagtaaagtttgcgcggtagtaacggcgttttgtgtttttttgatttgcgcgatggtttttagtcgttgtttttgtaatacgcg

SEQ ID NO: 11344 - DNA, 525 bp, Artificial Sequence
  chemically treated genomic DNA (Homo sapiens) CpG-island No: 11344
  misc_feature (314)..(314): n is either a, c, g or t
cgcgtattacaaaaacaacgactaaaaaccatcgcgcaaatcaaaaaaacacaaaacgccgttactaccgcgcaaactttactaaaacaacgacaaaacgaaactcgtaccgcacaatcgctaattaatcaacgccaaacaaaactaaactccgtaacaaaacgtcatacgcgttcccgttcactaacccaacgaaaaactatttctacgcaacaactaaataacgatcgcgccgccgctaaaaacgcccgaactacgctaaaatcgacgaaaatcaaatatcgacttctaaaacgactataaaaacgacacgnaccaatatcattcaaacgcaaacccgcgtcgaaacgacacaaaccactaaacgacgcattacccaaatatcgataacaacgaactaaaaaccccgcgtaacgaacgcgtacaatatcgaattaccaaacaaacgaaatactaatttccttatatctacataatcgatataaaaaaaaaatttttaccgcaccaaaacaacatcgataaaaa

SEQ ID NO: 11345 - DNA, 1460 bp, Artificial Sequence
  chemically treated genomic DNA (Homo sapiens) CpG-island No: 11345
  misc_feature (38)..(38): n is either a, c, g or t
  misc_feature (75)..(75): n is either a, c, g or t
  misc_feature (98)..(98): n is either a, c, g or t
  misc_feature (126)..(126): n is either a, c, g or t
  misc_feature (132)..(132): n is either a, c, g or t
  misc_feature (141)..(141): n is either a, c, g or t
  misc_feature (250)..(250): n is either a, c, g or t
  misc_feature (783)..(783): n is either a, c, g or t
  misc_feature (810)..(810): n is either a, c, g or t
  misc_feature (1042)..(1042): n is either a, c, g or t
  misc_feature (1236)..(1236): n is either a, c, g or t
gtgtcgttcgtgatttgtgcgtcgtgagtgtcggattngatggatgtatgacgtgtattgcgtcgagtgttcgtngcgtcgttagcgtcgttgcgggntaggagtgtatattaggcgtcgcgcgtngtcgangtggtgttncgtcgcgttcgcgtgttacgcgatgcggatgtttcgatatgcgttgcgcggattcggttgtgtggatcgagtgttagtcgtacggtgtacgtcgacggggatgattttntgcgtaggtgtatgttcgtcgtttgtcgtgtttcgacgcgttggacgatgcgacgtagtttggtcgaggatgtttttcgtgcgtttttgtttttcgttttcgtatagcgtgggtgttcgagtttggcgttattgcgtcgttatggtgagtgggtagcgtcgttgtggcggtggttgtacgaagtgcgtgttcgatggtgtttcgcgcgagttgtcgttgtatggagtgaaggtacgcgtagggagttgttaggattcgttgggagggggcgggcgtatggcgtagtcgacgtaggggttttgtcgtacgcgtatgcgaattgagtcggggttggaggtttggttatgtgcgagtgcgagagcgtgtgggcgagcgtgtgcgcggtgcggtgtgggagcgaacggtgcggtggagcgtgggggagaaacgtttggggcggtgtacgtcgaacgtgtagatcggtcgtgtgcgaggacgatgttcgttcgttgtgcggcgaggcgtggggtgagagtaggcgggagaggagggtncgcggcgagtcggattgcggcggcgtntcgcggagacgaggtgtgcggcgacggtgggaagtgggcgagatgggcgcggcgttggatgcgggtatgttgtttgcgttgtgacgggatgttggtggcgggtgatgtgttacgacgggggatgatgggtgggagtgcgtaggtacgaatgttggcgtgttggatgcgcggcgatgaggtgtagaggcgcgaggtcgttcggacgagcggcggcgcgagacgacgcgcggtntggagcggcggcgcgttggaggcgggcgttgtggttttggcgtgtcgcggggcgagtggcgggtgtgagcgagaggagaggcgtggtggacggcggtcgtcgcgggggaagcgtggcgatgggtggtcgaggagggtgtgtttaacgcggtcgagtggacgcggaagagcggcgggcggaggagcgaagagggncgttcggtggatgtacgcgcgtaggttgtgtatgagggtggtgatggtgcggtggatgagatggagtggggttgtttttaagagcggtgtacgggtggcgacgtgtgtcggggggagagatggtggcgggcgagattcgcgtatggtgtgtgagagggttgtaaagatgcgttggaagatatggtatggcggttcgatgaggagagagaaaggcggtatttttt

SEQ ID NO: 11346 - DNA, 1460 bp, Artificial Sequence
  chemically treated genomic DNA (Homo sapiens) CpG-island No: 11346
  misc_feature (225)..(225): n is either a, c, g or t
  misc_feature (419)..(419): n is either a, c, g or t
  misc_feature (651)..(651): n is either a, c, g or t
  misc_feature (678)..(678): n is either a, c, g or t
  misc_feature (1211)..(1211): n is either a, c, g or t
  misc_feature (1320)..(1320): n is either a, c, g or t
  misc_feature (1329)..(1329): n is either a, c, g or t
  misc_feature (1335)..(1335): n is either a, c, g or t
  misc_feature (1363)..(1363): n is either a, c, g or t
  misc_feature (1386)..(1386): n is either a, c, g or t
  misc_feature (1423)..(1423): n is either a, c, g or t
aaaaaataccgcctttctctctcctcatcgaaccgccataccatatcttccaacgcatctttacaaccctctcacacaccatacgcgaatctcgcccgccaccatctctccccccgacacacgtcgccacccgtacaccgctcttaaaaacaaccccactccatctcatccaccgcaccatcaccaccctcatacacaacctacgcgcgtacatccaccgaacgnccctcttcgctcctccgcccgccgctcttccgcgtccactcgaccgcgttaaacacaccctcctcgaccacccatcgccacgcttcccccgcgacgaccgccgtccaccacgcctctcctctcgctcacacccgccactcgccccgcgacacgccaaaaccacaacgcccgcctccaacgcgccgccgctccanaccgcgcgtcgtctcgcgccgccgctcgtccgaacgacctcgcgcctctacacctcatcgccgcgcatccaacacgccaacattcgtacctacgcactcccacccatcatcccccgtcgtaacacatcacccgccaccaacatcccgtcacaacgcaaacaacatacccgcatccaacgccgcgcccatctcgcccacttcccaccgtcgccgcacacctcgtctccgcganacgccgccgcaatccgactcgccgcgnaccctcctctcccgcctactctcaccccacgcctcgccgcacaacgaacgaacatcgtcctcgcacacgaccgatctacacgttcgacgtacaccgccccaaacgtttctcccccacgctccaccgcaccgttcgctcccacaccgcaccgcgcacacgctcgcccacacgctctcgcactcgcacataaccaaacctccaaccccgactcaattcgcatacgcgtacgacaaaacccctacgtcgactacgccatacgcccgccccctcccaacgaatcctaacaactccctacgcgtaccttcactccatacaacgacaactcgcgcgaaacaccatcgaacacgcacttcgtacaaccaccgccacaacgacgctacccactcaccataacgacgcaataacgccaaactcgaacacccacgctatacgaaaacgaaaaacaaaaacgcacgaaaaacatcctcgaccaaactacgtcgcatcgtccaacgcgtcgaaacacgacaaacgacgaacatacacctacgcanaaaatcatccccgtcgacgtacaccgtacgactaacactcgatccacacaaccgaatccgcgcaacgcatatcgaaacatccgcatcgcgtaacacgcgaacgcgacgnaacaccacntcgacnacgcgcgacgcctaatatacactcctancccgcaacgacgctaacgacgcnacgaacactcgacgcaatacacgtcatacatccatcnaatccgacactcacgacgcacaaatcacgaacgacac

SEQ ID NO: 11347 - DNA, 1460 bp, Artificial Sequence
  chemically treated genomic DNA (Homo sapiens) CpG-island No: 11347
  misc_feature (225)..(225): n is either a, c, g or t
  misc_feature (419)..(419): n is either a, c, g or t
  misc_feature (651)..(651): n is either a, c, g or t
  misc_feature (678)..(678): n is either a, c, g or t
  misc_feature (1211)..(1211): n is either a, c, g or t
  misc_feature (1320)..(1320): n is either a, c, g or t
  misc_feature (1329)..(1329): n is either a, c, g or t
  misc_feature (1335)..(1335): n is either a, c, g or t
  misc_feature (1363)..(1363): n is either a, c, g or t
  misc_feature (1386)..(1386): n is either a, c, g or t
  misc_feature (1423)..(1423): n is either a, c, g or t
aaaaagtatcgtttttttttttttttatcgagtcgttatattatattttttaacgtatttttataatttttttatatattatacgcgggtttcgttcgttattattttttttttcgatatacgtcgttattcgtgtatcgtttttaaggataattttattttattttatttatcgtattattattatttttatatataatttacgcgcgtatatttatcgagcgntttttttcgttttttcgttcgtcgttttttcgcgtttattcgatcgcgttgaatatatttttttcgattatttatcgttacgtttttttcgcgacgatcgtcgtttattacgttttttttttcgtttatattcgttattcgtttcgcggtacgttaggattatagcgttcgtttttagcgcgtcgtcgttttangtcgcgcgtcgtttcgcgtcgtcgttcgttcgagcggtttcgcgtttttatattttatcgtcgcgtatttagtacgttagtattcgtatttgcgtatttttatttattatttttcgtcgtgatatattattcgttattagtatttcgttatagcgtagataatatattcgtatttagcgtcgcgtttatttcgtttattttttatcgtcgtcgtatatttcgttttcgcganacgtcgtcgtaattcggttcgtcgcgngtttttttttttcgtttatttttattttacgtttcgtcgtataacgggcgggtatcgttttcgtatacggtcgatttatacgttcggcgtatatcgttttaggcgttttttttttacgttttatcgtatcgttcgtttttatatcgtatcgcgtatacgttcgtttatacgttttcgtattcgtatatggttaggtttttagtttcgatttagttcgtatgcgcgtgcgatagagtttttgcgtcgattgcgttatgcgttcgtttttttttaacgggttttggtaattttttgcgcgtgtttttattttatgtagcgataattcgcgcggagtattatcggatacgtatttcgtgtagttatcgttatagcggcgttatttatttattatggcggcgtaatgacgttaagttcggatatttacgttgtacgagaacgagagatagaggcgtacggagagtattttcggttagattacgtcgtatcgtttagcgcgtcgaggtacggtaagcgacggatatgtatttacgtanggagttattttcgtcggcgtgtatcgtgcgattggtattcgatttatatagtcggattcgcgtaacgtatgtcgaggtattcgtatcgcgtagtacgcgagcgcgacgngatattatntcgatnacgcgcggcgtttaatatatatttttanttcgtagcgacgttggcggcgtnacgagtattcgacgtaatatacgttatatatttattngattcggtatttacggcgtatagattacgagcgatat

SEQ ID NO: 11348 - DNA, 1460 bp, Artificial Sequence
  chemically treated genomic DNA (Homo sapiens) CpG-island No: 11348
  misc_feature (38)..(38): n is either a, c, g or t
  misc_feature (75)..(75): n is either a, c, g or t
  misc_feature (98)..(98): n is either a, c, g or t
  misc_feature (126)..(126): n is either a, c, g or t
  misc_feature (132)..(132): n is either a, c, g or t
  misc_feature (141)..(141): n is either a, c, g or t
  misc_feature (250)..(250): n is either a, c, g or t
  misc_feature (783)..(783): n is either a, c, g or t
  misc_feature (810)..(810): n is either a, c, g or t
  misc_feature (1042)..(1042): n is either a, c, g or t
  misc_feature (1236)..(1236): n is either a, c, g or t
atatcgctcgtaatctatacgccgtaaataccgaatcnaataaatatataacgtatattacgtcgaatactcgtnacgccgccaacgtcgctacgaantaaaaatatatattaaacgccgcgcgtnatcganataatatcncgtcgcgctcgcgtactacgcgatacgaatacctcgacatacgttacgcgaatccgactatataaatcgaataccaatcgcacgatacacgccgacgaaaataactccntacgtaaatacatatccgtcgcttaccgtacctcgacgcgctaaacgatacgacgtaatctaaccgaaaatactctccgtacgcctctatctctcgttctcgtacaacgtaaatatccgaacttaacgtcattacgccgccataataaataaataacgccgctataacgataactacacgaaatacgtatccgataatactccgcgcgaattatcgctacataaaataaaaacacgcgcaaaaaattaccaaaacccgttaaaaaaaaacgaacgcataacgcaatcgacgcaaaaactctatcgcacgcgcatacgaactaaatcgaaactaaaaacctaaccatatacgaatacgaaaacgtataaacgaacgtatacgcgatacgatataaaaacgaacgatacgataaaacgtaaaaaaaaaacgcctaaaacgatatacgccgaacgtataaatcgaccgtatacgaaaacgatacccgcccgttatacgacgaaacgtaaaataaaaataaacgaaaaaaaaaaacncgcgacgaaccgaattacgacgacgtntcgcgaaaacgaaatatacgacgacgataaaaaataaacgaaataaacgcgacgctaaatacgaatatattatctacgctataacgaaatactaataacgaataatatatcacgacgaaaaataataaataaaaatacgcaaatacgaatactaacgtactaaatacgcgacgataaaatataaaaacgcgaaaccgctcgaacgaacgacgacgcgaaacgacgcgcgacntaaaacgacgacgcgctaaaaacgaacgctataatcctaacgtaccgcgaaacgaataacgaatataaacgaaaaaaaaaacgtaataaacgacgatcgtcgcgaaaaaaacgtaacgataaataatcgaaaaaaatatattcaacgcgatcgaataaacgcgaaaaaacgacgaacgaaaaaacgaaaaaaancgctcgataaatatacgcgcgtaaattatatataaaaataataataatacgataaataaaataaaataaaattatccttaaaaacgatacacgaataacgacgtatatcgaaaaaaaaaataataacgaacgaaacccgcgtataatatataaaaaaattataaaaatacgttaaaaaatataatataacgactcgataaaaaaaaaaaaaaacgatacttttt

SEQ ID NO: 11349 - DNA, 764 bp, Artificial Sequence
  chemically treated genomic DNA (Homo sapiens) CpG-island No: 11349
gtcgcgtattagggcgttgttgcggcgtttttttcgtatgttgttggtggatcggttgtcggggttgtagggcgcgttggatttgttggtcgtgttgtgcgtggacggttcgggtcgtgcgcgttaggttgtttgttgcgtggcgcgttcgggtatatcgagtttgttgcgtttcgcgttcgcgtcgttgttgtagagcgcgttagacgttaagggtcgcgtgcgttgttttatcgtcgggttcgaggtggcggcgtagttgtttgtagtgcgttagttgttgttttgcgcgcgcgtgtagatttgtcgcgcgtagggtttggagacgttttttagtaaggcgtaggagttgggcggtttcggtcgcgaggatcggggtttgtggtcgtttttgtgtcgtttggttgtcgcgtcgtcgttcgtagttatcgacgaggcgttggttgagttttacgtttacggtttagtcgttttcgtggattatttcgagcgtaattgggagtttcgtcgcgatatgtgggttcgttttcgcgttttcgaggcggttagagatttggacgcgtgtgttttggtgcgaggttatcgtcggcgattgttgcgtcgttttagtttttcgcgtggcgtggcgtagtgttttcgcgatttggtggttatgtagtgggtcgacgcggtcggggaggcggtgttcgaggggttcgatggcggggggttttggttggaggatgagttagggaggggagtttagggggagaacgagagggtga

SEQ ID NO: 11350 - DNA, 764 bp, Artificial Sequence
  chemically treated genomic DNA (Homo sapiens) CpG-island No: 11350
tcaccctctcgttctccccctaaactcccctccctaactcatcctccaaccaaaaccccccgccatcgaacccctcgaacaccgcctccccgaccgcgtcgacccactacataaccaccaaatcgcgaaaacactacgccacgccacgcgaaaaactaaaacgacgcaacaatcgccgacgataacctcgcaccaaaacacacgcgtccaaatctctaaccgcctcgaaaacgcgaaaacgaacccacatatcgcgacgaaactcccaattacgctcgaaataatccacgaaaacgactaaaccgtaaacgtaaaactcaaccaacgcctcgtcgataactacgaacgacgacgcgacaaccaaacgacacaaaaacgaccacaaaccccgatcctcgcgaccgaaaccgcccaactcctacgccttactaaaaaacgtctccaaaccctacgcgcgacaaatctacacgcgcgcgcaaaacaacaactaacgcactacaaacaactacgccgccacctcgaacccgacgataaaacaacgcacgcgacccttaacgtctaacgcgctctacaacaacgacgcgaacgcgaaacgcaacaaactcgatatacccgaacgcgccacgcaacaaacaacctaacgcgcacgacccgaaccgtccacgcacaacacgaccaacaaatccaacgcgccctacaaccccgacaaccgatccaccaacaacatacgaaaaaaacgccgcaacaacgccctaatacgcgac

SEQ ID NO: 11351 - DNA, 764 bp, Artificial Sequence
  chemically treated genomic DNA (Homo sapiens) CpG-island No: 11351
ttattttttcgttttttttttgggtttttttttttggtttattttttagttaaggtttttcgttatcgggtttttcgggtatcgttttttcggtcgcgtcggtttattgtatggttattaggtcgcgaaggtattgcgttacgttacgcgaggggttgagacgacgtagtagtcgtcggcggtggtttcgtattagggtatacgcgtttaggtttttggtcgtttcgaaggcgcggaagcggatttatatgtcgcggcggggtttttagttgcgttcgaagtagtttacgaaggcggttgggtcgtgggcgtggagtttagttagcgtttcgtcggtagttgcgggcgacgacgcggtagttaggcggtataggagcgattataggtttcggttttcgcggtcggggtcgtttagtttttgcgttttgttgaagagcgtttttaggttttgcgcgcggtagatttgtacgcgcgcgtagggtagtagttggcgtattgtaggtaattgcgtcgttatttcgggttcggcggtgaggtagcgtacgcggtttttgacgtttggcgcgttttgtagtagcgacgcgagcgcgaagcgtagtaggttcggtgtgttcgggcgcgttacgtagtaggtagtttggcgcgtacggttcgagtcgtttacgtatagtacggttagtagatttagcgcgttttgtagtttcggtagtcggtttattagtagtatgcgagggaagcgtcgtagtagcgttttggtgcgcgat

SEQ ID NO: 11352 - DNA, 764 bp, Artificial Sequence
  chemically treated genomic DNA (Homo sapiens) CpG-island No: 11352
atcgcgcaccaaaacgctactacgacgcttccctcgcatactactaataaaccgactaccgaaactacaaaacgcgctaaatctactaaccgtactatacgtaaacgactcgaaccgtacgcgccaaactacctactacgtaacgcgcccgaacacaccgaacctactacgcttcgcgctcgcgtcgctactacaaaacgcgccaaacgtcaaaaaccgcgtacgctacctcaccgccgaacccgaaataacgacgcaattacctacaatacgccaactactaccctacgcgcgcgtacaaatctaccgcgcgcaaaacctaaaaacgctcttcaacaaaacgcaaaaactaaacgaccccgaccgcgaaaaccgaaacctataatcgctcctataccgcctaactaccgcgtcgtcgcccgcaactaccgacgaaacgctaactaaactccacgcccacgacccaaccgccttcgtaaactacttcgaacgcaactaaaaaccccgccgcgacatataaatccgcttccgcgccttcgaaacgaccaaaaacctaaacgcgtataccctaatacgaaaccaccgccgacgactactacgtcgtctcaacccctcgcgtaacgtaacgcaataccttcgcgacctaataaccatacaataaaccgacgcgaccgaaaaaacgatacccgaaaaacccgataacgaaaaaccttaactaaaaaataaaccaaaaaaaaaaacccaaaaaaaaaacgaaaaaataa

SEQ ID NO: 11353 - DNA, 958 bp, Artificial Sequence
  chemically treated genomic DNA (Homo sapiens) CpG-island No: 11353
attattcggtttaggttgggaatattgagcgtttcggagttaattattattgcgtcgtagtcgttgatcgttatgtattgttgcgcgttttgttagttttagattttatcgttggtaattatcggaatatttagtcgttgggatatatcgttaatcgtttgttagttaatatgtttcgcgcggtaattttgttttttcgttcgtttattgtattattagtttcgtagcgttaggttgttgaatcggtatcggcgattttaaatttttttttagcggtgttttaggtttagacgtatttttacgttgacgggtaaatgcgtcggtatagttttacgtatcggttttgtattttggtagatgagtttaggatttttgagtaacgtcgtttcgtcgtcgttatcgttaatcgttttcgacgggtagtcgtaattgagatttacgttttaggaatttaattttatcgtacgggcggcgttttttgttagttattgtgggaattgatttaataattgtacgcgtattagcgtattagatggtgtcgaggtagaaggaatttattttaacggagtagaagcgtattagacgttgtatatttcgtggaaatcgtatgtttcgtacgttttgaggatgtttttttgtgttcgtttcgtataatttacggtttagcgatttagtattattatttttttcggttttattatattttttgttggattaaaatcgtttaggtttgttagtaggaagcgcgcggtgttatagggtagttattatttcggtaatggtattattaaatagatttgcgagtaaatagaaaatgtttgtaacggtacggttattaacgttgatttttattcggatgcgttttcgggttttggtaaatagtcgcggtgattgtcgtaatatcgacggaataaacgtcgaaaggggaaaaaattagtgttagtaatttagtaaatat

SEQ ID NO: 11354 - DNA, 958 bp, Artificial Sequence
  chemically treated genomic DNA (Homo sapiens) CpG-island No: 11354
atatttactaaattactaacactaattttttcccctttcgacgtttattccgtcgatattacgacaatcaccgcgactatttaccaaaacccgaaaacgcatccgaataaaaatcaacgttaataaccgtaccgttacaaacattttctatttactcgcaaatctatttaataataccattaccgaaataataactaccctataacaccgcgcgcttcctactaacaaacctaaacgattttaatccaacaaaaaatataataaaaccgaaaaaaataataatactaaatcgctaaaccgtaaattatacgaaacgaacacaaaaaaacatcctcaaaacgtacgaaacatacgatttccacgaaatatacaacgtctaatacgcttctactccgttaaaataaattccttctacctcgacaccatctaatacgctaatacgcgtacaattattaaatcaattcccacaataactaacaaaaaacgccgcccgtacgataaaattaaattcctaaaacgtaaatctcaattacgactacccgtcgaaaacgattaacgataacgacgacgaaacgacgttactcaaaaatcctaaactcatctaccaaaatacaaaaccgatacgtaaaactataccgacgcatttacccgtcaacgtaaaaatacgtctaaacctaaaacaccgctaaaaaaaaatttaaaatcgccgataccgattcaacaacctaacgctacgaaactaataatacaataaacgaacgaaaaaacaaaattaccgcgcgaaacatattaactaacaaacgattaacgatatatcccaacgactaaatattccgataattaccaacgataaaatctaaaactaacaaaacgcgcaacaatacataacgatcaacgactacgacgcaataataattaactccgaaacgctcaatattcccaacctaaaccgaataat

SEQ ID NO: 11355 - DNA, 958 bp, Artificial Sequence
  chemically treated genomic DNA (Homo sapiens) CpG-island No: 11355
gtatttattggattgttggtattggtttttttttttttcggcgtttatttcgtcggtattgcggtaattatcgcggttatttgttaaagttcggaagcgtattcggataaagattaacgttggtggtcgtgtcgttgtaggtattttttatttgttcgtaggtttgtttggtagtgttattatcgggatgatggttgttttgtaatatcgcgcgttttttgttggtaaatttgaacggttttgatttagtaaaagatatggtgaaatcggaagagatggtggtattggatcgttgggtcgtaggttgtgcgaaacgggtataggaagatatttttaaggcgtacgaagtatacgatttttacgaagtgtatagcgtttgatgcgtttttgtttcgttgagatgggttttttttatttcgatattatttggtacgttggtgcgcgtgtagttgttaggttagtttttataatggttggtagagaacgtcgttcgtgcggtggagttaggtttttggggcgtggattttaattgcggttgttcgtcgaaaacggttaacggtagcggcggcggggcgacgttatttaaagattttgaatttatttattagggtgtaaaatcgatgcgtgaagttgtatcggcgtatttgttcgttagcgtgaaagtgcgtttgggtttgggatatcgttgagaagaaatttgaaatcgtcgatgtcggtttaatagtttggcgttacggagttggtggtgtaatgggcggacgaaagagtagggttatcgcgcggagtatattgattggtaggcgattggcgatatattttagcggttgaatatttcggtgattgttaacggtgaaatttgggattggtagagcgcgtaataatgtatggcgattagcggttgcgacgtagtgatgattggtttcggggcgtttaatatttttaatttgagtcgggtggt

SEQ ID NO: 11356 - DNA, 958 bp, Artificial Sequence
  chemically treated genomic DNA (Homo sapiens) CpG-island No: 11356
accacccgactcaaattaaaaatattaaacgccccgaaaccaatcatcactacgtcgcaaccgctaatcgccatacattattacgcgctctaccaatcccaaatttcaccgttaacaatcaccgaaatattcaaccgctaaaatatatcgccaatcgcctaccaatcaatatactccgcgcgataaccctactctttcgtccgcccattacaccaccaactccgtaacgccaaactattaaaccgacatcgacgatttcaaatttcttctcaacgatatcccaaacccaaacgcactttcacgctaacgaacaaatacgccgatacaacttcacgcatcgattttacaccctaataaataaattcaaaatctttaaataacgtcgccccgccgccgctaccgttaaccgttttcgacgaacaaccgcaattaaaatccacgccccaaaaacctaactccaccgcacgaacgacgttctctaccaaccattataaaaactaacctaacaactacacgcgcaccaacgtaccaaataatatcgaaataaaaaaaacccatctcaacgaaacaaaaacgcatcaaacgctatacacttcgtaaaaatcgtatacttcgtacgccttaaaaatatcttcctatacccgtttcgcacaacctacgacccaacgatccaataccaccatctcttccgatttcaccatatcttttactaaatcaaaaccgttcaaatttaccaacaaaaaacgcgcgatattacaaaacaaccatcatcccgataataacactaccaaacaaacctacgaacaaataaaaaatacctacaacgacacgaccaccaacgttaatctttatccgaatacgcttccgaactttaacaaataaccgcgataattaccgcaataccgacgaaataaacgccgaaaaaaaaaaaaaccaataccaacaatccaataaatac

SEQ ID NO: 11357 - DNA, 517 bp, Artificial Sequence
  chemically treated genomic DNA (Homo sapiens) CpG-island No: 11357
  misc_feature (180)..(180): n is either a, c, g or t
ttggaagtatttagacgttgacgcgaataaaacgtaaagtgcgtttggttgttggtttgaatagcgaaaatgttttttttaatgaagtaatggagcgcggttggtaatgtttgcgtttgtttgttgaacgtttgtaagatatttttttttcgtaaattcgcgttgtcgttacgggcgatntacgttttgtcgttaatgcgggtgattttattgttaaagcgtaggaaattttcggttgttcggtataggtgattagcggtgaagaggaagtacgtttgatttattagggcgttgtttatattattggtggtgtcggattagcgtttggtggtggatataggcggatagtattgaattggtaatcggtacggtgtatagatatttcgttgttcggttgtcgatgggttgggtaattggttggacgttatttggcgatcgaatttggggcggaaaatttgaggtgtagaaaagcggaggaagtgttacgtcggttgcgatgattacggtattaggttgg

SEQ ID NO: 11358 - DNA, 517 bp, Artificial Sequence
  chemically treated genomic DNA (Homo sapiens) CpG-island No: 11358
  misc_feature (338)..(338): n is either a, c, g or t
ccaacctaataccgtaatcatcgcaaccgacgtaacacttcctccgcttttctacacctcaaattttccgccccaaattcgatcgccaaataacgtccaaccaattacccaacccatcgacaaccgaacaacgaaatatctatacaccgtaccgattaccaattcaatactatccgcctatatccaccaccaaacgctaatccgacaccaccaataatataaacaacgccctaataaatcaaacgtacttcctcttcaccgctaatcacctataccgaacaaccgaaaatttcctacgctttaacaataaaatcacccgcattaacgacaaaacgtanatcgcccgtaacgacaacgcgaatttacgaaaaaaaaatatcttacaaacgttcaacaaacaaacgcaaacattaccaaccgcgctccattacttcattaaaaaaaacattttcgctattcaaaccaacaaccaaacgcactttacgttttattcgcgtcaacgtctaaatacttccaa

SEQ ID NO: 11359 - DNA, 517 bp, Artificial Sequence
  chemically treated genomic DNA (Homo sapiens) CpG-island No: 11359
  misc_feature (338)..(338): n is either a, c, g or t
ttagtttgatatcgtaattatcgtaatcgacgtaatatttttttcgtttttttgtattttaaatttttcgttttagattcgatcgttaaatagcgtttagttagttatttagtttatcgatagtcgaataacgaggtgtttgtgtatcgtgtcggttattagtttagtattgttcgtttatatttattattaggcgttgattcggtattattagtggtgtgagtaacgttttgataaattagacgtgttttttttttatcgttgattatttgtatcggataatcgagaattttttgcgttttggtaataaaattattcgtattgacggtaaggcgtanatcgttcgtagcgataacgcgaatttgcgagggaggaatattttgtagacgtttagtaaataggcgtaaatattgttaatcgcgttttattgttttattggagagggtattttcgttatttaggttagtagttagacgtattttgcgttttattcgcgttagcgtttggatgtttttag

SEQ ID NO: 11360 - DNA, 517 bp, Artificial Sequence
  chemically treated genomic DNA (Homo sapiens) CpG-island No: 11360
  misc_feature (180)..(180): n is either a, c, g or t
ctaaaaacatccaaacgctaacgcgaataaaacgcaaaatacgtctaactactaacctaaataacgaaaataccctctccaataaaacaataaaacgcgattaacaatatttacgcctatttactaaacgtctacaaaatattcctccctcgcaaattcgcgttatcgctacgaacgatntacgccttaccgtcaatacgaataattttattaccaaaacgcaaaaaattctcgattatccgatacaaataatcaacgataaaaaaaaaacacgtctaatttatcaaaacgttactcacaccactaataataccgaatcaacgcctaataataaatataaacgaacaatactaaactaataaccgacacgatacacaaacacctcgttattcgactatcgataaactaaataactaactaaacgctatttaacgatcgaatctaaaacgaaaaatttaaaatacaaaaaaacgaaaaaaatattacgtcgattacgataattacgatatcaaactaa

SEQ ID NO: 11361 - DNA, 964 bp, Artificial Sequence
  chemically treated genomic DNA (Homo sapiens) CpG-island No: 11361
gggtttttcgtatttcgggagtttgtcggaataattatatacgttacggcgcgttgaatcgcgtttattcgtttcggtaggttttgtcgggatcggcgggtcgtagattggtgtttattcgttggtaacgtcgggtggttggtagttgattggttatattttatttagtttgtttgattcggcgcgtgacgaatttattttattacgttcgggagatagcgtgcgttttgtatcgtagaaggagggagtatgttgaagattattcgtgcgggtatgtatattattgtgtaggatggcggtcgttacggttttcgttagtcgggtattagttattgcggcgtattggatatgttcgcgttacgtattgttaatttattggtgggtaatgacgttaatgttttcgcgttggagattacgttcggttagttaattgttgagttcgaaattgatgggtggtttgttttgacgggtgtcggttgcgaagcgcggttggatgataatgtcgtttggatcggttggcgattgtcgatgaaagtaggttagcgtttaacgtttaaacgttcgtagtacgggatgcgtagttatttggcggtcgcgggtggtattgatgtttcgtcggtaatgggtttatgtagtatcgattttaaagtggggattggcgggttggaaggtcgtttattgaaggatggtgatcgattttcgattggtaaatcgaagcgtgattttatggaagttagggcgttaaatagttgttgtggggtaatttattcgcgttttgtcggggtcggaatattattagttcgatcgcgtttcgtaggatgtattcgtggttcgttttggtagtttagttcgtaaagtaatcgcgcggtattaatataggattttaggtattttgtatttacgtttaattagtatttatattttttttatggtatgcgtgggattcgtgtattttcggtgtggg

SEQ ID NO: 11362 - DNA, 964 bp, Artificial Sequence
  chemically treated genomic DNA (Homo sapiens) CpG-island No: 11362
cccacaccgaaaatacacgaatcccacgcataccataaaaaaaatataaatactaattaaacgtaaatacaaaatacctaaaatcctatattaataccgcgcgattactttacgaactaaactaccaaaacgaaccacgaatacatcctacgaaacgcgatcgaactaataatattccgaccccgacaaaacgcgaataaattaccccacaacaactatttaacgccctaacttccataaaatcacgcttcgatttaccaatcgaaaatcgatcaccatccttcaataaacgaccttccaacccgccaatccccactttaaaatcgatactacataaacccattaccgacgaaacatcaataccacccgcgaccgccaaataactacgcatcccgtactacgaacgtttaaacgttaaacgctaacctactttcatcgacaatcgccaaccgatccaaacgacattatcatccaaccgcgcttcgcaaccgacacccgtcaaaacaaaccacccatcaatttcgaactcaacaattaactaaccgaacgtaatctccaacgcgaaaacattaacgtcattacccaccaataaattaacaatacgtaacgcgaacatatccaatacgccgcaataactaatacccgactaacgaaaaccgtaacgaccgccatcctacacaataatatacatacccgcacgaataatcttcaacatactccctccttctacgatacaaaacgcacgctatctcccgaacgtaataaaataaattcgtcacgcgccgaatcaaacaaactaaataaaatataaccaatcaactaccaaccacccgacgttaccaacgaataaacaccaatctacgacccgccgatcccgacaaaacctaccgaaacgaataaacgcgattcaacgcgccgtaacgtatataattattccgacaaactcccgaaatacgaaaaaccc

SEQ ID NO: 11363 - DNA, 964 bp, Artificial Sequence
  chemically treated genomic DNA (Homo sapiens) CpG-island No: 11363
tttatatcgaagatgtacgggttttacgtatattatggagggaatatagatgttagttggacgtgagtgtaggatgtttgaggttttgtattgatatcgcgcgattattttgcgagttaagttgttagggcgaattacggatgtattttgcgaggcgcgatcgaattgatgatatttcggtttcggtaaggcgcgaatggattgttttatagtagttgtttaacgttttggtttttatagaattacgtttcgatttgttaatcgggagtcggttattattttttagtaaacggttttttagttcgttaatttttattttgagatcggtgttgtatgagtttattatcggcggaatattaatattattcgcgatcgttagataattgcgtatttcgtgttgcgggcgtttaagcgttaaacgttggtttgtttttatcggtaatcgttagtcggtttagacggtattattatttagtcgcgtttcgtaatcggtattcgttagagtaaattatttattagtttcgaatttaatagttaattgatcgagcgtgatttttagcgcgggggtattggcgttattatttattagtaggttagtaatgcgtaacgcgggtatatttagtgcgtcgtagtggttgatattcgattggcgaaaatcgtgacgatcgttattttgtatagtggtatatatgttcgtacgaataatttttagtatattttttttttttgcggtataaagcgtacgttgtttttcggacgtaataagatgggttcgttacgcgtcggattaaataggttgagtgaggtatgattaattaattgttagttattcggcgttgttagcggataaatattagtttgcggttcgtcgatttcgatagaatttgtcggaacgagtaagcgcggtttagcgcgtcgtggcgtgtgtagttgtttcggtaaattttcgagatacgggaagttt

SEQ ID NO: 11364 - DNA, 964 bp, Artificial Sequence
  chemically treated genomic DNA (Homo sapiens) CpG-island No: 11364
aaacttcccgtatctcgaaaatttaccgaaacaactacacacgccacgacgcgctaaaccgcgcttactcgttccgacaaattctatcgaaatcgacgaaccgcaaactaatatttatccgctaacaacgccgaataactaacaattaattaatcatacctcactcaacctatttaatccgacgcgtaacgaacccatcttattacgtccgaaaaacaacgtacgctttataccgcaaaaaaaaaaaatatactaaaaattattcgtacgaacatatataccactatacaaaataacgatcgtcacgattttcgccaatcgaatatcaaccactacgacgcactaaatatacccgcgttacgcattactaacctactaataaataataacgccaatacccccgcgctaaaaatcacgctcgatcaattaactattaaattcgaaactaataaataatttactctaacgaataccgattacgaaacgcgactaaataataataccgtctaaaccgactaacgattaccgataaaaacaaaccaacgtttaacgcttaaacgcccgcaacacgaaatacgcaattatctaacgatcgcgaataatattaatattccgccgataataaactcatacaacaccgatctcaaaataaaaattaacgaactaaaaaaccgtttactaaaaaataataaccgactcccgattaacaaatcgaaacgtaattctataaaaaccaaaacgttaaacaactactataaaacaatccattcgcgccttaccgaaaccgaaatatcatcaattcgatcgcgcctcgcaaaatacatccgtaattcgccctaacaacttaactcgcaaaataatcgcgcgatatcaatacaaaacctcaaacatcctacactcacgtccaactaacatctatattccctccataatatacgtaaaacccgtacatcttcgatataaa

SEQ ID NO: 11365 - DNA, 606 bp, Artificial Sequence
  chemically treated genomic DNA (Homo sapiens) CpG-island No: 11365
ggtttgaattgttagttggcgtaggtagtagagcgggtaaattggttcggattagggtcgtaagaaaattatttcgatcgttttattgtcgtttgttttgatcgttgggatttgttattgttagatatgtatatttcgtacgttttttcgagcgaaaacggtttgcgttgcgggacgcgcgaattgaattatggtttatattagtggcgcggcgatttttagtttaatattagtcgttatagttaatagtaattgatggaaattagttatcgttatttgtgtacgcggaagattttagagttgtttgttgtattcgattattcgcgttgacgggtttttcgtattaggtcgcgatttaggttattgttgaattggaatcgttcgatcgcgaattgtttggcggtattgttattttgtatgaaaatggcgttttagttagtgtcgcgattcgtggcgatggtattatcggggaagatattacgtttaatgtgcgtattattcgcgttatttcgttgaagtatagtcgttttaggcgttatgtgggttggttacgattagtgttatttgcgttttttttgggagaaataggttatttatcgacgagaa

SEQ ID NO: 11366 - DNA, 606 bp, Artificial Sequence
  chemically treated genomic DNA (Homo sapiens) CpG-island No: 11366
ttctcgtcgataaataacctatttctcccaaaaaaaacgcaaataacactaatcgtaaccaacccacataacgcctaaaacgactatacttcaacgaaataacgcgaataatacgcacattaaacgtaatatcttccccgataataccatcgccacgaatcgcgacactaactaaaacgccattttcatacaaaataacaataccgccaaacaattcgcgatcgaacgattccaattcaacaataacctaaatcgcgacctaatacgaaaaacccgtcaacgcgaataatcgaatacaacaaacaactctaaaatcttccgcgtacacaaataacgataactaatttccatcaattactattaactataacgactaatattaaactaaaaatcgccgcgccactaatataaaccataattcaattcgcgcgtcccgcaacgcaaaccgttttcgctcgaaaaaacgtacgaaatatacatatctaacaataacaaatcccaacgatcaaaacaaacgacaataaaacgatcgaaataattttcttacgaccctaatccgaaccaatttacccgctctactacctacgccaactaacaattcaaacc

SEQ ID NO: 11367 - DNA, 606 bp, Artificial Sequence
  chemically treated genomic DNA (Homo sapiens) CpG-island No: 11367
ttttcgtcggtgagtagtttgttttttttaaaagaagcgtaaatggtattagtcgtagttagtttatatgacgtttaaaacgattatgttttagcggaatggcgcgaatagtacgtatattagacgtgatatttttttcggtggtgttatcgttacgggtcgcggtattgattaaaacgttatttttatatagaataataatgtcgttaaatagttcgcggtcgaacggttttagtttagtaataatttgggtcgcggtttgatgcgggaaattcgttagcgcgggtggtcggatgtagtagatagttttagagtttttcgcgtgtatagatggcgatggttggtttttattagttgttgttgattgtagcggttgatgttgaattggaagtcgtcgcgttattggtgtgggttataatttaattcgcgcgtttcgtagcgtagatcgttttcgttcgggaagacgtacggggtatatatgtttgataatggtagattttagcggttaaaataggcggtagtaaggcggtcgggatagtttttttgcggttttaattcgagttagtttattcgttttgttatttgcgttagttggtagtttaggtt

SEQ ID NO: 11368 - DNA, 606 bp, Artificial Sequence
  chemically treated genomic DNA (Homo sapiens) CpG-island No: 11368
aacctaaactaccaactaacgcaaataacaaaacgaataaactaactcgaattaaaaccgcaaaaaaactatcccgaccgccttactaccgcctattttaaccgctaaaatctaccattatcaaacatatataccccgtacgtcttcccgaacgaaaacgatctacgctacgaaacgcgcgaattaaattataacccacaccaataacgcgacgacttccaattcaacatcaaccgctacaatcaacaacaactaataaaaaccaaccatcgccatctatacacgcgaaaaactctaaaactatctactacatccgaccacccgcgctaacgaatttcccgcatcaaaccgcgacccaaattattactaaactaaaaccgttcgaccgcgaactatttaacgacattattattctatataaaaataacgttttaatcaataccgcgacccgtaacgataacaccaccgaaaaaaatatcacgtctaatatacgtactattcgcgccattccgctaaaacataatcgttttaaacgtcatataaactaactacgactaataccatttacgcttcttttaaaaaaaacaaactactcaccgacgaaaa

SEQ ID NO: 11369 - DNA, 524 bp, Artificial Sequence
  chemically treated genomic DNA (Homo sapiens) CpG-island No: 11369
tttggttcgcgtttgtgtttgggtgggggtgttgggggacgacggtgtgttgggtggttttttgttgtggttgggggttgtcggtcggtcgttggtcgttttgcgtgtcgatttggtcgtttgtgtcggcgttgtttgcgtttgcgtgtcgtttgtggtgttgtcgatttgtgtcgcgttggttcgtgttggttgttcgttggtggaagcggcgttggggtttcggtgtacgatcgttgaagacgttttttgttgtggtcgtgtcgttgattaaaggtggggttgttgtcggatcgatgttggtgtttgtttcggttgtgggcgagtttgtgatttcggaattgttcggtggttcggatagtatcgtgatcgggcgcgtgttatggtaagagttttttaataatcgcgattggtcggtggttcggcggtacgattattatgttgttgttgttaattgtgtcgatgatgtggttttaaaatattagtaaaaaagcgtgggagaatacgggtgagtggtttgtcgg

SEQ ID NO: 11370 - DNA, 524 bp, Artificial Sequence
  chemically treated genomic DNA (Homo sapiens) CpG-island No: 11370
ccgacaaaccactcacccgtattctcccacgcttttttactaatattttaaaaccacatcatcgacacaattaacaacaacaacataataatcgtaccgccgaaccaccgaccaatcgcgattattaaaaaactcttaccataacacgcgcccgatcacgatactatccgaaccaccgaacaattccgaaatcacaaactcgcccacaaccgaaacaaacaccaacatcgatccgacaacaaccccacctttaatcaacgacacgaccacaacaaaaaacgtcttcaacgatcgtacaccgaaaccccaacgccgcttccaccaacgaacaaccaacacgaaccaacgcgacacaaatcgacaacaccacaaacgacacgcaaacgcaaacaacgccgacacaaacgaccaaatcgacacgcaaaacgaccaacgaccgaccgacaacccccaaccacaacaaaaaaccacccaacacaccgtcgtcccccaacacccccacccaaacacaaacgcgaaccaaa

SEQ ID NO: 11371 - DNA, 524 bp, Artificial Sequence
  chemically treated genomic DNA (Homo sapiens) CpG-island No: 11371
tcggtaaattatttattcgtgtttttttacgtttttttgttggtgttttggaattatattatcggtataattagtagtagtaatatgatgatcgtatcgtcgagttatcggttagtcgcggttattgaaaaatttttgttatagtacgcgttcgattacgatgttgttcgggttatcgagtagtttcgggattataaattcgtttatagtcgggataaatattagtatcgattcggtaataattttatttttagttagcggtacgattatagtaaagaacgtttttagcggtcgtgtatcgagattttagcgtcgtttttattagcgaataattaatacgaattaacgcggtataaatcggtagtattataaacggtacgtaagcgtaaataacgtcgatataaacggttagatcggtacgtagaacggttagcggtcgatcgataatttttagttatagtagaaaattatttagtatatcgtcgttttttaatatttttatttaggtataaacgcggattaga

SEQ ID NO: 11372 - DNA, 524 bp, Artificial Sequence
  chemically treated genomic DNA (Homo sapiens) CpG-island No: 11372
tctaatccgcgtttatacctaaataaaaatattaaaaaacgacgatatactaaataattttctactataactaaaaattatcgatcgaccgctaaccgttctacgtaccgatctaaccgtttatatcgacgttatttacgcttacgtaccgtttataatactaccgatttataccgcgttaattcgtattaattattcgctaataaaaacgacgctaaaatctcgatacacgaccgctaaaaacgttctttactataatcgtaccgctaactaaaaataaaattattaccgaatcgatactaatatttatcccgactataaacgaatttataatcccgaaactactcgataacccgaacaacatcgtaatcgaacgcgtactataacaaaaatttttcaataaccgcgactaaccgataactcgacgatacgatcatcatattactactactaattataccgataatataattccaaaacaccaacaaaaaaacgtaaaaaaacacgaataaataatttaccga

SEQ ID NO: 11373 - DNA, 1053 bp, Artificial Sequence
  chemically treated genomic DNA (Homo sapiens) CpG-island No: 11373
gtcgaattacgtagtgtcgggtttggtaagtgtacgtcggcgagtaggtaggtcgagaaaaagcggcggaaaagtttaggaggcgttaatgttgggttttacggaagtaaggtaggaagggaagtattaaatggtcgcgtttggtatgttattgttacgttagtggcgagggtcgcggtgggtacggtgcgtatgtggcgtaggaaaaaggttaggggttatttgggtcgcgagggagggtcgggggttcgtaattcgtcgaggttaagcgggaggcgagatttgcggcgtcggttaggagtcgcgagtttttaagttcggtggtgggatttcggagcgacgtgtagtgggcgattagtgtgcggggaaggtcggtgggggaggttcgaggagggggtcgtattcgggggggaggtggggcgcggaggcgcgggtggagggtggaaggatttcgcgaggttagaatgttcgggagaaaacggtgggggcgggagagtttcgtgacgggatatgggggacgggggagcgcggggggggcgggtgggggtacgcgggagagtgttcgagaaggtggtcggagggaggagggcgggaggcggaggcgtcggggagggtcgagaggaggagggcgagaggcgggtggaggagggcgcggggtggtttgtatgtttgtagtcggtaattattttttataatttgagtgtattgttttgatgaatcgaatttatgcgtgtttcgttgcggatgtgtcggaggttgaggtttttcggatcgatatttcgttcgttatcgttttgtttaacgttggcggcgagttttatgttattaacgatcgttgtagttatggtaatgcgttaatgttagaagggtatttggaagatgacgttacggtggagtgttcgttatacgtcgttagtttttgtttgaaaacggggaaagcgttatgtttgttcgttatcgattcgtttattatttatttagtatacgttgaaggtggtgatatttttatcgatttatcggagcgtatattgagcgatttgtataacgagttta

SEQ ID NO: 11374 - DNA, 1053 bp, Artificial Sequence
  chemically treated genomic DNA (Homo sapiens) CpG-island No: 11374
taaactcgttatacaaatcgctcaatatacgctccgataaatcgataaaaatatcaccaccttcaacgtatactaaataaataataaacgaatcgataacgaacaaacataacgctttccccgttttcaaacaaaaactaacgacgtataacgaacactccaccgtaacgtcatcttccaaatacccttctaacattaacgcattaccataactacaacgatcgttaataacataaaactcgccgccaacgttaaacaaaacgataacgaacgaaatatcgatccgaaaaacctcaacctccgacacatccgcaacgaaacacgcataaattcgattcatcaaaacaatacactcaaattataaaaaataattaccgactacaaacatacaaaccaccccgcgccctcctccacccgcctctcgccctcctcctctcgaccctccccgacgcctccgcctcccgccctcctccctccgaccaccttctcgaacactctcccgcgtacccccacccgccccccccgcgctcccccgtcccccatatcccgtcacgaaactctcccgcccccaccgttttctcccgaacattctaacctcgcgaaatccttccaccctccacccgcgcctccgcgccccacctcccccccgaatacgaccccctcctcgaacctcccccaccgaccttccccgcacactaatcgcccactacacgtcgctccgaaatcccaccaccgaacttaaaaactcgcgactcctaaccgacgccgcaaatctcgcctcccgcttaacctcgacgaattacgaacccccgaccctccctcgcgacccaaataacccctaacctttttcctacgccacatacgcaccgtacccaccgcgaccctcgccactaacgtaacaataacataccaaacgcgaccatttaatacttcccttcctaccttacttccgtaaaacccaacattaacgcctcctaaacttttccgccgctttttctcgacctacctactcgccgacgtacacttaccaaacccgacactacgtaattcgac

SEQ ID NO: 11375 - DNA, 1053 bp, Artificial Sequence
  chemically treated genomic DNA (Homo sapiens) CpG-island No: 11375
tggattcgttatgtagatcgtttagtgtgcgtttcggtaagtcgatgaaaatgttattatttttaacgtgtattggataagtggtgagcggatcggtggcgggtaggtataacgtttttttcgtttttaggtaaaaattggcggcgtgtagcgggtattttatcgtggcgttattttttagatatttttttgatattgacgtattattatggttgtaacgatcgttaatggtataaaattcgtcgttaacgttgaatagggcgatgacgggcgaggtatcgattcggagagttttagttttcggtatattcgtaacgggatacgtataaattcgatttattagaatagtatatttaggttatgggaagtgattatcgattgtaggtatgtaggttatttcgcgtttttttttattcgtttttcgttttttttttttcggtttttttcggcgttttcgtttttcgttttttttttttcggttattttttcgggtattttttcgcgtatttttattcgtttttttcgcgttttttcgttttttatgtttcgttacggggttttttcgtttttatcgttttttttcgggtattttggtttcgcggaatttttttattttttattcgcgttttcgcgttttatttttttttcgggtgcggtttttttttcgggttttttttatcggtttttttcgtatattggtcgtttattgtacgtcgtttcgggattttattatcgggtttggaaattcgcggtttttggtcgacgtcgtaggtttcgtttttcgtttaatttcggcgggttacggattttcggttttttttcgcggtttaggtggtttttaattttttttttgcgttatatgcgtatcgtgtttatcgcggttttcgttattggcgtaatagtgatatgttaggcgcgattatttggtatttttttttttgttttattttcgtgggatttagtattggcgttttttggattttttcgtcgttttttttcggtttgtttgttcgtcggcgtgtatttgttaggttcggtattgcgtggttcggt

SEQ ID NO: 11376 - DNA, 1053 bp, Artificial Sequence
  chemically treated genomic DNA (Homo sapiens) CpG-island No: 11376
accgaaccacgcaataccgaacctaacaaatacacgccgacgaacaaacaaaccgaaaaaaaacgacgaaaaaatccaaaaaacgccaatactaaatcccacgaaaataaaacaaaaaaaaaaataccaaataatcgcgcctaacatatcactattacgccaataacgaaaaccgcgataaacacgatacgcatataacgcaaaaaaaaaattaaaaaccacctaaaccgcgaaaaaaaaccgaaaatccgtaacccgccgaaattaaacgaaaaacgaaacctacgacgtcgaccaaaaaccgcgaatttccaaacccgataataaaatcccgaaacgacgtacaataaacgaccaatatacgaaaaaaaccgataaaaaaaacccgaaaaaaaaaccgcacccgaaaaaaaaataaaacgcgaaaacgcgaataaaaaataaaaaaattccgcgaaaccaaaatacccgaaaaaaaacgataaaaacgaaaaaaccccgtaacgaaacataaaaaacgaaaaaacgcgaaaaaaacgaataaaaatacgcgaaaaaatacccgaaaaaataaccgaaaaaaaaaaaacgaaaaacgaaaacgccgaaaaaaaccgaaaaaaaaaaaacgaaaaacgaataaaaaaaaacgcgaaataacctacatacctacaatcgataatcacttcccataacctaaatatactattctaataaatcgaatttatacgtatcccgttacgaatataccgaaaactaaaactctccgaatcgatacctcgcccgtcatcgccctattcaacgttaacgacgaattttataccattaacgatcgttacaaccataataatacgtcaatatcaaaaaaatatctaaaaaataacgccacgataaaatacccgctacacgccgccaatttttacctaaaaacgaaaaaaacgttatacctacccgccaccgatccgctcaccacttatccaatacacgttaaaaataataacattttcatcgacttaccgaaacgcacactaaacgatctacataacgaatcca

SEQ ID NO: 11377 - DNA, 793 bp, Artificial Sequence
  chemically treated genomic DNA (Homo sapiens) CpG-island No: 11377
  misc_feature (457)..(458): n is either a, c, g or t
ggatcgggattagggttggcgttggtcgagcgatttatcgaagaaggcgcgtaggttgttacgttggaattgtcggcggtaaaagtcgttagtttgcgttacgatttggcgaatatattttggcggtggaaggtaacgtgatttgttatgtcgattattaacgcgcggtcgattagattttgattcgtttcggtaagttggattgttttatcggtaatgtaggtatttgggattataatgttttattggttaatattttcgtagagacgttcgaaatcggtttttacgagttgtttaacgttaatgttttcggttatttgttgggcgtaaaagtttgcgtttcgcgttaatcgttagtgaaggtagtatgatttttatattgttaaatgtcgtttggtatttttggcggtgtggttcgttgtatatcgttagtaaatatgtcgtaatcggatttatnntttaattggtttatgaattggtatcgaaagtgcgggtgaatggcgtcggttcgtgtggtatgtttagcgatttgcgcggtttataggcgttcgggtaaagtgaaatttcgataatgtagtttttgacgtcggagaaaattgtcgttattttatcgttgtaatttttttcgtaatcggcggattttacggggtcgtatgtgatgttgatatcgcggcgtaataatcgcgtattaagcggtgtgatgattaacgttgatgcgggtttagcgattcgcgtattcgttacgtagcggttgggttggatttttaaggaagtacgatgaaagaaaaaacga

SEQ ID NO: 11378 - DNA, 793 bp, Artificial Sequence
  chemically treated genomic DNA (Homo sapiens) CpG-island No: 11378
  misc_feature (336)..(337): n is either a, c, g or t
tcgttttttctttcatcgtacttccttaaaaatccaacccaaccgctacgtaacgaatacgcgaatcgctaaacccgcatcaacgttaatcatcacaccgcttaatacgcgattattacgccgcgatatcaacatcacatacgaccccgtaaaatccgccgattacgaaaaaaattacaacgataaaataacgacaattttctccgacgtcaaaaactacattatcgaaatttcactttacccgaacgcctataaaccgcgcaaatcgctaaacataccacacgaaccgacgccattcacccgcactttcgataccaattcataaaccaattaaannataaatccgattacgacatatttactaacgatatacaacgaaccacaccgccaaaaataccaaacgacatttaacaatataaaaatcatactaccttcactaacgattaacgcgaaacgcaaacttttacgcccaacaaataaccgaaaacattaacgttaaacaactcgtaaaaaccgatttcgaacgtctctacgaaaatattaaccaataaaacattataatcccaaatacctacattaccgataaaacaatccaacttaccgaaacgaatcaaaatctaatcgaccgcgcgttaataatcgacataacaaatcacgttaccttccaccgccaaaatatattcgccaaatcgtaacgcaaactaacgacttttaccgccgacaattccaacgtaacaacctacgcgccttcttcgataaatcgctcgaccaacgccaaccctaatcccgatcc

SEQ ID NO: 11379 - DNA, 793 bp, Artificial Sequence
  chemically treated genomic DNA (Homo sapiens) CpG-island No: 11379
  misc_feature (336)..(337): n is either a, c, g or t
tcgtttttttttttatcgtgtttttttaaagatttagtttagtcgttacgtggcgaatgcgcgaatcgttaaattcgtattagcgttgattattatatcgtttaatgcgcgattattgcgtcgcgatgttaatattatatacggtttcgtaaaattcgtcggttgcgggaaaaattgtagcggtaaaatggcggtaatttttttcggcgttagagattgtattatcgaggttttattttgttcgagcgtttgtgggtcgcgtaggtcgttgggtatattatacgggtcgacgttatttattcgtattttcggtgttagtttataagttagttgggnnataagttcggttgcggtatgtttattggcggtgtatagcgggttatatcgttagggatattaggcggtatttgatagtgtgaaaattatgttgtttttattggcgattaacgcggagcgtaggtttttgcgtttagtaggtaatcgagaatattgacgttaaatagttcgtggaagtcggtttcgagcgtttttgcgggagtattaattagtgaggtattgtgattttagatgtttgtattgtcgataaaataatttagtttgtcggaacgagttaggatttgatcgatcgcgcgttgataatcggtataataggttacgttattttttatcgttagaatatgttcgttaaatcgtgacgtagattggcgatttttgtcgtcgatagttttagcgtggtaatttgcgcgtttttttcgataaatcgttcgattagcgttagttttaatttcgattt

SEQ ID NO: 11380 - DNA, 793 bp, Artificial Sequence
  chemically treated genomic DNA (Homo sapiens) CpG-island No: 11380
  misc_feature (457)..(458): n is either a, c, g or t
aaatcgaaattaaaactaacgctaatcgaacgatttatcgaaaaaaacgcgcaaattaccacgctaaaactatcgacgacaaaaatcgccaatctacgtcacgatttaacgaacatattctaacgataaaaaataacgtaacctattataccgattatcaacgcgcgatcgatcaaatcctaactcgttccgacaaactaaattattttatcgacaatacaaacatctaaaatcacaatacctcactaattaatactcccgcaaaaacgctcgaaaccgacttccacgaactatttaacgtcaatattctcgattacctactaaacgcaaaaacctacgctccgcgttaatcgccaataaaaacaacataattttcacactatcaaataccgcctaatatccctaacgatataacccgctatacaccgccaataaacataccgcaaccgaacttatnncccaactaacttataaactaacaccgaaaatacgaataaataacgtcgacccgtataatatacccaacgacctacgcgacccacaaacgctcgaacaaaataaaacctcgataatacaatctctaacgccgaaaaaaattaccgccattttaccgctacaatttttcccgcaaccgacgaattttacgaaaccgtatataatattaacatcgcgacgcaataatcgcgcattaaacgatataataatcaacgctaatacgaatttaacgattcgcgcattcgccacgtaacgactaaactaaatctttaaaaaaacacgataaaaaaaaaaacga

SEQ ID NO: 11381 - DNA, 567 bp, Artificial Sequence
  chemically treated genomic DNA (Homo sapiens) CpG-island No: 11381
tggtatagcgattgcggatcgttggtttagatcggtaagatacgtatgttatcgttgtaaataaagttgtcgtcgtagtttacgtttatatttgtaatattttttggcggaataagatttagcggcgttggcgtttggttagttagataacgttgataaatcgatattgtttcgttggtattatatagtttggtcggttggttgttattacggtcgatttaggtgatggttatcgtgttgtcgttaatgttcgtaaattaggtatttacgttattgttggtagttttgtttttttgttagatgtaggttcgggtatttcgttttaagttgacgattcgtatcgcgttgtattattgttgtatggttatagtgttagatacgtcgttgcgtcggaatagcgcgttcgtttgcggaagttttgatatagtattttgtaattttcgcgattatcgaacgtaacgagatatgtttgtacgggtattacgttggcgatggtttgggattcggggaagtatgggggggagtaatttatttaagtttttatcggagtttttttgagatattttt

SEQ ID NO: 11382 - DNA, 567 bp, Artificial Sequence
  chemically treated genomic DNA (Homo sapiens) CpG-island No: 11382
aaaaatatctcaaaaaaactccgataaaaacttaaataaattactcccccccatacttccccgaatcccaaaccatcgccaacgtaatacccgtacaaacatatctcgttacgttcgataatcgcgaaaattacaaaatactatatcaaaacttccgcaaacgaacgcgctattccgacgcaacgacgtatctaacactataaccatacaacaataatacaacgcgatacgaatcgtcaacttaaaacgaaatacccgaacctacatctaacaaaaaaacaaaactaccaacaataacgtaaatacctaatttacgaacattaacgacaacacgataaccatcacctaaatcgaccgtaataacaaccaaccgaccaaactatataataccaacgaaacaatatcgatttatcaacgttatctaactaaccaaacgccaacgccgctaaatcttattccgccaaaaaatattacaaatataaacgtaaactacgacgacaactttatttacaacgataacatacgtatcttaccgatctaaaccaacgatccgcaatcgctatacca

SEQ ID NO: 11383 - DNA, 567 bp, Artificial Sequence
  chemically treated genomic DNA (Homo sapiens) CpG-island No: 11383
gggggtattttagaggggtttcgatagagatttgaatagattatttttttttatattttttcgggttttagattatcgttagcgtgatattcgtgtaagtatatttcgttgcgttcggtaatcgcgaagattgtaaagtgttgtattagagttttcgtaggcgaacgcgttgtttcggcgtagcggcgtatttgatattatgattatgtagtagtggtataacgcggtacgggtcgttagtttggggcgaaatattcgaatttgtatttggtaggaaaataggattattaataataacgtagatatttggtttgcgggtattgacggtagtacggtgattattatttgggtcggtcgtgataataattagtcgattaaattgtatggtgttagcggggtaatgtcgatttattagcgttatttggttaattagacgttaacgtcgttgaattttgtttcgttagaagatattgtagatatgggcgtggattacgacggtaattttgtttgtagcggtggtatgcgtattttgtcggtttggattagcgattcgtaatcgttgtgtta

SEQ ID NO: 11384 - DNA, 567 bp, Artificial Sequence
  chemically treated genomic DNA (Homo sapiens) CpG-island No: 11384
taacacaacgattacgaatcgctaatccaaaccgacaaaatacgcataccaccgctacaaacaaaattaccgtcgtaatccacgcccatatctacaatatcttctaacgaaacaaaattcaacgacgttaacgtctaattaaccaaataacgctaataaatcgacattaccccgctaacaccatacaatttaatcgactaattattatcacgaccgacccaaataataatcaccgtactaccgtcaatacccgcaaaccaaatatctacgttattattaataatcctattttcctaccaaatacaaattcgaatatttcgccccaaactaacgacccgtaccgcgttataccactactacataatcataatatcaaatacgccgctacgccgaaacaacgcgttcgcctacgaaaactctaatacaacactttacaatcttcgcgattaccgaacgcaacgaaatatacttacacgaatatcacgctaacgataatctaaaacccgaaaaaatataaaaaaaaataatctattcaaatctctatcgaaacccctctaaaataccccc

SEQ ID NO: 11385 - DNA, 557 bp, Artificial Sequence
  chemically treated genomic DNA (Homo sapiens) CpG-island No: 11385
cgttttcgtaaagtaatatagggtagtagcgtatttttttatgcgcgatgtagattagtggttattacggggttagtttggtcggcgaatttttatattttagtaggttaatttgtcgaagtgtattcgttttgttcgtcggagtaggtcgaaggttattagtagatgattgcgtagttggttgattggttggtgaaattgatcggttacgacgtcgtttgtatgtagtcgaattttggcgtatagggcgaatacgcgggtttgttggcgattcgttattattatgaaagtcgtaacgaagggtatcgcgatatttgtttgatttcggtttttgcgtacggaattaatttcgtttttgtatatatggtaggaatgtacgtggtggttgtggcgtgtgataaaaacggtaatatcgatttgattgatttgcgcgcgaaatcggaataggtcgggcgataattttttttgtattatggtgatttatttttttatttacggcgtgtatgaagaaacgattcgtgaagtgtgtgaagtcgtgtattagttcggcggttagg

SEQ ID NO: 11386 - DNA, 557 bp, Artificial Sequence
  chemically treated genomic DNA (Homo sapiens) CpG-island No: 11386
cctaaccgccgaactaatacacgacttcacacacttcacgaatcgtttcttcatacacgccgtaaataaaaaaataaatcaccataatacaaaaaaaattatcgcccgacctattccgatttcgcgcgcaaatcaatcaaatcgatattaccgtttttatcacacgccacaaccaccacgtacattcctaccatatatacaaaaacgaaattaattccgtacgcaaaaaccgaaatcaaacaaatatcgcgatacccttcgttacgactttcataataataacgaatcgccaacaaacccgcgtattcgccctatacgccaaaattcgactacatacaaacgacgtcgtaaccgatcaatttcaccaaccaatcaaccaactacgcaatcatctactaataaccttcgacctactccgacgaacaaaacgaatacacttcgacaaattaacctactaaaatataaaaattcgccgaccaaactaaccccgtaataaccactaatctacatcgcgcataaaaaaatacgctactaccctatattactttacgaaaacg

SEQ ID NO: 11387 - DNA, 557 bp, Artificial Sequence
  chemically treated genomic DNA (Homo sapiens) CpG-island No: 11387
tttgatcgtcgaattgatgtacgattttatatattttacggatcgtttttttatatacgtcgtgggtagaaggataagttattatgatataggagaggttatcgttcggtttgtttcggtttcgcgcgtagattagttagatcgatgttgtcgtttttattatacgttataattattacgtgtatttttgttatatgtgtagaagcggggttagtttcgtgcgtagaagtcgggattaggtagatatcgcgatgtttttcgttgcggtttttatgataatgacgaatcgttagtaggttcgcgtattcgttttgtgcgttagagttcggttgtatataaacggcgtcgtaatcggttagttttattagttagttagttagttgcgtaattatttgttgataattttcggtttgtttcggcgggtagaacgggtgtatttcggtaaattgatttgttagagtataagggttcgtcgattaggttggtttcgtgataattattggtttatatcgcgtatgagagggtgcgttattgttttgtgttgttttgcggaaacg

SEQ ID NO: 11388 - DNA, 557 bp, Artificial Sequence
  chemically treated genomic DNA (Homo sapiens) CpG-island No: 11388
cgtttccgcaaaacaacacaaaacaataacgcaccctctcatacgcgatataaaccaataattatcacgaaaccaacctaatcgacgaacccttatactctaacaaatcaatttaccgaaatacacccgttctacccgccgaaacaaaccgaaaattatcaacaaataattacgcaactaactaactaactaataaaactaaccgattacgacgccgtttatatacaaccgaactctaacgcacaaaacgaatacgcgaacctactaacgattcgtcattatcataaaaaccgcaacgaaaaacatcgcgatatctacctaatcccgacttctacgcacgaaactaaccccgcttctacacatataacaaaaatacacgtaataattataacgtataataaaaacgacaacatcgatctaactaatctacgcgcgaaaccgaaacaaaccgaacgataacctctcctatatcataataacttatccttctacccacgacgtatataaaaaaacgatccgtaaaatatataaaatcgtacatcaattcgacgatcaaa

SEQ ID NO: 11389 - DNA, 762 bp, Artificial Sequence
  chemically treated genomic DNA (Homo sapiens) CpG-island No: 11389
tttgttttttttgcgggttaatacggtgtattttttagtcgacgttgttgtttattatttttgttattattattggcgttttttttttacgttagtcggtcgtgatttttgttaatatcgtagtcggagatttttcgtttaggcgcgtgagttgtttttgattgtttgttttttaggtagtggtcgttttgataaagttaggcgcgtagattggtcgatttttagttaattgcgatgtagcgagttgttatgtgattttttttaattttcgtgtcgagttggcgattatggtaagcgtcgtttgttttgtcgtatcgtcgttttgatgtcgtatcgtatcgaatagcgttttatgtttttggagcgtttgcggtatgttggttttatcgtttatttaggttcgtttaaaaatcgttcgttgtagcgaattgatcgtaatgttaagttgttgtaatatcgggttatgtatcgattgtagtatcgtttcgtggtagcgaatattcgtttcgttaaacgtttcggggttttggattgttggtaattatttcgtttagcgtcgatttaatttgcgttagatcgttggaagtcgcgcgttttgttgtttaacggaagttcgtcggtttttattagatttcgtatttcgtttatgggtattgataagttttgggtcgtagttattttttaggatttattgtagtacgttagtgtcgaggtaattttattggttacgcggtgtataaacgtttcgtttaacgttttatt

SEQ ID NO: 11390 - DNA, 762 bp, Artificial Sequence
  chemically treated genomic DNA (Homo sapiens) CpG-island No: 11390
aataaaacgttaaacgaaacgtttatacaccgcgtaaccaataaaattacctcgacactaacgtactacaataaatcctaaaaaataactacgacccaaaacttatcaatacccataaacgaaatacgaaatctaataaaaaccgacgaacttccgttaaacaacaaaacgcgcgacttccaacgatctaacgcaaattaaatcgacgctaaacgaaataattaccaacaatccaaaaccccgaaacgtttaacgaaacgaatattcgctaccacgaaacgatactacaatcgatacataacccgatattacaacaacttaacattacgatcaattcgctacaacgaacgatttttaaacgaacctaaataaacgataaaaccaacataccgcaaacgctccaaaaacataaaacgctattcgatacgatacgacatcaaaacgacgatacgacaaaacaaacgacgcttaccataatcgccaactcgacacgaaaattaaaaaaaatcacataacaactcgctacatcgcaattaactaaaaatcgaccaatctacgcgcctaactttatcaaaacgaccactacctaaaaaacaaacaatcaaaaacaactcacgcgcctaaacgaaaaatctccgactacgatattaacaaaaatcacgaccgactaacgtaaaaaaaaaacgccaataataataacaaaaataataaacaacaacgtcgactaaaaaatacaccgtattaacccgcaaaaaaaacaaa

SEQ ID NO: 11391 - DNA, 762 bp, Artificial Sequence
  chemically treated genomic DNA (Homo sapiens) CpG-island No: 11391
aatgaaacgttaagcggggcgtttgtgtatcgcgtaattagtggaattatttcgatattgacgtattgtaatgggttttggaaaatgattacgatttaaggtttattagtgtttatgagcgaagtgcgaaatttggtggaaatcggcggattttcgttgggtagtagagcgcgcgatttttagcgatttggcgtagattgaatcggcgttgaacgagatgattgttaataatttaggatttcgaagcgtttaacgaagcggatattcgttattacgaggcggtgttgtagtcggtgtataattcggtgttatagtaatttagtattgcgattagttcgttgtagcgggcggtttttgaacgaatttggatgggcgatgaggttaatatgtcgtaaacgttttaggaatataaggcgttgttcgatgcgatacgatattaggacggcgatgcggtagagtaggcggcgtttattatgatcgttagttcgatacgaaggttaaaggaaattatatgatagttcgttatatcgtaattgattggggatcgattaatttgcgcgtttggttttattagggcgattattgtttggagagtaggtaattagaagtagtttacgcgtttgaacggaaaattttcggttgcggtgttagtagaagttacgatcgattggcgtgaagagaaaacgttagtggtaatggtaggaatggtaggtagtaacgtcggttggaaagtgtatcgtattgattcgtagggaggataag

SEQ ID NO: 11392 - DNA, 762 bp, Artificial Sequence
  chemically treated genomic DNA (Homo sapiens) CpG-island No: 11392
cttatcctccctacgaatcaatacgatacactttccaaccgacgttactacctaccattcctaccattaccactaacgttttctcttcacgccaatcgatcgtaacttctactaacaccgcaaccgaaaattttccgttcaaacgcgtaaactacttctaattacctactctccaaacaataatcgccctaataaaaccaaacgcgcaaattaatcgatccccaatcaattacgatataacgaactatcatataatttcctttaaccttcgtatcgaactaacgatcataataaacgccgcctactctaccgcatcgccgtcctaatatcgtatcgcatcgaacaacgccttatattcctaaaacgtttacgacatattaacctcatcgcccatccaaattcgttcaaaaaccgcccgctacaacgaactaatcgcaatactaaattactataacaccgaattatacaccgactacaacaccgcctcgtaataacgaatatccgcttcgttaaacgcttcgaaatcctaaattattaacaatcatctcgttcaacgccgattcaatctacgccaaatcgctaaaaatcgcgcgctctactacccaacgaaaatccgccgatttccaccaaatttcgcacttcgctcataaacactaataaaccttaaatcgtaatcattttccaaaacccattacaatacgtcaatatcgaaataattccactaattacgcgatacacaaacgccccgcttaacgtttcatt

SEQ ID NO: 11393 - DNA, 902 bp, Artificial Sequence
  chemically treated genomic DNA (Homo sapiens) CpG-island No: 11393
cgcgtgattttttcgtcgttgataataatttcgttttgtttatatttttttagtttaataatcgtttttagtaatttattgcgttttgtttttagtagattagtaatgtcgagtatttcgttacgacgtagcgtaaaattgatattttttagtttgggtttatggcgtaacgtacggatttttagtacggtttgatttataattttttgaggggttatcggcgtaatattaacgtgatcgcgttcgagtattagcgatataatatgaatgcgtggaggtgttttcgagtattatatcgtttcgttatttgattatcgcgtataacggtggtataggaggtaatgcggcgaattttttttattcggtggttgatataaattatcgttacgtttagtgtcgatattttttttatcgcgttgattattagtttaattttcgtattcgtaagcgaattggtaggtttattaagaatgattacgcgcggttcgttttttattattcgcgtaatttttattagttgtttttgcgtcgggtttagcgttgaaataagttgtttaggattaacgttaacgtttagcgtttgtaagtaacgttgggtattttgcgttatttgtaggtaattaattatgtcgttgcggcggggttattgatcgaggtagaggtttttcgttattgttagtttttttattagatttaatttttgataaatcgcgcgtatttttagtttagcggtacggcgagttagcgtagtttcgttattttttagtcgcgtttcgttaatttagatattatcgttattcgggcgttcgttgtcggtaagtattcgaatgagagtcgatttgttcgcgtcgtttttatttaatagcgtacgaatttcgtttttattgagcgtgaagttaacg

SEQ ID NO: 11394 - DNA, 902 bp, Artificial Sequence
  chemically treated genomic DNA (Homo sapiens) CpG-island No: 11394
cgttaacttcacgctcaataaaaacgaaattcgtacgctattaaataaaaacgacgcgaacaaatcgactctcattcgaatacttaccgacaacgaacgcccgaataacgataatatctaaattaacgaaacgcgactaaaaaataacgaaactacgctaactcgccgtaccgctaaactaaaaatacgcgcgatttatcaaaaattaaatctaataaaaaaactaacaataacgaaaaacctctacctcgatcaataaccccgccgcaacgacataattaattacctacaaataacgcaaaatacccaacgttacttacaaacgctaaacgttaacgttaatcctaaacaacttatttcaacgctaaacccgacgcaaaaacaactaataaaaattacgcgaataataaaaaacgaaccgcgcgtaatcattcttaataaacctaccaattcgcttacgaatacgaaaattaaactaataatcaacgcgataaaaaaaatatcgacactaaacgtaacgataatttatatcaaccaccgaataaaaaaaattcgccgcattacctcctataccaccgttatacgcgataatcaaataacgaaacgatataatactcgaaaacacctccacgcattcatattatatcgctaatactcgaacgcgatcacgttaatattacgccgataacccctcaaaaaattataaatcaaaccgtactaaaaatccgtacgttacgccataaacccaaactaaaaaatatcaattttacgctacgtcgtaacgaaatactcgacattactaatctactaaaaacaaaacgcaataaattactaaaaacgattattaaactaaaaaaatataaacaaaacgaaattattatcaacgacgaaaaaatcacgcg

SEQ ID NO: 11395 - DNA, 902 bp, Artificial Sequence
  chemically treated genomic DNA (Homo sapiens) CpG-island No: 11395
cgttaattttacgtttaataaaggcgaagttcgtgcgttgttaggtaaaaacggcgcgggtaaatcgatttttattcgaatgtttatcggtagcgaacgttcggatagcggtgatatttggattggcgagacgcgattggaaggtgacgaagttacgttgattcgtcgtgtcgttgaattgggggtgcgcgcggtttattaggagttaagtttggtggaagggttgatagtggcggaaaatttttgtttcggttagtggtttcgtcgtaacggtatgattgattatttgtaaatggcgtaggatgtttaacgttgtttataggcgttgggcgttgacgttagttttgaataatttgttttaacgttaagttcggcgtaaaagtagttggtggaaattgcgcgggtgatgaagggcgagtcgcgcgtggttatttttgatgaatttattagttcgtttgcgagtgcggaagttgaattggtgattagcgcggtgaaaaagatgtcggtattgggcgtggcggtgatttatgttagttatcggatggaagaaattcgtcgtattgttttttgtgttatcgttatgcgcgatggttaggtggcggggcgatgtgatgttcgaaaatatttttacgtatttatattgtgtcgttgatgttcgggcgcgattacgttgatattgcgtcggtagttttttaggaaattgtggattaggtcgtgttggaagttcgtgcgttacgttataagtttaagttggaggatattagttttacgttacgtcgtggcgaagtgttcggtattgttggtttgttgggggtagggcgtagtgaattgttgaaggcgattgttgggttggaggagtatgaatagggcgaaattgttattaacggcgagaaaattacgcg

SEQ ID NO: 11396 - DNA, 902 bp, Artificial Sequence
  chemically treated genomic DNA (Homo sapiens) CpG-island No: 11396
cgcgtaattttctcgccgttaataacaatttcgccctattcatactcctccaacccaacaatcgccttcaacaattcactacgccctacccccaacaaaccaacaataccgaacacttcgccacgacgtaacgtaaaactaatatcctccaacttaaacttataacgtaacgcacgaacttccaacacgacctaatccacaatttcctaaaaaactaccgacgcaatatcaacgtaatcgcgcccgaacatcaacgacacaatataaatacgtaaaaatattttcgaacatcacatcgccccgccacctaaccatcgcgcataacgataacacaaaaaacaatacgacgaatttcttccatccgataactaacataaatcaccgccacgcccaataccgacatctttttcaccgcgctaatcaccaattcaacttccgcactcgcaaacgaactaataaattcatcaaaaataaccacgcgcgactcgcccttcatcacccgcgcaatttccaccaactacttttacgccgaacttaacgttaaaacaaattattcaaaactaacgtcaacgcccaacgcctataaacaacgttaaacatcctacgccatttacaaataatcaatcataccgttacgacgaaaccactaaccgaaacaaaaattttccgccactatcaacccttccaccaaacttaactcctaataaaccgcgcgcacccccaattcaacgacacgacgaatcaacgtaacttcgtcaccttccaatcgcgtctcgccaatccaaatatcaccgctatccgaacgttcgctaccgataaacattcgaataaaaatcgatttacccgcgccgtttttacctaacaacgcacgaacttcgcctttattaaacgtaaaattaacg

SEQ ID NO: 11397 - DNA, 820 bp, Artificial Sequence
  chemically treated genomic DNA (Homo sapiens) CpG-island No: 11397
  misc_feature (815)..(815): n is either a, c, g or t
ggggcgggcgggatattgcgtgcggtaaatgtcgtgtatgtaggttatatcgttggtaggttttttacggtcgggttatagcgatagcgcgttttaatatttattagttcgttttggttggcgggtgtcgattgtcggttcgttatattttgtaattagttttggtgtatggtttgtacgtaattttttatcgttttagtacggttcggtatcgtttcgtcgatttagacgtcgagttttataggcgtattacgcgcgatatcgcgttcgaaattgggcgggattttaatcgttatcgtgatatcgttcgtacgtattcgacgattaagttcgttataattggtgagcggcggttgttcgataaagtaacgggaatcggagaggttgagtgtttacgtttggttattgacggtttggtcgcggtcgagtatcgtaaagcgtaggttttttatatttatattgatgtcgtaatttattattagtattaggattatcgtttttattagcgttagcgtcgaacgtattggatcgcgtcgtagttttagcgtttcgcggcggttgtagttaaatagacggcgtaggttaaatttttgacgcggcgcgtgggtggtgtcgtgtattacgggcggcgtttcggtttcgttgttttgttttgtcgttttttgtaaataggcgataaatgttttttttagattggcggtttcgcgttttttaattagtttttgcggtgtatcgttggtaagtattttttcggcgtgtattagtgagatgcggtcgtaatcgttcgtttttttataaaatgggtggagatgaanaatat

SEQ ID NO: 11398 - DNA, 820 bp, Artificial Sequence
  chemically treated genomic DNA (Homo sapiens) CpG-island No: 11398
  misc_feature (6)..(6): n is either a, c, g or t
atattnttcatctccacccattttataaaaaaacgaacgattacgaccgcatctcactaatacacgccgaaaaaatacttaccaacgatacaccgcaaaaactaattaaaaaacgcgaaaccgccaatctaaaaaaaacatttatcgcctatttacaaaaaacgacaaaacaaaacaacgaaaccgaaacgccgcccgtaatacacgacaccacccacgcgccgcgtcaaaaatttaacctacgccgtctatttaactacaaccgccgcgaaacgctaaaactacgacgcgatccaatacgttcgacgctaacgctaataaaaacgataatcctaatactaataataaattacgacatcaatataaatataaaaaacctacgctttacgatactcgaccgcgaccaaaccgtcaataaccaaacgtaaacactcaacctctccgattcccgttactttatcgaacaaccgccgctcaccaattataacgaacttaatcgtcgaatacgtacgaacgatatcacgataacgattaaaatcccgcccaatttcgaacgcgatatcgcgcgtaatacgcctataaaactcgacgtctaaatcgacgaaacgataccgaaccgtactaaaacgataaaaaattacgtacaaaccatacaccaaaactaattacaaaatataacgaaccgacaatcgacacccgccaaccaaaacgaactaataaatattaaaacgcgctatcgctataacccgaccgtaaaaaacctaccaacgatataacctacatacacgacatttaccgcacgcaatatcccgcccgcccc

SEQ ID NO: 11399 - DNA, 820 bp, Artificial Sequence
  chemically treated genomic DNA (Homo sapiens) CpG-island No: 11399
  misc_feature (6)..(6): n is either a, c, g or t
atattntttatttttatttattttataaagaagcggacggttgcgatcgtattttattgatgtacgtcggaaaagtgtttgttagcggtatatcgtaggaattggttgagaaacgcggagtcgttagtttggaagaggtatttatcgtttatttgtaggaagcggtagggtagagtaacgaagtcgaagcgtcgttcgtggtatacgatattatttacgcgtcgcgttagggatttagtttgcgtcgtttgtttagttatagtcgtcgcgaagcgttggaattgcgacgcgatttagtacgttcgacgttggcgttgatgggaacggtgattttgatgttgataatgggttacggtattagtatggatgtggaaaatttgcgttttgcggtgttcgatcgcgattagatcgttagtagttaggcgtggatatttaattttttcggttttcgttattttatcgaatagtcgtcgtttattagttatgacgagtttgatcgtcggatgcgtgcgggcgatattacggtggcgattgagatttcgtttaatttcgggcgcgatatcgcgcgtggtacgtttgtggaattcggcgtttggatcgacggagcgatgtcgagtcgtgttgaaacggtaaaaggttacgtgtaggttatgtattagagttggttataggatgtggcgagtcgataatcgatattcgttagttaaagcgggttgatgaatattgagacgcgttatcgttataattcggtcgtaaaaagtttgttagcgatatggtttgtatgtacggtatttatcgtacgtaatatttcgttcgtttt

SEQ ID NO: 11400 - DNA, 820 bp, Artificial Sequence
  chemically treated genomic DNA (Homo sapiens) CpG-island No: 11400
  misc_feature (815)..(815): n is either a, c, g or t
aaaacgaacgaaatattacgtacgataaataccgtacatacaaaccatatcgctaacaaactttttacgaccgaattataacgataacgcgtctcaatattcatcaacccgctttaactaacgaatatcgattatcgactcgccacatcctataaccaactctaatacataacctacacgtaaccttttaccgtttcaacacgactcgacatcgctccgtcgatccaaacgccgaattccacaaacgtaccacgcgcgatatcgcgcccgaaattaaacgaaatctcaatcgccaccgtaatatcgcccgcacgcatccgacgatcaaactcgtcataactaataaacgacgactattcgataaaataacgaaaaccgaaaaaattaaatatccacgcctaactactaacgatctaatcgcgatcgaacaccgcaaaacgcaaattttccacatccatactaataccgtaacccattatcaacatcaaaatcaccgttcccatcaacgccaacgtcgaacgtactaaatcgcgtcgcaattccaacgcttcgcgacgactataactaaacaaacgacgcaaactaaatccctaacgcgacgcgtaaataatatcgtataccacgaacgacgcttcgacttcgttactctaccctaccgcttcctacaaataaacgataaatacctcttccaaactaacgactccgcgtttctcaaccaattcctacgatataccgctaacaaacacttttccgacgtacatcaataaaatacgatcgcaaccgtccgcttctttataaaataaataaaaataaanaatat

SEQ ID NO: 11401 - DNA, 1222 bp, Artificial Sequence
  chemically treated genomic DNA (Homo sapiens) CpG-island No: 11401
cgttagtcgcgttgttgcgaagtttagtgatgtttcgattgtttcgttttattaggggtatcggagttattcgatttttatcggcgtatttagttgtatagggttgttatgattatgtttgcgttgttcgggaataattatattagagtgttaggttgtggtgacgttgttgaggacgaagggtgatagagggtatttgtttggtacgtttgcggacggggtagtatgtatcggtaagtttgaggttgatgggagcgatttattgtgatcgtagtcgacggagtttatcgtgtaggtttggtttaggtcgttatatgttgtgttttgtgggaagattcggttacgtagtgatgcgacgtagtatgttttgttattggtcgtcgcgagtgcgatattagagagtcgtcggtcgttagtgagggcgcggagttttcgaggggtagtagtgtatagtttcgagagttgattcgatggtcgggatgtaggtggatgcgttggtgcgtacgtcgtagtgacggaagagattggatcggggcgtggatcgttgtcgttagagtattagcgagcgtagcgtcgattaggtttgcgagttcgtttattagttgaggagcggagacgattgcgattgtatatgggcgggtgtaggtacgtcggacgttgcgatgtcgaggcgtcggggagcgtgagcgatagttatgtttgatagggacgtttagtggcgtacgagtattaggaatagcgtggggagttagcgagatcgtgtggcgatattaagttcgggtgagttgggatcgtttagaggtcgagtgtggtacgacgaagtgggacgcgtttacgggtgtgcgtggagtatattcgttttgcgttgcggatgtcgtgtattagtacgcgatgttgtgttggagcggtgagatgtcgagagcgagggtgatttgtaggtatcggacgatggagtatgtcgatttggtgtcgaggtggtttacgaacggatatagtgcgtgtcgtggttatgttagttacgggtatttgtgcgcgggtagtgagtttgaggtagtgtgtcgttttcgatgatcgcggacgcgagtagtagataggcgtgcggcgtatgaggtaaggttatattaagcgtgtttgattagttgataataaattatttttttatgtagtttgtatttgtaagaatacggcggcggacgtttcgttacggtttttgatagtcgtt

SEQ ID NO: 11402 - DNA, 1222 bp, Artificial Sequence
  chemically treated genomic DNA (Homo sapiens) CpG-island No: 11402
aacgactatcaaaaaccgtaacgaaacgtccgccgccgtattcttacaaatacaaactacataaaaaaataatttattatcaactaatcaaacacgcttaatataaccttacctcatacgccgcacgcctatctactactcgcgtccgcgatcatcgaaaacgacacactacctcaaactcactacccgcgcacaaatacccgtaactaacataaccacgacacgcactatatccgttcgtaaaccacctcgacaccaaatcgacatactccatcgtccgatacctacaaatcaccctcgctctcgacatctcaccgctccaacacaacatcgcgtactaatacacgacatccgcaacgcaaaacgaatatactccacgcacacccgtaaacgcgtcccacttcgtcgtaccacactcgacctctaaacgatcccaactcacccgaacttaatatcgccacacgatctcgctaactccccacgctattcctaatactcgtacgccactaaacgtccctatcaaacataactatcgctcacgctccccgacgcctcgacatcgcaacgtccgacgtacctacacccgcccatatacaatcgcaatcgtctccgctcctcaactaataaacgaactcgcaaacctaatcgacgctacgctcgctaatactctaacgacaacgatccacgccccgatccaatctcttccgtcactacgacgtacgcaccaacgcatccacctacatcccgaccatcgaatcaactctcgaaactatacactactacccctcgaaaactccgcgccctcactaacgaccgacgactctctaatatcgcactcgcgacgaccaataacaaaacatactacgtcgcatcactacgtaaccgaatcttcccacaaaacacaacatataacgacctaaaccaaacctacacgataaactccgtcgactacgatcacaataaatcgctcccatcaacctcaaacttaccgatacatactaccccgtccgcaaacgtaccaaacaaataccctctatcacccttcgtcctcaacaacgtcaccacaacctaacactctaatataattattcccgaacaacgcaaacataatcataacaaccctatacaactaaatacgccgataaaaatcgaataactccgatacccctaataaaacgaaacaatcgaaacatcactaaacttcgcaacaacgcgactaacg

SEQ ID NO: 11403 - DNA, 1222 bp, Artificial Sequence
  chemically treated genomic DNA (Homo sapiens) CpG-island No: 11403
agcggttattaaaagtcgtggcgaaacgttcgtcgtcgtatttttatagatataaattgtatgaaagagtggtttattgttagttggttaggtacgtttggtgtgattttgttttatgcgtcgtacgtttatttgttattcgcgttcgcgattatcggagacgatatattattttagatttattgttcgcgtataagtattcgtggttgatatgattacggtacgtattatgttcgttcgtgagttatttcggtattagatcggtatgttttatcgttcgatgtttataggttattttcgttttcgatattttatcgttttaatatagtatcgcgtgttggtatacgatattcgtaacgtagagcgagtgtgttttacgtatattcgtgagcgcgttttatttcgtcgtattatattcggtttttggacgattttagtttattcgagtttgatatcgttatacggtttcgttgattttttacgttgtttttggtgttcgtgcgttattagacgtttttgttagatataattgtcgtttacgtttttcgacgtttcgatatcgtaacgttcgacgtgtttatattcgtttatgtatagtcgtagtcgttttcgttttttagttagtaggcgggttcgtaagtttgatcggcgttgcgttcgttaatattttagcgataacggtttacgtttcggtttagtttttttcgttattgcgacgtgcgtattaacgtatttatttgtatttcggttatcgggttagttttcggagttgtgtattattgtttttcgagagtttcgcgtttttattgacggtcgacgattttttaatgtcgtattcgcggcggttagtaataaggtatgttgcgtcgtattattacgtggtcgaatttttttataaagtatagtatataacggtttgggttagatttgtacgatgagtttcgtcggttacgattatagtgaatcgtttttattagttttagatttgtcgatatatgttatttcgttcgtaggcgtattaggtaggtattttttgttatttttcgtttttaatagcgttattataatttaatattttagtgtggttattttcgggtaacgtaagtatagttataatagttttgtgtagttgagtacgtcggtggaggtcgggtaatttcgatatttttggtaggacggagtagtcgggatattattaaatttcgtaatagcgcggttagcg

SEQ ID NO: 11404 - DNA, 1222 bp, Artificial Sequence
  chemically treated genomic DNA (Homo sapiens) CpG-island No: 11404
cgctaaccgcgctattacgaaatttaataatatcccgactactccgtcctaccaaaaatatcgaaattacccgacctccaccgacgtactcaactacacaaaactattataactatacttacgttacccgaaaataaccacactaaaatattaaattataataacgctattaaaaacgaaaaataacaaaaaatacctacctaatacgcctacgaacgaaataacatatatcgacaaatctaaaactaataaaaacgattcactataatcgtaaccgacgaaactcatcgtacaaatctaacccaaaccgttatatactatactttataaaaaaattcgaccacgtaataatacgacgcaacataccttattactaaccgccgcgaatacgacattaaaaaatcgtcgaccgtcaataaaaacgcgaaactctcgaaaaacaataatacacaactccgaaaactaacccgataaccgaaatacaaataaatacgttaatacgcacgtcgcaataacgaaaaaaactaaaccgaaacgtaaaccgttatcgctaaaatattaacgaacgcaacgccgatcaaacttacgaacccgcctactaactaaaaaacgaaaacgactacgactatacataaacgaatataaacacgtcgaacgttacgatatcgaaacgtcgaaaaacgtaaacgacaattatatctaacaaaaacgtctaataacgcacgaacaccaaaaacaacgtaaaaaatcaacgaaaccgtataacgatatcaaactcgaataaactaaaatcgtccaaaaaccgaatataatacgacgaaataaaacgcgctcacgaatatacgtaaaacacactcgctctacgttacgaatatcgtataccaacacgcgatactatattaaaacgataaaatatcgaaaacgaaaataacctataaacatcgaacgataaaacataccgatctaataccgaaataactcacgaacgaacataatacgtaccgtaatcatatcaaccacgaatacttatacgcgaacaataaatctaaaataatatatcgtctccgataatcgcgaacgcgaataacaaataaacgtacgacgcataaaacaaaatcacaccaaacgtacctaaccaactaacaataaaccactctttcatacaatttatatctataaaaatacgacgacgaacgtttcgccacgacttttaataaccgct

SEQ ID NO: 11405 - DNA, 752 bp, Artificial Sequence
  chemically treated genomic DNA (Homo sapiens) CpG-island No: 11405
attgttcgcgattgtgttttgcgcgggttgcgcgtgattttggttgagcgttacgatatcgtaatcggtgttatcgggcgtaattacggtttgttgtatagcggtgcgcgttatgcggtaatcgatgcggaatcggttcgcgaatgtattagtgaaaattagattttgaaacgtattgtacgttattgcgttgaattaattaacggtttgtttattattttgtcggaagatgatttttttttttaggttatttttattcgcgtttgcgaagaagtagggattagcgtagaagttatagattcgtagtaagcgcgtattatcgaatttgtcgttaattcggtattgattggcgcggtgaaagtttcggatggtatcgttgatttatttcgtttgatcgtagtaaatatgttggatgttaaagaatacggtgtcgttatttttatcgtttatgaagttacggggttgattcgtgaaggcgcgacggtgtgcggtgttcgtgtacgtaattattttatcggcgaaatttaggttttttatgtatttgtcgtggttaatgtcgttgggatttgggggtaatatattgtcgaatatgtcgatttgcgtattcgtatgttttcggcgaaaggatcgttgttgattatggattatcgtattaattagtatgtgattaatcgttgtcgtaaatttttcgacgtcgatattttggtgtttggcgatattatttcgttgattggtattatttttttacgtat

SEQ ID NO: 11406 - DNA, 752 bp, Artificial Sequence
  chemically treated genomic DNA (Homo sapiens) CpG-island No: 11406
atacgtaaaaaaataataccaatcaacgaaataatatcgccaaacaccaaaatatcgacgtcgaaaaatttacgacaacgattaatcacatactaattaatacgataatccataatcaacaacgatcctttcgccgaaaacatacgaatacgcaaatcgacatattcgacaatatattacccccaaatcccaacgacattaaccacgacaaatacataaaaaacctaaatttcgccgataaaataattacgtacacgaacaccgcacaccgtcgcgccttcacgaatcaaccccgtaacttcataaacgataaaaataacgacaccgtattctttaacatccaacatatttactacgatcaaacgaaataaatcaacgataccatccgaaactttcaccgcgccaatcaataccgaattaacgacaaattcgataatacgcgcttactacgaatctataacttctacgctaatccctacttcttcgcaaacgcgaataaaaataacctaaaaaaaaaaatcatcttccgacaaaataataaacaaaccgttaattaattcaacgcaataacgtacaatacgtttcaaaatctaattttcactaatacattcgcgaaccgattccgcatcgattaccgcataacgcgcaccgctatacaacaaaccgtaattacgcccgataacaccgattacgatatcgtaacgctcaaccaaaatcacgcgcaacccgcgcaaaacacaatcgcgaacaat

SEQ ID NO: 11407 - DNA, 752 bp, Artificial Sequence
  chemically treated genomic DNA (Homo sapiens) CpG-island No: 11407
atacgtaaagaggtggtattaattagcgaaatggtatcgttaggtattagaatatcggcgtcggaaggtttacggtagcggttgattatatgttggttaatgcggtgatttatgattagtagcgattttttcgtcgggaatatgcgaatgcgtagatcggtatattcggtaatgtgttgtttttagattttagcggtattaattacgataggtgtatgaagggtttgagtttcgtcggtgagatggttacgtatacgaatatcgtatatcgtcgcgtttttacgaattagtttcgtgattttatgagcggtaaggataacggtatcgtgttttttggtatttagtatgtttgttgcggttagacgaaatggattaacggtgttattcggaatttttatcgcgttaattagtgtcgggttaacggtaggttcgataatgcgcgtttgttgcgggtttatagtttttgcgttgatttttgttttttcgtaggcgcgaataaaagtggtttggaaggagaggttatttttcggtagggtgataaataggtcgttggttggtttaacgtagtgacgtgtaatgcgttttaggatttggtttttattaatgtattcgcgggtcgatttcgtatcggttatcgtatagcgcgtatcgttgtgtagtaggtcgtggttacgttcggtggtatcggttgcgatgtcgtggcgtttaattaaaattacgcgtagttcgcgtagggtatagtcgcgggtaat

SEQ ID NO: 11408 - DNA, 752 bp, Artificial Sequence
  chemically treated genomic DNA (Homo sapiens) CpG-island No: 11408
attacccgcgactataccctacgcgaactacgcgtaattttaattaaacgccacgacatcgcaaccgataccaccgaacgtaaccacgacctactacacaacgatacgcgctatacgataaccgatacgaaatcgacccgcgaatacattaataaaaaccaaatcctaaaacgcattacacgtcactacgttaaaccaaccaacgacctatttatcaccctaccgaaaaataacctctccttccaaaccacttttattcgcgcctacgaaaaaacaaaaatcaacgcaaaaactataaacccgcaacaaacgcgcattatcgaacctaccgttaacccgacactaattaacgcgataaaaattccgaataacaccgttaatccatttcgtctaaccgcaacaaacatactaaataccaaaaaacacgataccgttatccttaccgctcataaaatcacgaaactaattcgtaaaaacgcgacgatatacgatattcgtatacgtaaccatctcaccgacgaaactcaaacccttcatacacctatcgtaattaataccgctaaaatctaaaaacaacacattaccgaatataccgatctacgcattcgcatattcccgacgaaaaaatcgctactaatcataaatcaccgcattaaccaacatataatcaaccgctaccgtaaaccttccgacgccgatattctaatacctaacgataccatttcgctaattaataccacctctttacgtat

SEQ ID NO: 11409 - DNA, 717 bp, Artificial Sequence
  chemically treated genomic DNA (Homo sapiens) CpG-island No: 11409
gtattttgcgggtttattttgcgtgcgttcgttggttgttagcgatgacgattcgagcggacgtaacgttagtcgtggtatcgtgttgttcgattatgttgaacgcgatggtttggacggatttattattattatcggtggtaaattgatgattatcggttgatggttgaatgggttatcgacgcggtatgtcgtaaattgggtaatacgcgtttttgtacgattgtcgatttggtattgtttggtttataagaattcgttgaagttattttgcgtaaagttatttttttgtttgtttcgttgcggttttgcggtttatcgttatggcgatcgtacgtttgtttggttgagcgaaggtcgtttgtatcgtagtttggtatgtgagtgcgaagcggtaattgcgggtgaagtgtagtacgcggtagaaaatttaaacgttaatagtttgttggatttacgtcgtcgtattcgtgtggggatgggtatttgttagggcgaattttgcgtttgtcgcgttgtcggattgttgtaacgttttaacgttacgacgttcgcgtaatttatcgagtaattttttattttttttaacgaacgttggaaaggcgtgtaatttatcgtttggggagatgtattgcgcgaaagcgaatttattcgttgggtttattagggattgtgtggtttggagaaggagtagaaagatgcgttttgatattgtta

SEQ ID NO: 11410 - DNA, 717 bp, Artificial Sequence
  chemically treated genomic DNA (Homo sapiens) CpG-island No: 11410
taacaatatcaaaacgcatctttctactccttctccaaaccacacaatccctaataaacccaacgaataaattcgctttcgcgcaatacatctccccaaacgataaattacacgcctttccaacgttcgttaaaaaaaataaaaaattactcgataaattacgcgaacgtcgtaacgttaaaacgttacaacaatccgacaacgcgacaaacgcaaaattcgccctaacaaatacccatccccacacgaatacgacgacgtaaatccaacaaactattaacgtttaaattttctaccgcgtactacacttcacccgcaattaccgcttcgcactcacataccaaactacgatacaaacgaccttcgctcaaccaaacaaacgtacgatcgccataacgataaaccgcaaaaccgcaacgaaacaaacaaaaaaataactttacgcaaaataacttcaacgaattcttataaaccaaacaataccaaatcgacaatcgtacaaaaacgcgtattacccaatttacgacataccgcgtcgataacccattcaaccatcaaccgataatcatcaatttaccaccgataataataataaatccgtccaaaccatcgcgttcaacataatcgaacaacacgataccacgactaacgttacgtccgctcgaatcgtcatcgctaacaaccaacgaacgcacgcaaaataaacccgcaaaatac

SEQ ID NO: 11411 - DNA, 717 bp, Artificial Sequence
  chemically treated genomic DNA (Homo sapiens) CpG-island No: 11411
tgatagtattaaagcgtatttttttgttttttttttagattatataatttttgataaatttagcgggtaaattcgttttcgcgtagtgtatttttttaggcgatgggttgtacgtttttttagcgttcgttaaggaaggtggaaagttgttcgatagattgcgcggacgtcgtgacgttaaaacgttgtagtagttcggtagcgcggtaggcgtagagttcgttttggtaggtgtttatttttatacgggtacgacggcgtaaatttagtaggttattaacgtttaaattttttatcgcgtattgtattttattcgtagttatcgtttcgtatttatatattaggttacggtgtagacggttttcgtttagttaggtaggcgtgcgatcgttatgacgataaatcgtagaatcgtagcggggtaggtagggagatgattttacgtaaggtaattttagcgggtttttgtgaattaggtagtgttagatcggtagtcgtataggggcgcgtgttgtttagtttgcggtatatcgcgtcggtagtttatttagttattagtcgatagttattagtttgttatcggtgatggtgataaattcgtttagattatcgcgtttagtatggtcgagtagtacgatgttacggttgacgttacgttcgttcgggtcgttatcgttggtaattagcgggcgtacgtagaataggttcgtaaaatgt

SEQ ID NO: 11412 - DNA, 717 bp, Artificial Sequence
  chemically treated genomic DNA (Homo sapiens) CpG-island No: 11412
acattttacgaacctattctacgtacgcccgctaattaccaacgataacgacccgaacgaacgtaacgtcaaccgtaacatcgtactactcgaccatactaaacgcgataatctaaacgaatttatcaccatcaccgataacaaactaataactatcgactaataactaaataaactaccgacgcgatataccgcaaactaaacaacacgcgcccctatacgactaccgatctaacactacctaattcacaaaaacccgctaaaattaccttacgtaaaatcatctccctacctaccccgctacgattctacgatttatcgtcataacgatcgcacgcctacctaactaaacgaaaaccgtctacaccgtaacctaatatataaatacgaaacgataactacgaataaaatacaatacgcgataaaaaatttaaacgttaataacctactaaatttacgccgtcgtacccgtataaaaataaacacctaccaaaacgaactctacgcctaccgcgctaccgaactactacaacgttttaacgtcacgacgtccgcgcaatctatcgaacaactttccaccttccttaacgaacgctaaaaaaacgtacaacccatcgcctaaaaaaatacactacgcgaaaacgaatttacccgctaaatttatcaaaaattatataatctaaaaaaaaaacaaaaaaatacgctttaatactatca

SEQ ID NO: 11413 - DNA, 534 bp, Artificial Sequence
  chemically treated genomic DNA (Homo sapiens) CpG-island No: 11413
cgttagcggtagtttttttagtggcggattggtagcggaacgtaacggtattcgagagtcgattttcggttttgatgtgttataaatcgttacgcggggtgaatggtataagggagatttttttgcgtcgtaatcgtggtagtagttcggtgtaattattgatgagacgtacgttcgttataggtagggtaaattattgaaaatttgtttgttatcggttcggtgttgggcggatttgattttatcgtttagggatgcggcggcggtgtttgtgtcgttagtgttttatatgtcgtttaatagattgtttaacgcgtaggaggttaataatgaatgatattagtttcgaaaattgtattaagtgtatcgtttgtattatcgtttgttcggtgagtcggtgaaatttcggttatttagggttaaaataagtcgggtcggatggcgagcgtttgcgtttgaaagatggcgtattgtatgacgaggatattcgagttcgattttcgggatttttagagttaaaacggagataatgtt

SEQ ID NO: 11414 - DNA, 534 bp, Artificial Sequence
  chemically treated genomic DNA (Homo sapiens) CpG-island No: 11414
aacattatctccgttttaactctaaaaatcccgaaaatcgaactcgaatatcctcgtcatacaatacgccatctttcaaacgcaaacgctcgccatccgacccgacttattttaaccctaaataaccgaaatttcaccgactcaccgaacaaacgataatacaaacgatacacttaatacaattttcgaaactaatatcattcattattaacctcctacgcgttaaacaatctattaaacgacatataaaacactaacgacacaaacaccgccgccgcatccctaaacgataaaatcaaatccgcccaacaccgaaccgataacaaacaaattttcaataatttaccctacctataacgaacgtacgtctcatcaataattacaccgaactactaccacgattacgacgcaaaaaaatctcccttataccattcaccccgcgtaacgatttataacacatcaaaaccgaaaatcgactctcgaataccgttacgttccgctaccaatccgccactaaaaaaactaccgctaacg

SEQ ID NO: 11415 - DNA, 534 bp, Artificial Sequence
  chemically treated genomic DNA (Homo sapiens) CpG-island No: 11415
agtattattttcgttttgattttagagatttcggagatcgagttcgaatattttcgttatatagtgcgttattttttaaacgtagacgttcgttattcggttcggtttgttttggttttggataatcgggattttatcggtttatcgggtaggcggtggtgtagacggtgtatttaatgtagttttcgaagttggtgttatttattgttggttttttgcgcgttgggtaatttgttgagcggtatgtaaagtattgacggtataaatatcgtcgtcgtatttttgggcgatgggattaaattcgtttagtatcgaatcgatggtaaataggtttttaatggtttgttttgtttgtgacgggcgtacgttttattagtggttatatcgaattgttgttacggttgcggcgtaaaaaaattttttttatattatttatttcgcgtggcggtttgtagtatattaaggtcgagaatcggttttcgaatgtcgttacgtttcgttattagttcgttattaaagaaattgtcgttggcg

SEQ ID NO: 11416 - DNA, 534 bp, Artificial Sequence
  chemically treated genomic DNA (Homo sapiens) CpG-island No: 11416
cgccaacgacaatttctttaataacgaactaataacgaaacgtaacgacattcgaaaaccgattctcgaccttaatatactacaaaccgccacgcgaaataaataatataaaaaaaatttttttacgccgcaaccgtaacaacaattcgatataaccactaataaaacgtacgcccgtcacaaacaaaacaaaccattaaaaacctatttaccatcgattcgatactaaacgaatttaatcccatcgcccaaaaatacgacgacgatatttataccgtcaatactttacataccgctcaacaaattacccaacgcgcaaaaaaccaacaataaataacaccaacttcgaaaactacattaaatacaccgtctacaccaccgcctacccgataaaccgataaaatcccgattatccaaaaccaaaacaaaccgaaccgaataacgaacgtctacgtttaaaaaataacgcactatataacgaaaatattcgaactcgatctccgaaatctctaaaatcaaaacgaaaataatact

SEQ ID NO: 11417 - DNA, 608 bp, Artificial Sequence
  chemically treated genomic DNA (Homo sapiens) CpG-island No: 11417
gtttgttcgtaggttgagttattcggattacggagcgcgacggggaggcgcgattgcggtttagtaaggattaagttagtaataagatattttttattgtgtacgatatggtcgcgagtacggttattaagtacgttaataatatcgcgttcggttttaatagttgttatttgtttatttatatcgagtattattagtagtgtttcggcgtcgagaagtttttttttaaagtatcgttaggcggttcgcgtttgcgcgtttttttcgttttttttgcgtttgcgcgttttttttgtatttatttttttgcgtttgcgcgttatttattttattttttgcgttagcgtagcgttttagggttttttttttttcgttttttttcgcgttttgcgtttgcgcgttttttttttttcggtaagtttgcgcgtcgtttcggtttatttgtttttgcgtttgcgcgtcgttgtagggttttttttttttattttttttcgttttttacgtttgcgcgttattatattttttttgcgtttgcgtagtgttatttttttgtgattgttatttgtttgattcgtatgtttgttttaacggattttttgaggttgttt

SEQ ID NO: 11418 - DNA, 608 bp, Artificial Sequence
  chemically treated genomic DNA (Homo sapiens) CpG-island No: 11418
aaacaacctcaaaaaatccgttaaaacaaacatacgaatcaaacaaataacaatcacaaaaaaataacactacgcaaacgcaaaaaaaatataataacgcgcaaacgtaaaaaacgaaaaaaaataaaaaaaaaaaaccctacaacgacgcgcaaacgcaaaaacaaataaaccgaaacgacgcgcaaacttaccgaaaaaaaaaaaacgcgcaaacgcaaaacgcgaaaaaaaacgaaaaaaaaaaaaccctaaaacgctacgctaacgcaaaaaataaaataaataacgcgcaaacgcaaaaaaataaatacaaaaaaaacgcgcaaacgcaaaaaaaacgaaaaaaacgcgcaaacgcgaaccgcctaacgatactttaaaaaaaaacttctcgacgccgaaacactactaataatactcgatataaataaacaaataacaactattaaaaccgaacgcgatattattaacgtacttaataaccgtactcgcgaccatatcgtacacaataaaaaatatcttattactaacttaatccttactaaaccgcaatcgcgcctccccgtcgcgctccgtaatccgaataactcaacctacgaacaaac

SEQ ID NO: 11419 - DNA, 608 bp, Artificial Sequence
  chemically treated genomic DNA (Homo sapiens) CpG-island No: 11419
aggtagttttagggaattcgttaaaataaatatgcgagttagataagtggtagttataggagagtaatattgcgtaggcgtagaagggatgtagtggcgcgtaggcgtaggaggcggggggagatgggggaggaaggttttgtagcggcgcgtaggcgtagaagtaagtgggtcggagcggcgcgtaggtttatcgggggaagaaaggcgcgtaggcgtaggacgcggggaggggcgggggaagaaaggttttggagcgttgcgttggcgtaggaggtgaaataagtggcgcgtaggcgtaagagggtgggtgtagaagaggcgcgtaggcgtaggaggggcgggaggggcgcgtaggcgcggatcgtttggcggtattttgaagaaagatttttcgacgtcgagatattgttggtggtattcgatgtaggtgagtaggtggtagttgttggagtcgggcgcgatgttgttggcgtatttgatggtcgtgttcgcgattatgtcgtgtatagtgaggagtgttttgttgttaatttagtttttgttgagtcgtagtcgcgttttttcgtcgcgtttcgtggttcgagtagtttagtttgcggataggt

SEQ ID NO: 11420 - DNA, 608 bp, Artificial Sequence
  chemically treated genomic DNA (Homo sapiens) CpG-island No: 11420
acctatccgcaaactaaactactcgaaccacgaaacgcgacgaaaaaacgcgactacgactcaacaaaaactaaattaacaacaaaacactcctcactatacacgacataatcgcgaacacgaccatcaaatacgccaacaacatcgcgcccgactccaacaactaccacctactcacctacatcgaataccaccaacaatatctcgacgtcgaaaaatctttcttcaaaataccgccaaacgatccgcgcctacgcgcccctcccgcccctcctacgcctacgcgcctcttctacacccaccctcttacgcctacgcgccacttatttcacctcctacgccaacgcaacgctccaaaacctttcttcccccgcccctccccgcgtcctacgcctacgcgcctttcttcccccgataaacctacgcgccgctccgacccacttacttctacgcctacgcgccgctacaaaaccttcctcccccatctccccccgcctcctacgcctacgcgccactacatcccttctacgcctacgcaatattactctcctataactaccacttatctaactcgcatatttattttaacgaattccctaaaactacct

SEQ ID NO: 11421 - DNA, 776 bp, Artificial Sequence
  chemically treated genomic DNA (Homo sapiens) CpG-island No: 11421
tgcgggtcgtagcgcgtaggcgtcgcgcgttcgtttcgttttcgtttttttttacgtgcggcgtatatttcgcgttttttttcgttaggttcgtttcgcgttttttttttttttttttttcgttttttcggtttcggttttttattggttgcgggtttcgttttttcggtcgtagttcggtaggttttcgttaggtaggaagtttcgcgttataagcggtcgttcgcgtcgtcgattggtttaggtggttgttagtcgatgcggcgggttttagtcggcggcgggggttcgtgatcggtgcgcgattcgggttggcggtggttttcggtttcgcggggttggcgggcgagcgggcggtcgggatcggcggcggcggcggcggcggcggcgtttgatagataatgagggcggcggggcggcgttgagcggcggcggcggcggcggcggcggcgaggcgacgcggggttcgggggcggggcggggcgttagttatggataattaggtgaggagcggtcgcgtcgtttttgcgtagttcgttcggttttttttcgttcgtcggttcgttcggtttttttcggtttcggttttttcgtttcgcgttcgttcgttcgttttgtgcgcgttcgtcgtttttcgggtttttatgtggggcgggggcgtattttttttattcgcgatttcggttagggcgtttcggatatttttcgggattcgggtcgggttcggaggtttttgggacgtttttggtgattttttagtttggttcggagatttt

SEQ ID NO: 11422 - DNA, 776 bp, Artificial Sequence
  chemically treated genomic DNA (Homo sapiens) CpG-island No: 11422
aaaatctccgaaccaaactaaaaaatcaccaaaaacgtcccaaaaacctccgaacccgacccgaatcccgaaaaatatccgaaacgccctaaccgaaatcgcgaataaaaaaaatacgcccccgccccacataaaaacccgaaaaacgacgaacgcgcacaaaacgaacgaacgaacgcgaaacgaaaaaaccgaaaccgaaaaaaaccgaacgaaccgacgaacgaaaaaaaaccgaacgaactacgcaaaaacgacgcgaccgctcctcacctaattatccataactaacgccccgccccgcccccgaaccccgcgtcgcctcgccgccgccgccgccgccgccgccgctcaacgccgccccgccgccctcattatctatcaaacgccgccgccgccgccgccgccgccgatcccgaccgcccgctcgcccgccaaccccgcgaaaccgaaaaccaccgccaacccgaatcgcgcaccgatcacgaacccccgccgccgactaaaacccgccgcatcgactaacaaccacctaaaccaatcgacgacgcgaacgaccgcttataacgcgaaacttcctacctaacgaaaacctaccgaactacgaccgaaaaaacgaaacccgcaaccaataaaaaaccgaaaccgaaaaaacgaaaaaaaaaaaaaaaaaaaacgcgaaacgaacctaacgaaaaaaaacgcgaaatatacgccgcacgtaaaaaaaaacgaaaacgaaacgaacgcgcgacgcctacgcgctacgacccgca

SEQ ID NO: 11423 - DNA, 776 bp, Artificial Sequence
  chemically treated genomic DNA (Homo sapiens) CpG-island No: 11423
ggggttttcgagttaggttggggggttattaggggcgttttaagggttttcgggttcggttcgggtttcgaagggtgttcgaggcgttttggtcggggtcgcggatgggggaggtgcgttttcgttttatataaaggttcgaggagcggcgggcgcgtataaagcgggcgggcgggcgcgaagcggggaggtcgggatcggggagggtcgggcgggtcggcgggcgggagggggtcgggcgggttgcgtaggggcggcgcggtcgttttttatttgattgtttatggttggcgtttcgtttcgttttcgggtttcgcgtcgtttcgtcgtcgtcgtcgtcgtcgtcgtcgtttaacgtcgtttcgtcgtttttattgtttgttaagcgtcgtcgtcgtcgtcgtcgtcgtcgatttcggtcgttcgttcgttcgttagtttcgcggaatcggaaattatcgttagttcgggtcgcgtatcgattacgggttttcgtcgtcgattagggttcgtcgtatcgattgatagttatttgggttaatcgacggcgcggacggtcgtttgtggcgcgggattttttgtttggcgggggtttgtcgggttgcggtcggagggacgaagttcgtagttaatgggaggtcgggatcggaggggcgggaggagggagggagggaggcgcgaggcgagtttggcggaggggagcgcgaggtgtgcgtcgtacgtggaggggggcgggggcgggacgggcgcgcggcgtttgcgcgttgcggttcgta

SEQ ID NO: 11424 - DNA, 776 bp, Artificial Sequence
  chemically treated genomic DNA (Homo sapiens) CpG-island No: 11424
tacgaaccgcaacgcgcaaacgccgcgcgcccgtcccgcccccgcccccctccacgtacgacgcacacctcgcgctcccctccgccaaactcgcctcgcgcctccctccctccctcctcccgcccctccgatcccgacctcccattaactacgaacttcgtccctccgaccgcaacccgacaaacccccgccaaacaaaaaatcccgcgccacaaacgaccgtccgcgccgtcgattaacccaaataactatcaatcgatacgacgaaccctaatcgacgacgaaaacccgtaatcgatacgcgacccgaactaacgataatttccgattccgcgaaactaacgaacgaacgaacgaccgaaatcgacgacgacgacgacgacgacgacgcttaacaaacaataaaaacgacgaaacgacgttaaacgacgacgacgacgacgacgacgacgaaacgacgcgaaacccgaaaacgaaacgaaacgccaaccataaacaatcaaataaaaaacgaccgcgccgcccctacgcaacccgcccgaccccctcccgcccgccgacccgcccgaccctccccgatcccgacctccccgcttcgcgcccgcccgcccgctttatacgcgcccgccgctcctcgaacctttatataaaacgaaaacgcacctcccccatccgcgaccccgaccaaaacgcctcgaacacccttcgaaacccgaaccgaacccgaaaacccttaaaacgcccctaataaccccccaacctaactcgaaaacccc

SEQ ID NO: 11425 - DNA, 549 bp, Artificial Sequence
  chemically treated genomic DNA (Homo sapiens) CpG-island No: 11425
  misc_feature (390)..(391): n is either a, c, g or t
  misc_feature (531)..(531): n is either a, c, g or t
  misc_feature (546)..(546): n is either a, c, g or t
aattgcgtcgggtaaatagggcgcggatattgtttttggttcggcgtaattttcggttgtcgatgggttacggtggtttatacgcggtattttttgcggcgaaagatgaatataaacgtttaatgtcgggtcgtattatcggtgtatcgaaagatgtagttggtaatatcgcgttgttatggcgatgtagattcgcgagtaatatattcgtcgtgagaaagcgaattttaatatttgtattttttaggtattgttggtaaatatcgttagtttgtatgtcgtttattacggttcggttggtttgaaacgtatcgttaatcgtatttatcgtttgatcgatattttggcggcgggtttgtaataaaaaggtttgaaattgcgttatgcgtnntatttcgatattttgtgtgtggaagtggtcgataaagcgggcgtattgacgcgtgtcgaagcggttgaaattaatttgcgtacgatattttgaacgcggttgggattatttttgatgaaataattacgcgtgaaaacgtngcgggagtgggcgtnaat

SEQ ID NO: 11426 - DNA, 549 bp, Artificial Sequence
  chemically treated genomic DNA (Homo sapiens) CpG-island No: 11426
  misc_feature (4)..(4): n is either a, c, g or t
  misc_feature (19)..(19): n is either a, c, g or t
  misc_feature (159)..(160): n is either a, c, g or t
attnacgcccactcccgcnacgttttcacgcgtaattatttcatcaaaaataatcccaaccgcgttcaaaatatcgtacgcaaattaatttcaaccgcttcgacacgcgtcaatacgcccgctttatcgaccacttccacacacaaaatatcgaaatannacgcataacgcaatttcaaacctttttattacaaacccgccgccaaaatatcgatcaaacgataaatacgattaacgatacgtttcaaaccaaccgaaccgtaataaacgacatacaaactaacgatatttaccaacaatacctaaaaaatacaaatattaaaattcgctttctcacgacgaatatattactcgcgaatctacatcgccataacaacgcgatattaccaactacatctttcgatacaccgataatacgacccgacattaaacgtttatattcatctttcgccgcaaaaaataccgcgtataaaccaccgtaacccatcgacaaccgaaaattacgccgaaccaaaaacaatatccgcgccctatttacccgacgcaatt

SEQ ID NO: 11427 - DNA, 549 bp, Artificial Sequence
  chemically treated genomic DNA (Homo sapiens) CpG-island No: 11427
  misc_feature (4)..(4): n is either a, c, g or t
  misc_feature (19)..(19): n is either a, c, g or t
  misc_feature (159)..(160): n is either a, c, g or t
attngcgtttattttcgtnacgtttttacgcgtggttgttttattaagggtgattttaatcgcgtttagaatatcgtacgtaggttgattttagtcgtttcggtacgcgttagtacgttcgttttgtcggttatttttatatataaggtgtcgaaatanngcgtatggcgtagttttagatttttttgttgtaggttcgtcgttaggatatcggttagacggtgaatgcggttagcgatacgttttaggttaatcgggtcgtgataaacggtatataggttggcgatgtttgttagtagtatttgggaagtataaatgttggagttcgtttttttacggcggatatgttgttcgcgagtttgtatcgttatggtagcgcggtattgttagttgtatttttcgatatatcgataatacggttcggtattgagcgtttgtatttatttttcgtcgtaaagaatgtcgcgtgtgggttatcgtagtttatcggtagtcgaaggttgcgtcgaattaaaaataatattcgcgttttgtttattcggcgtagtt

SEQ ID NO: 11428 - DNA, 549 bp, Artificial Sequence
  chemically treated genomic DNA (Homo sapiens) CpG-island No: 11428
  misc_feature (390)..(391): n is either a, c, g or t
  misc_feature (531)..(531): n is either a, c, g or t
  misc_feature (546)..(546): n is either a, c, g or t
aactacgccgaataaacaaaacgcgaatattatttttaattcgacgcaaccttcgactaccgataaactacgataacccacacgcgacattctttacgacgaaaaataaatacaaacgctcaataccgaaccgtattatcgatatatcgaaaaatacaactaacaataccgcgctaccataacgatacaaactcgcgaacaacatatccgccgtaaaaaaacgaactccaacatttatacttcccaaatactactaacaaacatcgccaacctatataccgtttatcacgacccgattaacctaaaacgtatcgctaaccgcattcaccgtctaaccgatatcctaacgacgaacctacaacaaaaaaatctaaaactacgccatacgcnntatttcgacaccttatatataaaaataaccgacaaaacgaacgtactaacgcgtaccgaaacgactaaaatcaacctacgtacgatattctaaacgcgattaaaatcacccttaataaaacaaccacgcgtaaaaacgtnacgaaaataaacgcnaat

SEQ ID NO: 11429 - DNA, 553 bp, Artificial Sequence
  chemically treated genomic DNA (Homo sapiens) CpG-island No: 11429
  misc_feature (552)..(552): n is either a, c, g or t
tagtttacgtagatcgcgaatgtttcgtcgtaatttatcggtcggttatagcgttatagtaggttagatttattagtatgtgttattatatttagttagaaacgtttaatgtcgagttttattatcggtgtatcgaaatatatagttgtataatatcgcgttgttaatgcgtatgtagagtttagcgtaatatattcgtattgagtaagcgtattcgagtatttgtatttagtagattgaggttgcgtaaatatcgatattattaatgtacgtttattaaggttttgtttggtttgaaaacgtagtcgtttttacgtgattttagacgttttgatggcgtatatttgtacggatcgtgtttgtttacgagacgtttttgtggattcgcgaaattcgtataatgttcgtttatttatgcgtgtcggaaggtgttagttatattagtgggtgtatgtagttttgcgcgaagttggtcgatatttaatttttcgtaggattatgtttgaacgttggttcgggattacgttgtgatggaaaatcgaggtgtgaaang

SEQ ID NO: 11430 - DNA, 553 bp, Artificial Sequence
  chemically treated genomic DNA (Homo sapiens) CpG-island No: 11430
  misc_feature (2)..(2): n is either a, c, g or t
cntttcacacctcgattttccatcacaacgtaatcccgaaccaacgttcaaacataatcctacgaaaaattaaatatcgaccaacttcgcgcaaaactacatacacccactaatataactaacaccttccgacacgcataaataaacgaacattatacgaatttcgcgaatccacaaaaacgtctcgtaaacaaacacgatccgtacaaatatacgccatcaaaacgtctaaaatcacgtaaaaacgactacgttttcaaaccaaacaaaaccttaataaacgtacattaataatatcgatatttacgcaacctcaatctactaaatacaaatactcgaatacgcttactcaatacgaatatattacgctaaactctacatacgcattaacaacgcgatattatacaactatatatttcgatacaccgataataaaactcgacattaaacgtttctaactaaatataataacacatactaataaatctaacctactataacgctataaccgaccgataaattacgacgaaacattcgcgatctacgtaaacta

SEQ ID NO: 11431 - DNA, 553 bp, Artificial Sequence
  chemically treated genomic DNA (Homo sapiens) CpG-island No: 11431
  misc_feature (2)..(2): n is either a, c, g or t
tnttttatatttcggttttttattatagcgtgatttcgaattagcgtttagatataattttacggagagttgaatgtcgattagtttcgcgtaaggttgtatgtatttattgatgtggttggtatttttcgatacgtataggtggacgaatattatgcggatttcgcgagtttatagaagcgtttcgtaggtaggtacggttcgtgtaggtatacgttattaggacgtttgagattacgtgggagcgattacgtttttaggttagatagggttttgataaacgtgtattagtgatgtcgatgtttgcgtagttttagtttgttaagtataggtgttcgagtgcgtttgtttagtgcggatatgttgcgttggattttgtatacgtattgatagcgcggtattgtgtagttgtatgtttcgatatatcgatagtagggttcggtattgagcgtttttggttaggtgtggtggtatatattggtgagtttagtttattgtggcgttgtggtcggtcgataggttgcggcgaggtattcgcgatttgcgtgaattg

SEQ ID NO: 11432 - DNA, 553 bp, Artificial Sequence
  chemically treated genomic DNA (Homo sapiens) CpG-island No: 11432
  misc_feature (552)..(552): n is either a, c, g or t
caattcacgcaaatcgcgaatacctcgccgcaacctatcgaccgaccacaacgccacaataaactaaactcaccaatatataccaccacacctaaccaaaaacgctcaataccgaaccctactatcgatatatcgaaacatacaactacacaataccgcgctatcaatacgtatacaaaatccaacgcaacatatccgcactaaacaaacgcactcgaacacctatacttaacaaactaaaactacgcaaacatcgacatcactaatacacgtttatcaaaaccctatctaacctaaaaacgtaatcgctcccacgtaatctcaaacgtcctaataacgtatacctacacgaaccgtacctacctacgaaacgcttctataaactcgcgaaatccgcataatattcgtccacctatacgtatcgaaaaataccaaccacatcaataaatacatacaaccttacgcgaaactaatcgacattcaactctccgtaaaattatatctaaacgctaattcgaaatcacgctataataaaaaaccgaaatataaaana

SEQ ID NO: 11433 - DNA, 746 bp, Artificial Sequence
  chemically treated genomic DNA (Homo sapiens) CpG-island No: 11433
gtatttgaattagtcgttgcgtgagggttttgtcggtttggttaggtgtcgtttcgtcggaaggatggttatgcgcgagtattatcgtcgtcgcgttgaagtgtagagtacgttttgattatttttcggggatgtatttcggtcgagttaatcgtgtcggtgaagagcgttttatgggtaattaattgattttggttgtttagatataatattcggaatttttttcgtttaagcgcggttatatgtagtcgtagttatttacgtacggcgtgggtagaggtgaaggttacgcggggtttatgtaggtggcggtttagagttttgagcgttcgttgaatgagacgtcggttttgtggcgttatttcgtcgggtaaaaaggaaagttgtgttatttgttgttttttcggttagtcgataatacgtagaatggcgtgagtttttggatgttgtatggtatatttcgtaggcggtaatagtgtgcggttatcgcgttatattttgtacggtaggtatggtggtatacgtaattaggtagatagtaatatttgttgtttttgtatttagtttgggtatcgttatcgtttaggtagttaaatagacgttatgttttatcgttgttaggttcgggggatataaatgcgtcgttattgttgagggtgtagaacgattagatattatcgttgtagtttttattagaagcgattttagagatttcgtggtatcgagtaagatttgtaatgtgtttg

SEQ ID NO: 11434 - DNA, 746 bp, Artificial Sequence
  chemically treated genomic DNA (Homo sapiens) CpG-island No: 11434
caaacacattacaaatcttactcgataccacgaaatctctaaaatcgcttctaataaaaactacaacgataatatctaatcgttctacaccctcaacaataacgacgcatttatatcccccgaacctaacaacgataaaacataacgtctatttaactacctaaacgataacgatacccaaactaaatacaaaaacaacaaatattactatctacctaattacgtataccaccatacctaccgtacaaaatataacgcgataaccgcacactattaccgcctacgaaatataccatacaacatccaaaaactcacgccattctacgtattatcgactaaccgaaaaaacaacaaataacacaactttcctttttacccgacgaaataacgccacaaaaccgacgtctcattcaacgaacgctcaaaactctaaaccgccacctacataaaccccgcgtaaccttcacctctacccacgccgtacgtaaataactacgactacatataaccgcgcttaaacgaaaaaaattccgaatattatatctaaacaaccaaaatcaattaattacccataaaacgctcttcaccgacacgattaactcgaccgaaatacatccccgaaaaataatcaaaacgtactctacacttcaacgcgacgacgataatactcgcgcataaccatccttccgacgaaacgacacctaaccaaaccgacaaaaccctcacgcaacgactaattcaaatac

SEQ ID NO: 11435 - DNA, 746 bp, Artificial Sequence
  chemically treated genomic DNA (Homo sapiens) CpG-island No: 11435
taaatatattataaattttgttcggtattacgggatttttagagtcgtttttgatgagggttatagcggtggtatttggtcgttttatatttttagtaatggcggcgtatttatgtttttcgagtttgataacgatgagatatggcgtttgtttaattgtttgaacggtaacgatgtttaaattgagtgtagaagtagtaggtattgttgtttgtttgattgcgtatattattatgtttgtcgtatagaatgtgacgcgatgatcgtatattattatcgtttgcggagtatgttatgtaatatttagaggtttacgttattttgcgtattatcgattgatcgaaggagtaatagatgatatagtttttttttttattcggcgagatgacgttataggatcggcgttttatttagcgggcgtttagggttttggatcgttatttgtatgagtttcgcgtagtttttatttttatttacgtcgtacgtgaatggttgcgattgtatatggtcgcgtttgagcgggaagagtttcgggtgttgtatttggataattagaattagttgattgtttatgaaacgttttttatcggtacgattaattcgatcgaggtgtattttcgggaggtggttaagacgtgttttgtattttaacgcggcggcggtgatattcgcgtataattattttttcggcgagacgatatttagttaggtcgataaaatttttacgtagcgattggtttaggtgt

SEQ ID NO: 11436 - DNA, 746 bp, Artificial Sequence
  chemically treated genomic DNA (Homo sapiens) CpG-island No: 11436
acacctaaaccaatcgctacgtaaaaattttatcgacctaactaaatatcgtctcgccgaaaaaataattatacgcgaatatcaccgccgccgcgttaaaatacaaaacacgtcttaaccacctcccgaaaatacacctcgatcgaattaatcgtaccgataaaaaacgtttcataaacaatcaactaattctaattatccaaatacaacacccgaaactcttcccgctcaaacgcgaccatatacaatcgcaaccattcacgtacgacgtaaataaaaataaaaactacgcgaaactcatacaaataacgatccaaaaccctaaacgcccgctaaataaaacgccgatcctataacgtcatctcgccgaataaaaaaaaaaactatatcatctattactccttcgatcaatcgataatacgcaaaataacgtaaacctctaaatattacataacatactccgcaaacgataataatatacgatcatcgcgtcacattctatacgacaaacataataatatacgcaatcaaacaaacaacaatacctactacttctacactcaatttaaacatcgttaccgttcaaacaattaaacaaacgccatatctcatcgttatcaaactcgaaaaacataaatacgccgccattactaaaaatataaaacgaccaaataccaccgctataaccctcatcaaaaacgactctaaaaatcccgtaataccgaacaaaatttataatatattta

SEQ ID NO: 11437 - DNA, 742 bp, Artificial Sequence
  chemically treated genomic DNA (Homo sapiens) CpG-island No: 11437
cgtcgtattgcgcggtatttagttacggttgcgaagtttatttagtatagcgttacggatacgttgtattgcgtaagttgtaaatgtcgttttttgtagggcgttatagcgttcgacggtattaagtaatttaatttcgttttgtaatagggagagttggatttggtaatgacgttcgatattttgtcgcgtagtgcgttgtattattcgtcgatgttcgattatgaagtgcgtttggtgttagtatttgattatttattggcggcgaaaacgcgaattatatcggaagatttcgttagcgagacgttattaatttattcggtgtagcgtagtcgattggatgtttggcggtattttttttagtcggtaggcgttagttcgttattgaaaagcgtcgataatattttattgttgatttagatggttgtcgcgcggatgggtattgtcgcgttatcgtattgggtagtagagagttttgagcgttagggtttggtggtgattaaaattttgggcgaaggtttgtggagtcgattgtacgtcgtcgtgcgcgatggcgagtagcgttagttagttacggaagcgtttattcgtttagcgcgtaattacgtttgcgattatttgtcgtttgtgaagagtcggagcgatttatttacgatgtatttatagtgaggttaggattattagcgcgtttgtaataaacgttggttagtgcggttgttggtgttagatagttaggtttatt

SEQ ID NO: 11438 - DNA, 742 bp, Artificial Sequence
  chemically treated genomic DNA (Homo sapiens) CpG-island No: 11438
aataaacctaactatctaacaccaacaaccgcactaaccaacgtttattacaaacgcgctaataatcctaacctcactataaatacatcgtaaataaatcgctccgactcttcacaaacgacaaataatcgcaaacgtaattacgcgctaaacgaataaacgcttccgtaactaactaacgctactcgccatcgcgcacgacgacgtacaatcgactccacaaaccttcgcccaaaattttaatcaccaccaaaccctaacgctcaaaactctctactacccaatacgataacgcgacaatacccatccgcgcgacaaccatctaaatcaacaataaaatattatcgacgcttttcaataacgaactaacgcctaccgactaaaaaaaataccgccaaacatccaatcgactacgctacaccgaataaattaataacgtctcgctaacgaaatcttccgatataattcgcgttttcgccgccaataaataatcaaatactaacaccaaacgcacttcataatcgaacatcgacgaataatacaacgcactacgcgacaaaatatcgaacgtcattaccaaatccaactctccctattacaaaacgaaattaaattacttaataccgtcgaacgctataacgccctacaaaaaacgacatttacaacttacgcaatacaacgtatccgtaacgctatactaaataaacttcgcaaccgtaactaaataccgcgcaatacgacg

SEQ ID NO: 11439 - DNA, 742 bp, Artificial Sequence
  chemically treated genomic DNA (Homo sapiens) CpG-island No: 11439
ggtaaatttggttatttggtattaatagtcgtattggttaacgtttattataggcgcgttggtgattttggttttattgtgggtgtatcgtaagtgggtcgtttcggttttttataaacggtagatgatcgtaggcgtgattgcgcgttgagcgaataaacgttttcgtaattggttgacgttgttcgttatcgcgtacggcggcgtatagtcggttttataagttttcgtttagggttttggttattattagattttggcgtttaaaattttttattatttaatgcggtagcgcggtaatatttattcgcgcggtaattatttgaattaataataaggtgttatcgacgttttttagtgacgggttgacgtttgtcggttgaagaaaatgtcgttagatatttagtcgattacgttgtatcggataaattaatagcgtttcgttggcgagatttttcggtgtaattcgcgttttcgtcgttagtggatggttaggtgttaatattagacgtattttatagtcgaatatcggcgaataatgtagcgtattgcgcggtagaatatcggacgttattattagatttagttttttttgttgtaaggcgggattgggttatttaatgtcgtcgaacgttatgacgttttataaggaacggtatttataatttacgtagtgtagcgtattcgtggcgttatgttggatgaatttcgtagtcgtgattgggtgtcgcgtagtgcgacg

SEQ ID NO: 11440 - DNA, 742 bp, Artificial Sequence
  chemically treated genomic DNA (Homo sapiens) CpG-island No: 11440
cgtcgcactacgcgacacccaatcacgactacgaaattcatccaacataacgccacgaatacgctacactacgtaaattataaataccgttccttataaaacgtcataacgttcgacgacattaaataacccaatcccgccttacaacaaaaaaaactaaatctaataataacgtccgatattctaccgcgcaatacgctacattattcgccgatattcgactataaaatacgtctaatattaacacctaaccatccactaacgacgaaaacgcgaattacaccgaaaaatctcgccaacgaaacgctattaatttatccgatacaacgtaatcgactaaatatctaacgacattttcttcaaccgacaaacgtcaacccgtcactaaaaaacgtcgataacaccttattattaattcaaataattaccgcgcgaataaatattaccgcgctaccgcattaaataataaaaaattttaaacgccaaaatctaataataaccaaaaccctaaacgaaaacttataaaaccgactatacgccgccgtacgcgataacgaacaacgtcaaccaattacgaaaacgtttattcgctcaacgcgcaatcacgcctacgatcatctaccgtttataaaaaaccgaaacgacccacttacgatacacccacaataaaaccaaaatcaccaacgcgcctataataaacgttaaccaatacgactattaataccaaataaccaaatttacc

SEQ ID NO: 11441 - DNA, 576 bp, Artificial Sequence
  chemically treated genomic DNA (Homo sapiens) CpG-island No: 11441
gcgtcggtttcgtttcgtttcggttgtttagaatcgggaggcggcggcggcggcggggtcggggttcggggcggcggcggcgggacgcgaggattatggttgttttcgagcgtcgcgttttcgcgtataagattaataggtagtgtggtcgcggggtttttttttattttttttacgtggttcggtttcgtttcggggcggtgcgatttttttcgttcgggcgtttttaatttaattttttttcgtttcggttcgggtttcgttagtttttttcggtcggggttgggagcgggagaaggcggggagggtcgcgggggtttcggcgggggttttagatgggagtcgcgtcggggttgggagcgcgatggcggttgtcgttttgttttcgtgacgcgcgggggtgtgttcggagggtttttcggaggaggtggcgtggggatgcggatgacgggcgttttttgaattttttgcgtttttcgttcgtttttcggttttttattgttttcgcgttttcggagatcggggtgggtcggattttttgttttttttttagtgtttggtttggggtagggaggt

SEQ ID NO: 11442 - DNA, 576 bp, Artificial Sequence
  chemically treated genomic DNA (Homo sapiens) CpG-island No: 11442
acctccctaccccaaaccaaacactaaaaaaaaaacaaaaaatccgacccaccccgatctccgaaaacgcgaaaacaataaaaaaccgaaaaacgaacgaaaaacgcaaaaaattcaaaaaacgcccgtcatccgcatccccacgccacctcctccgaaaaaccctccgaacacacccccgcgcgtcacgaaaacaaaacgacaaccgccatcgcgctcccaaccccgacgcgactcccatctaaaacccccgccgaaacccccgcgaccctccccgccttctcccgctcccaaccccgaccgaaaaaaactaacgaaacccgaaccgaaacgaaaaaaaattaaattaaaaacgcccgaacgaaaaaaatcgcaccgccccgaaacgaaaccgaaccacgtaaaaaaaataaaaaaaaaccccgcgaccacactacctattaatcttatacgcgaaaacgcgacgctcgaaaacaaccataatcctcgcgtcccgccgccgccgccccgaaccccgaccccgccgccgccgccgcctcccgattctaaacaaccgaaacgaaacgaaaccgacgc

SEQ ID NO: 11443 - DNA, 576 bp, Artificial Sequence
  chemically treated genomic DNA (Homo sapiens) CpG-island No: 11443
gtttttttgttttaaattaggtattgaggaaggaatagaaagttcggtttatttcgattttcgagagcgcggggatagtgaggggtcgagaggcggacggggagcgtagggagtttagggggcgttcgttattcgtatttttacgttatttttttcgggaagtttttcggatatattttcgcgcgttacggaggtagaacggtagtcgttatcgcgtttttagtttcgacgcgatttttatttgggattttcgtcgggattttcgcggtttttttcgttttttttcgtttttagtttcggtcggaggaagttggcgggattcgggtcgaggcggaaaggggttgaattgggggcgttcgggcggggagggtcgtatcgtttcggggcggagtcgggttacgtgggggaggtgggagggggtttcgcggttatattatttgttgattttgtgcgcgaaggcgcggcgttcggaggtagttatggttttcgcgtttcgtcgtcgtcgtttcgggtttcggtttcgtcgtcgtcgtcgtttttcggttttgggtagtcggggcggggcggggtcggcgt

SEQ ID NO: 11444 - DNA, 576 bp, Artificial Sequence
  chemically treated genomic DNA (Homo sapiens) CpG-island No: 11444
acgccgaccccgccccgccccgactacccaaaaccgaaaaacgacgacgacgacgaaaccgaaacccgaaacgacgacgacgaaacgcgaaaaccataactacctccgaacgccgcgccttcgcgcacaaaatcaacaaataatataaccgcgaaaccccctcccacctcccccacgtaacccgactccgccccgaaacgatacgaccctccccgcccgaacgcccccaattcaacccctttccgcctcgacccgaatcccgccaacttcctccgaccgaaactaaaaacgaaaaaaaacgaaaaaaaccgcgaaaatcccgacgaaaatcccaaataaaaatcgcgtcgaaactaaaaacgcgataacgactaccgttctacctccgtaacgcgcgaaaatatatccgaaaaacttcccgaaaaaaataacgtaaaaatacgaataacgaacgccccctaaactccctacgctccccgtccgcctctcgacccctcactatccccgcgctctcgaaaatcgaaataaaccgaactttctattccttcctcaatacctaatttaaaacaaaaaaac

SEQ ID NO: 11445 - DNA, 634 bp, Artificial Sequence
  chemically treated genomic DNA (Homo sapiens) CpG-island No: 11445
ggttcgaagtcgttagaaggtggggacggttttggaggcggggggtcgggtcggattttcgggcgttttcggcgtcgttttttcgtttagatttcggcggtttttgtcgatggttaggcggggtcggtcgcggtttaggtcgtttaggagcgcgtaggtttggtagagcgcgcggttggttagcgttttatagcgggagtaggcgtcggggcgcgggggtcgcgcggtcggggttagcgttaggcgttcggtcgagtgtacgaggtttagtatcgcggacggtcgcgtcgtttttaggcgtttgagtaggtttcgggcgtggtcgcggaaggtttcgggcgcgtagacgtatttttcggagaagtagtcgaggcggcggaagtgcgcgtatagtattatttttttttgcgaggcgaattgtagcgggcggtagcgcggtagggcgtttttttcgtcgggagagtttaggttttcgtttcgggttagtcgtttcgcgtcgtttcgtaggaagtttatgagtacggttttcgttatgtcgtcggcgttgtgatttggtggggagagaagggagcgggtgaggtggggcgcggagggcgttgttggttagggagtttttcggggaattaagggttta

SEQ ID NO: 11446 - DNA, 634 bp, Artificial Sequence
  chemically treated genomic DNA (Homo sapiens) CpG-island No: 11446
taaacccttaattccccgaaaaactccctaaccaacaacgccctccgcgccccacctcacccgctcccttctctccccaccaaatcacaacgccgacgacataacgaaaaccgtactcataaacttcctacgaaacgacgcgaaacgactaacccgaaacgaaaacctaaactctcccgacgaaaaaaacgccctaccgcgctaccgcccgctacaattcgcctcgcaaaaaaaaataatactatacgcgcacttccgccgcctcgactacttctccgaaaaatacgtctacgcgcccgaaaccttccgcgaccacgcccgaaacctactcaaacgcctaaaaacgacgcgaccgtccgcgatactaaacctcgtacactcgaccgaacgcctaacgctaaccccgaccgcgcgacccccgcgccccgacgcctactcccgctataaaacgctaaccaaccgcgcgctctaccaaacctacgcgctcctaaacgacctaaaccgcgaccgaccccgcctaaccatcgacaaaaaccgccgaaatctaaacgaaaaaacgacgccgaaaacgcccgaaaatccgacccgaccccccgcctccaaaaccgtccccaccttctaacgacttcgaacc

SEQ ID NO: 11447 - DNA, 634 bp, Artificial Sequence
  chemically treated genomic DNA (Homo sapiens) CpG-island No: 11447
tggatttttggtttttcggggggttttttggttagtagcgtttttcgcgttttattttattcgtttttttttttttttattaggttataacgtcgacgatatggcggagatcgtgtttatgaattttttacggggcgacgcggggcggttggttcggggcgggggtttgggttttttcggcgaggggggcgttttgtcgcgttgtcgttcgttgtagttcgtttcgtagaaggaggtggtgttgtacgcgtattttcgtcgtttcgattattttttcgaggagtgcgtttacgcgttcgaggtttttcgcggttacgttcgggatttgtttaagcgtttggaggcggcgcggtcgttcgcggtgttggatttcgtgtattcggtcgagcgtttggcgttggtttcggtcgcgcggttttcgcgtttcggcgtttgttttcgttgtggggcgttggttagtcgcgcgttttgttaggtttgcgcgtttttggacggtttgaatcgcggtcggtttcgtttggttatcggtaagggtcgtcggggtttggacgaggaggcgacgtcggggacgttcggggattcggttcggtttttcgtttttaaggtcgtttttattttttagcgatttcgggtt

SEQ ID NO: 11448 - DNA, 634 bp, Artificial Sequence
  chemically treated genomic DNA (Homo sapiens) CpG-island No: 11448
aacccgaaatcgctaaaaaataaaaacgaccttaaaaacgaaaaaccgaaccgaatccccgaacgtccccgacgtcgcctcctcgtccaaaccccgacgacccttaccgataaccaaacgaaaccgaccgcgattcaaaccgtccaaaaacgcgcaaacctaacaaaacgcgcgactaaccaacgccccacaacgaaaacaaacgccgaaacgcgaaaaccgcgcgaccgaaaccaacgccaaacgctcgaccgaatacacgaaatccaacaccgcgaacgaccgcgccgcctccaaacgcttaaacaaatcccgaacgtaaccgcgaaaaacctcgaacgcgtaaacgcactcctcgaaaaaataatcgaaacgacgaaaatacgcgtacaacaccacctccttctacgaaacgaactacaacgaacgacaacgcgacaaaacgcccccctcgccgaaaaaacccaaacccccgccccgaaccaaccgccccgcgtcgccccgtaaaaaattcataaacacgatctccgccatatcgtcgacgttataacctaataaaaaaaaaaaaaaacgaataaaataaaacgcgaaaaacgctactaaccaaaaaaccccccgaaaaaccaaaaatcca

SEQ ID NO: 11449 - DNA, 690 bp, Artificial Sequence
  chemically treated genomic DNA (Homo sapiens) CpG-island No: 11449
tgcgtttgaatttttttttaggtttcgttttttcgtttgtgtattcgttttattgtttcggagagtgtcgttttgcggttcgtattacgtttatttgttacgatgtgcgtggtttttacgcggcgcgtttttttttttagcgttcggcgtcgtagtattttatagaaggtgtagtaggagcggttgcggtcggagtcggttgtgttgcgggttacggcgtttatcgtttagtttttaaagaggttttcgtaggttacgatcgtgagcggtagtttttagcgcgtcgtttggcgtcgtacggtcgttaacgtcgcgtttcggtagttatcgatgtttttatcgacggttacgagttgtagtgagatgtttaggcgcggcgttagcgcgcgtagtacgtgcgttagtatcgtggagtttttgtcgttcgaggcgtttacggttattatcgcgtcgggcggtagtaggcggtcggcgagtatcgtgtgtagtatttcggtttcgaaggcggcgtagaagtaggtatcgtatagcgtttggttcgagagcggacggcggagggcggcgcgtgtagtatggtaggaggcgtacggcggggcgggtattgcgggaggggtcggttttttttagatagggagagagaggaggtgggttatatatggatttcggattgtagggtttttgttatcgggg

SEQ ID NO: 11450 - DNA, 690 bp, Artificial Sequence
  chemically treated genomic DNA (Homo sapiens) CpG-island No: 11450
ccccgataacaaaaaccctacaatccgaaatccatatataacccacctcctctctctccctatctaaaaaaaaccgacccctcccgcaatacccgccccgccgtacgcctcctaccatactacacgcgccgccctccgccgtccgctctcgaaccaaacgctatacgatacctacttctacgccgccttcgaaaccgaaatactacacacgatactcgccgaccgcctactaccgcccgacgcgataataaccgtaaacgcctcgaacgacaaaaactccacgatactaacgcacgtactacgcgcgctaacgccgcgcctaaacatctcactacaactcgtaaccgtcgataaaaacatcgataactaccgaaacgcgacgttaacgaccgtacgacgccaaacgacgcgctaaaaactaccgctcacgatcgtaacctacgaaaacctctttaaaaactaaacgataaacgccgtaacccgcaacacaaccgactccgaccgcaaccgctcctactacaccttctataaaatactacgacgccgaacgctaaaaaaaaaaacgcgccgcgtaaaaaccacgcacatcgtaacaaataaacgtaatacgaaccgcaaaacgacactctccgaaacaataaaacgaatacacaaacgaaaaaacgaaacctaaaaaaaaattcaaacgca

SEQ ID NO: 11451 - DNA, 690 bp, Artificial Sequence
  chemically treated genomic DNA (Homo sapiens) CpG-island No: 11451
tttcgatggtagggattttgtaattcggaatttatatgtaatttattttttttttttttttgtttaggagaagtcgatttttttcgtaatgttcgtttcgtcgtgcgttttttgttatgttgtacgcgtcgtttttcgtcgttcgttttcgggttaagcgttgtgcggtgtttgtttttgcgtcgttttcgaggtcgaggtgttgtatacggtgttcgtcggtcgtttgttgtcgttcggcgcggtggtggtcgtgggcgtttcgggcggtaaggattttacggtgttggcgtacgtgttgcgcgcgttggcgtcgcgtttgggtattttattgtagttcgtggtcgtcgatgagggtatcggtggttatcgggacgcggcgttggcggtcgtgcggcgttaggcggcgcgttgggagttgtcgtttacggtcgtggtttacgaagatttttttgggggttggacgatggacgtcgtggttcgtagtatagtcggtttcggtcgtagtcgtttttgttgtattttttgtggagtgttgcggcgtcgggcgttggaggaaggggcgcgtcgcgtgggagttacgtatatcgtgataggtgagcgtagtacgggtcgtagagcggtatttttcgaggtagtggggcgaatgtataggcgaggaggcgggatttgaaaggggatttaggcgta

SEQ ID NO: 11452 - DNA, 690 bp, Artificial Sequence
  chemically treated genomic DNA (Homo sapiens) CpG-island No: 11452
tacgcctaaatcccctttcaaatcccgcctcctcgcctatacattcgccccactacctcgaaaaataccgctctacgacccgtactacgctcacctatcacgatatacgtaactcccacgcgacgcgccccttcctccaacgcccgacgccgcaacactccacaaaaaatacaacaaaaacgactacgaccgaaaccgactatactacgaaccacgacgtccatcgtccaacccccaaaaaaatcttcgtaaaccacgaccgtaaacgacaactcccaacgcgccgcctaacgccgcacgaccgccaacgccgcgtcccgataaccaccgataccctcatcgacgaccacgaactacaataaaatacccaaacgcgacgccaacgcgcgcaacacgtacgccaacaccgtaaaatccttaccgcccgaaacgcccacgaccaccaccgcgccgaacgacaacaaacgaccgacgaacaccgtatacaacacctcgacctcgaaaacgacgcaaaaacaaacaccgcacaacgcttaacccgaaaacgaacgacgaaaaacgacgcgtacaacataacaaaaaacgcacgacgaaacgaacattacgaaaaaaatcgacttctcctaaacaaaaaaaaaaaaaaaataaattacatataaattccgaattacaaaatccctaccatcgaaa

SEQ ID NO: 11453 - DNA, 1110 bp, Artificial Sequence
  chemically treated genomic DNA (Homo sapiens) CpG-island No: 11453
tttcgggttcgttacgtcggattcgtttttttcgcgttgcgttgggtcggacgttaggtttgcgcgtcgcggttgagcgtttattcgttttgcggaaagagtcgcggaggaatcggcgggggcggttgcgggagtcgaaggaggtggtaatcgggagtagaattagaaggagatagggaggtagaagttcgcggtttcgtggtacgtattttttcggttagggatgggtttcggcgcggtttagtttttgttcggttcgtcgggtagagattgaatcgcggatttttatcgttttgtggacgatcggatagagagaggtattgatcgatcgttagtagtttttcggtgggatcgcgttttttgtatatttcgcgtagcgtttttcgtcggagtcgtatcgggtaagtcggcgagggagcggggttgattggcggtcgtcggcggttaggggagggggcgtcgcgcggggttatggtaggttcggaggcgttttagttcgagtcggagtcgattcgagtttacgcggtcgtcgttttttcgttttcgggttttcgtcgttatcgcgtttttcgcgggagatggaatagcggaatcggttcggtgttttcggatatttgtcgtttttgttgttgtatgttttgttgtttttcgtggtcgacggtgagcgcgggaattttgttgtcgttgtggattcgggggggtttttgttggggtcgttatcgagaagaagaagaaagagaacgaatcgggaagtttcgcggtttttagtaatttcgttgtgtagtttgggttcggaggggtagggagaggcgagcggcgaagggtcgtcgtagtagtagcgtcgcgttcgagtcgtttttagtttcgtcggggtttcggttgcggaaaggatgtttgcggggagcgggagtaggcgcgttttagttaggttttggcggtgcggttaggggcgggggagaagtacgagtcgtttttgtcgtttcgttttattcggagggaagtagtaggtagtcgatggtcggtttttgtttcggttttgtagtcgttttttcgaattttgttagttttttcggtcgtgcgttagggagtagttgcggggtggggggtata

SEQ ID NO: 11454 - DNA, 1110 bp, Artificial Sequence
  chemically treated genomic DNA (Homo sapiens) CpG-island No: 11454
tataccccccaccccgcaactactccctaacgcacgaccgaaaaaactaacaaaattcgaaaaaacgactacaaaaccgaaacaaaaaccgaccatcgactacctactacttccctccgaataaaacgaaacgacaaaaacgactcgtacttctcccccgcccctaaccgcaccgccaaaacctaactaaaacgcgcctactcccgctccccgcaaacatcctttccgcaaccgaaaccccgacgaaactaaaaacgactcgaacgcgacgctactactacgacgacccttcgccgctcgcctctccctacccctccgaacccaaactacacaacgaaattactaaaaaccgcgaaacttcccgattcgttctctttcttcttcttctcgataacgaccccaacaaaaacccccccgaatccacaacgacaacaaaattcccgcgctcaccgtcgaccacgaaaaacaacaaaacatacaacaacaaaaacgacaaatatccgaaaacaccgaaccgattccgctattccatctcccgcgaaaaacgcgataacgacgaaaacccgaaaacgaaaaaacgacgaccgcgtaaactcgaatcgactccgactcgaactaaaacgcctccgaacctaccataaccccgcgcgacgccccctcccctaaccgccgacgaccgccaatcaaccccgctccctcgccgacttacccgatacgactccgacgaaaaacgctacgcgaaatatacaaaaaacgcgatcccaccgaaaaactactaacgatcgatcaatacctctctctatccgatcgtccacaaaacgataaaaatccgcgattcaatctctacccgacgaaccgaacaaaaactaaaccgcgccgaaacccatccctaaccgaaaaaatacgtaccacgaaaccgcgaacttctacctccctatctccttctaattctactcccgattaccacctccttcgactcccgcaaccgcccccgccgattcctccgcgactctttccgcaaaacgaataaacgctcaaccgcgacgcgcaaacctaacgtccgacccaacgcaacgcgaaaaaaacgaatccgacgtaacgaacccgaaa

SEQ ID NO: 11455 - DNA, 1110 bp, Artificial Sequence
  chemically treated genomic DNA (Homo sapiens) CpG-island No: 11455
tgtgttttttatttcgtagttgttttttggcgtacggtcggaggggttagtaaagttcggggaagcggttgtagggtcgaggtagggatcggttatcggttgtttattgttttttttcggatggggcggggcggtaggggcgattcgtgtttttttttcgtttttggtcgtatcgttagagtttggttggggcgcgtttattttcgtttttcgtaggtatttttttcgtagtcggggtttcggcgggattgggaacgattcgggcgcggcgttgttgttgcggcgatttttcgtcgttcgtttttttttattttttcgggtttaggttgtatagcgggattgttggagatcgcgaagtttttcggttcgtttttttttttttttttttcggtggcggttttagtaaagattttttcgagtttatagcggtagtaaagttttcgcgtttatcgtcggttacgaagagtagtagggtatgtagtagtagaggcggtaggtattcgagggtatcgagtcggtttcgttgttttatttttcgcggggggcgcggtggcggcgggggttcgggagcggagaggcggcggtcgcgtgggttcggatcggtttcggttcgggttaggacgttttcgagtttgttatggtttcgcgcggcgtttttttttttggtcgtcggcggtcgttaattagtttcgttttttcgtcggtttgttcggtgcggtttcggcggggggcgttgcgcggggtgtgtaggagacgcggttttatcgggaggttgttggcgatcggttagtgtttttttttgttcggtcgtttataggacggtggggattcgcggtttagtttttgttcggcgggtcgggtaggggttgggtcgcgtcgggatttatttttggtcgagggagtgcgtgttacggagtcgcgagtttttgtttttttgtttttttttggttttgttttcgattgttatttttttcggttttcgtagtcgttttcgtcggttttttcgcggtttttttcgtagggcgagtgggcgtttagtcgcggcgcgtagatttggcgttcgatttagcgtagcgcggggagagcgggttcggcgtggcggattcggag

SEQ ID NO: 11456 - DNA, 1110 bp, Artificial Sequence
  chemically treated genomic DNA (Homo sapiens) CpG-island No: 11456
ctccgaatccgccacgccgaacccgctctccccgcgctacgctaaatcgaacgccaaatctacgcgccgcgactaaacgcccactcgccctacgaaaaaaaccgcgaaaaaaccgacgaaaacgactacgaaaaccgaaaaaaataacaatcgaaaacaaaaccaaaaaaaaacaaaaaaacaaaaactcgcgactccgtaacacgcactccctcgaccaaaaataaatcccgacgcgacccaacccctacccgacccgccgaacaaaaactaaaccgcgaatccccaccgtcctataaacgaccgaacaaaaaaaaacactaaccgatcgccaacaacctcccgataaaaccgcgtctcctacacaccccgcgcaacgccccccgccgaaaccgcaccgaacaaaccgacgaaaaaacgaaactaattaacgaccgccgacgaccaaaaaaaaaaacgccgcgcgaaaccataacaaactcgaaaacgtcctaacccgaaccgaaaccgatccgaacccacgcgaccgccgcctctccgctcccgaacccccgccgccaccgcgccccccgcgaaaaataaaacaacgaaaccgactcgataccctcgaatacctaccgcctctactactacataccctactactcttcgtaaccgacgataaacgcgaaaactttactaccgctataaactcgaaaaaatctttactaaaaccgccaccgaaaaaaaaaaaaaaaaaaacgaaccgaaaaacttcgcgatctccaacaatcccgctatacaacctaaacccgaaaaaataaaaaaaaacgaacgacgaaaaatcgccgcaacaacaacgccgcgcccgaatcgttcccaatcccgccgaaaccccgactacgaaaaaaatacctacgaaaaacgaaaataaacgcgccccaaccaaactctaacgatacgaccaaaaacgaaaaaaaaacacgaatcgcccctaccgccccgccccatccgaaaaaaaacaataaacaaccgataaccgatccctacctcgaccctacaaccgcttccccgaactttactaacccctccgaccgtacgccaaaaaacaactacgaaataaaaaacaca

SEQ ID NO: 11457 - DNA, 590 bp, Artificial Sequence
  chemically treated genomic DNA (Homo sapiens) CpG-island No: 11457
ttcggttgtttgtcgtgcggttgtaggacgagggcgtgtacgagtgtcgcgtgtcggattatagcgacgacgatacgtaggagtataaggtttaggcgatgttgcgcgtgttttcgcgtttcgcgtcgtttaatatgtaggtcgtcgaggtcgtgttttatatttagagtagcggttcgcgtcgttacggtttagttagcgtcgttaacgttaataacgcgggcgtcgcgagtcgtattattttcgagttcggtcgcggcgataagagttcgtcgttcgggagttttttcgtcgttatcgatttcgtagttttcgaggtcgcggtagtttcggcggtttatacgtttattattatagtcgcggtagttgttgttgtttcgttagcgtcgtcgttatcgggataggcggttttgttgcgttagaggtacggttcgggtaagggatcgcggagagggggcgtacgcgcggggatggcgtagggttagggttgcgtcgggacgtttcggggggtttcggatttaggattcgttttttgggcgtatttgtatatgtatatttttttttagttaggtcgggagcgttttttttag

SEQ ID NO: 11458 - DNA, 590 bp, Artificial Sequence
  chemically treated genomic DNA (Homo sapiens) CpG-island No: 11458
ctaaaaaaaacgctcccgacctaactaaaaaaaaatatacatatacaaatacgcccaaaaaacgaatcctaaatccgaaaccccccgaaacgtcccgacgcaaccctaaccctacgccatccccgcgcgtacgccccctctccgcgatcccttacccgaaccgtacctctaacgcaacaaaaccgcctatcccgataacgacgacgctaacgaaacaacaacaactaccgcgactataataataaacgtataaaccgccgaaactaccgcgacctcgaaaactacgaaatcgataacgacgaaaaaactcccgaacgacgaactcttatcgccgcgaccgaactcgaaaataatacgactcgcgacgcccgcgttattaacgttaacgacgctaactaaaccgtaacgacgcgaaccgctactctaaatataaaacacgacctcgacgacctacatattaaacgacgcgaaacgcgaaaacacgcgcaacatcgcctaaaccttatactcctacgtatcgtcgtcgctataatccgacacgcgacactcgtacacgccctcgtcctacaaccgcacgacaaacaaccgaa

SEQ ID NO: 11459 - DNA, 590 bp, Artificial Sequence
  chemically treated genomic DNA (Homo sapiens) CpG-island No: 11459
ttggggggggcgttttcgatttaattaggaaggagtatgtatatgtaaatgcgtttagggggcgggttttgggttcggagtttttcggggcgtttcggcgtagttttagttttgcgttattttcgcgcgtgcgtttttttttcgcgattttttattcgagtcgtgtttttggcgtagtaggatcgtttgtttcgatggcggcgacgttgacgaggtagtagtagttgtcgcgattgtggtggtgggcgtgtgggtcgtcgaggttgtcgcggtttcggggattgcgggatcgatggcggcgggagggttttcgggcggcgggtttttgtcgtcgcggtcgggttcggaggtggtacggttcgcggcgttcgcgttgttggcgttggcggcgttggttgggtcgtggcgacgcgggtcgttgttttggatgtgggatacggtttcggcggtttgtatgttgggcggcgcgaagcgcgagagtacgcgtagtatcgtttgggttttgtgtttttgcgtgtcgtcgtcgttgtagttcgatacgcggtattcgtatacgttttcgttttgtagtcgtacggtagatagtcgaa

SEQ ID NO: 11460 - DNA, 590 bp, Artificial Sequence
  chemically treated genomic DNA (Homo sapiens) CpG-island No: 11460
ttcgactatctaccgtacgactacaaaacgaaaacgtatacgaataccgcgtatcgaactacaacgacgacgacacgcaaaaacacaaaacccaaacgatactacgcgtactctcgcgcttcgcgccgcccaacatacaaaccgccgaaaccgtatcccacatccaaaacaacgacccgcgtcgccacgacccaaccaacgccgccaacgccaacaacgcgaacgccgcgaaccgtaccacctccgaacccgaccgcgacgacaaaaacccgccgcccgaaaaccctcccgccgccatcgatcccgcaatccccgaaaccgcgacaacctcgacgacccacacgcccaccaccacaatcgcgacaactactactacctcgtcaacgtcgccgccatcgaaacaaacgatcctactacgccaaaaacacgactcgaataaaaaatcgcgaaaaaaaaacgcacgcgcgaaaataacgcaaaactaaaactacgccgaaacgccccgaaaaactccgaacccaaaacccgccccctaaacgcatttacatatacatactccttcctaattaaatcgaaaacgccccccccaa

SEQ ID NO: 11461 - DNA, 856 bp, Artificial Sequence
  chemically treated genomic DNA (Homo sapiens) CpG-island No: 11461
cgtttgtcgggtttatttgaaaatcgaaaatttcgttattgtcggcggtttatcggttgttatattttgattaattaggagcgacgcgttttacgtcgagttcgaagttttttcggcgacgcgtagttattggttatgtaggttttgtgggcggaacgtcgtaaggtcgcgcgtcgggtaacgcggtgtcgttatatagtagcgagtttgtaagaaaataaattagttgcgttcggggcgtggtcgggagtacgttggtttcgttttttggcggttgttttagcggcggcggcggcgtaggtttagagtagatttcgttcggcgaggaggagggagggtgagttagggggagattcggtttttaaggggcgggcgtcgggtagggtttcgcgggcggtcgagggttgggttcggtttttagtttttcgtcgtttttcggttgatagggggaggagttcgtcgggagggtcggggtttcgggttggggagtcgggacgggagagtagcgtagtcgggtgtatcgcggtcgcgtttcgggagggttgttcgggttagcgttcgtcggttgtttcgcgttgatagcgtcgggttggggcggggcggggggttttgtaggtcgttagtgtcgatatgttgttggaggaggttcgcgtcggcgatcggttgagtggggcggcggttcggggcgacgtgtaggaggtgcgtcgttttttgtatcgggagttggtgtatttcgacgtttttaatcgtttcggtaagacggcgttgtaggtgaggtcgggtcggtttaggttggggcggggcggttaagcgggatgaggatcgagattttagagtttttttttggttttttggt

SEQ ID NO: 11462 - DNA, 856 bp, Artificial Sequence
  chemically treated genomic DNA (Homo sapiens) CpG-island No: 11462
accaaaaaaccaaaaaaaaactctaaaatctcgatcctcatcccgcttaaccgccccgccccaacctaaaccgacccgacctcacctacaacgccgtcttaccgaaacgattaaaaacgtcgaaatacaccaactcccgatacaaaaaacgacgcacctcctacacgtcgccccgaaccgccgccccactcaaccgatcgccgacgcgaacctcctccaacaacatatcgacactaacgacctacaaaaccccccgccccgccccaacccgacgctatcaacgcgaaacaaccgacgaacgctaacccgaacaaccctcccgaaacgcgaccgcgatacacccgactacgctactctcccgtcccgactccccaacccgaaaccccgaccctcccgacgaactcctccccctatcaaccgaaaaacgacgaaaaactaaaaaccgaacccaaccctcgaccgcccgcgaaaccctacccgacgcccgccccttaaaaaccgaatctccccctaactcaccctccctcctcctcgccgaacgaaatctactctaaacctacgccgccgccgccgctaaaacaaccgccaaaaaacgaaaccaacgtactcccgaccacgccccgaacgcaactaatttattttcttacaaactcgctactatataacgacaccgcgttacccgacgcgcgaccttacgacgttccgcccacaaaacctacataaccaataactacgcgtcgccgaaaaaacttcgaactcgacgtaaaacgcgtcgctcctaattaatcaaaatataacaaccgataaaccgccgacaataacgaaattttcgattttcaaataaacccgacaaacg

SEQ ID NO: 11463 - DNA, 856 bp, Artificial Sequence
  chemically treated genomic DNA (Homo sapiens) CpG-island No: 11463
gttaggagattagagaggagttttggggtttcgatttttatttcgtttagtcgtttcgttttaatttggatcggttcggttttatttgtagcgtcgttttgtcgaagcggttgagggcgtcgggatgtattagttttcggtgtagaaggcggcgtattttttgtacgtcgtttcgggtcgtcgttttatttagtcggtcgtcggcgcgaattttttttagtagtatgtcgatattggcggtttgtaaagtttttcgtttcgttttagttcggcgttgttagcgcggagtagtcggcgggcgttggttcgaatagttttttcggggcgcggtcgcggtgtattcggttgcgttgttttttcgtttcggttttttagttcgagatttcggttttttcggcgggtttttttttttgttagtcggaggacggcgaggggttgggagtcgggtttaattttcggtcgttcgcggggttttgttcggcgttcgttttttgggggtcgggtttttttttaatttattttttttttttttcgtcgggcggggtttgttttgagtttgcgtcgtcgtcgtcgttgaggtagtcgttagggggcggagttaacgtgttttcggttacgtttcgaacgtaattgatttgtttttttataaattcgttattgtgtagcggtatcgcgttgttcggcgcgcgattttacggcgtttcgtttatagggtttgtataattagtggttgcgcgtcgtcggggaaatttcgggttcggcgtgaaacgcgtcgtttttgattggttagagtgtggtaatcggtggatcgtcggtaatggcggggttttcggtttttaaatgaattcggtaggcg

SEQ ID NO: 11464 - DNA, 856 bp, Artificial Sequence
  chemically treated genomic DNA (Homo sapiens) CpG-island No: 11464
cgcctaccgaattcatttaaaaaccgaaaaccccgccattaccgacgatccaccgattaccacactctaaccaatcaaaaacgacgcgtttcacgccgaacccgaaatttccccgacgacgcgcaaccactaattatacaaaccctataaacgaaacgccgtaaaatcgcgcgccgaacaacgcgataccgctacacaataacgaatttataaaaaaacaaatcaattacgttcgaaacgtaaccgaaaacacgttaactccgccccctaacgactacctcaacgacgacgacgacgcaaactcaaaacaaaccccgcccgacgaaaaaaaaaaaaaataaattaaaaaaaaacccgacccccaaaaaacgaacgccgaacaaaaccccgcgaacgaccgaaaattaaacccgactcccaacccctcgccgtcctccgactaacaaaaaaaaaaacccgccgaaaaaaccgaaatctcgaactaaaaaaccgaaacgaaaaaacaacgcaaccgaatacaccgcgaccgcgccccgaaaaaactattcgaaccaacgcccgccgactactccgcgctaacaacgccgaactaaaacgaaacgaaaaactttacaaaccgccaatatcgacatactactaaaaaaaattcgcgccgacgaccgactaaataaaacgacgacccgaaacgacgtacaaaaaatacgccgccttctacaccgaaaactaatacatcccgacgccctcaaccgcttcgacaaaacgacgctacaaataaaaccgaaccgatccaaattaaaacgaaacgactaaacgaaataaaaatcgaaaccccaaaactcctctctaatctcctaac

SEQ ID NO: 11465 - DNA, 807 bp, Artificial Sequence
  chemically treated genomic DNA (Homo sapiens) CpG-island No: 11465
gggggtcgcggatcgtggatgtggtgggtgaggggagagaatagtaatttttagggcgttagggtgagtgagttgggtggggtagcggttttcgttgtcggaacggaagggaagtaggaaatcgcgagtggagaaagggtttttagatgttagttgggtgttcggagtatagggggtggggcgggtgggcggtggtcgcggtttttttcgtaggggcgtagtcgtgggcggtgattgcggtgatgaggcgaaagggatttcggaaaagttaggggcggggttagtagcggtacgtttcgtttataagtggatgcgggcgggattgagggcggtttcgtttcgtttagggtttttttaatgcgcgtgcgtaatgggttatagaatcgttatgtcggaatcgcgcgggtcgtcgtagttgcgggtgaacgcggcgtttgtcgcgcggtataatcgttatcgggagcgcgaggaattgtagcggcgtgagtgcggggcgtatgcgcgcgggagtttgcgcgcgtcggtcggttgggaagtggggagtcgagtggtttcgtcggttgatttgggggggggtatttcgtttgtgtttcgtagtgaaggatcgttacggggatcgagatagtagtagcgattttagtttcgagtcggatttaagcgacgagcgcgtggtgcgcgttttcgtttcgttttggacgtgcggaggcgtttaagtttttttttgtatttcgatttcgatgtagacgggggggaatttttaattttagagcgttttgcgggagcgttttatttttcgttttttatttt

SEQ ID NO: 11466 - DNA, 807 bp, Artificial Sequence
  chemically treated genomic DNA (Homo sapiens) CpG-island No: 11466
aaaataaaaaacgaaaaataaaacgctcccgcaaaacgctctaaaattaaaaattcccccccgtctacatcgaaatcgaaatacaaaaaaaaacttaaacgcctccgcacgtccaaaacgaaacgaaaacgcgcaccacgcgctcgtcgcttaaatccgactcgaaactaaaatcgctactactatctcgatccccgtaacgatccttcactacgaaacacaaacgaaatacccccccccaaatcaaccgacgaaaccactcgactccccacttcccaaccgaccgacgcgcgcaaactcccgcgcgcatacgccccgcactcacgccgctacaattcctcgcgctcccgataacgattataccgcgcgacaaacgccgcgttcacccgcaactacgacgacccgcgcgattccgacataacgattctataacccattacgcacgcgcattaaaaaaaccctaaacgaaacgaaaccgccctcaatcccgcccgcatccacttataaacgaaacgtaccgctactaaccccgcccctaacttttccgaaatccctttcgcctcatcaccgcaatcaccgcccacgactacgcccctacgaaaaaaaccgcgaccaccgcccacccgccccaccccctatactccgaacacccaactaacatctaaaaaccctttctccactcgcgatttcctacttcccttccgttccgacaacgaaaaccgctaccccacccaactcactcaccctaacgccctaaaaattactattctctcccctcacccaccacatccacgatccgcgaccccc

SEQ ID NO: 11467 - DNA, 807 bp, Artificial Sequence
  chemically treated genomic DNA (Homo sapiens) CpG-island No: 11467
gggatggggagcggaggatgggacgttttcgtagggcgttttggggttgggggttttttttcgtttatatcggggtcggggtgtagaggggggtttggacgttttcgtacgtttaggacggggcggggacgcgtattacgcgttcgtcgtttgagttcgattcggagttggagtcgttgttgttgtttcggttttcgtagcgattttttattgcgggatatagacgggatgtttttttttaggttagtcggcggggttattcgattttttattttttaatcggtcggcgcgcgtaggttttcgcgcgtatgcgtttcgtatttacgtcgttgtagtttttcgcgttttcggtagcggttgtatcgcgcggtaaacgtcgcgtttattcgtagttgcgacgattcgcgcggtttcggtatggcggttttgtggtttattgcgtacgcgtattgaggaagttttggacggggcggggtcgtttttagtttcgttcgtatttatttgtaaacgaggcgtatcgttgttaatttcgtttttggttttttcgggatttttttcgttttattatcgtagttatcgtttacggttacgtttttgcggggaaggtcgcggttatcgtttattcgttttattttttgtgtttcgggtatttagttgatatttgggggttttttttttattcgcggttttttgtttttttttcgtttcgatagcgaaaatcgttgttttatttagtttatttattttggcgttttgggaattattattttttttttttatttattatatttacgattcgcgattttt

SEQ ID NO: 11468 - DNA, 807 bp, Artificial Sequence
  chemically treated genomic DNA (Homo sapiens) CpG-island No: 11468
aaaaatcgcgaatcgtaaatataataaataaaaaaaaaaaataataattcccaaaacgccaaaataaataaactaaataaaacaacgattttcgctatcgaaacgaaaaaaaaacaaaaaaccgcgaataaaaaaaaaacccccaaatatcaactaaatacccgaaacacaaaaaataaaacgaataaacgataaccgcgaccttccccgcaaaaacgtaaccgtaaacgataactacgataataaaacgaaaaaaatcccgaaaaaaccaaaaacgaaattaacaacgatacgcctcgtttacaaataaatacgaacgaaactaaaaacgaccccgccccgtccaaaacttcctcaatacgcgtacgcaataaaccacaaaaccgccataccgaaaccgcgcgaatcgtcgcaactacgaataaacgcgacgtttaccgcgcgatacaaccgctaccgaaaacgcgaaaaactacaacgacgtaaatacgaaacgcatacgcgcgaaaacctacgcgcgccgaccgattaaaaaataaaaaatcgaataaccccgccgactaacctaaaaaaaaacatcccgtctatatcccgcaataaaaaatcgctacgaaaaccgaaacaacaacaacgactccaactccgaatcgaactcaaacgacgaacgcgtaatacgcgtccccgccccgtcctaaacgtacgaaaacgtccaaacccccctctacaccccgaccccgatataaacgaaaaaaaacccccaaccccaaaacgccctacgaaaacgtcccatcctccgctccccatccc

SEQ ID NO: 11469 - DNA, 587 bp, Artificial Sequence
  chemically treated genomic DNA (Homo sapiens) CpG-island No: 11469
cgtcgcgggtacgtaagcgtcgtagttacgtcggcggcgtacggcgcgttattttcggttcgtttttcgcgttttaggtcgttattcgttcgcgatttttgtcgcgttcgtttatcggtttacgaagttttttagtatcgagtttttgtcggcgttttggtcgtttattatagcgatttgcggtaggtttaggtggtagttttggtcgatggagttgaaggcgttttgtagtttttttatttcgcggttgtttatggcgtcggcggttttcggttcgagcgttttgcgtttttcgttcgtcgtcgatttttaacgatttggtttcgcggcgtttgtagtcgttgtttttcgttcgttcgggtttcggtaagacgttcgttttcggttcggttttacggtcgtcgttttattcggtttttaggcgatattcgattcgagcgatttttcgtttcggtttcgggggttgcgtttaaagtattcgcgtcgtacgcgattggtttgttgtatcgttattcggatatattagttaataaaaattaggtacgggtttatggttgagtaaattttttttttggggatcgttttgt

SEQ ID NO: 11470 - DNA, 587 bp, Artificial Sequence
  chemically treated genomic DNA (Homo sapiens) CpG-island No: 11470
acaaaacgatccccaaaaaaaaaatttactcaaccataaacccgtacctaatttttattaactaatatatccgaataacgatacaacaaaccaatcgcgtacgacgcgaatactttaaacgcaacccccgaaaccgaaacgaaaaatcgctcgaatcgaatatcgcctaaaaaccgaataaaacgacgaccgtaaaaccgaaccgaaaacgaacgtcttaccgaaacccgaacgaacgaaaaacaacgactacaaacgccgcgaaaccaaatcgttaaaaatcgacgacgaacgaaaaacgcaaaacgctcgaaccgaaaaccgccgacgccataaacaaccgcgaaataaaaaaactacaaaacgccttcaactccatcgaccaaaactaccacctaaacctaccgcaaatcgctataataaacgaccaaaacgccgacaaaaactcgatactaaaaaacttcgtaaaccgataaacgaacgcgacaaaaatcgcgaacgaataacgacctaaaacgcgaaaaacgaaccgaaaataacgcgccgtacgccgccgacgtaactacgacgcttacgtacccgcgacg

SEQ ID NO: 11471 - DNA, 587 bp, Artificial Sequence
  chemically treated genomic DNA (Homo sapiens) CpG-island No: 11471
gtaagacggtttttagggggaaggtttatttaattataggttcgtgtttagtttttattggttagtgtattcgagtggcggtgtagtaggttagtcgcgtgcggcgcgagtgttttgggcgtagttttcggggtcggggcgggaggtcgttcgggtcgggtgtcgtttgagaatcggatgaggcggcgatcgtgaggtcgagtcgggagcgggcgttttgtcgaggttcgggcgggcggggagtaacggttatagacgtcgcggggttaggtcgttgagggtcggcggcgggcgaggagcgtagggcgttcgggtcgggggtcgtcggcgttatgggtaatcgcgggatggaaaaattgtaggacgtttttagttttatcggttagagttgttatttggatttgtcgtagatcgttgtagtgggcggttagagcgtcggtaagagttcggtgttggagaatttcgtgggtcggtgagcgggcgcggtagggatcgcgggcgggtggcggtttagggcgcggagggcggatcgggaatggcgcgtcgtgcgtcgtcggcgtaattgcggcgtttgcgtgttcgcggcg

SEQ ID NO: 11472 - DNA, 587 bp, Artificial Sequence
  chemically treated genomic DNA (Homo sapiens) CpG-island No: 11472
cgccgcgaacacgcaaacgccgcaattacgccgacgacgcacgacgcgccattcccgatccgccctccgcgccctaaaccgccacccgcccgcgatccctaccgcgcccgctcaccgacccacgaaattctccaacaccgaactcttaccgacgctctaaccgcccactacaacgatctacgacaaatccaaataacaactctaaccgataaaactaaaaacgtcctacaatttttccatcccgcgattacccataacgccgacgacccccgacccgaacgccctacgctcctcgcccgccgccgaccctcaacgacctaaccccgcgacgtctataaccgttactccccgcccgcccgaacctcgacaaaacgcccgctcccgactcgacctcacgatcgccgcctcatccgattctcaaacgacacccgacccgaacgacctcccgccccgaccccgaaaactacgcccaaaacactcgcgccgcacgcgactaacctactacaccgccactcgaatacactaaccaataaaaactaaacacgaacctataattaaataaaccttccccctaaaaaccgtcttac

SEQ ID NO: 11473 - DNA, 1339 bp, Artificial Sequence
  chemically treated genomic DNA (Homo sapiens) CpG-island No: 11473
ttttcgcgatttgtgaggataaaggaggcgatttttttcgtttcgggaatttgggatttttttggaatcgggggcgggatcgggataaagaggaggagggggtagggaaggagtgaggaaggggggtcgtttcgtcgcggaattcgggattcgagggggtgtgtgttttaagtacgtgcgcgcgtttttaggattttcgtaatagataaaagtttagtcgcggggaggcggtagtcgggggttcggtgcgcgcgtattttttcgcgcgtggcgtcgtcgtcggtcgaggggtcgcgtgcgggggggagcggttgtcgcgtatcgagttttcgtcgtcgtcgtagtcgttattttgtttttttcgtataatggaagagagttaacggttcgagcgcgggagaggtcggtaagggaggaacgggttaggcgtcgggatgagggaatcgggcggaggcggcgagcgtgggatttttttagttttgttatcgcgaatttttagtggggattttattgagggcgggcggggggaggggtagaggcgggagcgggttcggtcgtcgttatattgacgtttattttgtcggcgttttttttttcgatcgtagtcgtcgtcgtcgtttttttgttatagttcgtcggggtttgtttttaaaagttacgcggtgcgcgtcgggttgttgggtttaattgtaatggcgagaagaggaggaggaggagttcggatcgggggcgagcgggcgggcgggtaggcgcgcgtcggggaggtgcgggaatacgtgatcggttgaagtttcgttttttttgacgtcgcgttgcgtttcgacgtaggtttaatttaaatgggagggaggggcgaaaagagataaggggggggttgagggggtgggcgtgagttgtacgtggtgtaagcgggagtgtttgcgtgcgtagttacgtgatttcggtattttttttttcgttttcgataggttgttttattatgtgataatggcgaatttcgcggtttttttcgttatttgataatttttggcgttttttttttgtcgtattgggagttttttattacgtgacgagggtacgttttggttttcgttaaggcgttttttgagcggttattattacgtgatgtaaggtaagcgttagaggcggagtttttttacggttgcgatattttgcgtttgcgcggtcgttattttacgttcgtcgttttgagtacgttagcggaaatggtttcgagaggttttgacgtatgtgtatttttttagtggcggtatttcggtcggggattttcgggttttagtggaggtggttatgtttattttattttttttgagaggta

SEQ ID NO: 11474 - DNA, 1339 bp, Artificial Sequence
  chemically treated genomic DNA (Homo sapiens) CpG-island No: 11474
tacctctcaaaaaaaataaaataaacataaccacctccactaaaacccgaaaatccccgaccgaaataccgccactaaaaaaatacacatacgtcaaaacctctcgaaaccatttccgctaacgtactcaaaacgacgaacgtaaaataacgaccgcgcaaacgcaaaatatcgcaaccgtaaaaaaactccgcctctaacgcttaccttacatcacgtaataataaccgctcaaaaaacgccttaacgaaaaccaaaacgtaccctcgtcacgtaataaaaaactcccaatacgacaaaaaaaaaacgccaaaaattatcaaataacgaaaaaaaccgcgaaattcgccattatcacataataaaacaacctatcgaaaacgaaaaaaaaaataccgaaatcacgtaactacgcacgcaaacactcccgcttacaccacgtacaactcacgcccaccccctcaaccccccccttatctcttttcgcccctccctcccatttaaattaaacctacgtcgaaacgcaacgcgacgtcaaaaaaaacgaaacttcaaccgatcacgtattcccgcacctccccgacgcgcgcctacccgcccgcccgctcgcccccgatccgaactcctcctcctcctcttctcgccattacaattaaacccaacaacccgacgcgcaccgcgtaacttttaaaaacaaaccccgacgaactataacaaaaaaacgacgacgacgactacgatcgaaaaaaaaaacgccgacaaaataaacgtcaatataacgacgaccgaacccgctcccgcctctacccctccccccgcccgccctcaataaaatccccactaaaaattcgcgataacaaaactaaaaaaatcccacgctcgccgcctccgcccgattccctcatcccgacgcctaacccgttcctcccttaccgacctctcccgcgctcgaaccgttaactctcttccattatacgaaaaaaacaaaataacgactacgacgacgacgaaaactcgatacgcgacaaccgctcccccccgcacgcgacccctcgaccgacgacgacgccacgcgcgaaaaaatacgcgcgcaccgaacccccgactaccgcctccccgcgactaaacttttatctattacgaaaatcctaaaaacgcgcgcacgtacttaaaacacacaccccctcgaatcccgaattccgcgacgaaacgaccccccttcctcactccttccctaccccctcctcctctttatcccgatcccgcccccgattccaaaaaaatcccaaattcccgaaacgaaaaaaatcgcctcctttatcctcacaaatcgcgaaaa

SEQ ID NO: 11475 - DNA, 1339 bp, Artificial Sequence
  chemically treated genomic DNA (Homo sapiens) CpG-island No: 11475
tgttttttaagggagatggggtgagtatagttatttttattggagttcgaaaattttcggtcgagatatcgttattaaaaaggtatatatgcgttaaagtttttcggagttattttcgttaacgtatttagggcgacgggcgtaagatggcggtcgcgtaggcgtaaaatgtcgtagtcgtagggaggtttcgtttttgacgtttgttttgtattacgtggtaatggtcgtttaaaaaacgttttagcgaaaattagagcgtgttttcgttacgtgatggaggatttttagtacggtaaagggaaggcgttaaaagttgttagatggcgaaggaaatcgcgaaattcgttattgttatatgatggagtaatttatcgaaagcggagggaaaggtgtcgaagttacgtgattacgtacgtaaatattttcgtttgtattacgtgtaatttacgtttatttttttagttttttttttattttttttcgttttttttttttatttgggttgggtttgcgtcgaggcgtaacgcggcgttaaagggggcggggttttagtcggttacgtgttttcgtattttttcggcgcgcgtttgttcgttcgttcgttcgttttcggttcggatttttttttttttttttttcgttattgtagttggatttagtagttcggcgcgtatcgcgtggtttttgggggtagatttcggcgggttgtggtaggagggcggcggcggcggttgcggtcgaagaaggggacgtcgataaggtaagcgttaatgtggcggcggtcgggttcgttttcgtttttgttttttttttcgttcgtttttagtgagatttttattgagggttcgcggtgataaggttggagggattttacgttcgtcgttttcgttcggtttttttatttcggcgtttggttcgttttttttttgtcggtttttttcgcgttcgggtcgttaatttttttttattgtgcggaggaaataaaatggcggttgcggcggcggcgaggattcggtgcgcggtagtcgttttttttcgtacgcggtttttcggtcggcggcggcgttacgcgcgggggggtgcgcgcgtatcgggttttcggttgtcgttttttcgcggttgggtttttgtttgttgcgggggttttggggacgcgcgtacgtgtttggagtatatattttttcgggtttcgagtttcgcggcggggcgattttttttttttattttttttttattttttttttttttttgtttcggtttcgttttcgattttaggagagttttaggttttcgaggcgggaaaagtcgttttttttgtttttataggtcgcggaga

SEQ ID NO: 11476 - DNA, 1339 bp, Artificial Sequence
  chemically treated genomic DNA (Homo sapiens) CpG-island No: 11476
tctccgcgacctataaaaacaaaaaaaacgacttttcccgcctcgaaaacctaaaactctcctaaaatcgaaaacgaaaccgaaacaaaaaaaaaaaaaaaataaaaaaaaaataaaaaaaaaaaatcgccccgccgcgaaactcgaaacccgaaaaaatatatactccaaacacgtacgcgcgtccccaaaacccccgcaacaaacaaaaacccaaccgcgaaaaaacgacaaccgaaaacccgatacgcgcgcacccccccgcgcgtaacgccgccgccgaccgaaaaaccgcgtacgaaaaaaaacgactaccgcgcaccgaatcctcgccgccgccgcaaccgccattttatttcctccgcacaataaaaaaaaattaacgacccgaacgcgaaaaaaaccgacaaaaaaaaaacgaaccaaacgccgaaataaaaaaaccgaacgaaaacgacgaacgtaaaatccctccaaccttatcaccgcgaaccctcaataaaaatctcactaaaaacgaacgaaaaaaaaaacaaaaacgaaaacgaacccgaccgccgccacattaacgcttaccttatcgacgtccccttcttcgaccgcaaccgccgccgccgccctcctaccacaacccgccgaaatctacccccaaaaaccacgcgatacgcgccgaactactaaatccaactacaataacgaaaaaaaaaaaaaaaaaaatccgaaccgaaaacgaacgaacgaacgaacaaacgcgcgccgaaaaaatacgaaaacacgtaaccgactaaaaccccgccccctttaacgccgcgttacgcctcgacgcaaacccaacccaaataaaaaaaaaaaacgaaaaaaaataaaaaaaaaactaaaaaaataaacgtaaattacacgtaatacaaacgaaaatatttacgtacgtaatcacgtaacttcgacacctttccctccgctttcgataaattactccatcatataacaataacgaatttcgcgatttccttcgccatctaacaacttttaacgccttccctttaccgtactaaaaatcctccatcacgtaacgaaaacacgctctaattttcgctaaaacgttttttaaacgaccattaccacgtaatacaaaacaaacgtcaaaaacgaaacctccctacgactacgacattttacgcctacgcgaccgccatcttacgcccgtcgccctaaatacgttaacgaaaataactccgaaaaactttaacgcatatatacctttttaataacgatatctcgaccgaaaattttcgaactccaataaaaataactatactcaccccatctcccttaaaaaaca

SEQ ID NO: 11477 - DNA, 501 bp, Artificial Sequence
  chemically treated genomic DNA (Homo sapiens) CpG-island No: 11477
gacgggtttttttttcgcgcgcggttttggatttagtgggcgtttggtttttggtttcgtttgttttggtatgggtttcggcgttcgcgtttttttttttttttttgttttttgcggcgtcgttttgggtcgagtttcggttttcggtttttttttcgggagtgacgtttcggtttcggtttcggtcgttcgcgcgggttttgcgggtttcggaagcggtgggaggcgcgtcggtcggagttaggtttttgggggtcgtgcgcgtttttttggttcggggttttttggatgttttgtttttcggtttcgacgtttcgttttcggtgtttttcgattttttttcggattgttcgttcgaagtttttttcgatttttcgttggattttatgttttttcgggcggttaggagcgttaatattttttttagtttgtttttggggtatttgtatttttcgtttttttaggcgttttttttttttttttttattattttcgttatgt

SEQ ID NO: 11478 - DNA, 501 bp, Artificial Sequence
  chemically treated genomic DNA (Homo sapiens) CpG-island No: 11478
acataacgaaaataataaaaaaaaaaaaaaaaaacgcctaaaaaaacgaaaaatacaaataccccaaaaacaaactaaaaaaaatattaacgctcctaaccgcccgaaaaaacataaaatccaacgaaaaatcgaaaaaaacttcgaacgaacaatccgaaaaaaaatcgaaaaacaccgaaaacgaaacgtcgaaaccgaaaaacaaaacatccaaaaaaccccgaaccaaaaaaacgcgcacgacccccaaaaacctaactccgaccgacgcgcctcccaccgcttccgaaacccgcaaaacccgcgcgaacgaccgaaaccgaaaccgaaacgtcactcccgaaaaaaaaaccgaaaaccgaaactcgacccaaaacgacgccgcaaaaaacaaaaaaaaaaaaaaaaacgcgaacgccgaaacccataccaaaacaaacgaaaccaaaaaccaaacgcccactaaatccaaaaccgcgcgcgaaaaaaaaacccgtc

SEQ ID NO: 11479 - DNA, 501 bp, Artificial Sequence
  chemically treated genomic DNA (Homo sapiens) CpG-island No: 11479
atatggcggaggtgatgaaggaggaaaaagaaaacgtttgggaaggcgggaagtataaatattttaaaggtaaattgggggaggtattggcgtttttggtcgttcgggagaatatggggtttaacgaggggtcggaggaggtttcggacgaatagttcgaggaggagtcggaggatatcgagagcgaggcgtcggagtcggaggatagggtatttaggaagtttcgggttaagagggcgcgtacggtttttaggggtttgatttcggtcggcgcgttttttatcgttttcggggttcgtaaaattcgcgcgggcggtcgaggtcgaggtcggggcgttattttcgagaagaaagtcgggagtcggggttcggtttaggacgacgtcgtaggaagtaggaagaagaaggggagcgcgggcgtcggggtttatgttagggtaggcgaggttaagggttaggcgtttattggatttaaggtcgcgcgcgggaagaaggttcgtt

SEQ ID NO: 11480 - DNA, 501 bp, Artificial Sequence
  chemically treated genomic DNA (Homo sapiens) CpG-island No: 11480
aacgaaccttcttcccgcgcgcgaccttaaatccaataaacgcctaacccttaacctcgcctaccctaacataaaccccgacgcccgcgctccccttcttcttcctacttcctacgacgtcgtcctaaaccgaaccccgactcccgactttcttctcgaaaataacgccccgacctcgacctcgaccgcccgcgcgaattttacgaaccccgaaaacgataaaaaacgcgccgaccgaaatcaaacccctaaaaaccgtacgcgccctcttaacccgaaacttcctaaataccctatcctccgactccgacgcctcgctctcgatatcctccgactcctcctcgaactattcgtccgaaacctcctccgacccctcgttaaaccccatattctcccgaacgaccaaaaacgccaatacctcccccaatttacctttaaaatatttatacttcccgccttcccaaacgttttctttttcctccttcatcacctccgccatat

SEQ ID NO: 11481 - DNA, 518 bp, Artificial Sequence
  chemically treated genomic DNA (Homo sapiens) CpG-island No: 11481
tttcgtttttacggtgttcgttttagttttcgaagaggttacgtttagtttttttcgtttggggagggagattcggttgcgttaaggtggaaatgtattttcggaggttttcgttattttcggttttgcgtaggattacggcgtttatttcgcggttcgttttttttatttttacgcgggtttcgttagtgtttttggatatgacggataagatttgtcggagggggtttcgtttgtttttttcgtcgttttagtttagcgattcgataatagaagcgatttttaatattttttttcgggtttaggggttcgacgggtcggtataggttataatggttacgaatttaggattatttaatttttttgttttttggtttttatttttttgcgagtcgtttttcgaagtgtcgttgtttatcggtttttcgttcggggtgttttttatagttagtagggttattaagtcggggatattatttttgttttttttggtgtttaagcggatggattcggtttta

SEQ ID NO: 11482 - DNA, 518 bp, Artificial Sequence
  chemically treated genomic DNA (Homo sapiens) CpG-island No: 11482
taaaaccgaatccatccgcttaaacaccaaaaaaaacaaaaataatatccccgacttaataaccctactaactataaaaaacaccccgaacgaaaaaccgataaacaacgacacttcgaaaaacgactcgcaaaaaaataaaaaccaaaaaacaaaaaaattaaataatcctaaattcgtaaccattataacctataccgacccgtcgaacccctaaacccgaaaaaaaatattaaaaatcgcttctattatcgaatcgctaaactaaaacgacgaaaaaaacaaacgaaaccccctccgacaaatcttatccgtcatatccaaaaacactaacgaaacccgcgtaaaaataaaaaaaacgaaccgcgaaataaacgccgtaatcctacgcaaaaccgaaaataacgaaaacctccgaaaatacatttccaccttaacgcaaccgaatctccctccccaaacgaaaaaaactaaacgtaacctcttcgaaaactaaaacgaacaccgtaaaaacgaaa

SEQ ID NO: 11483 - DNA, 518 bp, Artificial Sequence
  chemically treated genomic DNA (Homo sapiens) CpG-island No: 11483
tggggtcgaatttattcgtttgaatattaaagaagataaaaatggtgttttcgatttagtggttttgttggttgtgagagatatttcggacgaggagtcggtggatagcgatatttcggagagcgattcgtaggaaagtggggattaagaaatagaggagttggataattttgagttcgtggttattgtggtttatatcgattcgtcggatttttgggttcgggaggagatgttgaaaatcgtttttgttatcgagtcgttgggttggagcgacgagaaagataagcgagatttttttcgataggttttgttcgttatgtttaaggatattaacgggattcgcgtgaaggtggaagaggcgggtcgcgaggtggacgtcgtggttttgcgtaaggtcggggatgacggggattttcgggagtgtatttttattttggcgtagtcggatttttttttttaggcgaagaaggttgggcgtggttttttcgggggttggagcgagtatcgtgaggacgaag

SEQ ID NO: 11484 - DNA, 518 bp, Artificial Sequence
  chemically treated genomic DNA (Homo sapiens) CpG-island No: 11484
cttcgtcctcacgatactcgctccaacccccgaaaaaaccacgcccaaccttcttcgcctaaaaaaaaaaatccgactacgccaaaataaaaatacactcccgaaaatccccgtcatccccgaccttacgcaaaaccacgacgtccacctcgcgacccgcctcttccaccttcacgcgaatcccgttaatatccttaaacataacgaacaaaacctatcgaaaaaaatctcgcttatctttctcgtcgctccaacccaacgactcgataacaaaaacgattttcaacatctcctcccgaacccaaaaatccgacgaatcgatataaaccacaataaccacgaactcaaaattatccaactcctctatttcttaatccccactttcctacgaatcgctctccgaaatatcgctatccaccgactcctcgtccgaaatatctctcacaaccaacaaaaccactaaatcgaaaacaccatttttatcttctttaatattcaaacgaataaattcgacccca

SEQ ID NO: 11485 - DNA, 626 bp, Artificial Sequence
  chemically treated genomic DNA (Homo sapiens) CpG-island No: 11485
ggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtaggtcgtgttgacgcgtagtatggaatacgatgttgtcggacgggttattcgtttgattagtgaaaacggtagttatatatttttcgttacgatgtaattgatcggttgataaaggatatcggttttgacggcgtatatagggtataatacgattgatcggtaaatttttttatttaggagagggtttgttattattggtttttgagaattatacgttttaggtatcgatttga

SEQ ID NO: 11486 - DNA, 626 bp, Artificial Sequence
  chemically treated genomic DNA (Homo sapiens) CpG-island No: 11486
tcaaatcgatacctaaaacgtataattctcaaaaaccaataataacaaaccctctcctaaataaaaaaatttaccgatcaatcgtattataccctatatacgccgtcaaaaccgatatcctttatcaaccgatcaattacatcgtaacgaaaaatatataactaccgttttcactaatcaaacgaataacccgtccgacaacatcgtattccatactacgcgtcaacacgacctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcc

SEQ ID NO: 11487 - DNA, 626 bp, Artificial Sequence
  chemically treated genomic DNA (Homo sapiens) CpG-island No: 11487
ttaggtcggtatttaaggcgtatgatttttaaaggttagtggtgataaatttttttttaggtgggaaaatttgtcggttagtcgtgttatattttgtgtgcgtcgttaaagtcggtattttttattagtcggttaattatatcgtaacggaaggtgtgtggttgtcgtttttattggttaggcggatgattcgttcggtagtatcgtattttatattgcgcgttagtacgatttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttt

SEQ ID NO: 11488 - DNA, 626 bp, Artificial Sequence
  chemically treated genomic DNA (Homo sapiens) CpG-island No: 11488
aaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaatcgtactaacgcgcaatataaaatacgatactaccgaacgaatcatccgcctaaccaataaaaacgacaaccacacaccttccgttacgatataattaaccgactaataaaaaataccgactttaacgacgcacacaaaatataacacgactaaccgacaaattttcccacctaaaaaaaaatttatcaccactaacctttaaaaatcatacgccttaaataccgacctaa

SEQ ID NO: 11489 - DNA, 674 bp, Artificial Sequence
  chemically treated genomic DNA (Homo sapiens) CpG-island No: 11489
tgtcgtcgtcgtttatagtttggagatgggggtgttgatcgaagttagtaatgaagaggaataggagcgcgttattgtattgggagtaaaggtcgttggtattaataatcgcgatttgcgtgatttgtcgattgattttaatcgtattcgcgagttgcgtcgaaattggggtataacgtgacggtaattagcgaattcggtattaatatttacgtttaggtgcgcgagttaagttatttcgttaacggttttttgattggttcggcgttgatggtttatgacgatttgtacgtcgtcgtgcgtcgggtgttgttgggtgagaataaagtatgtggtttgacgcgtgggtaagatgtaaagtagtttatgacgcgggcgcgatttacggtgggttgatttttgttgcgatattatcgcgttgcgttaacgttgaataggcgtaggaagtgatggttgcggtatcgttgtagtatgttggcgtgtttcgtaattacgattaattgtatgtttgtaggttatttagggaaaggagaggggatttcgggagcgttcgtgatgcgtcgtttcgggaatgattagttttcggtaattattgatgttttttatatgcgagttaatgttgttagttttattaaatacggcggtaataacgtttgggtataaaatgttgaatt

SEQ ID NO: 11490 - DNA, 674 bp, Artificial Sequence
  chemically treated genomic DNA (Homo sapiens) CpG-island No: 11490
aattcaacattttatacccaaacgttattaccgccgtatttaataaaactaacaacattaactcgcatataaaaaacatcaataattaccgaaaactaatcattcccgaaacgacgcatcacgaacgctcccgaaatcccctctcctttccctaaataacctacaaacatacaattaatcgtaattacgaaacacgccaacatactacaacgataccgcaaccatcacttcctacgcctattcaacgttaacgcaacgcgataatatcgcaacaaaaatcaacccaccgtaaatcgcgcccgcgtcataaactactttacatcttacccacgcgtcaaaccacatactttattctcacccaacaacacccgacgcacgacgacgtacaaatcgtcataaaccatcaacgccgaaccaatcaaaaaaccgttaacgaaataacttaactcgcgcacctaaacgtaaatattaataccgaattcgctaattaccgtcacgttataccccaatttcgacgcaactcgcgaatacgattaaaatcaatcgacaaatcacgcaaatcgcgattattaataccaacgacctttactcccaatacaataacgcgctcctattcctcttcattactaacttcgatcaacacccccatctccaaactataaacgacgacgaca

SEQ ID NO: 11491 - DNA, 674 bp, Artificial Sequence
  chemically treated genomic DNA (Homo sapiens) CpG-island No: 11491
ggtttaatattttatgtttaggcgttattgtcgtcgtgtttgatgaaattgatagtattgattcgtatgtggaagatattagtgattgtcgggggttggttattttcgaagcgacgtattacgagcgttttcggagtttttttttttttttttaagtgatttgtaggtatgtagttaatcgtgattgcggaatacgttaatatattgtaacggtgtcgtagttattattttttgcgtttgtttaacgttgacgtaacgcggtgatgtcgtaataaaaattaatttatcgtaaatcgcgttcgcgttataagttgttttatattttgtttacgcgttaggttatatattttatttttatttagtaatattcggcgtacggcggcgtgtaaatcgttatgggttattaacgtcgaattaattagaaaatcgttagcgaagtggtttaattcgcgtatttgagcgtaagtattgatgtcggattcgttgattatcgttacgttgtgttttagtttcggcgtaattcgcgggtacggttgagattaatcgataaattacgtagatcgcggttgttgatgttaacgatttttgtttttaatgtaatggcgcgtttttgtttttttttattattgatttcggttagtatttttatttttagattgtgagcgacggcggta

SEQ ID NO: 11492 - DNA, 674 bp, Artificial Sequence
  chemically treated genomic DNA (Homo sapiens) CpG-island No: 11492
taccgccgtcgctcacaatctaaaaataaaaatactaaccgaaatcaataataaaaaaaaacaaaaacgcgccattacattaaaaacaaaaatcgttaacatcaacaaccgcgatctacgtaatttatcgattaatctcaaccgtacccgcgaattacgccgaaactaaaacacaacgtaacgataatcaacgaatccgacatcaatacttacgctcaaatacgcgaattaaaccacttcgctaacgattttctaattaattcgacgttaataacccataacgatttacacgccgccgtacgccgaatattactaaataaaaataaaatatataacctaacgcgtaaacaaaatataaaacaacttataacgcgaacgcgatttacgataaattaatttttattacgacatcaccgcgttacgtcaacgttaaacaaacgcaaaaaataataactacgacaccgttacaatatattaacgtattccgcaatcacgattaactacatacctacaaatcacttaaaaaaaaaaaaaaaaactccgaaaacgctcgtaatacgtcgcttcgaaaataaccaacccccgacaatcactaatatcttccacatacgaatcaatactatcaatttcatcaaacacgacgacaataacgcctaaacataaaatattaaacc

SEQ ID NO: 11493 - DNA, 747 bp, Artificial Sequence
  chemically treated genomic DNA (Homo sapiens) CpG-island No: 11493
ggatttcgatcggggtcgtcgggtagtagtacgttaattttttgatatgggttttataaatgatggtgttgttttacggcgtgcgcggcggggtattatttttttagttatagtgattaattattattacgtatttcggcgtaatggcggcgttgtcgcgatagttaggtttattatgatcggcgtgtagtagcgggttatttttaaatttttcgttaatttgtcgcgcgtaaggattaattaataatttcgtcgggttaaagcgatgtttttcggcgggttgttaggggttatgaacgcgataattataacgtaaattcgggcgcgtattcggtagataatcgtgttaaatgtcgttattgtgttttggtaagttatagcgatgtttttggttattggcgttaaagatatatagttttattcgttcggtatgagcggagaaaagtgtgaagttgacgttttgatcgtcgtaatgcgcgtcgaggggagcgggtttgttaatggcgagttgtgttattttgtttttcgaattagttagatagtggttagcggtggtagcgttaggtttagtgaatgttgacgatcgtggttggtaattttatcgttgtgtatcgtgtcgttattgtttgtattattgtcgtgatagtgtatggaatcggtattgaggattttacgttatttgttcggttggtttatgtcgaagcgataattatgacgcggtatcggcgtaaagttattggtaacgat

SEQ ID NO: 11494 - DNA, 747 bp, Artificial Sequence
  chemically treated genomic DNA (Homo sapiens) CpG-island No: 11494
atcgttaccaataactttacgccgataccgcgtcataattatcgcttcgacataaaccaaccgaacaaataacgtaaaatcctcaataccgattccatacactatcacgacaataatacaaacaataacgacacgatacacaacgataaaattaccaaccacgatcgtcaacattcactaaacctaacgctaccaccgctaaccactatctaactaattcgaaaaacaaaataacacaactcgccattaacaaacccgctcccctcgacgcgcattacgacgatcaaaacgtcaacttcacacttttctccgctcataccgaacgaataaaactatatatctttaacgccaataaccaaaaacatcgctataacttaccaaaacacaataacgacatttaacacgattatctaccgaatacgcgcccgaatttacgttataattatcgcgttcataacccctaacaacccgccgaaaaacatcgctttaacccgacgaaattattaattaatccttacgcgcgacaaattaacgaaaaatttaaaaataacccgctactacacgccgatcataataaacctaactatcgcgacaacgccgccattacgccgaaatacgtaataataattaatcactataactaaaaaaataataccccgccgcgcacgccgtaaaacaacaccatcatttataaaacccatatcaaaaaattaacgtactactacccgacgaccccgatcgaaatcc

SEQ ID NO: 11495 - DNA, 747 bp, Artificial Sequence
  chemically treated genomic DNA (Homo sapiens) CpG-island No: 11495
atcgttgttagtaattttacgtcggtatcgcgttatgattatcgtttcggtataaattagtcgggtaaatggcgtgaaatttttaatatcgattttatgtattattacggtagtaatgtaggtaatggcggtacggtatatagcgatgagattgttagttacggtcgttagtatttattaagtttgacgttattatcgttggttattatttggttggttcgggaggtagaatgatataattcgttattggtaaattcgtttttttcggcgcgtattacgacggttagggcgttaattttatattttttttcgtttatgtcgagcgggtagaattgtgtgtttttgacgttaatggttaggaatatcgttatgatttgttagggtatagtggcgatatttggtacggttatttgtcggatgcgcgttcgggtttgcgttatggttatcgcgtttatggtttttggtaattcgtcgaggggtatcgttttaattcggcgaagttgttgattgatttttgcgcgcggtaaattgacggggagtttaaagataattcgttgttgtacgtcggttataatgaatttgattatcgcgataacgtcgttattgcgtcgaaatgcgtagtggtggttgattattatgattgggaagatgatgtttcgtcgcgtacgtcgtggggtagtattattatttatgaagtttatgttaaaggattaacgtattattattcggcggtttcggtcgagattt

SEQ ID NO: 11496 - DNA, 747 bp, Artificial Sequence
  chemically treated genomic DNA (Homo sapiens) CpG-island No: 11496
aaatctcgaccgaaaccgccgaataataatacgttaatcctttaacataaacttcataaataataatactaccccacgacgtacgcgacgaaacatcatcttcccaatcataataatcaaccaccactacgcatttcgacgcaataacgacgttatcgcgataatcaaattcattataaccgacgtacaacaacgaattatctttaaactccccgtcaatttaccgcgcgcaaaaatcaatcaacaacttcgccgaattaaaacgatacccctcgacgaattaccaaaaaccataaacgcgataaccataacgcaaacccgaacgcgcatccgacaaataaccgtaccaaatatcgccactataccctaacaaatcataacgatattcctaaccattaacgtcaaaaacacacaattctacccgctcgacataaacgaaaaaaaatataaaattaacgccctaaccgtcgtaatacgcgccgaaaaaaacgaatttaccaataacgaattatatcattctacctcccgaaccaaccaaataataaccaacgataataacgtcaaacttaataaatactaacgaccgtaactaacaatctcatcgctatataccgtaccgccattacctacattactaccgtaataatacataaaatcgatattaaaaatttcacgccatttacccgactaatttataccgaaacgataatcataacgcgataccgacgtaaaattactaacaacgat

SEQ ID NO: 11497 - DNA, 637 bp, Artificial Sequence
  chemically treated genomic DNA (Homo sapiens) CpG-island No: 11497
  misc_feature (636)..(636): n is either a, c, g or t
ggcgtgcggtaggtgtgcgtgatgagggtgggtgcgagtacgtgagagagtgcggtgatggggtgggtgattcggagtgagcgagtgagaagaggtgtgaatgggtgagtgtgagagtgtgggtgagggcgcgggcggtgtgcgtgagagcgggtgtcggagtaggtgatcgcgagagtgtgagttggcgcgcgttcggcgtcgcgtgggcgcgagcgtgcgagtgcgggcgaaggtgagcgttggtgtgggtgagagtgtgcgagtgtgagagggcgagtgtgcgtgggcgcgggagcgattggggagatggcgcgagtgcgagcgagagagcggggtcgagtgggagtgggatagcgcgttggagagtgttggcgcgatgtgcggtggcgagtgcgatgttcgagcgcgtgttgggtgtcggcgtcgtgtggacgggtgaatgatagtgagtgtgtgggcgcgcgagtgggggtgggagagagagcggggggggacgagaggaagtgtggtgcgtaatgagtgtggggcgcgagcgggtgtgtaagagaattacgagagaagagcgtgggggtgggagagaacgttcgatcgcgcgatgagtgtgaatgttgtggcgttggatggaacggaaana

SEQ ID NO: 11498 - DNA, 637 bp, Artificial Sequence
  chemically treated genomic DNA (Homo sapiens) CpG-island No: 11498
  misc_feature (2)..(2): n is either a, c, g or t
tntttccgttccatccaacgccacaacattcacactcatcgcgcgatcgaacgttctctcccacccccacgctcttctctcgtaattctcttacacacccgctcgcgccccacactcattacgcaccacacttcctctcgtccccccccgctctctctcccacccccactcgcgcgcccacacactcactatcattcacccgtccacacgacgccgacacccaacacgcgctcgaacatcgcactcgccaccgcacatcgcgccaacactctccaacgcgctatcccactcccactcgaccccgctctctcgctcgcactcgcgccatctccccaatcgctcccgcgcccacgcacactcgccctctcacactcgcacactctcacccacaccaacgctcaccttcgcccgcactcgcacgctcgcgcccacgcgacgccgaacgcgcgccaactcacactctcgcgatcacctactccgacacccgctctcacgcacaccgcccgcgccctcacccacactctcacactcacccattcacacctcttctcactcgctcactccgaatcacccaccccatcaccgcactctctcacgtactcgcacccaccctcatcacgcacacctaccgcacgcc

SEQ ID NO: 11499 - DNA, 637 bp, Artificial Sequence
  chemically treated genomic DNA (Homo sapiens) CpG-island No: 11499
  misc_feature (2)..(2): n is either a, c, g or t
tnttttcgttttatttaacgttataatatttatatttatcgcgcgatcgaacgtttttttttatttttacgtttttttttcgtaatttttttatatattcgttcgcgttttatatttattgcgtattatattttttttcgttttttttcgtttttttttttatttttattcgcgcgtttatatatttattattatttattcgtttatacggcgtcggtatttaatacgcgttcggatatcgtattcgttatcgtatatcgcgttagtattttttaacgcgttattttatttttattcgatttcgttttttcgttcgtattcgcgttatttttttaatcgttttcgcgtttacgtatattcgtttttttatattcgtatatttttatttatattaacgtttattttcgttcgtattcgtacgttcgcgtttacgcggcgtcgggcgcgcgttagtttatattttcgcgattatttgtttcggtattcgtttttacgtatatcgttcgcgtttttatttatatttttatatttatttatttatatttttttttattcgtttatttcgagttatttattttattatcgtatttttttacgtgttcgtatttatttttattacgtatatttatcgtacgtt

SEQ ID NO: 11500 - DNA, 637 bp, Artificial Sequence
  chemically treated genomic DNA (Homo sapiens) CpG-island No: 11500
  misc_feature (636)..(636): n is either a, c, g or t
aacgtacgataaatatacgtaataaaaataaatacgaacacgtaaaaaaatacgataataaaataaataactcgaaataaacgaataaaaaaaaatataaataaataaatataaaaatataaataaaaacgcgaacgatatacgtaaaaacgaataccgaaacaaataatcgcgaaaatataaactaacgcgcgcccgacgccgcgtaaacgcgaacgtacgaatacgaacgaaaataaacgttaatataaataaaaatatacgaatataaaaaaacgaatatacgtaaacgcgaaaacgattaaaaaaataacgcgaatacgaacgaaaaaacgaaatcgaataaaaataaaataacgcgttaaaaaatactaacgcgatatacgataacgaatacgatatccgaacgcgtattaaataccgacgccgtataaacgaataaataataataaatatataaacgcgcgaataaaaataaaaaaaaaaacgaaaaaaaacgaaaaaaaatataatacgcaataaatataaaacgcgaacgaatatataaaaaaattacgaaaaaaaaacgtaaaaataaaaaaaaacgttcgatcgcgcgataaatataaatattataacgttaaataaaacgaaaana

SEQ ID NO: 11501 - DNA, 728 bp, Artificial Sequence
  chemically treated genomic DNA (Homo sapiens) CpG-island No: 11501
gcgttttttcgatagtttagttcgcgtacgttaggttcgatttgttcgtcgcgttcgaaaggtttagttttcggttcgcgtacgttgcggtttgcgtttttcgtttcgtaaatttgtagcgttttttttatcgttttagtggtatggttcgtcgttatcgtttcggtttttcgaggttggttttatcgttttcgtttggttatttttatttattttttgaatgaggggttttatggtcgcggttttttcgtcgggtacgggtggtatagtttatcgttgtatcgcggggggttcgtacgcgattatcgtggggggggcgttcggggatacgcgttgtgcgtatttatttgttatcggtagtcgtttagttttttcggcggggttttattttcgtttatggttacgttgcgttggttttttttttttgtgtttttcggtagcggtaacggcgtcggtagcggtagcggcggcggcgacgtttttttcgaggtaggtttaacggttagtacggcgcggtttttttcgttttttttttttagttttcgtttatcgtttttttttattttttggacggaaatatcgttttttcgcgttataaataggaagtgacgtataaagagttagagacgaattttgagagagcgagagcgtaagagtagggtagagaaggaggcgggtttatagtagggcgtttgcgtatattagataattttgggtttgtgtgggtt

SEQ ID NO: 11502 - DNA, 728 bp, Artificial Sequence
  chemically treated genomic DNA (Homo sapiens) CpG-island No: 11502
aacccacacaaacccaaaattatctaatatacgcaaacgccctactataaacccgcctccttctctaccctactcttacgctctcgctctctcaaaattcgtctctaactctttatacgtcacttcctatttataacgcgaaaaaacgatatttccgtccaaaaaataaaaaaaaacgataaacgaaaactaaaaaaaaaaaacgaaaaaaaccgcgccgtactaaccgttaaacctacctcgaaaaaaacgtcgccgccgccgctaccgctaccgacgccgttaccgctaccgaaaaacacaaaaaaaaaaaaccaacgcaacgtaaccataaacgaaaataaaaccccgccgaaaaaactaaacgactaccgataacaaataaatacgcacaacgcgtatccccgaacgccccccccacgataatcgcgtacgaaccccccgcgatacaacgataaactataccacccgtacccgacgaaaaaaccgcgaccataaaacccctcattcaaaaaataaataaaaataaccaaacgaaaacgataaaaccaacctcgaaaaaccgaaacgataacgacgaaccataccactaaaacgataaaaaaaacgctacaaatttacgaaacgaaaaacgcaaaccgcaacgtacgcgaaccgaaaactaaacctttcgaacgcgacgaacaaatcgaacctaacgtacgcgaactaaactatcgaaaaaacgc

SEQ ID NO: 11503 - DNA, 728 bp, Artificial Sequence
  chemically treated genomic DNA (Homo sapiens) CpG-island No: 11503
aatttatataggtttaaagttgtttaatgtgcgtaggcgttttgttgtgagttcgtttttttttttgttttgtttttgcgttttcgtttttttagagttcgtttttggttttttgtacgttattttttgtttgtggcgcgagagggcggtattttcgtttagagggtgggagggggcggtaagcgggggttggggggagggggcggggggggtcgcgtcgtgttagtcgttgggtttgtttcggaggaggcgtcgtcgtcgtcgttgtcgttgtcggcgtcgttgtcgttgtcgggaaatataaggaaagggaattagcgtagcgtggttatgggcgggggtagagtttcgtcggagaggttgggcggttgtcggtgataggtgagtgcgtatagcgcgtgttttcgaacgttttttttacgatggtcgcgtacgggtttttcgcggtgtagcgatgggttgtattattcgtgttcggcggggggatcgcggttatagagttttttatttaggagatgagtgggagtggttaagcgggggcggtgggattagtttcggggggtcggggcggtggcggcgggttatattattgaggcggtggggggagcgttgtaagtttgcgggacggggagcgtaggtcgtagcgtgcgcgggtcgggggttggatttttcgggcgcggcgggtagatcgagtttggcgtgcgcgggttaagttatcgagggggcgt

SEQ ID NO: 11504 - DNA, 728 bp, Artificial Sequence
  chemically treated genomic DNA (Homo sapiens) CpG-island No: 11504
acgccccctcgataacttaacccgcgcacgccaaactcgatctacccgccgcgcccgaaaaatccaacccccgacccgcgcacgctacgacctacgctccccgtcccgcaaacttacaacgctccccccaccgcctcaataatataacccgccgccaccgccccgaccccccgaaactaatcccaccgcccccgcttaaccactcccactcatctcctaaataaaaaactctataaccgcgatccccccgccgaacacgaataatacaacccatcgctacaccgcgaaaaacccgtacgcgaccatcgtaaaaaaaacgttcgaaaacacgcgctatacgcactcacctatcaccgacaaccgcccaacctctccgacgaaactctacccccgcccataaccacgctacgctaattccctttccttatatttcccgacaacgacaacgacgccgacaacgacaacgacgacgacgacgcctcctccgaaacaaacccaacgactaacacgacgcgaccccccccgccccctccccccaacccccgcttaccgccccctcccaccctctaaacgaaaataccgccctctcgcgccacaaacaaaaaataacgtacaaaaaaccaaaaacgaactctaaaaaaacgaaaacgcaaaaacaaaacaaaaaaaaaaacgaactcacaacaaaacgcctacgcacattaaacaactttaaacctatataaatt

SEQ ID NO: 11505 - DNA, 572 bp, Artificial Sequence
  chemically treated genomic DNA (Homo sapiens) CpG-island No: 11505
cgcggggggcgatgcggtagttgtagcggcggcggtaggagttttttataatgtagcgcggcgcgttgttttcggtgttgatgtttagcgttgtttcggagttttcgtcgcgttcgtttttcgttttttttttatcgggttcgggtttaggttcgggttttcgttatggttcggttcgtttcggttttattttagagtcgtcggggagtttgggcgcggcgttcgatagtagtttgcgtgtcgtcgtggcgtttaaggtagagggttagcgttgttatcgagagaagaagtttcgggaggttatcggtaagtattatcgagcgttgttgtagttgaaggcggcgtagggggttcgttttagcggtttgttcgttttcgttttcgggtttattagtagtttcgggtcggcgcgttttagcgaggagtagcggcgtttggtggagagtacggaggtggagtgttacgatttttttacgggtacgtcgtcggggggtggggggatggggtacgaggggagggggtaatcgggagagtttggcgatttgggggttaggggttttggggttgaaggg

SEQ ID NO: 11506 - DNA, 572 bp, Artificial Sequence
  chemically treated genomic DNA (Homo sapiens) CpG-island No: 11506
cccttcaaccccaaaacccctaacccccaaatcgccaaactctcccgattaccccctcccctcgtaccccatccccccaccccccgacgacgtacccgtaaaaaaatcgtaacactccacctccgtactctccaccaaacgccgctactcctcgctaaaacgcgccgacccgaaactactaataaacccgaaaacgaaaacgaacaaaccgctaaaacgaaccccctacgccgccttcaactacaacaacgctcgataatacttaccgataacctcccgaaacttcttctctcgataacaacgctaaccctctaccttaaacgccacgacgacacgcaaactactatcgaacgccgcgcccaaactccccgacgactctaaaataaaaccgaaacgaaccgaaccataacgaaaacccgaacctaaacccgaacccgataaaaaaaaaacgaaaaacgaacgcgacgaaaactccgaaacaacgctaaacatcaacaccgaaaacaacgcgccgcgctacattataaaaaactcctaccgccgccgctacaactaccgcatcgccccccgcg

SEQ ID NO: 11507 - DNA, 572 bp, Artificial Sequence
  chemically treated genomic DNA (Homo sapiens) CpG-island No: 11507
ttttttagttttagggtttttggtttttaagtcgttaagttttttcgattgtttttttttttcgtgttttatttttttatttttcgacggcgtattcgtgagggagtcgtaatattttattttcgtgttttttattaggcgtcgttgtttttcgttgaggcgcgtcggttcggggttgttggtgggttcgggggcgggggcgggtaggtcgttagggcgggttttttgcgtcgtttttagttgtagtagcgttcggtggtatttgtcgatggtttttcggaattttttttttcgatagtagcgttggttttttgttttgaacgttacggcggtacgtaggttgttgtcgagcgtcgcgtttaggtttttcgacggttttggggtaggatcgggacgagtcgagttatggcgggagttcgagtttgggttcgagttcggtggggagagggcgggaggcgggcgcggcggaggtttcggggtagcgttgagtattagtatcggggatagcgcgtcgcgttgtattgtgggaaatttttgtcgtcgtcgttgtagttatcgtatcgtttttcgcg

SEQ ID NO: 11508 - DNA, 572 bp, Artificial Sequence
  chemically treated genomic DNA (Homo sapiens) CpG-island No: 11508
cgcgaaaaacgatacgataactacaacgacgacgacaaaaatttcccacaatacaacgcgacgcgctatccccgatactaatactcaacgctaccccgaaacctccgccgcgcccgcctcccgccctctccccaccgaactcgaacccaaactcgaactcccgccataactcgactcgtcccgatcctaccccaaaaccgtcgaaaaacctaaacgcgacgctcgacaacaacctacgtaccgccgtaacgttcaaaacaaaaaaccaacgctactatcgaaaaaaaaaattccgaaaaaccatcgacaaataccaccgaacgctactacaactaaaaacgacgcaaaaaacccgccctaacgacctacccgcccccgcccccgaacccaccaacaaccccgaaccgacgcgcctcaacgaaaaacaacgacgcctaataaaaaacacgaaaataaaatattacgactccctcacgaatacgccgtcgaaaaataaaaaaataaaacacgaaaaaaaaaaacaatcgaaaaaacttaacgacttaaaaaccaaaaaccctaaaactaaaaaa

SEQ ID NO: 11509 - DNA, 982 bp, Artificial Sequence
  chemically treated genomic DNA (Homo sapiens) CpG-island No: 11509
gggcggggcggggcggggtgggagtggggcggtaggtttattcgtgttttttaaacggtagagggttaagagggtttggtcgcgcggttttcgaatgttcgtcggggttcgtcggtgggggacgagggcgagggcggtaggtagttttcgtttttcgcgtcgtttatttcgcgtagttttatcggcggttttcggtttcgtatttcgggttacgattgtcgggtcgggcgggggtggcggggtttttggggcggtcgtttcgggtcggggtggcgcgtttttcggtttttttacgcgcggggtagtcgggcggtttttatttttggtatcggtttttcggtcggttttagtttttgtttttcgttcgtgttgttttttcgggttatcggcggggttcgagtgacgtgtgggcgtcgtcgtcgcggtgttttttgggagttgtagttttcggtcgtgcggtttcggggttcggtttttagcgttttttagtagagtttcgcggttagtttcgggtcgtaatggatatgatattttacgaagtcgaaggagttttttcggggagatgagttcggtttcggtttttttttcggacgcggcgtagcgggcgttcggggcggggggaagcgttttttatagattttgtgggggtcgcggtttaggatgggttggattgtagcggacgcgattagtaacgcgaaaaataggagttgcgtgtatgattgtgattgttcggagtcgcgaacgtagtttggattttatttttgaggtaggacggtttttcggatttttcgatcgagatgtacgttgggaattgtagttcgcgcggggatttggcgttgtagggggcggtttttaaatagcgggttgcgggcgtcggcgggtggttggagtaagttaggggtcgggtcggtggcgggattttgcggggaagatggggttgggaggatgtgtttagtgtttttggggatgttatagttacgtt

SEQ ID NO: 11510 - DNA, 982 bp, Artificial Sequence
  chemically treated genomic DNA (Homo sapiens) CpG-island No: 11510
aacgtaactataacatccccaaaaacactaaacacatcctcccaaccccatcttccccgcaaaatcccgccaccgacccgacccctaacttactccaaccacccgccgacgcccgcaacccgctatttaaaaaccgccccctacaacgccaaatccccgcgcgaactacaattcccaacgtacatctcgatcgaaaaatccgaaaaaccgtcctacctcaaaaataaaatccaaactacgttcgcgactccgaacaatcacaatcatacacgcaactcctatttttcgcgttactaatcgcgtccgctacaatccaacccatcctaaaccgcgacccccacaaaatctataaaaaacgcttccccccgccccgaacgcccgctacgccgcgtccgaaaaaaaaaccgaaaccgaactcatctccccgaaaaaactccttcgacttcgtaaaatatcatatccattacgacccgaaactaaccgcgaaactctactaaaaaacgctaaaaaccgaaccccgaaaccgcacgaccgaaaactacaactcccaaaaaacaccgcgacgacgacgcccacacgtcactcgaaccccgccgataacccgaaaaaacaacacgaacgaaaaacaaaaactaaaaccgaccgaaaaaccgataccaaaaataaaaaccgcccgactaccccgcgcgtaaaaaaaccgaaaaacgcgccaccccgacccgaaacgaccgccccaaaaaccccgccacccccgcccgacccgacaatcgtaacccgaaatacgaaaccgaaaaccgccgataaaactacgcgaaataaacgacgcgaaaaacgaaaactacctaccgccctcgccctcgtcccccaccgacgaaccccgacgaacattcgaaaaccgcgcgaccaaaccctcttaaccctctaccgtttaaaaaacacgaataaacctaccgccccactcccaccccgccccgccccgccc

SEQ ID NO: 11511 - DNA, 982 bp, Artificial Sequence
  chemically treated genomic DNA (Homo sapiens) CpG-island No: 11511
gacgtggttgtgatatttttagggatattaaatatatttttttagttttatttttttcgtagagtttcgttatcggttcgatttttaatttgttttaattattcgtcgacgttcgtagttcgttgtttgggggtcgttttttgtagcgttaggttttcgcgcggattatagtttttagcgtatatttcggtcggggggttcgaggggtcgttttgttttagggataaggtttaggttgcgttcgcggtttcgggtagttatagttatgtacgtagtttttatttttcgcgttgttaatcgcgttcgttgtagtttaatttattttgggtcgcggtttttatagggtttgtgaggagcgttttttttcgtttcgggcgttcgttacgtcgcgttcgaaggaggggtcgaggtcgggtttattttttcgggaggattttttcggtttcgtggggtgttatgtttattgcggttcgaggttggtcgcggggttttgttggagggcgttgagagtcgggtttcgaggtcgtacggtcggagattataatttttaggaggtatcgcggcggcggcgtttatacgttattcgggtttcgtcggtggttcggggaagtagtacgggcggggggtaggggttggggtcgatcgggaggtcggtgttaaggatgggggtcgttcggttgtttcgcgcgtgaggaggtcgaggggcgcgttatttcggttcggggcggtcgttttaggggtttcgttattttcgttcggttcggtagtcgtggttcgggatgcggagtcgggggtcgtcggtggagttgcgcggggtgagcggcgcggggaacggggattgtttgtcgttttcgttttcgttttttatcggcggatttcggcgggtattcgagagtcgcgcggttaggtttttttagttttttgtcgtttggggggtacgggtgaatttgtcgttttatttttatttcgtttcgtttcgttt

SEQ ID NO: 11512 - DNA, 982 bp, Artificial Sequence
  chemically treated genomic DNA (Homo sapiens) CpG-island No: 11512
aaacgaaacgaaacgaaataaaaataaaacgacaaattcacccgtaccccccaaacgacaaaaaactaaaaaaacctaaccgcgcgactctcgaatacccgccgaaatccgccgataaaaaacgaaaacgaaaacgacaaacaatccccgttccccgcgccgctcaccccgcgcaactccaccgacgacccccgactccgcatcccgaaccacgactaccgaaccgaacgaaaataacgaaacccctaaaacgaccgccccgaaccgaaataacgcgcccctcgacctcctcacgcgcgaaacaaccgaacgacccccatccttaacaccgacctcccgatcgaccccaacccctaccccccgcccgtactacttccccgaaccaccgacgaaacccgaataacgtataaacgccgccgccgcgatacctcctaaaaattataatctccgaccgtacgacctcgaaacccgactctcaacgccctccaacaaaaccccgcgaccaacctcgaaccgcaataaacataacaccccacgaaaccgaaaaaatcctcccgaaaaaataaacccgacctcgacccctccttcgaacgcgacgtaacgaacgcccgaaacgaaaaaaaacgctcctcacaaaccctataaaaaccgcgacccaaaataaattaaactacaacgaacgcgattaacaacgcgaaaaataaaaactacgtacataactataactacccgaaaccgcgaacgcaacctaaaccttatccctaaaacaaaacgacccctcgaaccccccgaccgaaatatacgctaaaaactataatccgcgcgaaaacctaacgctacaaaaaacgacccccaaacaacgaactacgaacgtcgacgaataattaaaacaaattaaaaatcgaaccgataacgaaactctacgaaaaaaataaaactaaaaaaatatatttaatatccctaaaaatatcacaaccacgtc

SEQ ID NO: 11513 - DNA, 601 bp, Artificial Sequence
  chemically treated genomic DNA (Homo sapiens) CpG-island No: 11513
tatgggcgttaattttatttgcgcggattggcggagatatagcggttgcgttatcggtgtagaagcgtatcgagtacggtttttattatttttaatgacgtttgcgtgtattcgtgttatagttacgggagatagagtcgtcgcgttagtttcgtatttttacgtaagtgcgttatatagtcggtttcgttatttatggaggttagcgcgtatgcgtatttcggattcgggaggggtttttcgtatttagcggtcggagcgcgtaggtagtagtagagttcgatacgtatgtgcgtgtatatagattttgatacgtatgtatatttagatcgcgatatgtacgtgtacgcgtatatagatttttaacgtatgcgtgtggttagattttgattcgtatgtgcgattagattcgatatatatgtgcgcgtgtatagacgttgatatatgtatatattgatacgcgtgcgcgttttttttattttttttttttttggtttttttcgaagttataggcgtattcggcggtttttttatttttatgtttggcgcgtatttttgggttttttttaggaagcgaatgttttatttaggtttaaatata

SEQ ID NO: 11514 - DNA, 601 bp, Artificial Sequence
  chemically treated genomic DNA (Homo sapiens) CpG-island No: 11514
tatatttaaacctaaataaaacattcgcttcctaaaaaaaacccaaaaatacgcgccaaacataaaaataaaaaaaccgccgaatacgcctataacttcgaaaaaaaccaaaaaaaaaaaaaataaaaaaaacgcgcacgcgtatcaatatatacatatatcaacgtctatacacgcgcacatatatatcgaatctaatcgcacatacgaatcaaaatctaaccacacgcatacgttaaaaatctatatacgcgtacacgtacatatcgcgatctaaatatacatacgtatcaaaatctatatacacgcacatacgtatcgaactctactactacctacgcgctccgaccgctaaatacgaaaaacccctcccgaatccgaaatacgcatacgcgctaacctccataaataacgaaaccgactatataacgcacttacgtaaaaatacgaaactaacgcgacgactctatctcccgtaactataacacgaatacacgcaaacgtcattaaaaataataaaaaccgtactcgatacgcttctacaccgataacgcaaccgctatatctccgccaatccgcgcaaataaaattaacgcccata

SEQ ID NO: 11515 - DNA, 601 bp, Artificial Sequence
  chemically treated genomic DNA (Homo sapiens) CpG-island No: 11515
tgtgtttgggtttgagtagggtattcgttttttaggaggaatttaggggtgcgcgttaagtatgggggtagggggatcgtcgagtgcgtttgtggtttcgggagaggttaaagaaggaaggagtgggaagggcgcgtacgcgtgttagtgtgtgtatgtgttagcgtttgtgtacgcgtatatgtgtgtcgggtttggtcgtatatgcggattaaggtttggttatacgtatgcgttgggggtttgtgtgcgcgtatacgtgtatgtcgcggtttgggtgtatatgcgtgttaggatttgtgtgtacgtatatgcgtgtcgggttttgttgttgtttgcgcgtttcggtcgttgggtgcgggaggtttttttcgagttcggggtgcgtatgcgcgttggtttttatgggtggcgggatcgattgtgtgacgtatttgcgtgggagtgcgaggttgacgcggcggttttatttttcgtaattgtgatacgggtgtacgtaagcgttattgggggtgatgggggtcgtgttcggtgcgtttttgtatcggtgacgtaatcgttgtgttttcgttagttcgcgtaggtgagattggcgtttatg

SEQ ID NO: 11516 - DNA, 601 bp, Artificial Sequence
  chemically treated genomic DNA (Homo sapiens) CpG-island No: 11516
cataaacgccaatctcacctacgcgaactaacgaaaacacaacgattacgtcaccgatacaaaaacgcaccgaacacgacccccatcacccccaataacgcttacgtacacccgtatcacaattacgaaaaataaaaccgccgcgtcaacctcgcactcccacgcaaatacgtcacacaatcgatcccgccacccataaaaaccaacgcgcatacgcaccccgaactcgaaaaaaacctcccgcacccaacgaccgaaacgcgcaaacaacaacaaaacccgacacgcatatacgtacacacaaatcctaacacgcatatacacccaaaccgcgacatacacgtatacgcgcacacaaacccccaacgcatacgtataaccaaaccttaatccgcatatacgaccaaacccgacacacatatacgcgtacacaaacgctaacacatacacacactaacacgcgtacgcgcccttcccactccttccttctttaacctctcccgaaaccacaaacgcactcgacgatccccctacccccatacttaacgcgcacccctaaattcctcctaaaaaacgaataccctactcaaacccaaacaca

SEQ ID NO: 11517 - DNA, 605 bp, Artificial Sequence
  chemically treated genomic DNA (Homo sapiens) CpG-island No: 11517
tttttcggagttacgcgtattaattttatttgcgcggattggcggagatgtagcggttgcgttattggtgtaaacgcgtatttagtacggtttttatcgtttttaatgacgttcgcgtgtattcgtgttatagttacggggatagggtcgtcgcgttagtttcgtatttttacgtaagtgcgttatatattcggtttcgttattttttggaggttagcgcgtatgcgtacgcgtatttagcggtcgtagcgcgtagatagtagtagagttcgatacgtatgtgtatatagatttttatacgtatgtgtacgtatttagatttcgatacgtatgtgagcgtatatagattttcgatatatagcgtgtttagttgttgacgtgtttgtgcgggtatatagattttgacgggcgtgtgcgtacgtatagatgtcgatacgtatgtgtagatataatagagttcgatatatacgtgcgtttgtatagatgttgatacgcggatatattgatacgtgtgcgtgtattttttttatttttttttttttttttatttttttaaagtcgtagacgtattcggtagttttttaacgttggggtttcgggagagg

SEQ ID NO: 11518 - DNA, 605 bp, Artificial Sequence
  chemically treated genomic DNA (Homo sapiens) CpG-island No: 11518
cctctcccgaaaccccaacgttaaaaaactaccgaatacgtctacgactttaaaaaaataaaaaaaaaaaaaaaaataaaaaaaatacacgcacacgtatcaatatatccgcgtatcaacatctatacaaacgcacgtatatatcgaactctattatatctacacatacgtatcgacatctatacgtacgcacacgcccgtcaaaatctatatacccgcacaaacacgtcaacaactaaacacgctatatatcgaaaatctatatacgctcacatacgtatcgaaatctaaatacgtacacatacgtataaaaatctatatacacatacgtatcgaactctactactatctacgcgctacgaccgctaaatacgcgtacgcatacgcgctaacctccaaaaaataacgaaaccgaatatataacgcacttacgtaaaaatacgaaactaacgcgacgaccctatccccgtaactataacacgaatacacgcgaacgtcattaaaaacgataaaaaccgtactaaatacgcgtttacaccaataacgcaaccgctacatctccgccaatccgcgcaaataaaattaatacgcgtaactccgaaaaa

SEQ ID NO: 11519 - DNA, 605 bp, Artificial Sequence
  chemically treated genomic DNA (Homo sapiens) CpG-island No: 11519
tttttttcgaggttttagcgttgggggattatcgggtgcgtttgcggttttgggagagtgggaggagggaaagggatgggaggggtgtacgtatacgtgttagtgtgttcgcgtgttagtatttgtgtaggcgtacgtgtgtgtcgggttttgttgtgtttgtatatgcgtgtcggtatttgtgcgtgcgtatacgttcgttagggtttgtgtgttcgtataggtacgttaatagttgagtacgttatgtatcgggggtttgtgtacgtttatatacgtgtcggggtttgggtacgtgtatatacgtgtaggggtttgtgtgtatatgcgtgtcgggttttgttgttgtttgcgcgttgcggtcgttgggtgcgcgtgcgtatgcgcgttggtttttagggggtggcgggatcgagtgtgtgacgtatttgcgtgggagtacgaggttgacgcggcggttttgttttcgtaattgtgatacgggtgtacgcgagcgttattgggggcgatgggggtcgtgttgggtgcgcgtttgtattagtgacgtagtcgttgtattttcgttagttcgcgtaggtgagattggtgcgcgtggtttcgagggg

SEQ ID NO: 11520 - DNA, 605 bp, Artificial Sequence
  chemically treated genomic DNA (Homo sapiens) CpG-island No: 11520
cccctcgaaaccacgcgcaccaatctcacctacgcgaactaacgaaaatacaacgactacgtcactaatacaaacgcgcacccaacacgacccccatcgcccccaataacgctcgcgtacacccgtatcacaattacgaaaacaaaaccgccgcgtcaacctcgtactcccacgcaaatacgtcacacactcgatcccgccaccccctaaaaaccaacgcgcatacgcacgcgcacccaacgaccgcaacgcgcaaacaacaacaaaacccgacacgcatatacacacaaacccctacacgtatatacacgtacccaaaccccgacacgtatataaacgtacacaaacccccgatacataacgtactcaactattaacgtacctatacgaacacacaaaccctaacgaacgtatacgcacgcacaaataccgacacgcatatacaaacacaacaaaacccgacacacacgtacgcctacacaaatactaacacgcgaacacactaacacgtatacgtacacccctcccatccctttccctcctcccactctcccaaaaccgcaaacgcacccgataatcccccaacgctaaaacctcgaaaaaaa

SEQ ID NO: 11521 - DNA, 566 bp, Artificial Sequence
  chemically treated genomic DNA (Homo sapiens) CpG-island No: 11521
ttttaatgcgttggcgatagttagcgatatgaatcgtaacgtattgtgtatttcgaatttttacgagtcgtagttgtacgcggaattttacgagtgggcgaataagatttttgagtatttgttgtttcgtattcgcgcgtatgcggagatttggttcgattaggaaaaagtcgttattattgatgaagaatcgattttcggttagatttatttgtcgcgtaaattcgaaattacggaagtgatttcgttatagaacgatatcgatttgtacgttaacgatatgaatttcgtggcgatcgtcgaaaacggtaaattggtgggttttaatttgttggtgggcggtgggttttttatcgagtacggtaataagaaaatttacgttcgcgtcgtgaatgattttgttatttgtcgcggggatatacgttggcggtggttgaagtcgtttgatatttatcgtggcggggaatcgaatcgatgtaaaattttaatttaataatttggatttggggggggtgatttaggaaaaacgtaaatgttgaattgttagagattcgttaggcggtatt

SEQ ID NO: 11522 - DNA, 566 bp, Artificial Sequence
  chemically treated genomic DNA (Homo sapiens) CpG-island No: 11522
aataccgcctaacgaatctctaacaattcaacatttacgtttttcctaaatcaccccccccaaatccaaattattaaattaaaattttacatcgattcgattccccgccacgataaatatcaaacgacttcaaccaccgccaacgtatatccccgcgacaaataacaaaatcattcacgacgcgaacgtaaattttcttattaccgtactcgataaaaaacccaccgcccaccaacaaattaaaacccaccaatttaccgttttcgacgatcgccacgaaattcatatcgttaacgtacaaatcgatatcgttctataacgaaatcacttccgtaatttcgaatttacgcgacaaataaatctaaccgaaaatcgattcttcatcaataataacgactttttcctaatcgaaccaaatctccgcatacgcgcgaatacgaaacaacaaatactcaaaaatcttattcgcccactcgtaaaattccgcgtacaactacgactcgtaaaaattcgaaatacacaatacgttacgattcatatcgctaactatcgccaacgcattaaaa

SEQ ID NO: 11523 - DNA, 566 bp, Artificial Sequence
  chemically treated genomic DNA (Homo sapiens) CpG-island No: 11523
aatgtcgtttggcggatttttggtaatttaatatttgcgttttttttggattattttttttagatttaggttattgggttgggattttatatcggttcggtttttcgttacggtgagtgttaaacggttttagttatcgttagcgtatgttttcgcggtagatagtaaaattatttacggcgcgggcgtaggtttttttgttgtcgtgttcgatggaaagtttatcgtttattaataggttaaagtttattagtttgtcgttttcggcgatcgttacgaagtttatgtcgttggcgtgtagatcgatatcgttttgtggcgggattattttcgtggtttcgaatttacgcggtaggtaggtttggtcgaggatcggttttttattagtagtggcgatttttttttggtcgagttagattttcgtatacgcgcgggtacgaggtaatagatgtttagaaattttattcgtttattcgtaagatttcgcgtgtagttgcgattcgtaagggttcgaggtgtatagtacgttacggtttatgtcgttagttgtcgttagcgtattaaga

SEQ ID NO: 11524 - DNA, 566 bp, Artificial Sequence
  chemically treated genomic DNA (Homo sapiens) CpG-island No: 11524
tcttaatacgctaacgacaactaacgacataaaccgtaacgtactatacacctcgaacccttacgaatcgcaactacacgcgaaatcttacgaataaacgaataaaatttctaaacatctattacctcgtacccgcgcgtatacgaaaatctaactcgaccaaaaaaaaatcgccactactaataaaaaaccgatcctcgaccaaacctacctaccgcgtaaattcgaaaccacgaaaataatcccgccacaaaacgatatcgatctacacgccaacgacataaacttcgtaacgatcgccgaaaacgacaaactaataaactttaacctattaataaacgataaactttccatcgaacacgacaacaaaaaaacctacgcccgcgccgtaaataattttactatctaccgcgaaaacatacgctaacgataactaaaaccgtttaacactcaccgtaacgaaaaaccgaaccgatataaaatcccaacccaataacctaaatctaaaaaaaataatccaaaaaaaacgcaaatattaaattaccaaaaatccgccaaacgacatt

SEQ ID NO: 11525 - DNA, 922 bp, Artificial Sequence
  chemically treated genomic DNA (Homo sapiens) CpG-island No: 11525
gtgacgttatgcggataatgttatttttggtgaaggagttggcgaaggcgttttgatgggtttgaaaatgggagttgggagttttatcgtagaggcgggggaattttaagtgatatttattatcgtatttagtgcgttcggtttattttcgttgatgcggggaatattagcgttaggcgtgaaattttatcgtcgttgtcggtttatttttgttggcgcggggaattttcggtttaggcgttgtaaatttggttatcgggcggtttattttcgttaacgcggggaattcgtagtttattattttatttatgtttgaattttcggtttattttcgttggcgcggggaattttcgggggataatgtttacggttatgcgtttttcggtttattttcgttggcgcggggaattttgggcggtttgttttgtagttagttttagtagcggtttattttcgttggcgcggggaatttaagttggttggtaatttttttcggggtgagttcggtttattttcgttggcgcggggaattttagttttcgtattttcggatttataaagttgacggtttattttcgttggcgcggggaattcgtaggcggcgacgcgtagggtatgcgcgaattcgtcggttttagttggcgcggggaattcgcgatcgtttagaaattttagattcgattttaaacggttatttcgttggcgcggggaatttttaatattattaattataatcgatagggagttacggttttttagcggcgcggggaatttagcgtgttcggtattatttttggtttcggttgtaggtttatgttggcgcggggaattttgcgtgagcgtatcgtcgcgcgtttgcgaaagcgcgtttatgttggcgcggggaattttttaaaagtatatatttgtttttaaagtattt

SEQ ID NO: 11526 - DNA, 922 bp, Artificial Sequence
  chemically treated genomic DNA (Homo sapiens) CpG-island No: 11526
aaatactttaaaaacaaatatatacttttaaaaaattccccgcgccaacataaacgcgctttcgcaaacgcgcgacgatacgctcacgcaaaattccccgcgccaacataaacctacaaccgaaaccaaaaataataccgaacacgctaaattccccgcgccgctaaaaaaccgtaactccctatcgattataattaataatattaaaaattccccgcgccaacgaaataaccgtttaaaatcgaatctaaaatttctaaacgatcgcgaattccccgcgccaactaaaaccgacgaattcgcgcataccctacgcgtcgccgcctacgaattccccgcgccaacgaaaataaaccgtcaactttataaatccgaaaatacgaaaactaaaattccccgcgccaacgaaaataaaccgaactcaccccgaaaaaaattaccaaccaacttaaattccccgcgccaacgaaaataaaccgctactaaaactaactacaaaacaaaccgcccaaaattccccgcgccaacgaaaataaaccgaaaaacgcataaccgtaaacattatcccccgaaaattccccgcgccaacgaaaataaaccgaaaattcaaacataaataaaataataaactacgaattccccgcgttaacgaaaataaaccgcccgataaccaaatttacaacgcctaaaccgaaaattccccgcgccaacaaaaataaaccgacaacgacgataaaatttcacgcctaacgctaatattccccgcatcaacgaaaataaaccgaacgcactaaatacgataataaatatcacttaaaattcccccgcctctacgataaaactcccaactcccattttcaaacccatcaaaacgccttcgccaactccttcaccaaaaataacattatccgcataacgtcac

SEQ ID NO: 11527 - DNA, 922 bp, Artificial Sequence
  chemically treated genomic DNA (Homo sapiens) CpG-island No: 11527
aaatgttttaagaataaatgtatatttttagagagtttttcgcgttagtataaacgcgttttcgtagacgcgcggcgatacgtttacgtagagtttttcgcgttagtataaatttgtagtcgaagttaaaggtgatgtcgaatacgttgagtttttcgcgtcgttagagagtcgtggttttttgtcggttgtaattgataatgttgagagtttttcgcgttagcgggataatcgtttggaatcgggtttggaatttttgagcggtcgcgagtttttcgcgttagttaaaatcggcgaattcgcgtatattttgcgcgtcgtcgtttgcgagtttttcgcgttagcgaggataaatcgttagttttataaattcggagatacggaaattagagtttttcgcgttagcgaggataaatcggatttatttcgaaagagattgttagttagtttgagtttttcgcgttagcggggataaatcgttgttggagttggttgtaaggtaagtcgtttagagtttttcgcgttagcggggataaatcggggggcgtatgatcgtaaatattatttttcgggagtttttcgcgttagcggggataaatcgggagtttagatataggtggaatgatggattacgagtttttcgcgttagcggggataaatcgttcggtagttaggtttgtaacgtttgaatcgagagtttttcgcgttagtagggataaatcggtaacgacggtgagattttacgtttgacgttggtgtttttcgtattagcggggataaatcgggcgtattggatgcgatgatggatattatttggagttttttcgtttttgcggtagaatttttagtttttatttttaaatttattaagacgttttcgttaatttttttattagaggtagtattattcgtataacgttat

SEQ ID NO: 11528 - DNA, 922 bp, Artificial Sequence
  chemically treated genomic DNA (Homo sapiens) CpG-island No: 11528
ataacgttatacgaataatactacctctaataaaaaaattaacgaaaacgtcttaataaatttaaaaataaaaactaaaaattctaccgcaaaaacgaaaaaactccaaataatatccatcatcgcatccaatacgcccgatttatccccgctaatacgaaaaacaccaacgtcaaacgtaaaatctcaccgtcgttaccgatttatccctactaacgcgaaaaactctcgattcaaacgttacaaacctaactaccgaacgatttatccccgctaacgcgaaaaactcgtaatccatcattccacctatatctaaactcccgatttatccccgctaacgcgaaaaactcccgaaaaataatatttacgatcatacgccccccgatttatccccgctaacgcgaaaaactctaaacgacttaccttacaaccaactccaacaacgatttatccccgctaacgcgaaaaactcaaactaactaacaatctctttcgaaataaatccgatttatcctcgctaacgcgaaaaactctaatttccgtatctccgaatttataaaactaacgatttatcctcgctaacgcgaaaaactcgcaaacgacgacgcgcaaaatatacgcgaattcgccgattttaactaacgcgaaaaactcgcgaccgctcaaaaattccaaacccgattccaaacgattatcccgctaacgcgaaaaactctcaacattatcaattacaaccgacaaaaaaccacgactctctaacgacgcgaaaaactcaacgtattcgacatcacctttaacttcgactacaaatttatactaacgcgaaaaactctacgtaaacgtatcgccgcgcgtctacgaaaacgcgtttatactaacgcgaaaaactctctaaaaatatacatttattcttaaaacattt

SEQ ID NO: 11529 - DNA, 577 bp, Artificial Sequence
  chemically treated genomic DNA (Homo sapiens) CpG-island No: 11529
tagggcgcgtacgaggttttgtacgaagcgtatttcggaggttatttgtttggttagcgtttcgtagcggttttttaggcggttgaagcggcgtttgaggtcgttggtttttagtagcgcgtttttggtttttttttgcgtttgtcgtttgagcgtttcggttttgagtagtttttgtcgtagttttcgtaggttttggtttaggttgtcgtttttttcgcggtattaggttttttttttttcgtagatggcggttagcgtttttacgttttcgtggtagagtcgtcggttgcgttgtagttcgcgtaggtttttttcggcggtcgtcgttttttttagtattttggagaagcgttcgaagtcggcgtagttgttgttgggcggtaagttggagtgcgatttgatggtgtatttttttagacgcgtggtttttaggcgtcgtcgttcgggtttgcggtcgttgtttttattacgtacgtttcgtcgtcggatcgtttaggaaggagggaagtttgagcggggttttcgcgatgttatttagtttcgttagtttttatttgttagtgtgaattgaggt

SEQ ID NO: 11530 - DNA, 577 bp, Artificial Sequence
  chemically treated genomic DNA (Homo sapiens) CpG-island No: 11530
acctcaattcacactaacaaataaaaactaacgaaactaaataacatcgcgaaaaccccgctcaaacttccctccttcctaaacgatccgacgacgaaacgtacgtaataaaaacaacgaccgcaaacccgaacgacgacgcctaaaaaccacgcgtctaaaaaaatacaccatcaaatcgcactccaacttaccgcccaacaacaactacgccgacttcgaacgcttctccaaaatactaaaaaaaacgacgaccgccgaaaaaaacctacgcgaactacaacgcaaccgacgactctaccacgaaaacgtaaaaacgctaaccgccatctacgaaaaaaaaaaaacctaataccgcgaaaaaaacgacaacctaaaccaaaacctacgaaaactacgacaaaaactactcaaaaccgaaacgctcaaacgacaaacgcaaaaaaaaaccaaaaacgcgctactaaaaaccaacgacctcaaacgccgcttcaaccgcctaaaaaaccgctacgaaacgctaaccaaacaaataacctccgaaatacgcttcgtacaaaacctcgtacgcgcccta

SEQ ID NO: 11531 - DNA, 577 bp, Artificial Sequence
  chemically treated genomic DNA (Homo sapiens) CpG-island No: 11531
attttagtttatattggtaggtgggggttggcggggttgggtggtatcgcggggatttcgtttaggttttttttttttttaggcgattcggcggcggaacgtgcgtggtgaggatagcggtcgtaagttcgagcggcggcgtttgaagattacgcgtttgaaggagtatattattaagtcgtattttagtttgtcgtttaataatagttacgtcgatttcgagcgtttttttaaggtgttggaggaggcggcggtcgtcgaggagggtttgcgcgagttgtagcgtagtcggcggttttgttacgaggacgtggaggcgttggtcgttatttacgaggagaaggaggtttggtatcgcgaggagagcgatagtttgggttaggatttgcggaggttacggtaggagttgtttaagatcgaggcgtttaagcggtaggcgtaggaggaggttaagggcgcgttgttggggattagcggttttaagcgtcgttttagtcgtttggagaatcgttacgaggcgttggttaagtaagtagttttcgagatgcgtttcgtgtaggatttcgtgcgcgttttg

SEQ ID NO: 11532 - DNA, 577 bp, Artificial Sequence
  chemically treated genomic DNA (Homo sapiens) CpG-island No: 11532
caaaacgcgcacgaaatcctacacgaaacgcatctcgaaaactacttacttaaccaacgcctcgtaacgattctccaaacgactaaaacgacgcttaaaaccgctaatccccaacaacgcgcccttaacctcctcctacgcctaccgcttaaacgcctcgatcttaaacaactcctaccgtaacctccgcaaatcctaacccaaactatcgctctcctcgcgataccaaacctccttctcctcgtaaataacgaccaacgcctccacgtcctcgtaacaaaaccgccgactacgctacaactcgcgcaaaccctcctcgacgaccgccgcctcctccaacaccttaaaaaaacgctcgaaatcgacgtaactattattaaacgacaaactaaaatacgacttaataatatactccttcaaacgcgtaatcttcaaacgccgccgctcgaacttacgaccgctatcctcaccacgcacgttccgccgccgaatcgcctaaaaaaaaaaaaaacctaaacgaaatccccgcgataccacccaaccccgccaacccccacctaccaatataaactaaaat

SEQ ID NO: 11533 - DNA, 566 bp, Artificial Sequence
  chemically treated genomic DNA (Homo sapiens) CpG-island No: 11533
cgttcggtcgagtttttttttcggttcggttatttagatgggtttttaaatttattagttttttagattttttttttttttcgtttttcgcgggttttcgaagcgtcgttttggttttatttagttttttagtttcggttcgagttcgttttttatttttcgtagttcggagaatacggtcggcgtcgtcgcgttggttatcgtcgtcgtttttagaagtttcgcgtttttgtcgtcgcgacgcgtttgcgtcgacgttatcgtattcgttagtgtttattttcgggaaacgaatttcgtcgtttattggtcggtgcgttcgtcgttcgtgtcgtatttcgacgtttcgtttttagttgttttttcggtatttatattcggatgtagttttattattggttgaatattcgttatttttgattttattggttgtagtcgacgttggttaagcggacggaaaaaaggtcgattttcggtttttttatcgtttcgttcgttttttttttgatttaggtgttgaagttgcgagaagtgaggttgaagttttgtatttcgttttttgtttt

SEQ ID NO: 11534 - DNA, 566 bp, Artificial Sequence
  chemically treated genomic DNA (Homo sapiens) CpG-island No: 11534
aaaacaaaaaacgaaatacaaaacttcaacctcacttctcgcaacttcaacacctaaatcaaaaaaaaaacgaacgaaacgataaaaaaaccgaaaatcgaccttttttccgtccgcttaaccaacgtcgactacaaccaataaaatcaaaaataacgaatattcaaccaataataaaactacatccgaatataaataccgaaaaaacaactaaaaacgaaacgtcgaaatacgacacgaacgacgaacgcaccgaccaataaacgacgaaattcgtttcccgaaaataaacactaacgaatacgataacgtcgacgcaaacgcgtcgcgacgacaaaaacgcgaaacttctaaaaacgacgacgataaccaacgcgacgacgccgaccgtattctccgaactacgaaaaataaaaaacgaactcgaaccgaaactaaaaaactaaataaaaccaaaacgacgcttcgaaaacccgcgaaaaacgaaaaaaaaaaaaaatctaaaaaactaataaatttaaaaacccatctaaataaccgaaccgaaaaaaaaactcgaccgaacg

SEQ ID NO: 11535 - DNA, 566 bp, Artificial Sequence
  chemically treated genomic DNA (Homo sapiens) CpG-island No: 11535
aaggtaggaagcgggatgtagggttttagttttatttttcgtagttttagtatttgggttagaggagaggcgggcggggcgatgaagggatcggaagtcggtttttttttcgttcgtttgattagcgtcgattgtagttaatgaaattagggatggcgagtgtttagttagtggtgaggttgtattcgggtgtgggtgtcgaaaaggtagttgggggcgggacgtcgaggtgcggtacgagcggcgggcgtatcggttaataggcggcggggttcgtttttcgggggtgggtattggcgggtgcggtgacgtcggcgtaggcgcgtcgcggcggtaggggcgcggggtttttggaggcggcggcggtggttagcgcggcggcgtcggtcgtatttttcgggttgcggagggtaaagagcgggttcgggtcgaggttggagggttgggtggggttagagcggcgtttcgggggttcgcggaggacgagggagggagagaatttgaggagttggtaggtttggggatttatttgggtgatcgggtcggggaaagggttcggtcgggcg

SEQ ID NO: 11536 - DNA, 566 bp, Artificial Sequence
  chemically treated genomic DNA (Homo sapiens) CpG-island No: 11536
cgcccgaccgaaccctttccccgacccgatcacccaaataaatccccaaacctaccaactcctcaaattctctccctccctcgtcctccgcgaacccccgaaacgccgctctaaccccacccaaccctccaacctcgacccgaacccgctctttaccctccgcaacccgaaaaatacgaccgacgccgccgcgctaaccaccgccgccgcctccaaaaaccccgcgcccctaccgccgcgacgcgcctacgccgacgtcaccgcacccgccaatacccacccccgaaaaacgaaccccgccgcctattaaccgatacgcccgccgctcgtaccgcacctcgacgtcccgcccccaactaccttttcgacacccacacccgaatacaacctcaccactaactaaacactcgccatccctaatttcattaactacaatcgacgctaatcaaacgaacgaaaaaaaaaccgacttccgatcccttcatcgccccgcccgcctctcctctaacccaaatactaaaactacgaaaaataaaactaaaaccctacatcccgcttcctacctt

SEQ ID NO: 11537 - DNA, 513 bp, Artificial Sequence
  chemically treated genomic DNA (Homo sapiens) CpG-island No: 11537
gtggtcgcggggcggtgtttttttagtttaagagaaggaagcgagaaggtgagggtttcgcgtagggggcggagtttggggcgcgtggttaggcgcgagcggtacgcggttcgggggcggggcgggtgacgtcgcgggttcgttaggttcggggaagacgttaagatggcgacgagttagtatttcgatttcgcgtagggcggcggttcgtagtataggtaattgtttcgtcgcgttagttttcgttagtttcggtttttgtagtttggtcgggatttcgtttattttttttttcgtcgcgtgcgttcggttcggttttagttttagttttaatttggaatttcggtttgagggaagtcgcggcgtcgggagaagtaggcggggcggttttaggttaggtatcgggcgggatgcgggtttcggggtttcggttgagacgtttttgtagttaacggtgtttgtcggcgggagcgggagggggtttttgaagtgggagggggtttgggtttgggt

SEQ ID NO: 11538 - DNA, 513 bp, Artificial Sequence
  chemically treated genomic DNA (Homo sapiens) CpG-island No: 11538
acccaaacccaaaccccctcccacttcaaaaaccccctcccgctcccgccgacaaacaccgttaactacaaaaacgtctcaaccgaaaccccgaaacccgcatcccgcccgatacctaacctaaaaccgccccgcctacttctcccgacgccgcgacttccctcaaaccgaaattccaaattaaaactaaaactaaaaccgaaccgaacgcacgcgacgaaaaaaaaaataaacgaaatcccgaccaaactacaaaaaccgaaactaacgaaaactaacgcgacgaaacaattacctatactacgaaccgccgccctacgcgaaatcgaaatactaactcgtcgccatcttaacgtcttccccgaacctaacgaacccgcgacgtcacccgccccgcccccgaaccgcgtaccgctcgcgcctaaccacgcgccccaaactccgccccctacgcgaaaccctcaccttctcgcttccttctcttaaactaaaaaaacaccgccccgcgaccac

SEQ ID NO: 11539 - DNA, 513 bp, Artificial Sequence
  chemically treated genomic DNA (Homo sapiens) CpG-island No: 11539
gtttaaatttaggtttttttttattttaggagttttttttcgttttcgtcgatagatatcgttggttgtagagacgttttagtcggagtttcggagttcgtatttcgttcggtgtttaatttgaggtcgtttcgtttgtttttttcggcgtcgcggttttttttaggtcggggttttaggttggggttgggattggggtcgggtcgggcgtacgcggcgggagaaggggtaggcggggtttcggttaggttgtaggggtcgggattggcgggggttggcgcggcggggtagttatttgtattgcgggtcgtcgttttgcgcgaagtcgaaatattgattcgtcgttattttggcgtttttttcgagtttggcggattcgcgacgttattcgtttcgttttcgagtcgcgtgtcgttcgcgtttggttacgcgttttaagtttcgttttttgcgcgaagtttttattttttcgttttttttttttaggttagggagatatcgtttcgcgattat

SEQ ID NO: 11540 - DNA, 513 bp, Artificial Sequence
  chemically treated genomic DNA (Homo sapiens) CpG-island No: 11540
ataatcgcgaaacgatatctccctaacctaaaaaaaaaaaacgaaaaaataaaaacttcgcgcaaaaaacgaaacttaaaacgcgtaaccaaacgcgaacgacacgcgactcgaaaacgaaacgaataacgtcgcgaatccgccaaactcgaaaaaaacgccaaaataacgacgaatcaatatttcgacttcgcgcaaaacgacgacccgcaatacaaataactaccccgccgcgccaacccccgccaatcccgacccctacaacctaaccgaaaccccgcctaccccttctcccgccgcgtacgcccgacccgaccccaatcccaaccccaacctaaaaccccgacctaaaaaaaaccgcgacgccgaaaaaaacaaacgaaacgacctcaaattaaacaccgaacgaaatacgaactccgaaactccgactaaaacgtctctacaaccaacgatatctatcgacgaaaacgaaaaaaaactcctaaaataaaaaaaaacctaaatttaaac

SEQ ID NO: 11541 - DNA, 610 bp, Artificial Sequence
  chemically treated genomic DNA (Homo sapiens) CpG-island No: 11541
agcggcgggttcgttagtttcgagcgaaagtgtgattgcgaacgggtaggcgcgcgcggggttcggcggaggcgcgtttgggttttcggcggcgacgattacgattattaggagagcggacggaggcggcgtttgaagcggcggcggagtttatgtttcgggacggcgggcggattcggagagataaattcggggttcggggtatgttttcggggttttcgtgaggaggcggcggcggttatggagatcgcgtcgtaggaggcgtcgttcgtgtcgggcgcggacggcgatattgaagaggttttagttgaggtcgggttttttagtttcgcgtcgtttttcgtcgatgggcgttttaaggttgtagttaagcgcgttatattttcgttcgacgaggatatcgtgtttggagtagtggagtttaaagatttttggagatatggtagttatcgcgggtgaagcgggggcgggttcgagagggattcgggagtcgggagggatcggtgtagggttcggttcgaggtggcgtttaatagattgtatttaatggtgaataaggggatagtcgttagtttagaatcgtagtttgttagaaagggggtggttatgg

SEQ ID NO: 11542 - DNA, 610 bp, Artificial Sequence
  chemically treated genomic DNA (Homo sapiens) CpG-island No: 11542
ccataaccaccccctttctaacaaactacgattctaaactaacgactatccccttattcaccattaaatacaatctattaaacgccacctcgaaccgaaccctacaccgatccctcccgactcccgaatccctctcgaacccgcccccgcttcacccgcgataactaccatatctccaaaaatctttaaactccactactccaaacacgatatcctcgtcgaacgaaaatataacgcgcttaactacaaccttaaaacgcccatcgacgaaaaacgacgcgaaactaaaaaacccgacctcaactaaaacctcttcaatatcgccgtccgcgcccgacacgaacgacgcctcctacgacgcgatctccataaccgccgccgcctcctcacgaaaaccccgaaaacataccccgaaccccgaatttatctctccgaatccgcccgccgtcccgaaacataaactccgccgccgcttcaaacgccgcctccgtccgctctcctaataatcgtaatcgtcgccgccgaaaacccaaacgcgcctccgccgaaccccgcgcgcgcctacccgttcgcaatcacactttcgctcgaaactaacgaacccgccgct

SEQ ID NO: 11543 - DNA, 610 bp, Artificial Sequence
  chemically treated genomic DNA (Homo sapiens) CpG-island No: 11543
ttatagttattttttttttaatagattacggttttaaattgacgattgtttttttatttattattaggtgtaatttattgaacgttatttcgagtcgggttttgtatcgatttttttcgattttcgggtttttttcgagttcgttttcgttttattcgcggtagttattatgtttttaggggtttttgggttttattgttttagatacgatattttcgtcggacgggaatgtgacgcgtttggttgtagttttgaggcgtttatcggcggggggcgacgcggggttgggagattcggttttagttggggtttttttaatgtcgtcgttcgcgttcggtacgggcggcgttttttgcggcgcgatttttatagtcgtcgtcgtttttttacgggggtttcggggatatgtttcgggtttcggatttgttttttcgggttcgttcgtcgtttcggggtatgggtttcgtcgtcgttttaggcgtcgttttcgttcgtttttttagtggtcgtagtcgtcgtcgtcgggagtttaagcgcgttttcgtcgagtttcgcgcgcgtttgttcgttcgtagttatattttcgttcgaggttggcgagttcgtcgtt

SEQ ID NO: 11544 - DNA, 610 bp, Artificial Sequence
  chemically treated genomic DNA (Homo sapiens) CpG-island No: 11544
aacgacgaactcgccaacctcgaacgaaaatataactacgaacgaacaaacgcgcgcgaaactcgacgaaaacgcgcttaaactcccgacgacgacgactacgaccactaaaaaaacgaacgaaaacgacgcctaaaacgacgacgaaacccataccccgaaacgacgaacgaacccgaaaaaacaaatccgaaacccgaaacatatccccgaaacccccgtaaaaaaacgacgacgactataaaaatcgcgccgcaaaaaacgccgcccgtaccgaacgcgaacgacgacattaaaaaaaccccaactaaaaccgaatctcccaaccccgcgtcgccccccgccgataaacgcctcaaaactacaaccaaacgcgtcacattcccgtccgacgaaaatatcgtatctaaaacaataaaacccaaaaacccctaaaaacataataactaccgcgaataaaacgaaaacgaactcgaaaaaaacccgaaaatcgaaaaaaatcgatacaaaacccgactcgaaataacgttcaataaattacacctaataataaataaaaaaacaatcgtcaatttaaaaccgtaatctattaaaaaaaaaataactataa

SEQ ID NO: 11545 - DNA, 668 bp, Artificial Sequence
  chemically treated genomic DNA (Homo sapiens) CpG-island No: 11545
acgtacggatttttagtacggtttgatttataattttttgaggggttatcggcggggtatgggcgtgatcgcgttcgagtattagcgatataatatgatgcgtggaggtgttttcgagtattatatcgttcgttatttgattatcgcgtataacggtggtataggaggtaatgcggcgaattttttttattcggtggttgatataaattatcgttacgtttagtgtcgatattttttttatcgcgttgattattagtttaattttcgtattcgtaagcgaattggtaggtttattaagaatgattacgcgcggttcgttttttattattcgcgtaatttttattagttgtttttgcgtcgggtttagcgttgaaataagttgtttaggattaacgttaacgtttagcgtttgtaagtaacgttgggtattttgcgttatttgtaggtaattaattatgtcgttgcggcggggttattgatcgaggtagaggtttttcgttattgttagtttttttattagatttaatttttgataaatcgcgcgtatttttagtttagcggtacgcgagttagcgtaattcgttatttttagtcgcgttcgtaattagatattacgttatcgggcgtttttgcggtagtatttaatgagattcgattgtcgcgtcgtt

SEQ ID NO: 11546 - DNA, 668 bp, Artificial Sequence
  chemically treated genomic DNA (Homo sapiens) CpG-island No: 11546
aacgacgcgacaatcgaatctcattaaatactaccgcaaaaacgcccgataacgtaatatctaattacgaacgcgactaaaaataacgaattacgctaactcgcgtaccgctaaactaaaaatacgcgcgatttatcaaaaattaaatctaataaaaaaactaacaataacgaaaaacctctacctcgatcaataaccccgccgcaacgacataattaattacctacaaataacgcaaaatacccaacgttacttacaaacgctaaacgttaacgttaatcctaaacaacttatttcaacgctaaacccgacgcaaaaacaactaataaaaattacgcgaataataaaaaacgaaccgcgcgtaatcattcttaataaacctaccaattcgcttacgaatacgaaaattaaactaataatcaacgcgataaaaaaaatatcgacactaaacgtaacgataatttatatcaaccaccgaataaaaaaaattcgccgcattacctcctataccaccgttatacgcgataatcaaataacgaacgatataatactcgaaaacacctccacgcatcatattatatcgctaatactcgaacgcgatcacgcccataccccgccgataacccctcaaaaaattataaatcaaaccgtactaaaaatccgtacgt

SEQ ID NO: 11547 - DNA, 668 bp, Artificial Sequence
  chemically treated genomic DNA (Homo sapiens) CpG-island No: 11547
aacggcgcggtaatcgaattttattgaatgttatcgtaggaacgttcgatagcgtgatatttgattgcgaacgcgattgaaagtgacgaattacgttgattcgcgtgtcgttaaattgggggtgcgcgcggtttattaggagttaagtttggtggaagggttgatagtggcggaaaatttttgtttcggttagtggtttcgtcgtaacggtatgattgattatttgtaaatggcgtaggatgtttaacgttgtttataggcgttgggcgttgacgttagttttgaataatttgttttaacgttaagttcggcgtaaaagtagttggtggaaattgcgcgggtgatgaagggcgagtcgcgcgtggttatttttgatgaatttattagttcgtttgcgagtgcggaagttgaattggtgattagcgcggtgaaaaagatgtcggtattgggcgtggcggtgatttatgttagttatcggatggaagaaattcgtcgtattgttttttgtgttatcgttatgcgcgatggttaggtggcgggcgatgtgatgttcgaaaatatttttacgtattatattgtgtcgttgatgttcgggcgcgattacgtttatatttcgtcggtagttttttaggaaattgtggattaggtcgtgttggaagttcgtgcgt

SEQ ID NO: 11548 - DNA, 668 bp, Artificial Sequence
  chemically treated genomic DNA (Homo sapiens) CpG-island No: 11548
acgcacgaacttccaacacgacctaatccacaatttcctaaaaaactaccgacgaaatataaacgtaatcgcgcccgaacatcaacgacacaatataatacgtaaaaatattttcgaacatcacatcgcccgccacctaaccatcgcgcataacgataacacaaaaaacaatacgacgaatttcttccatccgataactaacataaatcaccgccacgcccaataccgacatctttttcaccgcgctaatcaccaattcaacttccgcactcgcaaacgaactaataaattcatcaaaaataaccacgcgcgactcgcccttcatcacccgcgcaatttccaccaactacttttacgccgaacttaacgttaaaacaaattattcaaaactaacgtcaacgcccaacgcctataaacaacgttaaacatcctacgccatttacaaataatcaatcataccgttacgacgaaaccactaaccgaaacaaaaattttccgccactatcaacccttccaccaaacttaactcctaataaaccgcgcgcacccccaatttaacgacacgcgaatcaacgtaattcgtcactttcaatcgcgttcgcaatcaaatatcacgctatcgaacgttcctacgataacattcaataaaattcgattaccgcgccgtt

SEQ ID NO: 11549 - DNA, 626 bp, Artificial Sequence
  chemically treated genomic DNA (Homo sapiens) CpG-island No: 11549
atacgcggtatggttttttttacgtttgtaggttttttcggtacgaaggcggcgttaaattgtaattcgttatttattattagttttggtgcgcgtttacggacgatttttgtcgtttgttggacgttagtaatataggggtgacgggcgttattattgttggaaaacgatagtatcgttacgtcggttttttttcggtgatggcgcgttaggtttcggtattggtaagcgcgatattcgttagttgcgtcgtcgtcggttgtggtattacgttgtaatcggtaaagttaacgtcgggtcgttgtattgtggtaatattaggaaaatggaagagagcgttttatagtttggttgtaagcgattaatgcgtaattcggtacgtagtatatttgtcgtggaagagaggttgttcgcgatatagatattcgttttatcggcgttgattattgttgcggcgaatattatagggtcggtaagtttttttagcgtattcggcggcgttttttcgtttcgcgcggttagttatcgatgagtaaatttttttcgtattgcgaggtttgttattcgatttaattatttgtagttcgtttaatcgtacgtcgttaattaattttaaatttattaat

SEQ ID NO: 11550 - DNA, 626 bp, Artificial Sequence
  chemically treated genomic DNA (Homo sapiens) CpG-island No: 11550
attaataaatttaaaattaattaacgacgtacgattaaacgaactacaaataattaaatcgaataacaaacctcgcaatacgaaaaaaatttactcatcgataactaaccgcgcgaaacgaaaaaacgccgccgaatacgctaaaaaaacttaccgaccctataatattcgccgcaacaataatcaacgccgataaaacgaatatctatatcgcgaacaacctctcttccacgacaaatatactacgtaccgaattacgcattaatcgcttacaaccaaactataaaacgctctcttccattttcctaatattaccacaatacaacgacccgacgttaactttaccgattacaacgtaataccacaaccgacgacgacgcaactaacgaatatcgcgcttaccaataccgaaacctaacgcgccatcaccgaaaaaaaaccgacgtaacgatactatcgttttccaacaataataacgcccgtcacccctatattactaacgtccaacaaacgacaaaaatcgtccgtaaacgcgcaccaaaactaataataaataacgaattacaatttaacgccgccttcgtaccgaaaaaacctacaaacgtaaaaaaaaccataccgcgtat

SEQ ID NO: 11551 - DNA, 626 bp, Artificial Sequence
  chemically treated genomic DNA (Homo sapiens) CpG-island No: 11551
attggtaagtttggggttagttaacggcgtgcgattggacgggttataggtgattgaatcggatggtagatttcgtaatgcgggaagaatttgtttatcgatggttggtcgcgcggggcgaaaaaacgtcgtcggatgcgttggaaaaatttatcgattttgtgatgttcgtcgtagtaatggttagcgtcggtaaagcggatgtttgtatcgcgggtaattttttttttacggtaaatgtgttgcgtgtcggattacgtattagtcgtttgtagttaggttgtaaaacgtttttttttatttttttgatgttgttatagtatagcggttcggcgttggttttgtcgattgtagcgtggtgttatagtcgacggcggcgtagttggcggatatcgcgtttgttagtgtcgaaatttggcgcgttattatcggagaagagtcggcgtggcgatgttgtcgttttttagtaatggtagcgttcgttatttttgtgttgttaacgtttagtaggcgatagaaatcgttcgtgagcgcgtattaaagttggtggtggatggcgagttatagtttgacgtcgttttcgtgtcggaaggatttgtaggcgtgaaggaggttatgtcgcgtgt

SEQ ID NO: 11552 - DNA, 626 bp, Artificial Sequence
  chemically treated genomic DNA (Homo sapiens) CpG-island No: 11552
acacgcgacataacctccttcacgcctacaaatccttccgacacgaaaacgacgtcaaactataactcgccatccaccaccaactttaatacgcgctcacgaacgatttctatcgcctactaaacgttaacaacacaaaaataacgaacgctaccattactaaaaaacgacaacatcgccacgccgactcttctccgataataacgcgccaaatttcgacactaacaaacgcgatatccgccaactacgccgccgtcgactataacaccacgctacaatcgacaaaaccaacgccgaaccgctatactataacaacatcaaaaaaataaaaaaaaacgttttacaacctaactacaaacgactaatacgtaatccgacacgcaacacatttaccgtaaaaaaaaaattacccgcgatacaaacatccgctttaccgacgctaaccattactacgacgaacatcacaaaatcgataaatttttccaacgcatccgacgacgttttttcgccccgcgcgaccaaccatcgataaacaaattcttcccgcattacgaaatctaccatccgattcaatcacctataacccgtccaatcgcacgccgttaactaaccccaaacttaccaat

SEQ ID NO: 11553 - DNA, 607 bp, Artificial Sequence
  chemically treated genomic DNA (Homo sapiens) CpG-island No: 11553
ttttcgattagcggtcgtattggtaagtcgaacgtgacggaaggcgtattggtatagaacggttaggcgattgcgttggtaatcgtgtagtaatttgattcgatttacgttgatgtgatttagtttagtaacgattttttgcgtttgaaataggaattggcgaatggtacgttgaaataagagaacggtaaagttaaagtgttattgattattagtgacggtattaagttttcgtaggacggtacgttggaattttttgacgttatcgttgattagattattgggtttattattttacgcgttattttttcgaattcggattatattttgttgtcgggtatgttcgtgcgcgtacgtttggaagaagggtttaatttaaacgttattttagtttcgtaatagggcgtaattcgtacgtcgcgtggcgatgttatcgtattggtagttggcgcggatgataaagtggaaattcgttcgatcgttgtaagttaggttattggcgataagtggttggtgatagaaggtttgaaagtaggcgatcgcgtagtaataagtgggttgtagaaagtgcgttttggtgtttaggtaaaagtataagaagttacgt

SEQ ID NO: 11554 - DNA, 607 bp, Artificial Sequence
  chemically treated genomic DNA (Homo sapiens) CpG-island No: 11554
acgtaacttcttatacttttacctaaacaccaaaacgcactttctacaacccacttattactacgcgatcgcctactttcaaaccttctatcaccaaccacttatcgccaataacctaacttacaacgatcgaacgaatttccactttatcatccgcgccaactaccaatacgataacatcgccacgcgacgtacgaattacgccctattacgaaactaaaataacgtttaaattaaacccttcttccaaacgtacgcgcacgaacatacccgacaacaaaatataatccgaattcgaaaaaataacgcgtaaaataataaacccaataatctaatcaacgataacgtcaaaaaattccaacgtaccgtcctacgaaaacttaataccgtcactaataatcaataacactttaactttaccgttctcttatttcaacgtaccattcgccaattcctatttcaaacgcaaaaaatcgttactaaactaaatcacatcaacgtaaatcgaatcaaattactacacgattaccaacgcaatcgcctaaccgttctataccaatacgccttccgtcacgttcgacttaccaatacgaccgctaatcgaaaa

SEQ ID NO: 11555 - DNA, 607 bp, Artificial Sequence
  chemically treated genomic DNA (Homo sapiens) CpG-island No: 11555
gcgtaattttttgtgtttttatttggatattaggacgtattttttgtagtttatttattattacgcgatcgtttgtttttagattttttgttattagttatttatcgttaatagtttggtttgtaacgatcggacgggtttttattttgttattcgcgttaattattagtacggtggtatcgttacgcggcgtacgggttacgttttgttgcgggattaaaatagcgtttggattaagttttttttttagacgtgcgcgtacgaatatattcggtagtagagtgtgattcgggttcgggaagatagcgcgtagggtgatagatttagtggtttgattaacggtaacgttagagaattttagcgtatcgttttgcgggaatttaatgtcgttattggtgattagtgatattttggttttgtcgtttttttgttttagcgtgttattcgttagtttttgttttaggcgtaggaagtcgttgttggattgggttatattaacgtagatcggattaagttgttgtacggttgttagcgtagtcgtttgatcgttttgtattaatgcgtttttcgttacgttcgatttattaatgcgatcgttaatcggaga

SEQ ID NO: 11556 - DNA, 607 bp, Artificial Sequence
  chemically treated genomic DNA (Homo sapiens) CpG-island No: 11556
tctccgattaacgatcgcattaataaatcgaacgtaacgaaaaacgcattaatacaaaacgatcaaacgactacgctaacaaccgtacaacaacttaatccgatctacgttaatataacccaatccaacaacgacttcctacgcctaaaacaaaaactaacgaataacacgctaaaacaaaaaaacgacaaaaccaaaatatcactaatcaccaataacgacattaaattcccgcaaaacgatacgctaaaattctctaacgttaccgttaatcaaaccactaaatctatcaccctacgcgctatcttcccgaacccgaatcacactctactaccgaatatattcgtacgcgcacgtctaaaaaaaaaacttaatccaaacgctattttaatcccgcaacaaaacgtaacccgtacgccgcgtaacgataccaccgtactaataattaacgcgaataacaaaataaaaacccgtccgatcgttacaaaccaaactattaacgataaataactaataacaaaaaatctaaaaacaaacgatcgcgtaataataaataaactacaaaaaatacgtcctaatatccaaataaaaacacaaaaaattacgc

SEQ ID NO: 11557 - DNA, 653 bp, Artificial Sequence
  chemically treated genomic DNA (Homo sapiens) CpG-island No: 11557
  misc_feature (375)..(375): n is either a, c, g or t
  misc_feature (379)..(379): n is either a, c, g or t
  misc_feature (424)..(424): n is either a, c, g or t
  misc_feature (458)..(458): n is either a, c, g or t
ttcggttattattcgttagatcgttaatatttattgtatatggttgcgtggcgaattaacgtttgtttcgttatttacgtttttcgttgatgtagtggaagagtattagtaatatcgcgaaagcgaagtttggtagcgtgatgcggtattttgggtagaatagcgtcgttaattgtcgtcgttcgcgttatttttttcggtatttttatcggggcgtagcggttcggtagatattttgcgtttgaaattggaatttatcgacgggaatattgtagttggttacgtaatttttaggtgtgtagcgtatcgatttaattttttcgttggtagtttgtggttggggcgattgtgtaatcgtatggattacgtcgtcgnattnatttttatgcgtcgattgggttcggcggcgttgaacgttaacggnatcgtgtttaacgttgtgtcgttgggtattttantgcggcgtagaacgttgcgggattgtaatcgattgttgtcgtttgtttgtaggtggttaaattgttcgacgcgcgtcgatttgatgaacgggtcgtttgtacgaatttgtgtcgttatttttttgagtatcgagtttaggtttatattttcgatatttattattacgcgtttagggttatttaacgcgaattgtt

SEQ ID NO: 11558 - DNA, 653 bp, Artificial Sequence
  chemically treated genomic DNA (Homo sapiens) CpG-island No: 11558
  misc_feature (196)..(196): n is either a, c, g or t
  misc_feature (230)..(230): n is either a, c, g or t
  misc_feature (275)..(275): n is either a, c, g or t
  misc_feature (279)..(279): n is either a, c, g or t
aacaattcgcgttaaataaccctaaacgcgtaataataaatatcgaaaatataaacctaaactcgatactcaaaaaaataacgacacaaattcgtacaaacgacccgttcatcaaatcgacgcgcgtcgaacaatttaaccacctacaaacaaacgacaacaatcgattacaatcccgcaacgttctacgccgcantaaaatacccaacgacacaacgttaaacacgatnccgttaacgttcaacgccgccgaacccaatcgacgcataaaaatnaatncgacgacgtaatccatacgattacacaatcgccccaaccacaaactaccaacgaaaaaattaaatcgatacgctacacacctaaaaattacgtaaccaactacaatattcccgtcgataaattccaatttcaaacgcaaaatatctaccgaaccgctacgccccgataaaaataccgaaaaaaataacgcgaacgacgacaattaacgacgctattctacccaaaataccgcatcacgctaccaaacttcgctttcgcgatattactaatactcttccactacatcaacgaaaaacgtaaataacgaaacaaacgttaattcgccacgcaaccatatacaataaatattaacgatctaacgaataataaccgaa

SEQ ID NO: 11559 - DNA, 653 bp, Artificial Sequence
  chemically treated genomic DNA (Homo sapiens) CpG-island No: 11559
  misc_feature (196)..(196): n is either a, c, g or t
  misc_feature (230)..(230): n is either a, c, g or t
  misc_feature (275)..(275): n is either a, c, g or t
  misc_feature (279)..(279): n is either a, c, g or t
agtagttcgcgttgagtaattttgaacgcgtggtggtggatatcgaagatgtaaatttgaattcggtatttaaggggatggcggtataaattcgtgtagacgattcgtttattaagtcggcgcgcgtcgggtaatttgattatttgtaggtagacggtagtagtcggttgtagtttcgtagcgttttgcgtcgtantgggatatttaacggtataacgttgagtacggtntcgttagcgtttagcgtcgtcgagtttagtcgacgtataagaatnaatncggcggcgtagtttatacgattgtataatcgttttagttataagttgttagcgaaagggttaagtcggtacgttgtatatttgaaagttgcgtagttagttgtagtattttcgtcggtaaattttagttttaggcgtagaatatttgtcgagtcgttgcgtttcggtaaaggtgtcggagaaagtgacgcgggcggcggtagttgacgacgttgttttgtttagaatgtcgtattacgttgttaggtttcgttttcgcggtattgttggtatttttttattatattagcgaaaggcgtaaatggcgaagtaggcgttggttcgttacgtagttatgtgtagtaaatattggcgatttggcgggtaatggtcggg

SEQ ID NO: 11560 - DNA, 653 bp, Artificial Sequence
  chemically treated genomic DNA (Homo sapiens) CpG-island No: 11560
  misc_feature (375)..(375): n is either a, c, g or t
  misc_feature (379)..(379): n is either a, c, g or t
  misc_feature (424)..(424): n is either a, c, g or t
  misc_feature (458)..(458): n is either a, c, g or t
cccgaccattacccgccaaatcgccaatatttactacacataactacgtaacgaaccaacgcctacttcgccatttacgcctttcgctaatataataaaaaaataccaacaataccgcgaaaacgaaacctaacaacgtaatacgacattctaaacaaaacaacgtcgtcaactaccgccgcccgcgtcactttctccgacacctttaccgaaacgcaacgactcgacaaatattctacgcctaaaactaaaatttaccgacgaaaatactacaactaactacgcaactttcaaatatacaacgtaccgacttaaccctttcgctaacaacttataactaaaacgattatacaatcgtataaactacgccgccgnattnattcttatacgtcgactaaactcgacgacgctaaacgctaacganaccgtactcaacgttataccgttaaatatcccantacgacgcaaaacgctacgaaactacaaccgactactaccgtctacctacaaataatcaaattacccgacgcgcgccgacttaataaacgaatcgtctacacgaatttataccgccatccccttaaataccgaattcaaatttacatcttcgatatccaccaccacgcgttcaaaattactcaacgcgaactact

SEQ ID NO: 11561 - DNA, 596 bp, Artificial Sequence
  chemically treated genomic DNA (Homo sapiens) CpG-island No: 11561
  misc_feature (588)..(588): n is either a, c, g or t
tgcgttagtttgttggtatgatgcgcgttattcgtattttgttttatcgtcgtagtgagttgttttatgttggcggtagttttttttataatcgcgtttttttttttgtgtagcgtatatgtttgtaggtttaatgtaggtaatggcggtacggtatatagcgatgagattgttagttacggtcgttagtatttattaagtttgacgttattatcgttggttattatttggttggttcgggaggtagaatgatataattcgttattggtaaattcgtttttttcggcgcgtattacgacggttagggcgttaattttatattttttttcgtttatgtcgagcgggtagaattgtgtgtttttgacgttaatggttaggaatatcgttatgatttgttagggtatagtggcgatatttggtacggttatttgtcggatgcgcgttcgggtttgcgttatggttatcgcgtttatggtttttggtaattcgtcgaggggtatcgttttaattcggcgaagttgttgattgatttttgcgcgcggtaaattgacggggagtttaaagataattcgttgttgtacgtcggtnataatgaa

SEQ ID NO: 11562 - DNA, 596 bp, Artificial Sequence
  chemically treated genomic DNA (Homo sapiens) CpG-island No: 11562
  misc_feature (9)..(9): n is either a, c, g or t
ttcattatnaccgacgtacaacaacgaattatctttaaactccccgtcaatttaccgcgcgcaaaaatcaatcaacaacttcgccgaattaaaacgatacccctcgacgaattaccaaaaaccataaacgcgataaccataacgcaaacccgaacgcgcatccgacaaataaccgtaccaaatatcgccactataccctaacaaatcataacgatattcctaaccattaacgtcaaaaacacacaattctacccgctcgacataaacgaaaaaaaatataaaattaacgccctaaccgtcgtaatacgcgccgaaaaaaacgaatttaccaataacgaattatatcattctacctcccgaaccaaccaaataataaccaacgataataacgtcaaacttaataaatactaacgaccgtaactaacaatctcatcgctatataccgtaccgccattacctacattaaacctacaaacatatacgctacacaaaaaaaaaaacgcgattataaaaaaaactaccgccaacataaaacaactcactacgacgataaaacaaaatacgaataacgcgcatcataccaacaaactaacgca

SEQ ID NO: 11563 - DNA, 596 bp, Artificial Sequence
  chemically treated genomic DNA (Homo sapiens) CpG-island No: 11563
  misc_feature (9)..(9): n is either a, c, g or t
tttattatnatcggcgtgtagtagcgggttatttttaaatttttcgttaatttgtcgcgcgtaaggattaattaataatttcgtcgggttaaagcgatgtttttcggcgggttgttaggggttatgaacgcgataattataacgtaaattcgggcgcgtattcggtagataatcgtgttaaatgtcgttattgtgttttggtaagttatagcgatgtttttggttattggcgttaaagatatatagttttattcgttcggtatgagcggagaaaagtgtgaagttgacgttttgatcgtcgtaatgcgcgtcgaggggagcgggtttgttaatggcgagttgtgttattttgtttttcgaattagttagatagtggttagcggtggtagcgttaggtttagtgaatgttgacgatcgtggttggtaattttatcgttgtgtatcgtgtcgttattgtttgtattagatttgtaggtatgtacgttgtatagaagaaaaagcgcggttatgaaaaaaattgtcgttagtatggagtaatttattgcgacggtgaaatagaatgcggataacgcgtattatgttagtaaattggcgta

SEQ ID NO: 11564 - DNA, 596 bp, Artificial Sequence
  chemically treated genomic DNA (Homo sapiens) CpG-island No: 11564
  misc_feature (588)..(588): n is either a, c, g or t
tacgccaatttactaacataatacgcgttatccgcattctatttcaccgtcgcaataaattactccatactaacgacaatttttttcataaccgcgctttttcttctatacaacgtacatacctacaaatctaatacaaacaataacgacacgatacacaacgataaaattaccaaccacgatcgtcaacattcactaaacctaacgctaccaccgctaaccactatctaactaattcgaaaaacaaaataacacaactcgccattaacaaacccgctcccctcgacgcgcattacgacgatcaaaacgtcaacttcacacttttctccgctcataccgaacgaataaaactatatatctttaacgccaataaccaaaaacatcgctataacttaccaaaacacaataacgacatttaacacgattatctaccgaatacgcgcccgaatttacgttataattatcgcgttcataacccctaacaacccgccgaaaaacatcgctttaacccgacgaaattattaattaatccttacgcgcgacaaattaacgaaaaatttaaaaataacccgctactacacgccgatnataataaa

SEQ ID NO: 11565 - DNA, 530 bp, Artificial Sequence
  chemically treated genomic DNA (Homo sapiens) CpG-island No: 11565
  misc_feature (295)..(295): n is either a, c, g or t
  misc_feature (340)..(340): n is either a, c, g or t
  misc_feature (430)..(430): n is either a, c, g or t
  misc_feature (438)..(438): n is either a, c, g or t
  misc_feature (453)..(453): n is either a, c, g or t
gcgtcgtcgtcgcgttttttgcgtcgttcgtttcgtatggtgtggaggaagatgttttttattcggtacgcgcgaaatagggaatggtagcgtttgtggacgttattgttatttaggtgggggtggatatttttaaggagggcgggaatgtcgttgatgtcgtcgtggcggtgggttacgcgttggcggtaacgtattcgtaggtagggaatttgggcggtggtggttttatgttaattcgttcgaaaaatggtaatattacggttatcgattttcgcgaaatggtattcgttanagcgatcgcgatatgttttcgatgattagggtaatcggatagtanaaattatttatttcgtatttggttttcggtatatcgggtacggtagtaggttttcgttggcgttgggataatacggtttatgtcgttgantaaagttngtgtagtcgcgtttnaattggtacgtatggtttatcgttataattcgtggttgagattttaaatttacggtgcgaagtgtgtcgaattagaa

SEQ ID NO: 11566 - DNA, 530 bp, Artificial Sequence
  chemically treated genomic DNA (Homo sapiens) CpG-island No: 11566
  misc_feature (78)..(78): n is either a, c, g or t
  misc_feature (93)..(93): n is either a, c, g or t
  misc_feature (101)..(101): n is either a, c, g or t
  misc_feature (191)..(191): n is either a, c, g or t
  misc_feature (236)..(236): n is either a, c, g or t
ttctaattcgacacacttcgcaccgtaaatttaaaatctcaaccacgaattataacgataaaccatacgtaccaattnaaacgcgactacacnaactttantcaacgacataaaccgtattatcccaacgccaacgaaaacctactaccgtacccgatataccgaaaaccaaatacgaaataaataatttntactatccgattaccctaatcatcgaaaacatatcgcgatcgctntaacgaataccatttcgcgaaaatcgataaccgtaatattaccatttttcgaacgaattaacataaaaccaccaccgcccaaattccctacctacgaatacgttaccgccaacgcgtaacccaccgccacgacgacatcaacgacattcccgccctccttaaaaatatccacccccacctaaataacaataacgtccacaaacgctaccattccctatttcgcgcgtaccgaataaaaaacatcttcctccacaccatacgaaacgaacgacgcaaaaaacgcgacgacgacgc

SEQ ID NO: 11567 - DNA, 530 bp, Artificial Sequence
  chemically treated genomic DNA (Homo sapiens) CpG-island No: 11567
  misc_feature (78)..(78): n is either a, c, g or t
  misc_feature (93)..(93): n is either a, c, g or t
  misc_feature (101)..(101): n is either a, c, g or t
  misc_feature (191)..(191): n is either a, c, g or t
  misc_feature (236)..(236): n is either a, c, g or t
ttttgattcggtatatttcgtatcgtaggtttgagattttagttacgggttgtaacgataaattatgcgtgttagttnaaacgcggttgtatngattttgnttagcggtatgggtcgtattattttagcgttagcgagaatttgttatcgtattcggtgtgtcggaagttagatgcgaagtgagtgatttntgttgttcggttgttttgattatcgaggatatatcgcggtcgttntggcgggtgttatttcgcggaaatcgatagtcgtggtattgttatttttcgagcggattaatataaaattattatcgtttagattttttgtttgcggatgcgttatcgttagcgcgtagtttatcgttacggcggtattaacggtattttcgttttttttgagaatatttatttttatttgagtggtagtggcgtttatagacgttattattttttgtttcgcgcgtatcgggtggaagatatttttttttatattatacgagacgggcggcgtaggaggcgcggcggcggcgt

SEQ ID NO: 11568 - DNA, 530 bp, Artificial Sequence
  chemically treated genomic DNA (Homo sapiens) CpG-island No: 11568
  misc_feature (295)..(295): n is either a, c, g or t
  misc_feature (340)..(340): n is either a, c, g or t
  misc_feature (430)..(430): n is either a, c, g or t
  misc_feature (438)..(438): n is either a, c, g or t
  misc_feature (453)..(453): n is either a, c, g or t
acgccgccgccgcgcctcctacgccgcccgtctcgtataatataaaaaaaaatatcttccacccgatacgcgcgaaacaaaaaataataacgtctataaacgccactaccactcaaataaaaataaatattctcaaaaaaaacgaaaataccgttaataccgccgtaacgataaactacgcgctaacgataacgcatccgcaaacaaaaaatctaaacgataataattttatattaatccgctcgaaaaataacaataccacgactatcgatttccgcgaaataacacccgccanaacgaccgcgatatatcctcgataatcaaaacaaccgaacaacanaaatcactcacttcgcatctaacttccgacacaccgaatacgataacaaattctcgctaacgctaaaataatacgacccataccgctaancaaaatcnatacaaccgcgtttnaactaacacgcataatttatcgttacaacccgtaactaaaatctcaaacctacgatacgaaatataccgaatcaaaa

SEQ ID NO: 11569 - DNA, 1398 bp, Artificial Sequence
  chemically treated genomic DNA (Homo sapiens) CpG-island No: 11569
  misc_feature (1016)..(1016): n is either a, c, g or t
  misc_feature (1075)..(1075): n is either a, c, g or t
cggtcgtacgttcgacgttaattttcggtttattataataaaagttcgaaattttagtttgcgggaagcgatcgttgattattagaacgttattttgcgttagtcgttgaattttgcgtagattcgttatttttcgtagcgagaagtagtatataattatcgtcgtttatagcgtcggattttttttatgtttgtaggtcgtagtgaagtttagggttggtacgttattcgcgatatcgacggttatgacgcggtatttattaaacgcgtagtagaagaagcgcgcgtagtgattgataaattttttttgttgatgtgtaaaattattatcggtttcggtttttcgaataaagtcggtatttacgatttttacggtgcgtcgttgggcgacgttgaaattgttttgattcgcgaataattgggttggaaatatgcgtcgttcgaaatttcgtttgaaatttatgtttagtgggatgcgaaagaagtaggttaggcgaaagaattcgtatggaacgagaaattcgttgtttacgcgaaagtttattcgtaggaagtcgttgaatttattcgtcgtatgaaaggcgaaatgtcgtttgatttcgacgttaaagcgaaagagtttatcgttaaattgtaggttaattcggcgaaaatcgttagtcgtaaagcgttttagaatgttatcgaagcgttcggttcgttgttgtcggaatttttcggcggttttgttgatttggcgtcgtttaatttgattttgtggtttggttttaaagtaattaacgaagatgttgcgggtaattatatttattacggtgttcgcgagttcggtatgatcgcgattgttaacggtatttttttgtacggtggttttttgtcgtatattttatttttttgatgttcgtggaatacgtacgtaacgtcgtacgtatggttgcgttgatgaaatagcgttaggtgatggtttaatttacgattttatcggtttgggcgaagacggtcgatttatagtcggtgantaggtcgttttttgcgcgtaattcgaaatgtttaatggcgttcgtgtgatagttgaatncgcggcgcgtggaattttcggagcgtcgaagagagtgttattgttgaattgattgagcgtatttatggtttgcgttgtatgattattgacgatttagttgtcggaacgtcgtttgtggtgtcgttcggacgaacggtatttttaatcgtaaatagttaaattaagtggtttgttattatggtattttgttttttggatgttatcgtatagcgtaatagtacgttattataagttattatttcgtcgattaacgcggaaaggattataataatcgttttattcggatcgtttttttttattggtaatgacgggtttaattgata

SEQ ID NO: 11570 - DNA, 1398 bp, Artificial Sequence
  chemically treated genomic DNA (Homo sapiens) CpG-island No: 11570
  misc_feature (324)..(324): n is either a, c, g or t
  misc_feature (383)..(383): n is either a, c, g or t
tatcaattaaacccgtcattaccaataaaaaaaaacgatccgaataaaacgattattataatcctttccgcgttaatcgacgaaataataacttataataacgtactattacgctatacgataacatccaaaaaacaaaataccataataacaaaccacttaatttaactatttacgattaaaaataccgttcgtccgaacgacaccacaaacgacgttccgacaactaaatcgtcaataatcatacaacgcaaaccataaatacgctcaatcaattcaacaataacactctcttcgacgctccgaaaattccacgcgccgcgnattcaactatcacacgaacgccattaaacatttcgaattacgcgcaaaaaacgacctantcaccgactataaatcgaccgtcttcgcccaaaccgataaaatcgtaaattaaaccatcacctaacgctatttcatcaacgcaaccatacgtacgacgttacgtacgtattccacgaacatcaaaaaaataaaatatacgacaaaaaaccaccgtacaaaaaaataccgttaacaatcgcgatcataccgaactcgcgaacaccgtaataaatataattacccgcaacatcttcgttaattactttaaaaccaaaccacaaaatcaaattaaacgacgccaaatcaacaaaaccgccgaaaaattccgacaacaacgaaccgaacgcttcgataacattctaaaacgctttacgactaacgattttcgccgaattaacctacaatttaacgataaactctttcgctttaacgtcgaaatcaaacgacatttcgcctttcatacgacgaataaattcaacgacttcctacgaataaactttcgcgtaaacaacgaatttctcgttccatacgaattctttcgcctaacctacttctttcgcatcccactaaacataaatttcaaacgaaatttcgaacgacgcatatttccaacccaattattcgcgaatcaaaacaatttcaacgtcgcccaacgacgcaccgtaaaaatcgtaaataccgactttattcgaaaaaccgaaaccgataataattttacacatcaacaaaaaaaatttatcaatcactacgcgcgcttcttctactacgcgtttaataaataccgcgtcataaccgtcgatatcgcgaataacgtaccaaccctaaacttcactacgacctacaaacataaaaaaaatccgacgctataaacgacgataattatatactacttctcgctacgaaaaataacgaatctacgcaaaattcaacgactaacgcaaaataacgttctaataatcaacgatcgcttcccgcaaactaaaatttcgaacttttattataataaaccgaaaattaacgtcgaacgtacgaccg

SEQ ID NO: 11571 - DNA, 1398 bp, Artificial Sequence
  chemically treated genomic DNA (Homo sapiens) CpG-island No: 11571
  misc_feature (324)..(324): n is either a, c, g or t
  misc_feature (383)..(383): n is either a, c, g or t
tattagttaagttcgttattgttagtgaaaaaagacggttcgggtaaggcgattattgtgatttttttcgcgttgatcggcgggatggtggtttgtggtggcgtgttgttgcgttatgcgatggtatttagaaaataggatgttatgatggtagattatttagtttaattatttgcggttgaaggtgtcgttcgttcgagcggtattataagcggcgtttcggtaattggatcgttaatgattatgtagcgtagattataaatgcgtttaattagtttagtagtgatatttttttcggcgtttcggagattttacgcgtcgcgnatttaattgttatacggacgttattagatatttcgagttacgcgtaagaagcgatttgnttatcggttgtgagtcggtcgttttcgtttagatcgatggagtcgtgggttaaattattatttgacgttgttttattagcgtagttatacgtacggcgttacgtgcgtattttacgaatattaggaaggtggagtgtacggtaggaagttatcgtgtagggagatatcgttagtaatcgcggttatatcgaattcgcgaatatcgtagtggatgtagttattcgtagtattttcgttgattgttttagaattagattatagggttaggttagacggcgttaggttagtagaatcgtcgaggaatttcggtaatagcggatcgaacgtttcgatagtattttgagacgttttacggttggcgattttcgtcggattagtttgtagtttagcgatgaattttttcgttttagcgtcgaagttagacggtatttcgttttttatacggcgggtaaatttagcggttttttgcggataagttttcgcgtaagtagcgaatttttcgttttatgcggattttttcgtttggtttgtttttttcgtattttattgagtatagattttagacgggatttcgaacggcgtatatttttagtttagttgttcgcgggttagggtaattttagcgtcgtttagcggcgtatcgtgggagtcgtgggtatcggttttgttcggggaatcgaaatcgatgatggttttgtatattagtagggaaggtttgttagttattgcgcgcgttttttttattgcgcgtttgatagatgtcgcgttatgatcgtcgatgtcgcgaataacgtgttagttttaagttttattacgatttgtaggtatgaaggaaattcggcgttatgggcggcggtgattatgtattgtttttcgttgcgaagaatggcgaatttacgtaaggtttagcgattggcgtaaagtggcgttttggtggttagcgatcgtttttcgtaggttgaaatttcgggtttttattatgatggatcggggattggcgtcgaacgtgcgatcg

SEQ ID NO: 11572 - DNA, 1398 bp, Artificial Sequence
  chemically treated genomic DNA (Homo sapiens) CpG-island No: 11572
  misc_feature (1016)..(1016): n is either a, c, g or t
  misc_feature (1075)..(1075): n is either a, c, g or t
cgatcgcacgttcgacgccaatccccgatccatcataataaaaacccgaaatttcaacctacgaaaaacgatcgctaaccaccaaaacgccactttacgccaatcgctaaaccttacgtaaattcgccattcttcgcaacgaaaaacaatacataatcaccgccgcccataacgccgaatttccttcatacctacaaatcgtaataaaacttaaaactaacacgttattcgcgacatcgacgatcataacgcgacatctatcaaacgcgcaataaaaaaaacgcgcgcaataactaacaaaccttccctactaatatacaaaaccatcatcgatttcgattccccgaacaaaaccgatacccacgactcccacgatacgccgctaaacgacgctaaaattaccctaacccgcgaacaactaaactaaaaatatacgccgttcgaaatcccgtctaaaatctatactcaataaaatacgaaaaaaacaaaccaaacgaaaaaatccgcataaaacgaaaaattcgctacttacgcgaaaacttatccgcaaaaaaccgctaaatttacccgccgtataaaaaacgaaataccgtctaacttcgacgctaaaacgaaaaaattcatcgctaaactacaaactaatccgacgaaaatcgccaaccgtaaaacgtctcaaaatactatcgaaacgttcgatccgctattaccgaaattcctcgacgattctactaacctaacgccgtctaacctaaccctataatctaattctaaaacaatcaacgaaaatactacgaataactacatccactacgatattcgcgaattcgatataaccgcgattactaacgatatctccctacacgataacttcctaccgtacactccaccttcctaatattcgtaaaatacgcacgtaacgccgtacgtataactacgctaataaaacaacgtcaaataataatttaacccacgactccatcgatctaaacgaaaacgaccgactcacaaccgataancaaatcgcttcttacgcgtaactcgaaatatctaataacgtccgtataacaattaaatncgcgacgcgtaaaatctccgaaacgccgaaaaaaatatcactactaaactaattaaacgcatttataatctacgctacataatcattaacgatccaattaccgaaacgccgcttataataccgctcgaacgaacgacaccttcaaccgcaaataattaaactaaataatctaccatcataacatcctattttctaaataccatcgcataacgcaacaacacgccaccacaaaccaccatcccgccgatcaacgcgaaaaaaatcacaataatcgccttacccgaaccgtcttttttcactaacaataacgaacttaactaata

SEQ ID NO: 11573 - DNA, 729 bp, Artificial Sequence
  chemically treated genomic DNA (Homo sapiens) CpG-island No: 11573
acgtaacgggttttttgtatggcgtaacggtatatttttaattggcgttcgttattggttggtagatatttttatttcggaagcgtgtttcgcgtgtttgagttaggtttggtatttggtatgttcggggaaacgtttttggtttatggtaatacgtcgattagattggttttatacgtcgttagtacgtaggaatgttacgattgcgattgatttacggtttgagtagtattggtataattagttttagttcggcgatattaagttagaattattacgtttagaaatcgttatttaatgtcgttattagcgtacgaattttatcgttatcgtttagcgttagatcgataaaaaacgttattagtaggaagattttattttatattatagggatttttatacggtgtataaattgcgttttcgtggaatgcgggttattgcgttggcgtatcgtaatgggcgattagcgttatcgtcgtatcggacgagatgtcggagaagaggaatagtatcggtagagtcgggttattgaggaacggatacgattttagcgtcgatagtagaaagtcggtataagtttttaataatatcgttagtattagtattaatgtttttagttcgcgatgaacgggcgttataggtttagaattttttgtacgatttttagtttcggtaattagcgttgttgtagggtaggtaaattatgtttaaagattttcgttagttata

SEQ ID NO: 11574 - DNA, 729 bp, Artificial Sequence
  chemically treated genomic DNA (Homo sapiens) CpG-island No: 11574
tataactaacgaaaatctttaaacataatttacctaccctacaacaacgctaattaccgaaactaaaaatcgtacaaaaaattctaaacctataacgcccgttcatcgcgaactaaaaacattaatactaatactaacgatattattaaaaacttataccgactttctactatcgacgctaaaatcgtatccgttcctcaataacccgactctaccgatactattcctcttctccgacatctcgtccgatacgacgataacgctaatcgcccattacgatacgccaacgcaataacccgcattccacgaaaacgcaatttatacaccgtataaaaatccctataatataaaataaaatcttcctactaataacgttttttatcgatctaacgctaaacgataacgataaaattcgtacgctaataacgacattaaataacgatttctaaacgtaataattctaacttaatatcgccgaactaaaactaattataccaatactactcaaaccgtaaatcaatcgcaatcgtaacattcctacgtactaacgacgtataaaaccaatctaatcgacgtattaccataaaccaaaaacgtttccccgaacataccaaataccaaacctaactcaaacacgcgaaacacgcttccgaaataaaaatatctaccaaccaataacgaacgccaattaaaaatataccgttacgccatacaaaaaacccgttacgt

SEQ ID NO: 11575 - DNA, 729 bp, Artificial Sequence
  chemically treated genomic DNA (Homo sapiens) CpG-island No: 11575
tgtggttggcgaaaatttttgaatatgatttgtttgttttgtaataacgttggttgtcgaagttggggatcgtgtaaaaggttttgagtttgtgacgttcgtttatcgcggattggaaatattgatgttggtgttggcggtgttgttgggggtttatatcggttttttgttgtcggcgttgaaatcgtattcgttttttaataattcgattttgtcggtgttgtttttttttttcggtatttcgttcggtgcggcggtggcgttgatcgtttattgcgatacgttaacgtagtaattcgtattttacggaagcgtagtttgtatatcgtatggaaatttttgtggtatggggtgaaatttttttgttggtggcgttttttgtcggtttggcgttgggcgatgacggtaaagttcgtgcgttggtggcggtattaggtggcggtttttggacgtggtggttttggtttggtgtcgtcgggttggggttgattgtgttaatgttgtttaaatcgtgggttaatcgtagtcgtggtatttttgcgtgttggcggcgtgtggggttagtttggtcggcgtgttgttatagattaaaagcgttttttcgagtatattaggtgttaaatttggtttaagtacgcgaaatacgttttcggagtgaaaatatttattaattagtggcgagcgttaattaagaatgtgtcgttacgttatgtagaaagttcgttgcgt

SEQ ID NO: 11576 - DNA, 729 bp, Artificial Sequence
  chemically treated genomic DNA (Homo sapiens) CpG-island No: 11576
acgcaacgaactttctacataacgtaacgacacattcttaattaacgctcgccactaattaataaatattttcactccgaaaacgtatttcgcgtacttaaaccaaatttaacacctaatatactcgaaaaaacgcttttaatctataacaacacgccgaccaaactaaccccacacgccgccaacacgcaaaaataccacgactacgattaacccacgatttaaacaacattaacacaatcaaccccaacccgacgacaccaaaccaaaaccaccacgtccaaaaaccgccacctaataccgccaccaacgcacgaactttaccgtcatcgcccaacgccaaaccgacaaaaaacgccaccaacaaaaaaatttcaccccataccacaaaaatttccatacgatatacaaactacgcttccgtaaaatacgaattactacgttaacgtatcgcaataaacgatcaacgccaccgccgcaccgaacgaaataccgaaaaaaaaaaacaacaccgacaaaatcgaattattaaaaaacgaatacgatttcaacgccgacaacaaaaaaccgatataaacccccaacaacaccgccaacaccaacatcaatatttccaatccgcgataaacgaacgtcacaaactcaaaaccttttacacgatccccaacttcgacaaccaacgttattacaaaacaaacaaatcatattcaaaaattttcgccaaccaca

SEQ ID NO: 11577 - DNA, 685 bp, Artificial Sequence
  chemically treated genomic DNA (Homo sapiens) CpG-island No: 11577
agtttacgtatcgatgtcgtatgttatatcgtagttacggtcgtaatcgatggagtcgtagttatcgaattttaggttagcgaaggtaagacgggttttatttttggaggaattttgagattcgtcggatttgtgttgtatgtggttcggcgaagtttgtatgtttgtaggtcggaaagataagtcgtttgtcggatgtcgttatcgtttgtgttggcggcggttcgaatgttatcggtatgtttgttgattttattaatgaaattaacgtcggtttgattggtgtggagttaggtggttacggtatcgaaattggcgagtacggcgtatcgttaaaatatggtcgcgtgggtatttatttcggtatgaaagcgtcgatgatgtaaatcgaagacgggtagattgaagaattttattttattttcgtcggattggatttttcgtttgtcggtttataatacgcgtattttaatagtattggacgcgttgattacgtgtttattatcgatgatgaagtttttgaagtttttaaaacgttgtgtttgtacgaagggattatttcggcgttggaatttttttacgttttggtttatgcgttgaaaatgatgcgcgaaaattcggataaagagtagttattggtggttaattttttcggtcgcggcgataaagatatttttatcgttta

SEQ ID NO: 11578 - DNA, 685 bp, Artificial Sequence
  chemically treated genomic DNA (Homo sapiens) CpG-island No: 11578
taaacgataaaaatatctttatcgccgcgaccgaaaaaattaaccaccaataactactctttatccgaattttcgcgcatcattttcaacgcataaaccaaaacgtaaaaaaattccaacgccgaaataatcccttcgtacaaacacaacgttttaaaaacttcaaaaacttcatcatcgataataaacacgtaatcaacgcgtccaatactattaaaatacgcgtattataaaccgacaaacgaaaaatccaatccgacgaaaataaaataaaattcttcaatctacccgtcttcgatttacatcatcgacgctttcataccgaaataaatacccacgcgaccatattttaacgatacgccgtactcgccaatttcgataccgtaaccacctaactccacaccaatcaaaccgacgttaatttcattaataaaatcaacaaacataccgataacattcgaaccgccgccaacacaaacgataacgacatccgacaaacgacttatctttccgacctacaaacatacaaacttcgccgaaccacatacaacacaaatccgacgaatctcaaaattcctccaaaaataaaacccgtcttaccttcgctaacctaaaattcgataactacgactccatcgattacgaccgtaactacgatataacatacgacatcgatacgtaaact

SEQ ID NO: 11579 - DNA, 685 bp, Artificial Sequence
  chemically treated genomic DNA (Homo sapiens) CpG-island No: 11579
tgaacggtgaagatgtttttatcgtcgcgatcggaaaggttaattattagtagttgttttttattcgggttttcgcgtattatttttaacgtatgggttagggcgtgggaggattttagcgtcgggatgattttttcgtgtaggtatagcgttttgaaggttttaagggttttattatcggtaatagatacgtaattagcgcgtttagtgttgttaagatacgcgtgttgtgggtcgatagacgggaaatttagttcggcggagatggagtaagattttttaatttgttcgttttcggtttgtattatcggcgtttttatatcgaaatagatatttacgcgattatgttttagcggtgcgtcgtgttcgttagtttcgatatcgtgattatttggttttatattaattaggtcgacgttggttttattgatgaaattagtaaatatgtcgatggtattcgaatcgtcgttaatataggcgataacggtattcggtaggcgatttattttttcgatttgtaggtatgtaaatttcgtcgagttatatgtagtataggttcgacgaattttaaggtttttttaaagataaaattcgttttgttttcgttggtttgaaattcggtgattacggttttatcgattacggtcgtaattacggtgtagtatacgatatcggtgcgtggatt

SEQ ID NO: 11580 - DNA, 685 bp, Artificial Sequence
  chemically treated genomic DNA (Homo sapiens) CpG-island No: 11580
aatccacgcaccgatatcgtatactacaccgtaattacgaccgtaatcgataaaaccgtaatcaccgaatttcaaaccaacgaaaacaaaacgaattttatctttaaaaaaaccttaaaattcgtcgaacctatactacatataactcgacgaaatttacatacctacaaatcgaaaaaataaatcgcctaccgaataccgttatcgcctatattaacgacgattcgaataccatcgacatatttactaatttcatcaataaaaccaacgtcgacctaattaatataaaaccaaataatcacgatatcgaaactaacgaacacgacgcaccgctaaaacataatcgcgtaaatatctatttcgatataaaaacgccgataatacaaaccgaaaacgaacaaattaaaaaatcttactccatctccgccgaactaaatttcccgtctatcgacccacaacacgcgtatcttaacaacactaaacgcgctaattacgtatctattaccgataataaaacccttaaaaccttcaaaacgctatacctacacgaaaaaatcatcccgacgctaaaatcctcccacgccctaacccatacgttaaaaataatacgcgaaaacccgaataaaaaacaactactaataattaacctttccgatcgcgacgataaaaacatcttcaccgttca

SEQ ID NO: 11581 - DNA, 528 bp, Artificial Sequence
  chemically treated genomic DNA (Homo sapiens) CpG-island No: 11581
tgtcgtcgttgttttagcgttggtttggtgtgatttgatcgtttttcgtaagatggtcgtaacgttgggtatagtgttgatgattgtttcggtatgatcggtttgtttataattcgtatgtcgttattatgtcgtttttatcggtggttttttttataggtattgtttggttttttgaatatcgtttttttaatttggttgcgggtatttatcgtcgcgaagtatttttagagggcgggttattgttatggtatttgtatcggcgaagggttggaaattgtcggatagggtgattgtgttattgtgtagtgggatgcgaatagtaacggtatttgggatcgcgaatcggtaaaagagttcgattagattggatttcgtttgaaggagtatgtgttggaaacgttacgcggtgcgatattttgtgaaggtaagggttgggataaagttattaattcggatgttattattatcgatattttttaggtcgtacgttaggatgttagcggtttttcgtcggtgttgacggtt

SEQ ID NO: 11582 - DNA, 528 bp, Artificial Sequence
  chemically treated genomic DNA (Homo sapiens) CpG-island No: 11582
aaccgtcaacaccgacgaaaaaccgctaacatcctaacgtacgacctaaaaaatatcgataataataacatccgaattaataactttatcccaacccttaccttcacaaaatatcgcaccgcgtaacgtttccaacacatactccttcaaacgaaatccaatctaatcgaactcttttaccgattcgcgatcccaaataccgttactattcgcatcccactacacaataacacaatcaccctatccgacaatttccaacccttcgccgatacaaataccataacaataacccgccctctaaaaatacttcgcgacgataaatacccgcaaccaaattaaaaaaacgatattcaaaaaaccaaacaatacctataaaaaaaaccaccgataaaaacgacataataacgacatacgaattataaacaaaccgatcataccgaaacaatcatcaacactatacccaacgttacgaccatcttacgaaaaacgatcaaatcacaccaaaccaacgctaaaacaacgacgaca

SEQ ID NO: 11583 - DNA, 528 bp, Artificial Sequence
  chemically treated genomic DNA (Homo sapiens) CpG-island No: 11583
aatcgttaatatcggcgagaagtcgttgatattttgacgtacgatttgaaaagtgtcgataatgatggtattcggattagtgattttattttagtttttatttttataggatgtcgtatcgcgtagcgtttttagtatatgtttttttagacgaaatttaatttggtcggatttttttatcggttcgcgattttagatatcgttattgttcgtattttattgtataatgatatagttattttgttcgataatttttagtttttcgtcggtatagatgttatgataataattcgttttttggagatgtttcgcgacggtaaatattcgtagttagattgggaagacggtatttagggagttagatagtgtttgtgggaaaaattatcgataaaggcggtataatggcgatatacgggttgtgaataggtcgattatatcggggtaattattagtattgtatttagcgttacgattattttacgggaaacgattaggttatattaaattaacgttggaatagcggcggta

SEQ ID NO: 11584 - DNA, 528 bp, Artificial Sequence
  chemically treated genomic DNA (Homo sapiens) CpG-island No: 11584
taccgccgctattccaacgttaatttaatataacctaatcgtttcccgtaaaataatcgtaacgctaaatacaatactaataattaccccgatataatcgacctattcacaacccgtatatcgccattataccgcctttatcgataatttttcccacaaacactatctaactccctaaataccgtcttcccaatctaactacgaatatttaccgtcgcgaaacatctccaaaaaacgaattattatcataacatctataccgacgaaaaactaaaaattatcgaacaaaataactatatcattatacaataaaatacgaacaataacgatatctaaaatcgcgaaccgataaaaaaatccgaccaaattaaatttcgtctaaaaaaacatatactaaaaacgctacgcgatacgacatcctataaaaataaaaactaaaataaaatcactaatccgaataccatcattatcgacacttttcaaatcgtacgtcaaaatatcaacgacttctcgccgatattaacgatt

SEQ ID NO: 11585 - DNA, 693 bp, Artificial Sequence
  chemically treated genomic DNA (Homo sapiens) CpG-island No: 11585
gcgcggcggatagtgggttggttgcgaatgtttagacgtttgcgtaaatcgggtaagttacggtttttatttttaagtttattgtatatggatgtttacgtcggaaatttagtgtatagcgcgttagggttaaaatttatcgattgggagtatgtcggagatggggatatcgcgttggaatttggcggcggtgtgggtggaaaatattgaatagtatcggtagttggttaatgattatgttattcgcgcgaagatttagtcggcgtaattatggcgttaggttaggcgatggttgttttggttgttgatgtttaaagtagggtggtttgagtatcgttggcgataaatcggcgatcgataatttattaggttggtcgatgatagttggcggtagttataataggagtaataaggagagtagtgtgggtttagtaatgttggatgtcgaaggttacgaattggacgcggaagcgcgtgaaatattggcgtattcgttggtgggagggttgagtttttttacgcgtaattattatgattttgttttaggtacgtgaattggtcgttagatttcgcgtattcgcgtaatcgtttggtggtggcggttgattaggaaggtggacgcgtgtagtgttttcgtgaaggtttatagggtttgtagcggtgtaattattcgttgatttttacgtttgtagg

SEQ ID NO: 11586 - DNA, 693 bp, Artificial Sequence
  chemically treated genomic DNA (Homo sapiens) CpG-island No: 11586
cctacaaacgtaaaaatcaacgaataattacaccgctacaaaccctataaaccttcacgaaaacactacacgcgtccaccttcctaatcaaccgccaccaccaaacgattacgcgaatacgcgaaatctaacgaccaattcacgtacctaaaacaaaatcataataattacgcgtaaaaaaactcaaccctcccaccaacgaatacgccaatatttcacgcgcttccgcgtccaattcgtaaccttcgacatccaacattactaaacccacactactctccttattactcctattataactaccgccaactatcatcgaccaacctaataaattatcgatcgccgatttatcgccaacgatactcaaaccaccctactttaaacatcaacaaccaaaacaaccatcgcctaacctaacgccataattacgccgactaaatcttcgcgcgaataacataatcattaaccaactaccgatactattcaatattttccacccacaccgccgccaaattccaacgcgatatccccatctccgacatactcccaatcgataaattttaaccctaacgcgctatacactaaatttccgacgtaaacatccatatacaataaacttaaaaataaaaaccgtaacttacccgatttacgcaaacgtctaaacattcgcaaccaacccactatccgccgcgc

SEQ ID NO: 11587 - DNA, 693 bp, Artificial Sequence
  chemically treated genomic DNA (Homo sapiens) CpG-island No: 11587
tttgtaaacgtgaaaattagcgaatgattgtatcgttgtaagttttataaatttttacgaaaatattgtacgcgtttatttttttgattaatcgttattattagacgattgcgcgaatacgcggagtttggcgattagtttacgtatttggggtaggattatgatggttacgcgtaaagagatttagtttttttattagcggatgcgttagtattttacgcgttttcgcgtttagttcgtaattttcgatatttaatattattggatttatattgttttttttattgtttttattgtagttgtcgttagttgttatcggttagtttgataaattgtcgatcgtcggtttgtcgttagcggtatttaaattattttgttttgagtattagtagttagggtaattatcgtttgatttgacgttataattgcgtcggttgaattttcgcgcgagtggtatagttattgattaattgtcggtgttgtttagtattttttatttatatcgtcgttagattttagcgcgatatttttattttcggtatatttttagtcgatgagttttagttttgacgcgttatgtattaaattttcggcgtggatatttatatgtaatggatttaagggtaaaggtcgtggtttgttcgatttgcgtagacgtttaaatattcgtagttaatttattgttcgtcgcgt

SEQ ID NO: 11588 - DNA, 693 bp, Artificial Sequence
  chemically treated genomic DNA (Homo sapiens) CpG-island No: 11588
acgcgacgaacaataaattaactacgaatatttaaacgtctacgcaaatcgaacaaaccacgacctttacccttaaatccattacatataaatatccacgccgaaaatttaatacataacgcgtcaaaactaaaactcatcgactaaaaatataccgaaaataaaaatatcgcgctaaaatctaacgacgatataaataaaaaatactaaacaacaccgacaattaatcaataactataccactcgcgcgaaaattcaaccgacgcaattataacgtcaaatcaaacgataattaccctaactactaatactcaaaacaaaataatttaaataccgctaacgacaaaccgacgatcgacaatttatcaaactaaccgataacaactaacgacaactacaataaaaacaataaaaaaaacaatataaatccaataatattaaatatcgaaaattacgaactaaacgcgaaaacgcgtaaaatactaacgcatccgctaataaaaaaactaaatctctttacgcgtaaccatcataatcctaccccaaatacgtaaactaatcgccaaactccgcgtattcgcgcaatcgtctaataataacgattaatcaaaaaaataaacgcgtacaatattttcgtaaaaatttataaaacttacaacgatacaatcattcgctaattttcacgtttacaaa

SEQ ID NO: 11589 - DNA, 824 bp, Artificial Sequence
  chemically treated genomic DNA (Homo sapiens) CpG-island No: 11589
agttttcgttgcgttattggcgattggtatgacgttggtgatcgttatcggtgggattgattttttcgtagggcggtgatggttatcgtcggagttataacggttgcgatgacggtcgcgggatttagtttgtcgattgttttgttaagcgttttgggtatcggtattttggcgggattgtggaacggtatattggtagcgatttttaaaatttagtcgtttgtcgttattttgattttgatggtcgtcgggcgcggttgagcgtagattgattatcgtcgggtagatcgttacgtttaattcgtcggattttttatggttcggtagtggatcgttgttgtttttgttaacgtcggttattatcgcggtgttgacgtttattttgttttggttgttgattcgtaaaacggcgttggggatgtttatcgaagtcgttggtattaatattcgggcggtaaaaaatgtcggggtaaatacgcgaattatcgttatgtttatttatgtgttgagcgggttgtgtgcggcgattgcgggtattatcgtggcggcggatattcgcggtgtcgatgttaataacgttgggttatggttggagttggacgttattttcgcggtggtgattggcggcggatcgttgatgggcgggcgttttaatttgttattttcggtggtgggggcgttgattatttaggggatgaatatcggaattttgttttcgggtttttcgttagagatgaattaggtggtgaaagcggtggtggtgttttgcgtgttgattgtttagtcgtaacgttttattagtttgattaaaggagtacgtagtt

SEQ ID NO: 11590 - DNA, 824 bp, Artificial Sequence
  chemically treated genomic DNA (Homo sapiens) CpG-island No: 11590
aactacgtactcctttaatcaaactaataaaacgttacgactaaacaatcaacacgcaaaacaccaccaccgctttcaccacctaattcatctctaacgaaaaacccgaaaacaaaattccgatattcatcccctaaataatcaacgcccccaccaccgaaaataacaaattaaaacgcccgcccatcaacgatccgccgccaatcaccaccgcgaaaataacgtccaactccaaccataacccaacgttattaacatcgacaccgcgaatatccgccgccacgataatacccgcaatcgccgcacacaacccgctcaacacataaataaacataacgataattcgcgtatttaccccgacattttttaccgcccgaatattaataccaacgacttcgataaacatccccaacgccgttttacgaatcaacaaccaaaacaaaataaacgtcaacaccgcgataataaccgacgttaacaaaaacaacaacgatccactaccgaaccataaaaaatccgacgaattaaacgtaacgatctacccgacgataatcaatctacgctcaaccgcgcccgacgaccatcaaaatcaaaataacgacaaacgactaaattttaaaaatcgctaccaatataccgttccacaatcccgccaaaataccgatacccaaaacgcttaacaaaacaatcgacaaactaaatcccgcgaccgtcatcgcaaccgttataactccgacgataaccatcaccgccctacgaaaaaatcaatcccaccgataacgatcaccaacgtcataccaatcgccaataacgcaacgaaaact

SEQ ID NO: 11591 - DNA, 824 bp, Artificial Sequence
  chemically treated genomic DNA (Homo sapiens) CpG-island No: 11591
ggttacgtatttttttaattagattgataaagcgttgcgattgaataattagtacgtaaagtattattatcgtttttattatttggtttatttttggcggaaagttcgaaagtaaaatttcggtgtttattttttgaataattagcgtttttattatcgaaagtagtaggttaaagcgttcgtttattagcgattcgtcgttaattattatcgcgagaatggcgtttagttttagttataatttagcgttgttggtatcggtatcgcgaatattcgtcgttacgataatgttcgtaatcgtcgtatatagttcgtttaatatataagtgagtatgacgatgattcgcgtgtttatttcggtattttttgtcgttcgaatgttgatattaacggtttcgataaatatttttagcgtcgttttgcgggttaatagttagaataggataagcgttagtatcgcgataatgatcggcgttggtaggaataatagcgatttattgtcgaattatgagagattcggcgagttaaacgtgacgatttgttcggcggtgattagtttgcgtttagtcgcgttcggcgattattaggattagagtggcgataaacggttgaattttgaggatcgttattagtatgtcgttttataatttcgttaggatgtcggtgtttagggcgtttaataaaataatcggtaggttgaatttcgcgatcgttatcgtagtcgttgtggtttcggcgatagttattatcgttttacggagagattaattttatcggtggcgattattagcgttatgttaatcgttagtaacgtaacgggagtt

SEQ ID NO: 11592 - DNA, 824 bp, Artificial Sequence
  chemically treated genomic DNA (Homo sapiens) CpG-island No: 11592
aactcccgttacgttactaacgattaacataacgctaataatcgccaccgataaaattaatctctccgtaaaacgataataactatcgccgaaaccacaacgactacgataacgatcgcgaaattcaacctaccgattattttattaaacgccctaaacaccgacatcctaacgaaattataaaacgacatactaataacgatcctcaaaattcaaccgtttatcgccactctaatcctaataatcgccgaacgcgactaaacgcaaactaatcaccgccgaacaaatcgtcacgtttaactcgccgaatctctcataattcgacaataaatcgctattattcctaccaacgccgatcattatcgcgatactaacgcttatcctattctaactattaacccgcaaaacgacgctaaaaatatttatcgaaaccgttaatatcaacattcgaacgacaaaaaataccgaaataaacacgcgaatcatcgtcatactcacttatatattaaacgaactatatacgacgattacgaacattatcgtaacgacgaatattcgcgataccgataccaacaacgctaaattataactaaaactaaacgccattctcgcgataataattaacgacgaatcgctaataaacgaacgctttaacctactactttcgataataaaaacgctaattattcaaaaaataaacaccgaaattttactttcgaactttccgccaaaaataaaccaaataataaaaacgataataatactttacgtactaattattcaatcgcaacgctttatcaatctaattaaaaaaatacgtaacc

SEQ ID NO: 11593 - DNA, 509 bp, Artificial Sequence
  chemically treated genomic DNA (Homo sapiens) CpG-island No: 11593
tgtttcgttgtttaaggagtagttatgatttggtttcgtcgttagttttttatcggcgtcggcgtgttggtagtcgttagcggtatcgtaggcgcgtggtggcgaaaacgttgaatattaatggggtgcgttacggtatggtgtatgacgagtcgttatgtatcggttgtatcgtttgtatggatgtttgtcgggaagtgaataaggtgtcggaagcgtttcgcgttgacgattattcgtagcgagtcgtaggcgaattttttgatgtgaaatatcgtttttttcgtaagttttgttagtattgcgattatgcgtcgtgcgttgacgtttgttcgatcggtgcgttttttcgcgatgttgttagtgggattgtcgatgttaattcggatttttgcgtcggttgttagtattgtatcgtcgtttgttcgtatcgcgtgttacgtcggtttgtttgtaggtttattagttagaaggtgattttatgtgattattattattttaataatcga

SEQ ID NO: 11594 - DNA, 509 bp, Artificial Sequence
  chemically treated genomic DNA (Homo sapiens) CpG-island No: 11594
tcgattattaaaataataataatcacataaaatcaccttctaactaataaacctacaaacaaaccgacgtaacacgcgatacgaacaaacgacgatacaatactaacaaccgacgcaaaaatccgaattaacatcgacaatcccactaacaacatcgcgaaaaaacgcaccgatcgaacaaacgtcaacgcacgacgcataatcgcaatactaacaaaacttacgaaaaaaacgatatttcacatcaaaaaattcgcctacgactcgctacgaataatcgtcaacgcgaaacgcttccgacaccttattcacttcccgacaaacatccatacaaacgatacaaccgatacataacgactcgtcatacaccataccgtaacgcaccccattaatattcaacgttttcgccaccacgcgcctacgataccgctaacgactaccaacacgccgacgccgataaaaaactaacgacgaaaccaaatcataactactccttaaacaacgaaaca

SEQ ID NO: 11595 - DNA, 509 bp, Artificial Sequence
  chemically treated genomic DNA (Homo sapiens) CpG-island No: 11595
tcgattattaaagtgatggtagttatataaagttattttttagttaatagatttgtaggtaagtcgacgtggtacgcggtacggataggcggcgatgtagtattgataatcgacgtagagattcggattaatatcgataattttattggtagtatcgcgaaaagacgtatcggtcgggtagacgttaacgtacggcgtatgatcgtagtgttggtaagatttacggaagaagcgatattttatattaggaaattcgtttgcggttcgttacgaataatcgttagcgcgagacgttttcggtattttgtttatttttcgataagtatttatataggcggtatagtcgatgtataacgattcgttatgtattatgtcgtaacgtattttattgatatttaacgttttcgttattacgcgtttgcggtgtcgttgacggttgttagtacgtcgacgtcggtgagaaattggcgacgagattaggttatggttgttttttaagtaacggaata

SEQ ID NO: 11596 - DNA, 509 bp, Artificial Sequence
  chemically treated genomic DNA (Homo sapiens) CpG-island No: 11596
tattccgttacttaaaaaacaaccataacctaatctcgtcgccaatttctcaccgacgtcgacgtactaacaaccgtcaacgacaccgcaaacgcgtaataacgaaaacgttaaatatcaataaaatacgttacgacataatacataacgaatcgttatacatcgactataccgcctatataaatacttatcgaaaaataaacaaaataccgaaaacgtctcgcgctaacgattattcgtaacgaaccgcaaacgaatttcctaatataaaatatcgcttcttccgtaaatcttaccaacactacgatcatacgccgtacgttaacgtctacccgaccgatacgtcttttcgcgatactaccaataaaattatcgatattaatccgaatctctacgtcgattatcaatactacatcgccgcctatccgtaccgcgtaccacgtcgacttacctacaaatctattaactaaaaaataactttatataactaccatcactttaataatcga

SEQ ID NO: 11597 - DNA, 512 bp, Artificial Sequence
  chemically treated genomic DNA (Homo sapiens) CpG-island No: 11597
ggaaagaggaagcggtgagtgaggggtcgtcgaggtcgtcgtcggaattttcgaatttcgttaaatttatatttattagggtcgttatgggtaatggttagtggtttcgatttggttcgattcgggtttttttcgttttttttggcgtgcgcgtttttcgatttcggggaagtcgtcgttcggtgtcgggtttttgtgtttgagcgaggattttaattttaggcgtttttggcgttgggaaaaggtaatcggaagaggcgtttaagttattcggtttacgtttttgcggtcgtttaattcggaagcgaaattttcgagtagtcgcgtcgcgatggtaatttttttagcgattgtggttattttagtgcgtagttatttatgtttttcggcggttatggttattttaaaaggtttatcgcggtttttttttagatttagtaaatttaggtcgagtttgagataaattaacgggtttttgtcgttggcgtttttgtatataacgcggttaattt

SEQ ID NO: 11598 - DNA, 512 bp, Artificial Sequence
  chemically treated genomic DNA (Homo sapiens) CpG-island No: 11598
aaattaaccgcgttatatacaaaaacgccaacgacaaaaacccgttaatttatctcaaactcgacctaaatttactaaatctaaaaaaaaaccgcgataaaccttttaaaataaccataaccgccgaaaaacataaataactacgcactaaaataaccacaatcgctaaaaaaattaccatcgcgacgcgactactcgaaaatttcgcttccgaattaaacgaccgcaaaaacgtaaaccgaataacttaaacgcctcttccgattaccttttcccaacgccaaaaacgcctaaaattaaaatcctcgctcaaacacaaaaacccgacaccgaacgacgacttccccgaaatcgaaaaacgcgcacgccaaaaaaaacgaaaaaaacccgaatcgaaccaaatcgaaaccactaaccattacccataacgaccctaataaatataaatttaacgaaattcgaaaattccgacgacgacctcgacgacccctcactcaccgcttcctctttcc

SEQ ID NO: 11599 - DNA, 512 bp, Artificial Sequence
  chemically treated genomic DNA (Homo sapiens) CpG-island No: 11599
aagttaatcgcgttatatataagagcgttagcgatagaggttcgttagtttattttagattcggtttaggtttgttgagtttaaaaagggatcgcggtggattttttgaggtgattatagtcgtcgaggagtataagtgattgcgtattgaggtggttatagtcgttaagaaggttgttatcgcgacgcggttgttcgagggtttcgttttcgggttaggcggtcgtagaagcgtagatcgagtagtttgagcgtttttttcggttatttttttttagcgttagaggcgtttagggttggggttttcgtttaggtatagagattcgatatcgagcggcggttttttcgggatcgagggacgcgtacgttagaggagacgaaaggaattcgggtcggattagatcggaattattgattattgtttatggcggttttagtgagtgtggatttggcggggttcgggggtttcgacggcgatttcggcgattttttatttatcgtttttttttttt

SEQ ID NO: 11600 - DNA, 512 bp, Artificial Sequence
  chemically treated genomic DNA (Homo sapiens) CpG-island No: 11600
aaaaaaaaaaaacgataaataaaaaatcgccgaaatcgccgtcgaaacccccgaaccccgccaaatccacactcactaaaaccgccataaacaataatcaataattccgatctaatccgacccgaattcctttcgtctcctctaacgtacgcgtccctcgatcccgaaaaaaccgccgctcgatatcgaatctctatacctaaacgaaaaccccaaccctaaacgcctctaacgctaaaaaaaaataaccgaaaaaaacgctcaaactactcgatctacgcttctacgaccgcctaacccgaaaacgaaaccctcgaacaaccgcgtcgcgataacaaccttcttaacgactataaccacctcaatacgcaatcacttatactcctcgacgactataatcacctcaaaaaatccaccgcgatccctttttaaactcaacaaacctaaaccgaatctaaaataaactaacgaacctctatcgctaacgctcttatatataacgcgattaactt

SEQ ID NO: 11601 - DNA, 835 bp, Artificial Sequence
  chemically treated genomic DNA (Homo sapiens) CpG-island No: 11601
cgggttttttcgtgttgagtcgtttgtaggacgcggtcgtggtgcggtttggttttttgagtacggtagaggaggagacgttgagtcgagaattggagttcgagttgcgtcgtcgtcgttacgaatacgattattgggacgcggtgagatcggtagcgtcgggggcgagggacgggggttcgtcgggggcgcggtttggggacgtggagtattagatggggcggggatacgttgggggcggtatttagagcggggatttggagcggggatagaggagacgagcgtcgggatcgggtagggttatattgggggcggttatagtatcgtttagcgtgggggcggggttacggtgttggggttgtggggttaggggggtcgggcgtagggatggggcggggttacgttggggcggggataaaggagatagcgtagggatggggcgggggtattttgggggcgggataggaggcgagcgtagggacggggcgtggttacgttgggggcggggatagtggggattagtgttgggatggggcgtggttacgtttgggggcggttatagcgtagtcgagcgtgggggtggggttagggagtcgggtgtagggttggggtgcgattacgttgttagtagttatagtgtagaagaacgtggcggttgggattggggcgtggttaggtcgtcgagcgtatggatggggcggggttaagtttggggcggggttcgtggagttaagcgtcgggatgggttggggttatgttgtgggggggacggggaagtcgaggtttagagagggtagaattacgttgggggcggagataggggagatatatgttg

SEQ ID NO: 11602 - DNA, 835 bp, Artificial Sequence
  chemically treated genomic DNA (Homo sapiens) CpG-island No: 11602
caacatatatctcccctatctccgcccccaacgtaattctaccctctctaaacctcgacttccccgtcccccccacaacataaccccaacccatcccgacgcttaactccacgaaccccgccccaaacttaaccccgccccatccatacgctcgacgacctaaccacgccccaatcccaaccgccacgttcttctacactataactactaacaacgtaatcgcaccccaaccctacacccgactccctaaccccacccccacgctcgactacgctataaccgcccccaaacgtaaccacgccccatcccaacactaatccccactatccccgcccccaacgtaaccacgccccgtccctacgctcgcctcctatcccgcccccaaaatacccccgccccatccctacgctatctcctttatccccgccccaacgtaaccccgccccatccctacgcccgacccccctaaccccacaaccccaacaccgtaaccccgcccccacgctaaacgatactataaccgcccccaatataaccctacccgatcccgacgctcgtctcctctatccccgctccaaatccccgctctaaataccgcccccaacgtatccccgccccatctaatactccacgtccccaaaccgcgcccccgacgaacccccgtccctcgcccccgacgctaccgatctcaccgcgtcccaataatcgtattcgtaacgacgacgacgcaactcgaactccaattctcgactcaacgtctcctcctctaccgtactcaaaaaaccaaaccgcaccacgaccgcgtcctacaaacgactcaacacgaaaaaacccg

SEQ ID NO: 11603 - DNA, 835 bp, Artificial Sequence
  chemically treated genomic DNA (Homo sapiens) CpG-island No: 11603
tagtatgtgttttttttattttcgtttttagcgtggttttgttttttttaaatttcgattttttcgttttttttatagtatggttttaatttatttcggcgtttgattttacggatttcgttttaagtttggtttcgttttatttatgcgttcgacgatttgattacgttttaattttagtcgttacgtttttttgtattgtaattgttagtagcgtaatcgtattttaattttatattcgattttttggttttatttttacgttcgattgcgttgtaatcgtttttaagcgtggttacgttttattttagtattggtttttattgttttcgtttttagcgtggttacgtttcgtttttacgttcgttttttgtttcgtttttagagtgttttcgttttatttttgcgttgttttttttgttttcgttttagcgtggtttcgttttatttttgcgttcgatttttttggttttataattttagtatcgtagtttcgtttttacgttaaacggtattgtaatcgtttttagtgtggttttgttcggtttcggcgttcgttttttttgttttcgttttaaattttcgttttaggtatcgtttttagcgtgttttcgttttatttgatgttttacgtttttaggtcgcgttttcgacgagttttcgtttttcgttttcggcgttgtcggttttatcgcgttttagtgatcgtattcgtagcggcggcggcgtagttcgggttttagttttcggtttagcgtttttttttttgtcgtgtttaggaagttaggtcgtattacggtcgcgttttgtaggcggtttagtacggaagggttcg

SEQ ID NO: 11604 - DNA, 835 bp, Artificial Sequence
  chemically treated genomic DNA (Homo sapiens) CpG-island No: 11604
cgaacccttccgtactaaaccgcctacaaaacgcgaccgtaatacgacctaacttcctaaacacgacaaaaaaaaaaacgctaaaccgaaaactaaaacccgaactacgccgccgccgctacgaatacgatcactaaaacgcgataaaaccgacaacgccgaaaacgaaaaacgaaaactcgtcgaaaacgcgacctaaaaacgtaaaacatcaaataaaacgaaaacacgctaaaaacgatacctaaaacgaaaatttaaaacgaaaacaaaaaaaacgaacgccgaaaccgaacaaaaccacactaaaaacgattacaataccgtttaacgtaaaaacgaaactacgatactaaaattataaaaccaaaaaaatcgaacgcaaaaataaaacgaaaccacgctaaaacgaaaacaaaaaaaacaacgcaaaaataaaacgaaaacactctaaaaacgaaacaaaaaacgaacgtaaaaacgaaacgtaaccacgctaaaaacgaaaacaataaaaaccaatactaaaataaaacgtaaccacgcttaaaaacgattacaacgcaatcgaacgtaaaaataaaaccaaaaaatcgaatataaaattaaaatacgattacgctactaacaattacaatacaaaaaaacgtaacgactaaaattaaaacgtaatcaaatcgtcgaacgcataaataaaacgaaaccaaacttaaaacgaaatccgtaaaatcaaacgccgaaataaattaaaaccatactataaaaaaaacgaaaaaatcgaaatttaaaaaaaacaaaaccacgctaaaaacgaaaataaaaaaaacacatacta

SEQ ID NO: 11605 - DNA, 565 bp, Artificial Sequence
  chemically treated genomic DNA (Homo sapiens) CpG-island No: 11605
taggtcgttggaaattatttttttatttttcgttagattagagcgtaatgcggtgatttttcgatgtttggaaaatagtaacggtgttcggtatacggatattgtttattttttagtttttcgtgtaagaattttataggtttgtttcgacgaggcgggcgataatttggttgcgtttcgttatgtagttgagtagtaatagttgtcgtaagtggtttggttggcggaatatttggcggtataattggaagttatcgcgcgtgaagttttcgtttggttattgcgcgagtgggatagtgtattatcgaaaattgttcgttggtagcgtaaacgtatttagtattaggattttgagcggcggttacgtgagatggttgtcgaacgtagagttcgtttggcgcgggtgatcgatttcgtggaatagtaaacgttgtatcgtgaagtggaagtttatgaagcgcgtttggtacgttgtcgttatgcgttggaaaaaatcgaaaataggttagcgcgtttaattcgttagtaatggagagaatatgttattggaaaatgtttttgacga

SEQ ID NO: 11606 - DNA, 565 bp, Artificial Sequence
  chemically treated genomic DNA (Homo sapiens) CpG-island No: 11606
tcgtcaaaaacattttccaataacatattctctccattactaacgaattaaacgcgctaacctattttcgattttttccaacgcataacgacaacgtaccaaacgcgcttcataaacttccacttcacgatacaacgtttactattccacgaaatcgatcacccgcgccaaacgaactctacgttcgacaaccatctcacgtaaccgccgctcaaaatcctaatactaaatacgtttacgctaccaacgaacaattttcgataatacactatcccactcgcgcaataaccaaacgaaaacttcacgcgcgataacttccaattataccgccaaatattccgccaaccaaaccacttacgacaactattactactcaactacataacgaaacgcaaccaaattatcgcccgcctcgtcgaaacaaacctataaaattcttacacgaaaaactaaaaaataaacaatatccgtataccgaacaccgttactattttccaaacatcgaaaaatcaccgcattacgctctaatctaacgaaaaataaaaaaataatttccaacgaccta

SEQ ID NO: 11607 - DNA, 565 bp, Artificial Sequence
  chemically treated genomic DNA (Homo sapiens) CpG-island No: 11607
tcgttaggggtattttttagtgatatattttttttattgttagcgggttaaacgcgttaatttgttttcgattttttttagcgtatggcggtagcgtgttaggcgcgttttataggtttttattttacgatgtagcgtttgttgttttacgagatcggttattcgcgttagacgggttttgcgttcggtaattattttacgtagtcgtcgtttaaaattttgatgttgaatacgtttacgttgttagcgggtaattttcggtggtgtattgttttattcgcgtaatgattaggcggaggttttacgcgcgatggtttttagttgtgtcgttagatgtttcgttagttaggttatttgcggtagttgttgttgtttaattgtatgacgaagcgtagttagattatcgttcgtttcgtcgagataagtttgtagggtttttgtacgaggagttaaaaaataggtagtattcgtgtatcgaatatcgttgttgttttttaggtatcgaagggttatcgtattacgttttggtttggcggaaggtgaaaaggtggtttttagcggtttg

SEQ ID NO: 11608 - DNA, 565 bp, Artificial Sequence
  chemically treated genomic DNA (Homo sapiens) CpG-island No: 11608
caaaccgctaaaaaccaccttttcaccttccgccaaaccaaaacgtaatacgataacccttcgatacctaaaaaacaacaacgatattcgatacacgaatactacctattttttaactcctcgtacaaaaaccctacaaacttatctcgacgaaacgaacgataatctaactacgcttcgtcatacaattaaacaacaacaactaccgcaaataacctaactaacgaaacatctaacgacacaactaaaaaccatcgcgcgtaaaacctccgcctaatcattacgcgaataaaacaatacaccaccgaaaattacccgctaacaacgtaaacgtattcaacatcaaaattttaaacgacgactacgtaaaataattaccgaacgcaaaacccgtctaacgcgaataaccgatctcgtaaaacaacaaacgctacatcgtaaaataaaaacctataaaacgcgcctaacacgctaccgccatacgctaaaaaaaatcgaaaacaaattaacgcgtttaacccgctaacaataaaaaaaatatatcactaaaaaatacccctaacga

SEQ ID NO: 11609 - DNA, 582 bp, Artificial Sequence
  chemically treated genomic DNA (Homo sapiens) CpG-island No: 11609
tggtcgtaatatggcgggtgttcgtgcgttgtggcgcgttatcggaatgatcgacgtcgatttcggtaagtcgattatcgcggttgtgaattcgtttatttaatttgtatcgggttacgtttatttgcgcgatttcggtaaattggtcgtcgaataaattgaagcggttggcggcgttgttaaagagtttaatattattgcggtggatgatgggattgttatgggttacggggggatgttttatttattgttatttcgcgaattgatcgttgatttcgttgagtatatggttaacgtttattgcgtcgacgttatggtttgtatttttaattgcgataaaattatttcggggatgttgatggtttttttgcgtttgaatatttcggtgatttttgttttcggcggttcgatggatgtcgggaaaattaaatttttcgattagattattaagttcgatttggttgatgcgatgatttagggcgtagattcgaaagtatttgatttttagagcgattaggttgaacgtttcgcgtgttcgatttgcgttttagaaacgattaattaaattggaaagcgtaaagt

SEQ ID NO: 11610 - DNA, 582 bp, Artificial Sequence
  chemically treated genomic DNA (Homo sapiens) CpG-island No: 11610
actttacgctttccaatttaattaatcgtttctaaaacgcaaatcgaacacgcgaaacgttcaacctaatcgctctaaaaatcaaatactttcgaatctacgccctaaatcatcgcatcaaccaaatcgaacttaataatctaatcgaaaaatttaattttcccgacatccatcgaaccgccgaaaacaaaaatcaccgaaatattcaaacgcaaaaaaaccatcaacatccccgaaataattttatcgcaattaaaaatacaaaccataacgtcgacgcaataaacgttaaccatatactcaacgaaatcaacgatcaattcgcgaaataacaataaataaaacatccccccgtaacccataacaatcccatcatccaccgcaataatattaaactctttaacaacgccgccaaccgcttcaatttattcgacgaccaatttaccgaaatcgcgcaaataaacgtaacccgatacaaattaaataaacgaattcacaaccgcgataatcgacttaccgaaatcgacgtcgatcattccgataacgcgccacaacgcacgaacacccgccatattacgacca

SEQ ID NO: 11611 - DNA, 582 bp, Artificial Sequence
  chemically treated genomic DNA (Homo sapiens) CpG-island No: 11611
gttttgcgttttttaatttaattggtcgtttttaaagcgtaggtcggatacgcggaacgtttaatttgatcgttttgggagttagatattttcgggtttgcgttttggattatcgtattaattagatcgagtttgatgatttgatcggaaagtttggttttttcggtatttatcgggtcgtcggaaataaagattatcggaatatttaggcgtagggaagttattagtattttcggggtgattttgtcgtagttagagatgtagattatggcgtcggcgtagtgggcgttgattatatatttaacggaattagcgattagttcgcgagatggtagtgaataaagtattttttcgtggtttatggtaattttattatttatcgtaatggtgttgaattttttggtaacgtcgttagtcgttttaatttgttcggcgattagtttatcgagatcgcgtagatggacgtgattcggtataaattgggtgaacgagtttataatcgcgataatcggtttatcgaaatcggcgtcggttatttcggtggcgcgttatagcgtacgagtattcgttatattacgatta

SEQ ID NO: 11612 - DNA, 582 bp, Artificial Sequence
  chemically treated genomic DNA (Homo sapiens) CpG-island No: 11612
taatcgtaatataacgaatactcgtacgctataacgcgccaccgaaataaccgacgccgatttcgataaaccgattatcgcgattataaactcgttcacccaatttataccgaatcacgtccatctacgcgatctcgataaactaatcgccgaacaaattaaaacgactaacgacgttaccaaaaaattcaacaccattacgataaataataaaattaccataaaccacgaaaaaatactttattcactaccatctcgcgaactaatcgctaattccgttaaatatataatcaacgcccactacgccgacgccataatctacatctctaactacgacaaaatcaccccgaaaatactaataacttccctacgcctaaatattccgataatctttatttccgacgacccgataaataccgaaaaaaccaaactttccgatcaaatcatcaaactcgatctaattaatacgataatccaaaacgcaaacccgaaaatatctaactcccaaaacgatcaaattaaacgttccgcgtatccgacctacgctttaaaaacgaccaattaaattaaaaaacgcaaaac

SEQ ID NO: 11613 - DNA, 628 bp, Artificial Sequence
  chemically treated genomic DNA (Homo sapiens) CpG-island No: 11613
cgttgtcgcgaatgtcgtcggaataatggcgaagtatttcgtatatcgttggtaatgttgaaggtggttagcgagttacgggttattagtatttgtttgttaatgtgtattatttcgattaatttggtcgggttagagtcgagatcgattatattgttcgtttttttcgtcgtttgggtgtcggagtttatcgttatcgtattgatggattacggtgaagtagtgtagtagggtaattcgttgacgatgttgattcgttcggcgaatgattttgttcgttagttttttggacgtagtgaattgggtgtgcgtttgttttcgttacgtagtgtggcggattacgtgcgtcgcgaagaacgagtagatggtgaggtattggtagaagagatgacgttacggtatgcgcgtttttttgttttgttgcgcggggatgcgaggtgttgtcggtggtgaatatgtagggttagttttgtagtacgttgtatttttaggatttgttggtggaggcgtaacgtatgaagatgttgcgcgattcgttgttttggtttattgttttgtttgtggcgttgattttttggttgttttatagttagtcgttgtttgttgttttgtttttataattgttacg

SEQ ID NO: 11614 - DNA, 628 bp, Artificial Sequence
  chemically treated genomic DNA (Homo sapiens) CpG-island No: 11614
cgtaacaattataaaaacaaaacaacaaacaacgactaactataaaacaaccaaaaaatcaacgccacaaacaaaacaataaaccaaaacaacgaatcgcgcaacatcttcatacgttacgcctccaccaacaaatcctaaaaatacaacgtactacaaaactaaccctacatattcaccaccgacaacacctcgcatccccgcgcaacaaaacaaaaaaacgcgcataccgtaacgtcatctcttctaccaatacctcaccatctactcgttcttcgcgacgcacgtaatccgccacactacgtaacgaaaacaaacgcacacccaattcactacgtccaaaaaactaacgaacaaaatcattcgccgaacgaatcaacatcgtcaacgaattaccctactacactacttcaccgtaatccatcaatacgataacgataaactccgacacccaaacgacgaaaaaaacgaacaatataatcgatctcgactctaacccgaccaaattaatcgaaataatacacattaacaaacaaatactaataacccgtaactcgctaaccaccttcaacattaccaacgatatacgaaatacttcgccattattccgacgacattcgcgacaacg

SEQ ID NO: 11615 - DNA, 628 bp, Artificial Sequence
  chemically treated genomic DNA (Homo sapiens) CpG-island No: 11615
cgtggtagttgtgggaataaggtagtaaatagcggttggttgtaaggtagttagaaaattagcgttataaatagagtaatgagttagaatagcggatcgcgtaatatttttatacgttacgtttttattagtagattttgaaaatgtagcgtgttgtaaggttggttttgtatgtttattatcggtagtatttcgtattttcgcgtaataagatagagagacgcgtatgtcgtagcgttattttttttgttagtgttttattatttgttcgtttttcgcgacgtacgtaattcgttatattacgtaacgaaagtaggcgtatatttagtttattacgtttaaaaaattggcggataaaattattcgtcggacgagttagtatcgttagcggattgttttgttgtattattttatcgtgatttattaatacggtggcgatgaatttcggtatttaggcggcgaaagaggcgggtaatatggtcgatttcgattttaattcgattaagttgatcgaggtggtgtatattggtaaatagatgttgatgattcgtggttcgttgattatttttagtattgttaacgatgtgcgaaatatttcgttattatttcggcggtattcgcggtaacg

SEQ ID NO: 11616 - DNA, 628 bp, Artificial Sequence
  chemically treated genomic DNA (Homo sapiens) CpG-island No: 11616
cgttaccgcgaataccgccgaaataataacgaaatatttcgcacatcgttaacaatactaaaaataatcaacgaaccacgaatcatcaacatctatttaccaatatacaccacctcgatcaacttaatcgaattaaaatcgaaatcgaccatattacccgcctctttcgccgcctaaataccgaaattcatcgccaccgtattaataaatcacgataaaataatacaacaaaacaatccgctaacgatactaactcgtccgacgaataattttatccgccaattttttaaacgtaataaactaaatatacgcctactttcgttacgtaatataacgaattacgtacgtcgcgaaaaacgaacaaataataaaacactaacaaaaaaaataacgctacgacatacgcgtctctctatcttattacgcgaaaatacgaaatactaccgataataaacatacaaaaccaaccttacaacacgctacattttcaaaatctactaataaaaacgtaacgtataaaaatattacgcgatccgctattctaactcattactctatttataacgctaattttctaactaccttacaaccaaccgctatttactaccttattcccacaactaccacg

SEQ ID NO: 11617 - DNA, 551 bp, Artificial Sequence
  chemically treated genomic DNA (Homo sapiens) CpG-island No: 11617
gatcggatgatcgtagattacgtcggtgttatggttgatattattcgttagtacggcgtagacgtttggtgttgttgttaaatattcgtcgcggtaaattattggcggtaaaattgggttatcgttttaaagcggcggtgtttaacgatgttagtatcgttagcgtataggacggtaaagcgatagtgaaatatatggtttacggtggtttggcgattggcgaagaacgtattgttacgtcgtatgcggtattgattattagtagcggtacgttcgatgcggtttagtagacgcgttacgtattggcgaaacgtatatcgtggagtggtaggtttcggttgtggcgattattcgtacggtaatttaggcgcgtagagtaatagcgtcgatttcgataaagttcgtttggtggttagcgtcggtcgcgttattggtagtaagagaatattgcgttggtagaatagtttttgtagcgataggtgcgagttggtttgttttcgttcgttgtcgaaaacgaatatggatgaatacgaagttatgtcgtattttaa

SEQ ID NO: 11618 - DNA, 551 bp, Artificial Sequence
  chemically treated genomic DNA (Homo sapiens) CpG-island No: 11618
ttaaaatacgacataacttcgtattcatccatattcgttttcgacaacgaacgaaaacaaaccaactcgcacctatcgctacaaaaactattctaccaacgcaatattctcttactaccaataacgcgaccgacgctaaccaccaaacgaactttatcgaaatcgacgctattactctacgcgcctaaattaccgtacgaataatcgccacaaccgaaacctaccactccacgatatacgtttcgccaatacgtaacgcgtctactaaaccgcatcgaacgtaccgctactaataatcaataccgcatacgacgtaacaatacgttcttcgccaatcgccaaaccaccgtaaaccatatatttcactatcgctttaccgtcctatacgctaacgatactaacatcgttaaacaccgccgctttaaaacgataacccaattttaccgccaataatttaccgcgacgaatatttaacaacaacaccaaacgtctacgccgtactaacgaataatatcaaccataacaccgacgtaatctacgatcatccgatc

SEQ ID NO: 11619 - DNA, 551 bp, Artificial Sequence
  chemically treated genomic DNA (Homo sapiens) CpG-island No: 11619
ttgagatacgatatagtttcgtgtttatttatgttcgttttcggtaacggacgagaataggttaattcgtatttatcgttgtaaaagttgttttgttagcgtaatgtttttttgttgttaataacgcgatcgacgttgattattagacgggttttgtcgagatcgacgttgttgttttgcgcgtttgggttgtcgtgcgggtaatcgttatagtcggagtttgttattttacggtgtgcgtttcgttagtgcgtgacgcgtttgttgagtcgtatcgaacgtgtcgttgttgatggttagtatcgtatacggcgtggtaatgcgtttttcgttaatcgttagattatcgtaaattatgtgttttattgtcgttttatcgttttgtacgttgacggtgttggtatcgttagatatcgtcgttttaaggcgataatttagttttgtcgttagtaatttgtcgcgacgggtgtttggtagtagtattaggcgtttgcgtcgtgttggcgaatagtgttagttatgatatcggcgtaatttacgattattcgatt

SEQ ID NO: 11620 - DNA, 551 bp, Artificial Sequence
  chemically treated genomic DNA (Homo sapiens) CpG-island No: 11620
aatcgaataatcgtaaattacgccgatatcataactaacactattcgccaacacgacgcaaacgcctaatactactaccaaacacccgtcgcgacaaattactaacgacaaaactaaattatcgccttaaaacgacgatatctaacgataccaacaccgtcaacgtacaaaacgataaaacgacaataaaacacataatttacgataatctaacgattaacgaaaaacgcattaccacgccgtatacgatactaaccatcaacaacgacacgttcgatacgactcaacaaacgcgtcacgcactaacgaaacgcacaccgtaaaataacaaactccgactataacgattacccgcacgacaacccaaacgcgcaaaacaacaacgtcgatctcgacaaaacccgtctaataatcaacgtcgatcgcgttattaacaacaaaaaaacattacgctaacaaaacaacttttacaacgataaatacgaattaacctattctcgtccgttaccgaaaacgaacataaataaacacgaaactatatcgtatctcaa

SEQ ID NO: 11621 - DNA, 547 bp, Artificial Sequence
  chemically treated genomic DNA (Homo sapiens) CpG-island No: 11621
gaggtggttggcgtgtcgtttagcgagtttagcgttattattatcgcgtcgttgtttgcgtttagtttcgttttgtacggcggtatataattattaaataggcgttgcggatttatatcgacggtgttgtattttttatcgttttttatcgcgtcgtatgcggtaaagtgtttgacgttggttattatcgagtagcgatttgtcgggtttttattttgtatcgtttttattatggttttatttattgttgaggtgagatacgtattttcgttaaaattttcggaagtacgtttttagcgcggatcgcgcgagatatcgattatcggtgtttaggttatatttaggttattatttgtcgttttataagtagagatacgttcgatcgtttttattgtatcgaggttaaaagacgaggttagatcgaggttaatcgggaatatcgtgcgttgatcgtgtagtacgtcgtaagtaaagaaaagaggaatttttaggcggtttaattttattatttgattttgtatggcgcggataatttgacgggttacgg

SEQ ID NO: 11622 - DNA, 547 bp, Artificial Sequence
  chemically treated genomic DNA (Homo sapiens) CpG-island No: 11622
ccgtaacccgtcaaattatccgcgccatacaaaatcaaataataaaattaaaccgcctaaaaattcctcttttctttacttacgacgtactacacgatcaacgcacgatattcccgattaacctcgatctaacctcgtcttttaacctcgatacaataaaaacgatcgaacgtatctctacttataaaacgacaaataataacctaaatataacctaaacaccgataatcgatatctcgcgcgatccgcgctaaaaacgtacttccgaaaattttaacgaaaatacgtatctcacctcaacaataaataaaaccataataaaaacgatacaaaataaaaacccgacaaatcgctactcgataataaccaacgtcaaacactttaccgcatacgacgcgataaaaaacgataaaaaatacaacaccgtcgatataaatccgcaacgcctatttaataattatataccgccgtacaaaacgaaactaaacgcaaacaacgacgcgataataataacgctaaactcgctaaacgacacgccaaccacctc

SEQ ID NO: 11623 - DNA, 547 bp, Artificial Sequence
  chemically treated genomic DNA (Homo sapiens) CpG-island No: 11623
tcgtaattcgttagattattcgcgttatgtaggattaggtgatggaattaagtcgtttgaaaattttttttttttttgtttacgacgtgttgtacggttagcgtacggtgttttcgattagtttcggtttggtttcgttttttaatttcgatgtagtgaaaacggtcggacgtgtttttgtttatgaagcggtagatgatggtttgaatatgatttgggtatcgatggtcgatgtttcgcgcgattcgcgttggggacgtgttttcgaaggttttggcgaagatacgtattttattttaataatgggtaaaattatggtggaagcgatgtagggtaaaagttcggtagatcgttattcggtgatgattagcgttaaatattttgtcgtatacggcgcggtagaaggcggtaaagagtataatatcgtcgatatgagttcgtagcgtttgtttaatgattatatgtcgtcgtataaagcggggttggacgtaggtagcggcgcggtgatggtggcgttgaattcgttgaacggtacgttagttatttt

SEQ ID NO: 11624 - DNA, 547 bp, Artificial Sequence
  chemically treated genomic DNA (Homo sapiens) CpG-island No: 11624
aaaataactaacgtaccgttcaacgaattcaacgccaccatcaccgcgccgctacctacgtccaaccccgctttatacgacgacatataatcattaaacaaacgctacgaactcatatcgacgatattatactctttaccgccttctaccgcgccgtatacgacaaaatatttaacgctaatcatcaccgaataacgatctaccgaacttttaccctacatcgcttccaccataattttacccattattaaaataaaatacgtatcttcgccaaaaccttcgaaaacacgtccccaacgcgaatcgcgcgaaacatcgaccatcgatacccaaatcatattcaaaccatcatctaccgcttcataaacaaaaacacgtccgaccgttttcactacatcgaaattaaaaaacgaaaccaaaccgaaactaatcgaaaacaccgtacgctaaccgtacaacacgtcgtaaacaaaaaaaaaaaaaattttcaaacgacttaattccatcacctaatcctacataacgcgaataatctaacgaattacga

SEQ ID NO: 11625 - DNA, 641 bp, Artificial Sequence
  chemically treated genomic DNA (Homo sapiens) CpG-island No: 11625
gaagcgaaggggttttttcgagtagcggcgggggtattcggcgtgcgcgtcgagttgtggttggatggcgcgttgttggtacgtacggcgtttcgggtcggtttaggttagtttttttgggtcgagcgtttttatttcgaggcgttgttatcggtacgtcgtttgtcgttgcggttgcgcggtttgggttcgggaagcgcggtgttgggtcgcgtggttttggcgttggaggagttggacgttttacgcgcgtttgtcgtcggtttggagcgttggttttcgttgttcggggcgtcggcgggcgtagcgttgcgggcgcggattcgggcgcgtcgtttgcgcgtgttgtcgttcgagcgttataaggagttggcggagttttttattttttattatgcgcgtttttgcggggttttggagttcgcgttgtttgcgtaggttaaggaggagttggcggtagttatggtgcgcgtgttgcgggttatcggtcgggcgtaggtgcggtatcgcgatagcgcggatcggggttattaggggtagatcgataacgcgtttcgggtaggagttggggcgtaggatttgagttgtatttgtaatgggggagatattttgaaggggtgtgaggggcgtggtttaagtgt

SEQ ID NO: 11626 - DNA, 641 bp, Artificial Sequence
  chemically treated genomic DNA (Homo sapiens) CpG-island No: 11626
acacttaaaccacgcccctcacaccccttcaaaatatctcccccattacaaatacaactcaaatcctacgccccaactcctacccgaaacgcgttatcgatctacccctaataaccccgatccgcgctatcgcgataccgcacctacgcccgaccgataacccgcaacacgcgcaccataactaccgccaactcctccttaacctacgcaaacaacgcgaactccaaaaccccgcaaaaacgcgcataataaaaaataaaaaactccgccaactccttataacgctcgaacgacaacacgcgcaaacgacgcgcccgaatccgcgcccgcaacgctacgcccgccgacgccccgaacaacgaaaaccaacgctccaaaccgacgacaaacgcgcgtaaaacgtccaactcctccaacgccaaaaccacgcgacccaacaccgcgcttcccgaacccaaaccgcgcaaccgcaacgacaaacgacgtaccgataacaacgcctcgaaataaaaacgctcgacccaaaaaaactaacctaaaccgacccgaaacgccgtacgtaccaacaacgcgccatccaaccacaactcgacgcgcacgccgaatacccccgccgctactcgaaaaaaccccttcgcttc

SEQ ID NO: 11627 - DNA, 641 bp, Artificial Sequence
  chemically treated genomic DNA (Homo sapiens) CpG-island No: 11627
atatttggattacgttttttatatttttttaaggtgttttttttattataggtgtaatttaggttttgcgttttaatttttgttcgaagcgcgttatcggtttatttttggtagtttcggttcgcgttgtcgcggtgtcgtatttgcgttcggtcggtggttcgtagtacgcgtattatggttgtcgttagtttttttttggtttgcgtaggtagcgcgggttttagggtttcgtagaggcgcgtatagtggaaggtgaggaatttcgttagttttttgtagcgttcggacggtagtacgcgtaggcgacgcgttcgaattcgcgttcgtagcgttgcgttcgtcggcgtttcgagtagcgggaattagcgttttagatcggcggtaggcgcgcgtggggcgtttagtttttttagcgttagggttacgcggtttagtatcgcgtttttcgggtttaagtcgcgtagtcgtagcgataggcgacgtgtcggtggtagcgtttcgaagtggaagcgttcggtttagaagagttggtttgggtcggttcgaggcgtcgtgcgtgttagtagcgcgttatttagttatagttcggcgcgtacgtcgggtgttttcgtcgttgttcggggaagttttttcgtttt

SEQ ID NO: 11628 - DNA, 641 bp, Artificial Sequence
  chemically treated genomic DNA (Homo sapiens) CpG-island No: 11628
aaaacgaaaaaacttccccgaacaacgacgaaaacacccgacgtacgcgccgaactataactaaataacgcgctactaacacgcacgacgcctcgaaccgacccaaaccaactcttctaaaccgaacgcttccacttcgaaacgctaccaccgacacgtcgcctatcgctacgactacgcgacttaaacccgaaaaacgcgatactaaaccgcgtaaccctaacgctaaaaaaactaaacgccccacgcgcgcctaccgccgatctaaaacgctaattcccgctactcgaaacgccgacgaacgcaacgctacgaacgcgaattcgaacgcgtcgcctacgcgtactaccgtccgaacgctacaaaaaactaacgaaattcctcaccttccactatacgcgcctctacgaaaccctaaaacccgcgctacctacgcaaaccaaaaaaaaactaacgacaaccataatacgcgtactacgaaccaccgaccgaacgcaaatacgacaccgcgacaacgcgaaccgaaactaccaaaaataaaccgataacgcgcttcgaacaaaaattaaaacgcaaaacctaaattacacctataataaaaaaaacaccttaaaaaaatataaaaaacgtaatccaaatat

SEQ ID NO: 11629 - DNA, 563 bp, Artificial Sequence
  chemically treated genomic DNA (Homo sapiens) CpG-island No: 11629
cgttatcggtgggcgtggaggtcgaggcgggtttcgtagtggtcgggatttttagggggcggattcggggtttttttcgtggtcggggtggtttattacgtttcgttttcgtgggtttgcggttacggcgtcgggggttatcgggttttgggttgggtgggtagaagtcgatgttttttagtggcgagagggtcggacgggagcggtagttggagattaggttaggtaagcgtcgggggttgaggcggatgtcggcgggaatatcggttttgttttcgttcgtttcgaattcgtatttttgggcgtatagttttttgggggtttggaagggtgggtcgcggcgtcgtagtaggtggaaggaggatgttttgagtagtttttttggtttggtagagtagaagatgggcgaggtgaggttatttttgggttcggaggtcggcgcgggaggcggcggtggcggaggcgggggtggtggcgtcgtttggtgggggttattttggattaggtttagcggttcggcgttgatcgtggagggtagtttaggcggtttgttggggtttagg

SEQ ID NO: 11630 - DNA, 563 bp, Artificial Sequence
  chemically treated genomic DNA (Homo sapiens) CpG-island No: 11630
cctaaaccccaacaaaccgcctaaactaccctccacgatcaacgccgaaccgctaaacctaatccaaaataacccccaccaaacgacgccaccacccccgcctccgccaccgccgcctcccgcgccgacctccgaacccaaaaataacctcacctcgcccatcttctactctaccaaaccaaaaaaactactcaaaacatcctccttccacctactacgacgccgcgacccacccttccaaacccccaaaaaactatacgcccaaaaatacgaattcgaaacgaacgaaaacaaaaccgatattcccgccgacatccgcctcaacccccgacgcttacctaacctaatctccaactaccgctcccgtccgaccctctcgccactaaaaaacatcgacttctacccacccaacccaaaacccgataacccccgacgccgtaaccgcaaacccacgaaaacgaaacgtaataaaccaccccgaccacgaaaaaaaccccgaatccgccccctaaaaatcccgaccactacgaaacccgcctcgacctccacgcccaccgataacg

SEQ ID NO: 11631 - DNA, 563 bp, Artificial Sequence
  chemically treated genomic DNA (Homo sapiens) CpG-island No: 11631
tttggattttaataaatcgtttgaattgttttttacggttaacgtcgagtcgttgggtttgatttagagtggtttttattaggcggcgttattattttcgttttcgttatcgtcgtttttcgcgtcggttttcgaatttaagggtggttttatttcgtttattttttgttttattaagttaaagaagttgtttaagatattttttttttatttgttgcggcgtcgcgatttatttttttagatttttaagaagttgtacgtttaggagtacgagttcgaggcggacgaggataaggtcgatgttttcgtcgatattcgttttaattttcggcgtttgtttgatttggtttttagttgtcgttttcgttcggttttttcgttattgggggatatcgatttttgtttatttaatttaggattcgatggttttcggcgtcgtggtcgtaagtttacgaaggcgaaacgtgatgggttatttcggttacgggggaggtttcggattcgttttttggaggtttcgattattgcggggttcgtttcggtttttacgtttatcgatggcg

SEQ ID NO: 11632 - DNA, 563 bp, Artificial Sequence
  chemically treated genomic DNA (Homo sapiens) CpG-island No: 11632
cgccatcgataaacgtaaaaaccgaaacgaaccccgcaataatcgaaacctccaaaaaacgaatccgaaacctcccccgtaaccgaaataacccatcacgtttcgccttcgtaaacttacgaccacgacgccgaaaaccatcgaatcctaaattaaataaacaaaaatcgatatcccccaataacgaaaaaaccgaacgaaaacgacaactaaaaaccaaatcaaacaaacgccgaaaattaaaacgaatatcgacgaaaacatcgaccttatcctcgtccgcctcgaactcgtactcctaaacgtacaacttcttaaaaatctaaaaaaataaatcgcgacgccgcaacaaataaaaaaaaaatatcttaaacaacttctttaacttaataaaacaaaaaataaacgaaataaaaccacccttaaattcgaaaaccgacgcgaaaaacgacgataacgaaaacgaaaataataacgccgcctaataaaaaccactctaaatcaaacccaacgactcgacgttaaccgtaaaaaacaattcaaacgatttattaaaatccaaa

SEQ ID NO: 11633 - DNA, 661 bp, Artificial Sequence
  chemically treated genomic DNA (Homo sapiens) CpG-island No: 11633
cgttttttacgttattttttgtttcgttatttttttcgcgcgcgcgtagggtattgtggggcgttatcgcgggttatcgcggtttcgtttattttattttttattttattagttgttttcgcgcgatagaggcggtgcgcggattacgtttttcggcgtgtatcgcgcggatttcgttttatgtgttttattggtttttgggaaatcgagtgcggttgttttttcgtcggtttttacgtcgtcgtgttcggtatttgaaatttcggtaagttcggcggcgttttagtttcgtttttttttttttttgtttacgaatttcgttttagttcgtttcgtttcgcgtcggggtcggagtcgtagttcgagcggcggggtaagatggcggcggtagttcgggtcgcggggttcgggtttattggggtgggcggggcggagttgggtcgttagttgtttcggggttttttttataagttacgggttttagagggtttttcggggcggtttcgggttcggtagttgcggcgaaatttggcgtcgagaggggggtttttttagggtttcgggacgtattcgtgggtttttgggggcgtttatggggcgttttcgagaggatttggggcgtttttgggtttagatcgagtttaaggtttgttttttatta

SEQ ID NO: 11634 - DNA, 661 bp, Artificial Sequence
  chemically treated genomic DNA (Homo sapiens) CpG-island No: 11634
taataaaaaacaaaccttaaactcgatctaaacccaaaaacgccccaaatcctctcgaaaacgccccataaacgcccccaaaaacccacgaatacgtcccgaaaccctaaaaaaacccccctctcgacgccaaatttcgccgcaactaccgaacccgaaaccgccccgaaaaaccctctaaaacccgtaacttataaaaaaaaccccgaaacaactaacgacccaactccgccccgcccaccccaataaacccgaaccccgcgacccgaactaccgccgccatcttaccccgccgctcgaactacgactccgaccccgacgcgaaacgaaacgaactaaaacgaaattcgtaaacaaaaaaaaaaaaaaacgaaactaaaacgccgccgaacttaccgaaatttcaaataccgaacacgacgacgtaaaaaccgacgaaaaaacaaccgcactcgatttcccaaaaaccaataaaacacataaaacgaaatccgcgcgatacacgccgaaaaacgtaatccgcgcaccgcctctatcgcgcgaaaacaactaataaaataaaaaataaaataaacgaaaccgcgataacccgcgataacgccccacaataccctacgcgcgcgcgaaaaaaataacgaaacaaaaaataacgtaaaaaacg

SEQ ID NO: 11635 - DNA, 661 bp, Artificial Sequence
  chemically treated genomic DNA (Homo sapiens) CpG-island No: 11635
tgatggagggtaggttttaggttcggtttaggtttagagacgttttaagttttttcggagacgttttatagacgtttttaggaatttacggatgcgtttcggggttttgagaaggtttttttttcggcgttaggtttcgtcgtagttgtcgggttcgagatcgtttcgagaagttttttaggattcgtggtttgtggggaggatttcgggataattagcgatttaatttcgtttcgtttattttaataggttcgagtttcgcggttcggattgtcgtcgttattttatttcgtcgttcgggttgcggtttcggtttcggcgcggggcggggcgggttggggcggggttcgtgagtaaaggaggagagaggcggagttaaagcgtcgtcgagtttgtcgggattttaagtatcgagtacggcgacgtgaaggtcggcgggaaggtaatcgtattcggttttttagaagttaatgggatatatggggcggggttcgcgcgatgtacgtcgggaggcgtagttcgcgtatcgtttttgtcgcgcggggatagttaatggggtgagaggtgaagtgggcggggtcgcggtagttcgcgatgacgttttatagtgttttgcgcgcgcgcggaaagggtggcggaataggaggtgacgtaagaggcg

SEQ ID NO: 11636 - DNA, 661 bp, Artificial Sequence
  chemically treated genomic DNA (Homo sapiens) CpG-island No: 11636
cgcctcttacgtcacctcctattccgccaccctttccgcgcgcgcgcaaaacactataaaacgtcatcgcgaactaccgcgaccccgcccacttcacctctcaccccattaactatccccgcgcgacaaaaacgatacgcgaactacgcctcccgacgtacatcgcgcgaaccccgccccatatatcccattaacttctaaaaaaccgaatacgattaccttcccgccgaccttcacgtcgccgtactcgatacttaaaatcccgacaaactcgacgacgctttaactccgcctctctcctcctttactcacgaaccccgccccaacccgccccgccccgcgccgaaaccgaaaccgcaacccgaacgacgaaataaaataacgacgacaatccgaaccgcgaaactcgaacctattaaaataaacgaaacgaaattaaatcgctaattatcccgaaatcctccccacaaaccacgaatcctaaaaaacttctcgaaacgatctcgaacccgacaactacgacgaaacctaacgccgaaaaaaaaaccttctcaaaaccccgaaacgcatccgtaaattcctaaaaacgtctataaaacgtctccgaaaaaacttaaaacgtctctaaacctaaaccgaacctaaaacctaccctccatca

SEQ ID NO: 11637 - DNA, 1449 bp, Artificial Sequence
  chemically treated genomic DNA (Homo sapiens) CpG-island No: 11637
agcgtttttcgacgagattttttttttcgggaagaggaggaggaggaggcggttttcgagcggcgtcgatttttttggttgtttttgtcgtttcgtttttcgtcgtttagtttttcggagtcgtataggatttttcgtttaggtgaggaggtcggagtaggagagggttttcgggggtcggatttgttaagtcggtttatcgtgatggttcgtttgatggcgaagaggtcgtggttcgtgaggttttggatggagggtggtacggtttttcggcggcggttgtcgcggttattatacgaggtggagttagagggcggcggggcgggcgtcggggttttttcgttgttatttttagatcgttttttatttcgggatcgcgatcgtttttttttttttttgttgtcgttatcgtttcggtgtttttcgcggtgtcgttcgcgtttcgaggacgacgatgaggaagtggtcgggggcggggaggcggagcgtcgtcgtcgtcgtcgtttttttcgggatcgcgatttgcggttgttttcgcggcggcggtcggtgttgcgcgagcggcggcgggtggagcgggagcgggagcgggagcgggagcggcggcgggcggacgacgaggcgtgggagtcgggtttgcggtttcgcgagcggtgttttttggagttttagggcgaggtcggggcgggcggcgttggttgggtgttcgacgaggacgaggcggtttttttggtttcgtcgttgcgtttgcgttttcgtttggattttttgcgcgtgggcggattagtagcggcggtcggggcgggcgcgggcgtcggggagggcgagcgttggcggtagcgttttcgtcgttgggttaggattttgcggcgtaggtttaggtcgttttagcgcgagtcggcggcgggcggcgcgggagtcggtttttttaggtttatttgtagggcgttttcgtcgttcgatttcgtatgtagggataagaagtcgtttttttcgggggttcgcggagcgggaggttgaggaaggggttgggtcgtgggggtggtcgaggcggtcggtgtaggtcgggcggttcggtcgtcggggcggaagagggatagcgttagtttgggtttttttttcggttggacgattttttttttttcgattttcgagtcgtcgggcggtagtaggggcggcgggagggcggttttattagcggttattatttttatcgagattttgttttttcgataagtttttgtttcggtttttattacgaagattcgtcggcgtatggttttattagttcgggtggagtttatttggggcggcgttttaggggcgggagtcggttgtgtgggttgcgcgttcgggcgggggttttcgttatttgggaagttttggtttaggttgttgttatcgtagatgttcgttagggttttcgagatgcggttgatgttttgggat

SEQ ID NO: 11638 - DNA, 1449 bp, Artificial Sequence
  chemically treated genomic DNA (Homo sapiens) CpG-island No: 11638
atcccaaaacatcaaccgcatctcgaaaaccctaacgaacatctacgataacaacaacctaaaccaaaacttcccaaataacgaaaacccccgcccgaacgcgcaacccacacaaccgactcccgcccctaaaacgccgccccaaataaactccacccgaactaataaaaccatacgccgacgaatcttcgtaataaaaaccgaaacaaaaacttatcgaaaaaacaaaatctcgataaaaataataaccgctaataaaaccgccctcccgccgcccctactaccgcccgacgactcgaaaatcgaaaaaaaaaaaatcgtccaaccgaaaaaaaaacccaaactaacgctatccctcttccgccccgacgaccgaaccgcccgacctacaccgaccgcctcgaccacccccacgacccaaccccttcctcaacctcccgctccgcgaacccccgaaaaaaacgacttcttatccctacatacgaaatcgaacgacgaaaacgccctacaaataaacctaaaaaaaccgactcccgcgccgcccgccgccgactcgcgctaaaacgacctaaacctacgccgcaaaatcctaacccaacgacgaaaacgctaccgccaacgctcgccctccccgacgcccgcgcccgccccgaccgccgctactaatccgcccacgcgcaaaaaatccaaacgaaaacgcaaacgcaacgacgaaaccaaaaaaaccgcctcgtcctcgtcgaacacccaaccaacgccgcccgccccgacctcgccctaaaactccaaaaaacaccgctcgcgaaaccgcaaacccgactcccacgcctcgtcgtccgcccgccgccgctcccgctcccgctcccgctcccgctccacccgccgccgctcgcgcaacaccgaccgccgccgcgaaaacaaccgcaaatcgcgatcccgaaaaaaacgacgacgacgacgacgctccgcctccccgcccccgaccacttcctcatcgtcgtcctcgaaacgcgaacgacaccgcgaaaaacaccgaaacgataacgacaacaaaaaaaaaaaaaaacgatcgcgatcccgaaataaaaaacgatctaaaaataacaacgaaaaaaccccgacgcccgccccgccgccctctaactccacctcgtataataaccgcgacaaccgccgccgaaaaaccgtaccaccctccatccaaaacctcacgaaccacgacctcttcgccatcaaacgaaccatcacgataaaccgacttaacaaatccgacccccgaaaaccctctcctactccgacctcctcacctaaacgaaaaatcctatacgactccgaaaaactaaacgacgaaaaacgaaacgacaaaaacaaccaaaaaaatcgacgccgctcgaaaaccgcctcctcctcctcctcttcccgaaaaaaaaaatctcgtcgaaaaacgct

SEQ ID NO: 11639 - DNA, 1449 bp, Artificial Sequence
  chemically treated genomic DNA (Homo sapiens) CpG-island No: 11639
gttttagagtattagtcgtatttcggagattttggcgggtatttacgatgataatagtttgagttaggattttttaggtgacgagagttttcgttcggacgcgtagtttatatagtcgattttcgtttttggaacgtcgttttaggtggattttattcgggttgatggagttatgcgtcggcgggttttcgtggtggggatcgaggtagaggtttgtcgggaaggtaaggtttcggtggaggtggtgatcgttggtggagtcgttttttcgtcgtttttgttgtcgttcggcgattcggagatcgaggaaggggagatcgtttagtcggaggaggagtttaggttggcgttgtttttttttcgtttcggcggtcgggtcgttcggtttatatcggtcgtttcggttatttttacggtttagttttttttttagtttttcgtttcgcgggttttcgagggggacgattttttgtttttgtatgcggagtcggacggcgagggcgttttgtaggtggatttaggggagtcggttttcgcgtcgttcgtcgtcgattcgcgttggggcggtttggatttgcgtcgtaagattttgatttaacggcgggagcgttatcgttagcgttcgtttttttcggcgttcgcgttcgtttcggtcgtcgttgttggttcgtttacgcgtaagaagtttaggcgggaacgtaagcgtagcggcgaggttaaggaggtcgtttcgttttcgtcgggtatttagttagcgtcgttcgtttcggtttcgttttgggattttaagaagtatcgttcgcgggatcgtaagttcggtttttacgtttcgtcgttcgttcgtcgtcgttttcgttttcgttttcgttttcgttttattcgtcgtcgttcgcgtagtatcgatcgtcgtcgcgggggtagtcgtaggtcgcggtttcgggagaagcggcgacggcggcggcgtttcgttttttcgttttcggttatttttttatcgtcgttttcgaggcgcgagcggtatcgcgggaaatatcgggacggtggcggtagtaagaagaagaagaagcggtcgcggtttcggggtgagaagcggtttggggatggtagcgagaaggtttcggcgttcgtttcgtcgttttttggttttatttcgtgtggtgatcgcgatagtcgtcgtcggggggtcgtgttattttttatttaggattttacggattacgattttttcgttattaagcggattattacggtgggtcggtttgataagttcgattttcgaggatttttttttgtttcggtttttttatttaagcgggaggttttgtacgatttcgagggattgagcggcgaggagcggggcggtaagagtagttagaaggatcggcgtcgttcgggggtcgttttttttttttttttttttcgggagaaggggtttcgtcggaaggcgtt

SEQ ID NO: 11640 - DNA, 1449 bp, Artificial Sequence
  chemically treated genomic DNA (Homo sapiens) CpG-island No: 11640
aacgccttccgacgaaaccccttctcccgaaaaaaaaaaaaaaaaaaaacgacccccgaacgacgccgatccttctaactactcttaccgccccgctcctcgccgctcaatccctcgaaatcgtacaaaacctcccgcttaaataaaaaaaccgaaacaaaaaaaaatcctcgaaaatcgaacttatcaaaccgacccaccgtaataatccgcttaataacgaaaaaatcgtaatccgtaaaatcctaaataaaaaataacacgaccccccgacgacgactatcgcgatcaccacacgaaataaaaccaaaaaacgacgaaacgaacgccgaaaccttctcgctaccatccccaaaccgcttctcaccccgaaaccgcgaccgcttcttcttcttcttactaccgccaccgtcccgatatttcccgcgataccgctcgcgcctcgaaaacgacgataaaaaaataaccgaaaacgaaaaaacgaaacgccgccgccgtcgccgcttctcccgaaaccgcgacctacgactacccccgcgacgacgatcgatactacgcgaacgacgacgaataaaacgaaaacgaaaacgaaaacgaaaacgacgacgaacgaacgacgaaacgtaaaaaccgaacttacgatcccgcgaacgatacttcttaaaatcccaaaacgaaaccgaaacgaacgacgctaactaaatacccgacgaaaacgaaacgacctccttaacctcgccgctacgcttacgttcccgcctaaacttcttacgcgtaaacgaaccaacaacgacgaccgaaacgaacgcgaacgccgaaaaaaacgaacgctaacgataacgctcccgccgttaaatcaaaatcttacgacgcaaatccaaaccgccccaacgcgaatcgacgacgaacgacgcgaaaaccgactcccctaaatccacctacaaaacgccctcgccgtccgactccgcatacaaaaacaaaaaatcgtccccctcgaaaacccgcgaaacgaaaaactaaaaaaaaaactaaaccgtaaaaataaccgaaacgaccgatataaaccgaacgacccgaccgccgaaacgaaaaaaaaacaacgccaacctaaactcctcctccgactaaacgatctccccttcctcgatctccgaatcgccgaacgacaacaaaaacgacgaaaaaacgactccaccaacgatcaccacctccaccgaaaccttaccttcccgacaaacctctacctcgatccccaccacgaaaacccgccgacgcataactccatcaacccgaataaaatccacctaaaacgacgttccaaaaacgaaaatcgactatataaactacgcgtccgaacgaaaactctcgtcacctaaaaaatcctaactcaaactattatcatcgtaaatacccgccaaaatctccgaaatacgactaatactctaaaac

SEQ ID NO: 11641 - DNA, 941 bp, Artificial Sequence
  chemically treated genomic DNA (Homo sapiens) CpG-island No: 11641
cgtagtaaatatcgtacgtttttttgtttcgtttaattttttttttgtagtagggaattgtaggcgtcgttttatttattttagtcgagcggagtgatatttttttttttttttttttttattgattttcgtttttcgttcgttttatagtcgtttaatggagggttgaagtaggatagatttcgttaattcgcgacgtttgcggggtaggtttattcgtttattggttttagttaatttaagtttcgttttttaggatcgtttttcgtttttttttacgtttttttttttttttttggagagtcgttagatttaattagtgtttgatttggtcgcgcggagggggcgggtttatgatacgtaatcgaatttcgttcgtttttcgggtaacgtttttttttttttttttttagtttttaaacggaaatagcggaatattgggttaatcgtagcgtcgtgtttttgtttggcggttaatgagagaggaagtgggggagaaattcgtttgtgagcggtaggagtttaagttagtgggcggtttagagtttcggatcgcgggcggaggggaggggtagggggcggtgttacggtttgttagttcgttcgttcgttcgttagttagtttttttcgcggtcggttcggttttttggcgttgtttggggtttttttcgttcggttttcgtttgttagttttcgttgttttgtgttttgttcggttaggtttggagtcgatattatcgttattatgtcggtcgtgtttaagggcgatgggatgcgggggttcgcggtgtttattttcgatattcggaattgtgagcgcgcggtcgggggatattggagacgcgggggaggggggagcgtgaaattgaggggtttggggattatagagggattcgggggattaaaagtttttgcggtcgtatagggatagtatagatgg

SEQ ID NO: 11642 - DNA, 941 bp, Artificial Sequence
  chemically treated genomic DNA (Homo sapiens) CpG-island No: 11642
ccatctatactatccctatacgaccgcaaaaacttttaatcccccgaatccctctataatccccaaacccctcaatttcacgctcccccctcccccgcgtctccaatatcccccgaccgcgcgctcacaattccgaatatcgaaaataaacaccgcgaacccccgcatcccatcgcccttaaacacgaccgacataataacgataatatcgactccaaacctaaccgaacaaaacacaaaacaacgaaaactaacaaacgaaaaccgaacgaaaaaaaccccaaacaacgccaaaaaaccgaaccgaccgcgaaaaaaactaactaacgaacgaacgaacgaactaacaaaccgtaacaccgccccctacccctcccctccgcccgcgatccgaaactctaaaccgcccactaacttaaactcctaccgctcacaaacgaatttctcccccacttcctctctcattaaccgccaaacaaaaacacgacgctacgattaacccaatattccgctatttccgtttaaaaactaaaaaaaaaaaaaaaaaaacgttacccgaaaaacgaacgaaattcgattacgtatcataaacccgccccctccgcgcgaccaaatcaaacactaattaaatctaacgactctccaaaaaaaaaaaaaaaaacgtaaaaaaaaacgaaaaacgatcctaaaaaacgaaacttaaattaactaaaaccaataaacgaataaacctaccccgcaaacgtcgcgaattaacgaaatctatcctacttcaaccctccattaaacgactataaaacgaacgaaaaacgaaaatcaataaaaaaaaaaaaaaaaaaaaatatcactccgctcgactaaaataaataaaacgacgcctacaattccctactacaaaaaaaaaattaaacgaaacaaaaaaacgtacgatatttactacg

SEQ ID NO: 11643 - DNA, 941 bp, Artificial Sequence
  chemically treated genomic DNA (Homo sapiens) CpG-island No: 11643
ttatttatgttgtttttatacggtcgtagaggtttttgatttttcgggtttttttgtgatttttaaattttttaattttacgtttttttttttttcgcgtttttagtgtttttcggtcgcgcgtttatagtttcggatgtcggagatgaatatcgcgagttttcgtattttatcgtttttggatacggtcggtatgatggcggtggtgtcggttttaggtttggtcggatagggtatagagtagcgggggttggtaagcggggatcgggcggaaaggattttaggtagcgttaaggagtcgagtcggtcgcggggagggttggttggcgggcgggcgggcgggttggtaggtcgtggtatcgttttttgtttttttttttcgttcgcggttcggagttttgagtcgtttattggtttgagtttttgtcgtttataggcgggttttttttttatttttttttttattggtcgttaagtaaaggtacgacgttacgattggtttagtgtttcgttattttcgtttgggagttggggaggggggggaggaggcgttgttcgagagacgggcggggttcgattgcgtattatgggttcgtttttttcgcgcggttaggttaaatattgattggatttagcggttttttaaggaggaagggagggacgtgaaggaaggcggggaacggttttaggaggcgggatttaggttgattgggattaatgaacgggtagatttgtttcgtaggcgtcgcggattggcgagatttgttttattttagttttttattgggcggttgtggggcgggcggaaggcgaagattagtagagaaggaaagaggggagggtgttatttcgttcggttgggataggtggagcgacgtttgtaattttttgttgtagagaaggggttgggcgaggtaagagagcgtgcggtgtttattgcg

SEQ ID NO: 11644 - DNA, 941 bp, Artificial Sequence
  chemically treated genomic DNA (Homo sapiens) CpG-island No: 11644
cgcaataaacaccgcacgctctcttacctcgcccaaccccttctctacaacaaaaaattacaaacgtcgctccacctatcccaaccgaacgaaataacaccctcccctctttccttctctactaatcttcgccttccgcccgccccacaaccgcccaataaaaaactaaaataaaacaaatctcgccaatccgcgacgcctacgaaacaaatctacccgttcattaatcccaatcaacctaaatcccgcctcctaaaaccgttccccgccttccttcacgtccctcccttcctccttaaaaaaccgctaaatccaatcaatatttaacctaaccgcgcgaaaaaaacgaacccataatacgcaatcgaaccccgcccgtctctcgaacaacgcctcctcccccccctccccaactcccaaacgaaaataacgaaacactaaaccaatcgtaacgtcgtacctttacttaacgaccaataaaaaaaaaaataaaaaaaaaacccgcctataaacgacaaaaactcaaaccaataaacgactcaaaactccgaaccgcgaacgaaaaaaaaaaacaaaaaacgataccacgacctaccaacccgcccgcccgcccgccaaccaaccctccccgcgaccgactcgactccttaacgctacctaaaatcctttccgcccgatccccgcttaccaacccccgctactctataccctatccgaccaaacctaaaaccgacaccaccgccatcataccgaccgtatccaaaaacgataaaatacgaaaactcgcgatattcatctccgacatccgaaactataaacgcgcgaccgaaaaacactaaaaacgcgaaaaaaaaaaaaacgtaaaattaaaaaatttaaaaatcacaaaaaaacccgaaaaatcaaaaacctctacgaccgtataaaaacaacataaataa

SEQ ID NO: 11645 - DNA, 977 bp, Artificial Sequence
  chemically treated genomic DNA (Homo sapiens) CpG-island No: 11645
taattattcgtcgacgttcgtagttcgttgtttgggggtcgttttttgtagcgttaggttttcgcgcggattatagtttttagcgtatatttcggtcggggggttcgaggggtcgttttgttttagggataaggtttaggttgcgttcgcggtttcgggtagttatagttatgtacgtagtttttatttttcgcgttgttaatcgcgttcgttgtagtttaatttattttgggtcgcggtttttatagggtttgtgaggagcgttttttttcgtttcgggcgttcgttacgtcgcgttcgaaggaggggtcgaggtcgggtttattttttcgggaggattttttcggtttcgtggggtgttatgtttattgcggttcgaggttggtcgcggggttttgttggagggcgttgagagtcgggtttcgaggtcgtacggtcggagattataatttttaggaggtatcgcggcggcggcgtttatacgttattcgggtttcgtcggtggttcggggaagtagtacgggcggggggtaggggttggggtcgatcgggaggtcggtgttaaggatgggggtcgttcggttgtttcgcgcgtgaggaggtcgaggggcgcgttatttcggttcggggcggtcgttttaggggtttcgttattttcgttcggttcggtagtcgtggttcgggatgcggagtcgggggtcgtcggtggagttgcgcggggtgagcggcgcggggaacggggattgtttgtcgttttcgttttcgttttttatcggcggatttcggcgggtattcgagagtcgcgcggttaggtttttttagttttttgtcgtttggggggtacgggtgaatttgtcgttttatttttatttcgtttcgtttcgttcgtatagttaaatcggaagggacgagtttgttttttgaaagggtttttttttttgtttttgcggagggcgttttagttatggtttttagga

SEQ ID NO: 11646 - DNA, 977 bp, Artificial Sequence
  chemically treated genomic DNA (Homo sapiens) CpG-island No: 11646
tcctaaaaaccataactaaaacgccctccgcaaaaacaaaaaaaaaaaccctttcaaaaaacaaactcgtcccttccgatttaactatacgaacgaaacgaaacgaaataaaaataaaacgacaaattcacccgtaccccccaaacgacaaaaaactaaaaaaacctaaccgcgcgactctcgaatacccgccgaaatccgccgataaaaaacgaaaacgaaaacgacaaacaatccccgttccccgcgccgctcaccccgcgcaactccaccgacgacccccgactccgcatcccgaaccacgactaccgaaccgaacgaaaataacgaaacccctaaaacgaccgccccgaaccgaaataacgcgcccctcgacctcctcacgcgcgaaacaaccgaacgacccccatccttaacaccgacctcccgatcgaccccaacccctaccccccgcccgtactacttccccgaaccaccgacgaaacccgaataacgtataaacgccgccgccgcgatacctcctaaaaattataatctccgaccgtacgacctcgaaacccgactctcaacgccctccaacaaaaccccgcgaccaacctcgaaccgcaataaacataacaccccacgaaaccgaaaaaatcctcccgaaaaaataaacccgacctcgacccctccttcgaacgcgacgtaacgaacgcccgaaacgaaaaaaaacgctcctcacaaaccctataaaaaccgcgacccaaaataaattaaactacaacgaacgcgattaacaacgcgaaaaataaaaactacgtacataactataactacccgaaaccgcgaacgcaacctaaaccttatccctaaaacaaaacgacccctcgaaccccccgaccgaaatatacgctaaaaactataatccgcgcgaaaacctaacgctacaaaaaacgacccccaaacaacgaactacgaacgtcgacgaataatta

SEQ ID NO: 11647 - DNA, 977 bp, Artificial Sequence
  chemically treated genomic DNA (Homo sapiens) CpG-island No: 11647
ttttgagggttatggttggggcgtttttcgtaggagtaagaaaaaaaatttttttaaagggtaggttcgtttttttcgatttggttgtacgggcggggcggggcggggtgggagtggggcggtaggtttattcgtgttttttaaacggtagagggttaagagggtttggtcgcgcggttttcgaatgttcgtcggggttcgtcggtgggggacgagggcgagggcggtaggtagttttcgtttttcgcgtcgtttatttcgcgtagttttatcggcggttttcggtttcgtatttcgggttacgattgtcgggtcgggcgggggtggcggggtttttggggcggtcgtttcgggtcggggtggcgcgtttttcggtttttttacgcgcggggtagtcgggcggtttttatttttggtatcggtttttcggtcggttttagtttttgtttttcgttcgtgttgttttttcgggttatcggcggggttcgagtgacgtgtgggcgtcgtcgtcgcggtgttttttgggagttgtagttttcggtcgtgcggtttcggggttcggtttttagcgttttttagtagagtttcgcggttagtttcgggtcgtaatggatatgatattttacgaagtcgaaggagttttttcggggagatgagttcggtttcggtttttttttcggacgcggcgtagcgggcgttcggggcggggggaagcgttttttatagattttgtgggggtcgcggtttaggatgggttggattgtaacggacgcgattagtaacgcgaaaaataggagttgcgtgtatgattgtgattgttcggagtcgcgaacgtagtttggattttatttttgaggtaggacggtttttcggatttttcgatcgagatgtacgttgggaattgtagttcgcgcggggatttggcgttgtagggggcggtttttaaatagcgggttgcgggcgtcggcgggtggttg

SEQ ID NO: 11648 - DNA, 977 bp, Artificial Sequence
  chemically treated genomic DNA (Homo sapiens) CpG-island No: 11648
caaccacccgccgacgcccgcaacccgctatttaaaaaccgccccctacaacgccaaatccccgcgcgaactacaattcccaacgtacatctcgatcgaaaaatccgaaaaaccgtcctacctcaaaaataaaatccaaactacgttcgcgactccgaacaatcacaatcatacacgcaactcctatttttcgcgttactaatcgcgtccgttacaatccaacccatcctaaaccgcgacccccacaaaatctataaaaaacgcttccccccgccccgaacgcccgctacgccgcgtccgaaaaaaaaaccgaaaccgaactcatctccccgaaaaaactccttcgacttcgtaaaatatcatatccattacgacccgaaactaaccgcgaaactctactaaaaaacgctaaaaaccgaaccccgaaaccgcacgaccgaaaactacaactcccaaaaaacaccgcgacgacgacgcccacacgtcactcgaaccccgccgataacccgaaaaaacaacacgaacgaaaaacaaaaactaaaaccgaccgaaaaaccgataccaaaaataaaaaccgcccgactaccccgcgcgtaaaaaaaccgaaaaacgcgccaccccgacccgaaacgaccgccccaaaaaccccgccacccccgcccgacccgacaatcgtaacccgaaatacgaaaccgaaaaccgccgataaaactacgcgaaataaacgacgcgaaaaacgaaaactacctaccgccctcgccctcgtcccccaccgacgaaccccgacgaacattcgaaaaccgcgcgaccaaaccctcttaaccctctaccgtttaaaaaacacgaataaacctaccgccccactcccaccccgccccgccccgcccgtacaaccaaatcgaaaaaaacgaacctaccctttaaaaaaattttttttcttactcctacgaaaaacgccccaaccataaccctcaaaa

SEQ ID NO: 11649 - DNA, 529 bp, Artificial Sequence
  chemically treated genomic DNA (Homo sapiens) CpG-island No: 11649
tttggggcgatttttttgttttcgattcgtaaaaattgtttgacgggtagcgcgaattattgtaattaagaatgtcgtagatttgtcgtcggtattggttgaatcgtacgtaggttgggtaaatgcgttggaataagaatggttatatcgttacggtacgtattaatttttttgttgtgggcgatggtggcggtgatttatgtatcgttgatttcggtagtttttacgttgatatcgtttgttttgtcgttgatatattggtaggcgttatttgtcgatttatagttatcgtagtattattggtaacgttggtgtcgataattatcgcggcggtcggggtattgttgattgttttgttggtgattgtggcgttgtggtttgggcgaaatggtagcgtatgtgcgttcgtttgtcgtggttgttcgttattttttatgtggtttttgtattagcgtttagtattttttcggtatcgttaatttatttatagttatataggaaatagcgacggatatgttttacgtttagt

SEQ ID NO: 11650 - DNA, 529 bp, Artificial Sequence
  chemically treated genomic DNA (Homo sapiens) CpG-island No: 11650
actaaacgtaaaacatatccgtcgctatttcctatataactataaataaattaacgataccgaaaaaatactaaacgctaatacaaaaaccacataaaaaataacgaacaaccacgacaaacgaacgcacatacgctaccatttcgcccaaaccacaacgccacaatcaccaacaaaacaatcaacaataccccgaccgccgcgataattatcgacaccaacgttaccaataatactacgataactataaatcgacaaataacgcctaccaatatatcaacgacaaaacaaacgatatcaacgtaaaaactaccgaaatcaacgatacataaatcaccgccaccatcgcccacaacaaaaaaattaatacgtaccgtaacgatataaccattcttattccaacgcatttacccaacctacgtacgattcaaccaataccgacgacaaatctacgacattcttaattacaataattcgcgctacccgtcaaacaatttttacgaatcgaaaacaaaaaaatcgccccaaa

SEQ ID NO: 11651 - DNA, 529 bp, Artificial Sequence
  chemically treated genomic DNA (Homo sapiens) CpG-island No: 11651
gttaggcgtaaggtatgttcgtcgttgttttttatatgattatagatagattagcggtatcgagaagatgttgggcgttggtgtaaaagttatatggggaatggcgagtagttacggtagacgggcgtatatacgttgttatttcgtttaggttatagcgttataattattagtagggtaattaataatgtttcgatcgtcgcgatggttgtcgatattagcgttgttagtaatgttgcggtaattgtggatcggtaaataacgtttgttagtgtgttaacgataaagtaggcgatattagcgtgagagttgtcgggattagcggtgtataaattatcgttattatcgtttatagtaaaaagattaatgcgtatcgtaacggtgtagttatttttgttttagcgtatttatttaatttgcgtgcggtttagttagtatcggcggtagatttgcggtatttttgattgtaatgattcgcgttgttcgttaggtagtttttgcggatcgagaatagaaggatcgttttaga

SEQ ID NO: 11652 - DNA, 529 bp, Artificial Sequence
  chemically treated genomic DNA (Homo sapiens) CpG-island No: 11652
tctaaaacgatccttctattctcgatccgcaaaaactacctaacgaacaacgcgaatcattacaatcaaaaataccgcaaatctaccgccgatactaactaaaccgcacgcaaattaaataaatacgctaaaacaaaaataactacaccgttacgatacgcattaatctttttactataaacgataataacgataatttatacaccgctaatcccgacaactctcacgctaatatcgcctactttatcgttaacacactaacaaacgttatttaccgatccacaattaccgcaacattactaacaacgctaatatcgacaaccatcgcgacgatcgaaacattattaattaccctactaataattataacgctataacctaaacgaaataacaacgtatatacgcccgtctaccgtaactactcgccattccccatataacttttacaccaacgcccaacatcttctcgataccgctaatctatctataatcatataaaaaacaacgacgaacataccttacgcctaac

SEQ ID NO: 11653 - DNA, 598 bp, Artificial Sequence
  chemically treated genomic DNA (Homo sapiens) CpG-island No: 11653
gtcggaaatcgttttgttacggtatttgttaaaggtgaaggtcgttattaacgacggacgttcggtgatatcggttatttgttttgtcgtttagtcggaggtgtttataatatcgataagtaacgggtcggtgatattatagttatataacgcgcggtgatgatgtaggttcggcggcgtttgtatattgagttcgcgtgttttaaggtttaattggggtcggtattcggggattcgtagagtgttgtatttatcggatggtggacggtggcgacgttgtaattgattagttcgttatttttgtcgtcgtcgtaataggtattggaaaaattatttattattgtcggatcgtaagcgtttatggacgttacgttgtggtagtatttggtagttagtttgacgcgtattatgttggcgttatttgtagcggtgttgttcggtatttcggtcgggatcgcgatgggatttagttttacggtacgcggtattttggattcgataatcgagttttagcgttcggtgtcgtcgttgtttaagttgtcgttgatggtgatttggaatggtattggtgaaatttcgaggattttattgattataa

SEQ ID NO: 11654 - DNA, 598 bp, Artificial Sequence
  chemically treated genomic DNA (Homo sapiens) CpG-island No: 11654
ttataatcaataaaatcctcgaaatttcaccaataccattccaaatcaccatcaacgacaacttaaacaacgacgacaccgaacgctaaaactcgattatcgaatccaaaataccgcgtaccgtaaaactaaatcccatcgcgatcccgaccgaaataccgaacaacaccgctacaaataacgccaacataatacgcgtcaaactaactaccaaatactaccacaacgtaacgtccataaacgcttacgatccgacaataataaataatttttccaatacctattacgacgacgacaaaaataacgaactaatcaattacaacgtcgccaccgtccaccatccgataaatacaacactctacgaatccccgaataccgaccccaattaaaccttaaaacacgcgaactcaatatacaaacgccgccgaacctacatcatcaccgcgcgttatataactataatatcaccgacccgttacttatcgatattataaacacctccgactaaacgacaaaacaaataaccgatatcaccgaacgtccgtcgttaataacgaccttcacctttaacaaataccgtaacaaaacgatttccgac

SEQ ID NO: 11655 - DNA, 598 bp, Artificial Sequence
  chemically treated genomic DNA (Homo sapiens) CpG-island No: 11655
ttatgattagtaagattttcgaggttttattaatattattttagattattattagcggtaatttaagtagcggcggtatcggacgttaaagttcgattatcggatttagaatgtcgcgtatcgtagggttaagttttatcgcgatttcgatcggaatatcgaataatatcgttgtaaatagcgttagtataatgcgcgttagattggttgttagatgttgttatagcgtggcgtttataaacgtttgcggttcggtaatggtgagtagtttttttagtatttgttgcggcggcggtaaaaatagcgggttaattagttgtagcgtcgttatcgtttattattcggtgagtataatattttgcggattttcgggtatcggttttaattaggttttaaaatacgcgggtttaatgtatagacgtcgtcgggtttgtattattatcgcgcgttgtatgattgtaatattatcgattcgttgtttatcgatattatgaatattttcggttggacggtagaatagatggtcgatattatcggacgttcgtcgttgatgacgatttttatttttggtaaatatcgtggtaaagcggttttcgat

SEQ ID NO: 11656 - DNA, 598 bp, Artificial Sequence
  chemically treated genomic DNA (Homo sapiens) CpG-island No: 11656
atcgaaaaccgctttaccacgatatttaccaaaaataaaaatcgtcatcaacgacgaacgtccgataatatcgaccatctattctaccgtccaaccgaaaatattcataatatcgataaacaacgaatcgataatattacaatcatacaacgcgcgataataatacaaacccgacgacgtctatacattaaacccgcgtattttaaaacctaattaaaaccgatacccgaaaatccgcaaaatattatactcaccgaataataaacgataacgacgctacaactaattaacccgctatttttaccgccgccgcaacaaatactaaaaaaactactcaccattaccgaaccgcaaacgtttataaacgccacgctataacaacatctaacaaccaatctaacgcgcattatactaacgctatttacaacgatattattcgatattccgatcgaaatcgcgataaaacttaaccctacgatacgcgacattctaaatccgataatcgaactttaacgtccgataccgccgctacttaaattaccgctaataataatctaaaataatattaataaaacctcgaaaatcttactaatcataa

SEQ ID NO: 11657 - DNA, 709 bp, Artificial Sequence
  chemically treated genomic DNA (Homo sapiens) CpG-island No: 11657
tatttcgtttgtattcgtatttttcgttttttttgtttattaaattttttttcgttttattcgatttcggtttgtttgttttttattttttttttacgttttttttcgttgtttcgtaggcgtgcgcgttggattttatgttggacgattcggttatgttcgcgcggcgattgcgtaatttgggttagtcggtgacgttgcgcgtggtggaggatttgtcgtacggttttttgattttagcggcgttgtgtcgcgagacgcgttaggtcgtagagttgtgcgtggagcgtattcgtttcgtttttatttttttcgtcggagtcgggtcgagcggggagacgggggttgcgggggtagacgggggttgcggggggcgatattaaaagtttgttgtttttatttgcgtcggttttcgttatgaatgtttttcgggtcgggcggaaggggacgcgggttgtgttttatttaagtcgggggtggtaagggggcggggcgggggttcgaaagttgagattttcgttacggggagggggacgcgtatatatatcggttatcgagacggttggatttgtacgttatcgttgttttttgttgttgttgttgttgcggcgatcgtcgtagggacggggattggtttttttttgtaggtcggtttggtttgttgtaaataaaagtatttaattagtttggttttttttaaatacggtgg

SEQ ID NO: 11658 - DNA, 709 bp, Artificial Sequence
  chemically treated genomic DNA (Homo sapiens) CpG-island No: 11658
ccaccgtatttaaaaaaaaccaaactaattaaatacttttatttacaacaaaccaaaccgacctacaaaaaaaaaccaatccccgtccctacgacgatcgccgcaacaacaacaacaacaaaaaacaacgataacgtacaaatccaaccgtctcgataaccgatatatatacgcgtccccctccccgtaacgaaaatctcaactttcgaacccccgccccgcccccttaccacccccgacttaaataaaacacaacccgcgtccccttccgcccgacccgaaaaacattcataacgaaaaccgacgcaaataaaaacaacaaacttttaatatcgccccccgcaacccccgtctacccccgcaacccccgtctccccgctcgacccgactccgacgaaaaaaataaaaacgaaacgaatacgctccacgcacaactctacgacctaacgcgtctcgcgacacaacgccgctaaaatcaaaaaaccgtacgacaaatcctccaccacgcgcaacgtcaccgactaacccaaattacgcaatcgccgcgcgaacataaccgaatcgtccaacataaaatccaacgcgcacgcctacgaaacaacgaaaaaaaacgtaaaaaaaaaataaaaaacaaacaaaccgaaatcgaataaaacgaaaaaaaatttaataaacaaaaaaaacgaaaaatacgaatacaaacgaaata

SEQ ID NO: 11659 - DNA, 709 bp, Artificial Sequence
  chemically treated genomic DNA (Homo sapiens) CpG-island No: 11659
ttatcgtatttgagagaggttaaattaattaaatatttttatttataataaattaaatcgatttgtaagggagggttagttttcgtttttgcggcggtcgtcgtagtagtagtagtagtaaaaggtagcggtggcgtgtaggtttagtcgtttcggtgatcggtgtgtgtgcgcgttttttttttcgtggcgagggttttagttttcgggttttcgtttcgtttttttgttattttcgatttaagtaaggtatagttcgcgttttttttcgttcggttcggaaggtatttatgacggaggtcggcgtagatgggaataataggtttttagtgtcgtttttcgtagttttcgtttattttcgtagttttcgttttttcgttcggttcggtttcggcgggaggagtgaggacgaggcggatgcgttttacgtatagttttgcggtttggcgcgtttcgcggtatagcgtcgttagggttaggaagtcgtgcggtaggttttttattacgcgtagcgttatcggttggtttaggttgcgtagtcgtcgcgcgagtatgatcgagtcgtttagtatggggtttagcgcgtacgtttacgggatagcggggagggacgtggagagagggtgggggatagatagatcggggtcgggtagagcgaggaggggtttgatgaataaagggagcgggaaatacggatatagacggagtg

SEQ ID NO: 11660 - DNA, 709 bp, Artificial Sequence
  chemically treated genomic DNA (Homo sapiens) CpG-island No: 11660
cactccgtctatatccgtatttcccgctccctttattcatcaaacccctcctcgctctacccgaccccgatctatctatcccccaccctctctccacgtccctccccgctatcccgtaaacgtacgcgctaaaccccatactaaacgactcgatcatactcgcgcgacgactacgcaacctaaaccaaccgataacgctacgcgtaataaaaaacctaccgcacgacttcctaaccctaacgacgctataccgcgaaacgcgccaaaccgcaaaactatacgtaaaacgcatccgcctcgtcctcactcctcccgccgaaaccgaaccgaacgaaaaaacgaaaactacgaaaataaacgaaaactacgaaaaacgacactaaaaacctattattcccatctacgccgacctccgtcataaataccttccgaaccgaacgaaaaaaaacgcgaactataccttacttaaatcgaaaataacaaaaaaacgaaacgaaaacccgaaaactaaaaccctcgccacgaaaaaaaaaacgcgcacacacaccgatcaccgaaacgactaaacctacacgccaccgctaccttttactactactactactacgacgaccgccgcaaaaacgaaaactaaccctcccttacaaatcgatttaatttattataaataaaaatatttaattaatttaacctctctcaaatacgataa

SEQ ID NO: 11661 - DNA, 548 bp, Artificial Sequence
  chemically treated genomic DNA (Homo sapiens) CpG-island No: 11661
tcggaggtcgagggtttttcggggaagcggatgcgtttggagcggggtttttttagtcgtcgtacgttggtttgtagggattgcgttttttcggattcgtagaaatgtcggcgttcgggttttttttttcgcgtgtcggttattttgagtttttttaggcggaggtcgcggtcgtgcgtattttcgtgtggtatcgaatcgtggggtagcgtacgatgggtcggatgggtttcgacgcggggtaggggcgaagcggcgcgttttggtttgttcggtttggcgtttgcggattttttgggtcggttggttgaatcgtttggttacgcgtcgttgtagtttttggggaagcggggtttcgagatcgtgtcgtttcggttgggcgtcgtggttgtttacggttttgcggttgtagattagaggggagttatcgaggggaaggtttttgcgcgcgcgtattttattttcggttttcgtttttaattttttagtttgggtcggaggtcgtttttagagttcgggtttcggtttaatgttgtttgcgaagaagg

SEQ ID NO: 11662 - DNA, 548 bp, Artificial Sequence
  chemically treated genomic DNA (Homo sapiens) CpG-island No: 11662
ccttcttcgcaaacaacattaaaccgaaacccgaactctaaaaacgacctccgacccaaactaaaaaattaaaaacgaaaaccgaaaataaaatacgcgcgcgcaaaaaccttcccctcgataactcccctctaatctacaaccgcaaaaccgtaaacaaccacgacgcccaaccgaaacgacacgatctcgaaaccccgcttccccaaaaactacaacgacgcgtaaccaaacgattcaaccaaccgacccaaaaaatccgcaaacgccaaaccgaacaaaccaaaacgcgccgcttcgcccctaccccgcgtcgaaacccatccgacccatcgtacgctaccccacgattcgataccacacgaaaatacgcacgaccgcgacctccgcctaaaaaaactcaaaataaccgacacgcgaaaaaaaaaacccgaacgccgacatttctacgaatccgaaaaaacgcaatccctacaaaccaacgtacgacgactaaaaaaaccccgctccaaacgcatccgcttccccgaaaaaccctcgacctccga

SEQ ID NO: 11663 - DNA, 548 bp, Artificial Sequence
  chemically treated genomic DNA (Homo sapiens) CpG-island No: 11663
tttttttcgtagatagtattggatcggggttcgggttttaggggcggttttcggtttaggttgggaggttagaggcggaggtcggggatggggtgcgcgcgcgtagggatttttttttcggtggtttttttttggtttgtagtcgtagggtcgtaggtagttacggcgtttagtcggaacggtacgatttcgaagtttcgtttttttaaggattgtagcggcgcgtggttaagcggtttaattagtcggtttagaagattcgtaggcgttaggtcgggtaagttaaggcgcgtcgtttcgtttttgtttcgcgtcggggtttattcggtttatcgtgcgttgttttacggttcggtattatacgaaggtgcgtacggtcgcggttttcgtttggaggagtttagggtggtcggtacgcgaagaagggggttcggacgtcggtatttttgcggattcgaggaggcgtagtttttgtaggttaacgtgcggcggttgaaggagtttcgttttaaacgtattcgttttttcgggaagttttcggttttcga

SEQ ID NO: 11664 - DNA, 548 bp, Artificial Sequence
  chemically treated genomic DNA (Homo sapiens) CpG-island No: 11664
tcgaaaaccgaaaacttcccgaaaaaacgaatacgtttaaaacgaaactccttcaaccgccgcacgttaacctacaaaaactacgcctcctcgaatccgcaaaaataccgacgtccgaacccccttcttcgcgtaccgaccaccctaaactcctccaaacgaaaaccgcgaccgtacgcaccttcgtataataccgaaccgtaaaacaacgcacgataaaccgaataaaccccgacgcgaaacaaaaacgaaacgacgcgccttaacttacccgacctaacgcctacgaatcttctaaaccgactaattaaaccgcttaaccacgcgccgctacaatccttaaaaaaacgaaacttcgaaatcgtaccgttccgactaaacgccgtaactacctacgaccctacgactacaaaccaaaaaaaaaccaccgaaaaaaaaatccctacgcgcgcgcaccccatccccgacctccgcctctaacctcccaacctaaaccgaaaaccgcccctaaaacccgaaccccgatccaatactatctacgaaaaaaa

SEQ ID NO: 11665 - DNA, 779 bp, Artificial Sequence
  chemically treated genomic DNA (Homo sapiens) CpG-island No: 11665
tttcgcgtcgatttgatcgtttggtagtattcgatgtagtggtatagtattttttcgttttttaaattttggatcgataaagtttttttttacggttgggtttacggttatggcggtacggcgttgtatggtaaatatttgttgtgggcggtgacgatcggcggcggggaaagttattttgaaattggtgcgtattcgggttttgatgtgttgtcgtagtcgttataggcgacggtaatttattgcgggttgaattggttgttatcgtttgttatgtattgtatttttatttgtgacgacgaaattttcgaagggtaggcgcgttattataagtaacgtttgttggaatggtaggaggtttattatggatagttatacgttgatttaggcgttgatttatttcggttcggtagcgttgattgtatttattgcggtacgttttggtttgggatcggtatttggttatttgatcgtcggttgtattattggtcgtgggggttgcgattggtgatcgatgtcgaatttattttgtattttgtcgagattggggtggtgttgatgttgattttagagatttagcgttatttagttcgatcgcgtttcgtcgatgattttagagatgatgaatttggtgaaaaatttcgttatcgtttcgattatcggtttggtggatatggcggcgtaggcgggtaaattgttcgattatttagtttatgtttgggagtcgtttatcgttattacgttggcgtatgtgttgattaacgtttttattatgttgg

SEQ ID NO: 11666 - DNA, 779 bp, Artificial Sequence
  chemically treated genomic DNA (Homo sapiens) CpG-island No: 11666
ccaacataataaaaacgttaatcaacacatacgccaacgtaataacgataaacgactcccaaacataaactaaataatcgaacaatttacccgcctacgccgccatatccaccaaaccgataatcgaaacgataacgaaatttttcaccaaattcatcatctctaaaatcatcgacgaaacgcgatcgaactaaataacgctaaatctctaaaatcaacatcaacaccaccccaatctcgacaaaatacaaaataaattcgacatcgatcaccaatcgcaacccccacgaccaataatacaaccgacgatcaaataaccaaataccgatcccaaaccaaaacgtaccgcaataaatacaatcaacgctaccgaaccgaaataaatcaacgcctaaatcaacgtataactatccataataaacctcctaccattccaacaaacgttacttataataacgcgcctacccttcgaaaatttcgtcgtcacaaataaaaatacaatacataacaaacgataacaaccaattcaacccgcaataaattaccgtcgcctataacgactacgacaacacatcaaaacccgaatacgcaccaatttcaaaataactttccccgccgccgatcgtcaccgcccacaacaaatatttaccatacaacgccgtaccgccataaccgtaaacccaaccgtaaaaaaaaactttatcgatccaaaatttaaaaaacgaaaaaatactataccactacatcgaatactaccaaacgatcaaatcgacgcgaaa

SEQ ID NO: 11667 - DNA, 779 bp, Artificial Sequence
  chemically treated genomic DNA (Homo sapiens) CpG-island No: 11667
ttagtatgataaaagcgttaattaatatatacgttagcgtaatggcggtaaacgatttttaggtatgggttgagtaatcgagtaatttattcgtttgcgtcgttatatttattagatcgatagtcgaggcgatggcggagttttttattaggtttattatttttgaggttatcggcgggacgcgatcgaattgagtagcgttgagtttttagagttagtattagtattattttaatttcggtaaagtgtagaatagattcggtatcggttattagtcgtagtttttacggttaataatgtagtcggcgattaggtagttaagtatcgattttagattaagacgtatcgtaatgggtataattagcgttgtcgaatcgagataaattagcgtttgaattagcgtatggttatttatgatgggttttttgttattttagtagacgttgtttatagtgacgcgtttgtttttcgagggtttcgtcgttataaataaaggtgtagtgtatggtaaacggtggtagttagtttagttcgtagtagattgtcgtcgtttgtagcggttgcgatagtatattaaagttcggatgcgtattaattttaaaatggtttttttcgtcgtcggtcgttatcgtttatagtaaatgtttgttatgtagcgtcgtgtcgttatgatcgtaagtttagtcgtgggagaaaattttatcgatttaaagtttgaggagcggaggaatgttgtattattgtatcggatgttgttagacgattagatcggcgcgaga

SEQ ID NO: 11668 - DNA, 779 bp, Artificial Sequence
  chemically treated genomic DNA (Homo sapiens) CpG-island No: 11668
tctcgcgccgatctaatcgtctaacaacatccgatacaataatacaacattcctccgctcctcaaactttaaatcgataaaattttctcccacgactaaacttacgatcataacgacacgacgctacataacaaacatttactataaacgataacgaccgacgacgaaaaaaaccattttaaaattaatacgcatccgaactttaatatactatcgcaaccgctacaaacgacgacaatctactacgaactaaactaactaccaccgtttaccatacactacacctttatttataacgacgaaaccctcgaaaaacaaacgcgtcactataaacaacgtctactaaaataacaaaaaacccatcataaataaccatacgctaattcaaacgctaatttatctcgattcgacaacgctaattatacccattacgatacgtcttaatctaaaatcgatacttaactacctaatcgccgactacattattaaccgtaaaaactacgactaataaccgataccgaatctattctacactttaccgaaattaaaataatactaatactaactctaaaaactcaacgctactcaattcgatcgcgtcccgccgataacctcaaaaataataaacctaataaaaaactccgccatcgcctcgactatcgatctaataaatataacgacgcaaacgaataaattactcgattactcaacccatacctaaaaatcgtttaccgccattacgctaacgtatatattaattaacgcttttatcatactaa

SEQ ID NO: 11669 - DNA, 581 bp, Artificial Sequence
  chemically treated genomic DNA (Homo sapiens) CpG-island No: 11669
ttattattcgtacggtagggtatatttttggttttattacgtatataatattgtatatattttttatattatgtttgttattattacggacggtttattatacgcggttagggagacgtttgatttcgttttgttttatttttttttttaagtttttatatttagttatattgtcgtttttttcggttgttcgtattcgttttattgttttttttatttttattcgtattgtcgattggggtatgagttcgtaacgttttttgcgtttcgttttgtttcgatgttttttttcgaaattatacgcggaatttaagaattattgggatgcgtaaagcggattaggagcgtacgtttattcggtttagtgatttgtgggaattgtagtttcgggtcggaaacgtaggagacgttagaaatttaagtttgggacggcgcgttttaagggtttttggaagttgtaatttgtgtttcgagtgcgtaggcgtaggaatttttcgggggaatttttttagtagggagcgtatattgaagagtgcgtgcggaggtgagagtaataaattgataacggaaatagatggtat

SEQ ID NO: 11670 - DNA, 581 bp, Artificial Sequence
  chemically treated genomic DNA (Homo sapiens) CpG-island No: 11670
ataccatctatttccgttatcaatttattactctcacctccgcacgcactcttcaatatacgctccctactaaaaaaattcccccgaaaaattcctacgcctacgcactcgaaacacaaattacaacttccaaaaacccttaaaacgcgccgtcccaaacttaaatttctaacgtctcctacgtttccgacccgaaactacaattcccacaaatcactaaaccgaataaacgtacgctcctaatccgctttacgcatcccaataattcttaaattccgcgtataatttcgaaaaaaaacatcgaaacaaaacgaaacgcaaaaaacgttacgaactcataccccaatcgacaatacgaataaaaataaaaaaaacaataaaacgaatacgaacaaccgaaaaaaacgacaatataactaaatataaaaacttaaaaaaaaaaataaaacaaaacgaaatcaaacgtctccctaaccgcgtataataaaccgtccgtaataataacaaacataatataaaaaatatatacaatattatatacgtaataaaaccaaaaatataccctaccgtacgaataataa

SEQ ID NO: 11671 - DNA, 581 bp, Artificial Sequence
  chemically treated genomic DNA (Homo sapiens) CpG-island No: 11671
atgttatttgttttcgttattagtttattgtttttattttcgtacgtattttttaatatacgttttttgttaaagggattttttcgaagggtttttgcgtttacgtattcggagtataggttataatttttagaaatttttgggacgcgtcgttttaaatttgggtttttggcgttttttgcgttttcggttcgggattataatttttataggttattgggtcgaatgagcgtgcgtttttgattcgttttgcgtattttagtgatttttgggtttcgcgtgtagtttcggaaggagatatcgaagtagggcgaggcgtagagggcgttgcggatttatgttttagtcggtagtgcgggtaagggtgggagaagtaatgaggcgaatgcgagtagtcgaagaaggcgatagtgtggttgggtatgaagatttgagggagggggtggggtaaaacgaggttaggcgtttttttggtcgcgtgtgatggatcgttcgtggtggtgatagatatggtgtagggggtgtgtgtaatattatgtgcgtgatagagttaaggatgtgttttatcgtgcgaatggtga

SEQ ID NO: 11672 - DNA, 581 bp, Artificial Sequence
  chemically treated genomic DNA (Homo sapiens) CpG-island No: 11672
tcaccattcgcacgataaaacacatccttaactctatcacgcacataatattacacacaccccctacaccatatctatcaccaccacgaacgatccatcacacgcgaccaaaaaaacgcctaacctcgttttaccccaccccctccctcaaatcttcatacccaaccacactatcgccttcttcgactactcgcattcgcctcattacttctcccacccttacccgcactaccgactaaaacataaatccgcaacgccctctacgcctcgccctacttcgatatctccttccgaaactacacgcgaaacccaaaaatcactaaaatacgcaaaacgaatcaaaaacgcacgctcattcgacccaataacctataaaaattataatcccgaaccgaaaacgcaaaaaacgccaaaaacccaaatttaaaacgacgcgtcccaaaaatttctaaaaattataacctatactccgaatacgtaaacgcaaaaacccttcgaaaaaatccctttaacaaaaaacgtatattaaaaaatacgtacgaaaataaaaacaataaactaataacgaaaacaaataacat

SEQ ID NO: 11673 - DNA, 703 bp, Artificial Sequence
  chemically treated genomic DNA (Homo sapiens) CpG-island No: 11673
atacggtttttttggggcgcggggtcggcgcgcggcgcgtatacgtatttttttcgtttatatttagatatttatataaatagggcgttaagtattcgcgcgtatacgtatcggggatacgtaggtatcgtcgcgtcgtttttttataaaggttggcgcgcgcgcgggtatacgtagttacgcgcgggtatattcgcggtttttttttttcgttaggtattttgcggtagttcgttcgtattttcgcgtttcgggcgtttcgtgggggtcgttttttttaggtttttcgttagtgggggtgaggtgcgggttgttttcgacgtttttttcgtttaggtgcggtgtttcgcgcggttttcgtgtttttttttttttcgcggttaggataggtttcggttttttatttttttcgtttttttttttttacgcgtttcgtatatttggtttaggtgcggtttcgtttttcgttttgggttcgtagatatttatttgtttagcgtttttttggggtcggtttagcgtgttttttttgcggttcggcgaattcgggtttttcgttcggtatatttttcggagtcggggttggggggaagcgggtaggaggtggcgggacgagggcggttttcgtgtttttttttttttttggtttagtatcgtcgtcgattaaaaattaggaaaaaaaaaaaaaaagaaaagaaaagaa

SEQ ID NO: 11674 - DNA, 703 bp, Artificial Sequence
  chemically treated genomic DNA (Homo sapiens) CpG-island No: 11674
ttcttttcttttctttttttttttttttcctaatttttaatcgacgacgatactaaaccaaaaaaaaaaaaaaacacgaaaaccgccctcgtcccgccacctcctacccgcttccccccaaccccgactccgaaaaatataccgaacgaaaaacccgaattcgccgaaccgcaaaaaaaacacgctaaaccgaccccaaaaaaacgctaaacaaataaatatctacgaacccaaaacgaaaaacgaaaccgcacctaaaccaaatatacgaaacgcgtaaaaaaaaaaaaacgaaaaaaataaaaaaccgaaacctatcctaaccgcgaaaaaaaaaaaaacacgaaaaccgcgcgaaacaccgcacctaaacgaaaaaaacgtcgaaaacaacccgcacctcacccccactaacgaaaaacctaaaaaaaacgacccccacgaaacgcccgaaacgcgaaaatacgaacgaactaccgcaaaatacctaacgaaaaaaaaaaaccgcgaatatacccgcgcgtaactacgtatacccgcgcgcgcgccaacctttataaaaaaacgacgcgacgatacctacgtatccccgatacgtatacgcgcgaatacttaacgccctatttatataaatatctaaatataaacgaaaaaaatacgtatacgcgccgcgcgccgaccccgcgccccaaaaaaaccgtat

SEQ ID NO: 11675 - DNA, 703 bp, Artificial Sequence
  chemically treated genomic DNA (Homo sapiens) CpG-island No: 11675
tttttttttttttttttttttttttttttttaatttttggtcggcggcggtgttgggttaggggaaggaagggatacggaggtcgttttcgtttcgttattttttattcgtttttttttagtttcggtttcgggagatgtgtcgggcggggggttcgggttcgtcgagtcgtaggagagatacgttgggtcgattttagagaggcgttggataggtgagtgtttgcgggtttagggcgaggggcgaagtcgtatttgggttaggtgtgcggggcgcgtggaagaggggaggcgggaaggatgggaggtcggggtttgttttggtcgcgaggggggaggggatacgggagtcgcgcggggtatcgtatttgagcgggaggggcgtcgggggtagttcgtattttatttttattggcgaggggtttgggaggggcggtttttacggagcgttcggggcgcgggggtgcggacgggttatcgtagggtgtttggcggggggaggggatcgcgagtgtgttcgcgcgtggttgcgtgtgttcgcgcgcgcgttagtttttgtggggaagcggcgcggcggtgtttgcgtgttttcggtgcgtgtgcgcgcgggtgtttggcgttttgtttgtgtaggtgtttgggtgtgagcggagggggtgcgtgtgcgcgtcgcgcgtcggtttcgcgttttagaggagtcgtgt

SEQ ID NO: 11676 - DNA, 703 bp, Artificial Sequence
  chemically treated genomic DNA (Homo sapiens) CpG-island No: 11676
acacgactcctctaaaacgcgaaaccgacgcgcgacgcgcacacgcaccccctccgctcacacccaaacacctacacaaacaaaacgccaaacacccgcgcgcacacgcaccgaaaacacgcaaacaccgccgcgccgcttccccacaaaaactaacgcgcgcgcgaacacacgcaaccacgcgcgaacacactcgcgatcccctccccccgccaaacaccctacgataacccgtccgcacccccgcgccccgaacgctccgtaaaaaccgcccctcccaaacccctcgccaataaaaataaaatacgaactacccccgacgcccctcccgctcaaatacgataccccgcgcgactcccgtatcccctcccccctcgcgaccaaaacaaaccccgacctcccatccttcccgcctcccctcttccacgcgccccgcacacctaacccaaatacgacttcgcccctcgccctaaacccgcaaacactcacctatccaacgcctctctaaaatcgacccaacgtatctctcctacgactcgacgaacccgaaccccccgcccgacacatctcccgaaaccgaaactaaaaaaaaacgaataaaaaataacgaaacgaaaacgacctccgtatcccttccttcccctaacccaacaccgccgccgaccaaaaattaaaaaaaaaaaaaaaaaaaaaaaaaaaaaaa

SEQ ID NO: 11677 - DNA, 705 bp, Artificial Sequence
  chemically treated genomic DNA (Homo sapiens) CpG-island No: 11677
ggcggtttgtaattaggtggtggatgtattatttgaggttgtatcgcgtcgttcgttgggattattagcggaaaaaatttgttcggtgtatcgcgaaagcgatatcgtatcgggagagtagatcgttattagtatattgaaataaggcggtattaaagagcgtttcgtttagttgcgtaaaatgggtattaaaacggtgatgattatcggcgataatcgtttgattgtcgtcgcgattgttgcggaagcgggtgtcgatgattttttcgtcgaagcgatatcggaggttaagttggtattgattcgttagtattaggcggaaggtcgtttggtagcgatgatcggcgacggtattaacgatgtttcggcgttggcgtaggtagatgtcgcggtggcgatgaatttcggtatttaggcggcgaaagaggcgggtaatatgggcgatttcgattttaattcgattaagttgatcgaggtggtgtatattggtaaatagatgttgatgattcgtggttcgttgattatttttagtattgttaacgatgtgggcgaaatatttcgttattattttcggcggtattcgcgggaggaagaggtttttgtcgatgggcgaattattcgcgttttgtaggttaatttgttcgcggttttgcgtgatatttttttcgtttacgggtaaatttataatatcgttcgtttttttaa

SEQ ID NO: 11678 - DNA, 705 bp, Artificial Sequence
  chemically treated genomic DNA (Homo sapiens) CpG-island No: 11678
ttaaaaaaacgaacgatattataaatttacccgtaaacgaaaaaaatatcacgcaaaaccgcgaacaaattaacctacaaaacgcgaataattcgcccatcgacaaaaacctcttcctcccgcgaataccgccgaaaataataacgaaatatttcgcccacatcgttaacaatactaaaaataatcaacgaaccacgaatcatcaacatctatttaccaatatacaccacctcgatcaacttaatcgaattaaaatcgaaatcgcccatattacccgcctctttcgccgcctaaataccgaaattcatcgccaccgcgacatctacctacgccaacgccgaaacatcgttaataccgtcgccgatcatcgctaccaaacgaccttccgcctaatactaacgaatcaataccaacttaacctccgatatcgcttcgacgaaaaaatcatcgacacccgcttccgcaacaatcgcgacgacaatcaaacgattatcgccgataatcatcaccgttttaatacccattttacgcaactaaacgaaacgctctttaataccgccttatttcaatatactaataacgatctactctcccgatacgatatcgctttcgcgatacaccgaacaaattttttccgctaataatcccaacgaacgacgcgatacaacctcaaataatacatccaccacctaattacaaaccgcc

SEQ ID NO: 11679 - DNA, 705 bp, Artificial Sequence
  chemically treated genomic DNA (Homo sapiens) CpG-island No: 11679
ttgggaaaacgaacggtgttatggatttgttcgtaaacgaagagaatgttacgtaggatcgcgaataagttggtttgtaaagcgcgaataattcgtttatcgataaaagtttttttttttcgcgaatgtcgtcgggaataatggcgaagtatttcgtttatatcgttggtaatgttgaaggtggttagcgagttacgggttattagtatttgtttgttaatgtgtattatttcgattaatttggtcgggttagagtcgagatcgtttatattgttcgtttttttcgtcgtttgggtgtcggagtttatcgttatcgcgatatttgtttgcgttagcgtcggagtatcgttggtgtcgtcgtcggttatcgttattaaacgatttttcgtttgatattgacggattaatgttagtttggttttcggtgtcgtttcggcgagaaaattatcgatattcgttttcgtagtaatcgcggcggtagttagacggttatcgtcggtaattattatcgttttaatgtttattttgcgtagttgggcgaagcgttttttaatatcgttttgttttaatatgttggtggcggtttgttttttcggtacgatgtcgttttcgcggtatatcgagtagatttttttcgttggtaattttagcgaacgacgcgatatagttttaggtagtgtatttattatttgattgtagatcgtt

SEQ ID NO: 11680 - DNA, 705 bp, Artificial Sequence
  chemically treated genomic DNA (Homo sapiens) CpG-island No: 11680
aacgatctacaatcaaataataaatacactacctaaaactatatcgcgtcgttcgctaaaattaccaacgaaaaaaatctactcgatataccgcgaaaacgacatcgtaccgaaaaaacaaaccgccaccaacatattaaaacaaaacgatattaaaaaacgcttcgcccaactacgcaaaataaacattaaaacgataataattaccgacgataaccgtctaactaccgccgcgattactacgaaaacgaatatcgataattttctcgccgaaacgacaccgaaaaccaaactaacattaatccgtcaatatcaaacgaaaaatcgtttaataacgataaccgacgacgacaccaacgatactccgacgctaacgcaaacaaatatcgcgataacgataaactccgacacccaaacgacgaaaaaaacgaacaatataaacgatctcgactctaacccgaccaaattaatcgaaataatacacattaacaaacaaatactaataacccgtaactcgctaaccaccttcaacattaccaacgatataaacgaaatacttcgccattattcccgacgacattcgcgaaaaaaaaaaacttttatcgataaacgaattattcgcgctttacaaaccaacttattcgcgatcctacgtaacattctcttcgtttacgaacaaatccataacaccgttcgttttcccaa

SEQ ID NO: 11681 - DNA, 538 bp, Artificial Sequence
  chemically treated genomic DNA (Homo sapiens) CpG-island No: 11681
aagaagtgtattggatagagttcgtaatgtcggcgttattgtgggtttgtcgggttatagagttcggttcgttgattgtttttattgatatttacggtaataatttgatagtcgataataaaaagttgttcgtcgaacgtcgcgatttttcggcgaattttttatgtttgtaggtttgtttgtataacgaatttgtcgcgtttgggttttaatgtttagtattttttgcgtaagttgtacgcgttcgattattagcggtatttgttattgttggtagacgttttcgtaatgcgtaatttaggtatcggtattggtatttaaatcgtgatgtatatgaatagcgcgtagagcgatattcggatttttcgttcgttattgtattaattgatgtagtagaacggtggagttaagttcgtcgttaaaggttattagaatttggcgtgaggtgagaagttgtttattgagcgtgagtgttatgatggtgcgattttatagtagtaatgttcggtacgttatcgggtaaatgcggcgataaaga

SEQ ID NO: 11682 - DNA, 538 bp, Artificial Sequence
  chemically treated genomic DNA (Homo sapiens) CpG-island No: 11682
tctttatcgccgcatttacccgataacgtaccgaacattactactataaaatcgcaccatcataacactcacgctcaataaacaacttctcacctcacgccaaattctaataacctttaacgacgaacttaactccaccgttctactacatcaattaatacaataacgaacgaaaaatccgaatatcgctctacgcgctattcatatacatcacgatttaaataccaataccgatacctaaattacgcattacgaaaacgtctaccaacaataacaaataccgctaataatcgaacgcgtacaacttacgcaaaaaatactaaacattaaaacccaaacgcgacaaattcgttatacaaacaaacctacaaacataaaaaattcgccgaaaaatcgcgacgttcgacgaacaactttttattatcgactatcaaattattaccgtaaatatcaataaaaacaatcaacgaaccgaactctataacccgacaaacccacaataacgccgacattacgaactctatccaatacacttctt

SEQ ID NO: 11683 - DNA, 538 bp, Artificial Sequence
  chemically treated genomic DNA (Homo sapiens) CpG-island No: 11683
tttttatcgtcgtatttgttcggtaacgtgtcgggtattgttattgtaaaatcgtattattatgatatttacgtttaatagataattttttattttacgttagattttggtggtttttagcggcgggtttgattttatcgttttgttgtattagttggtgtagtggcggacggaaaattcgggtgtcgttttgcgcgttatttatgtgtattacggtttaagtgttaatgtcgatgtttgggttacgtattgcgaaaacgtttgttaatagtggtaggtgtcgttggtggtcgaacgcgtataatttgcgtaagaagtattgggtattgaggtttaggcgcggtaggttcgttatataggtagatttgtaggtatgaaagattcgtcgagggatcgcggcgttcggcgaatagttttttgttgtcggttattaggttgttgtcgtgggtattaatagagataattagcgggtcgaattttgtgattcggtagatttatagtgacgtcggtattgcgagttttgtttagtgtatttttt

SEQ ID NO: 11684 - DNA, 538 bp, Artificial Sequence
  chemically treated genomic DNA (Homo sapiens) CpG-island No: 11684
aaaaaatacactaaacaaaactcgcaataccgacgtcactataaatctaccgaatcacaaaattcgacccgctaattatctctattaatacccacgacaacaacctaataaccgacaacaaaaaactattcgccgaacgccgcgatccctcgacgaatctttcatacctacaaatctacctatataacgaacctaccgcgcctaaacctcaatacccaatacttcttacgcaaattatacgcgttcgaccaccaacgacacctaccactattaacaaacgttttcgcaatacgtaacccaaacatcgacattaacacttaaaccgtaatacacataaataacgcgcaaaacgacacccgaattttccgtccgccactacaccaactaatacaacaaaacgataaaatcaaacccgccgctaaaaaccaccaaaatctaacgtaaaataaaaaattatctattaaacgtaaatatcataataatacgattttacaataacaatacccgacacgttaccgaacaaatacgacgataaaaa

SEQ ID NO: 11685 - DNA, 677 bp, Artificial Sequence
  chemically treated genomic DNA (Homo sapiens) CpG-island No: 11685
tttggtcgtacgttagttgtcggaggaagatcgagatggtgatttttcgcgttttgtatttggcgcgtcgtattattacgtcgttggtttttggcgttgtggtgatgattatcggtttgtcgttaatttaggttgggttaacgtttattggcggcggttacgtagttatgagcgataatattttcggcgtatcgaaaaatttgttgttggtaggcgtggttttagttgtaggtcgaaaagtagcggcggtttgtcgagttatttataaatttttggcgattggttgtgcgaaacggtagcgaaagataataagttgatggcgattatttcggcgatgcgtgaaggtttcggtatggtcgagtttttacgtaaattttcggatcgttatttcgacgtggtaattgtcgagtaatacgcggtgatttttgatgcgggtttggcgattggtgggtataaatttattgtcgcgatttattttatttttttgtaacgcgtttatgattaggtgttgtatgacgtggcgatttaaaagttttcggttttgttcgttatcgatcgcgcgggtattgttggtgttgacggttaaatttattagggtgtttttgattttttttatttgcgttgtatatcggaaatggttattatgatttcgagcgatgaaaacgaatgtcgttaga

SEQ ID NO: 11686 - DNA, 677 bp, Artificial Sequence
  chemically treated genomic DNA (Homo sapiens) CpG-island No: 11686
tctaacgacattcgttttcatcgctcgaaatcataataaccatttccgatatacaacgcaaataaaaaaaatcaaaaacaccctaataaatttaaccgtcaacaccaacaatacccgcgcgatcgataacgaacaaaaccgaaaacttttaaatcgccacgtcatacaacacctaatcataaacgcgttacaaaaaaataaaataaatcgcgacaataaatttatacccaccaatcgccaaacccgcatcaaaaatcaccgcgtattactcgacaattaccacgtcgaaataacgatccgaaaatttacgtaaaaactcgaccataccgaaaccttcacgcatcgccgaaataatcgccatcaacttattatctttcgctaccgtttcgcacaaccaatcgccaaaaatttataaataactcgacaaaccgccgctacttttcgacctacaactaaaaccacgcctaccaacaacaaatttttcgatacgccgaaaatattatcgctcataactacgtaaccgccgccaataaacgttaacccaacctaaattaacgacaaaccgataatcatcaccacaacgccaaaaaccaacgacgtaataatacgacgcgccaaatacaaaacgcgaaaaatcaccatctcgatcttcctccgacaactaacgtacgaccaaa

SEQ ID NO: 11687 - DNA, 677 bp, Artificial Sequence
  chemically treated genomic DNA (Homo sapiens) CpG-island No: 11687
tttggcgatattcgtttttatcgttcggggttataatgattattttcggtatgtagcgtaggtaagagagattaaaagtattttgatgggtttgatcgttagtattaataatgttcgcgcggtcgatggcgaataggatcggaagtttttgaatcgttacgttatgtagtatttgattataggcgcgttgtaggaaagtggagtaaatcgcgataatgggtttgtatttattaatcgttagattcgtattaaaggttatcgcgtgttgttcggtaattgttacgtcgaagtagcgattcgggaatttacgtgaaaattcgattatgtcggaatttttacgtatcgtcggagtaatcgttattagtttgttgtttttcgttgtcgtttcgtataattagtcgttaaagatttgtgaatagttcggtaaatcgtcgttatttttcgatttgtagttaagattacgtttgttagtagtagatttttcggtgcgtcgaaggtgttatcgtttatggttgcgtaatcgtcgttaatggacgttaatttaatttgaattagcgataggtcgataattattattataacgttagaaattagcggcgtaataatgcggcgcgttagatgtagaacgcgggagattattatttcggttttttttcggtagttggcgtgcggttagg

SEQ ID NO: 11688 - DNA, 677 bp, Artificial Sequence
  chemically treated genomic DNA (Homo sapiens) CpG-island No: 11688
cctaaccgcacgccaactaccgaaaaaaaaccgaaataataatctcccgcgttctacatctaacgcgccgcattattacgccgctaatttctaacgttataataataattatcgacctatcgctaattcaaattaaattaacgtccattaacgacgattacgcaaccataaacgataacaccttcgacgcaccgaaaaatctactactaacaaacgtaatcttaactacaaatcgaaaaataacgacgatttaccgaactattcacaaatctttaacgactaattatacgaaacgacaacgaaaaacaacaaactaataacgattactccgacgatacgtaaaaattccgacataatcgaattttcacgtaaattcccgaatcgctacttcgacgtaacaattaccgaacaacacgcgataacctttaatacgaatctaacgattaataaatacaaacccattatcgcgatttactccactttcctacaacgcgcctataatcaaatactacataacgtaacgattcaaaaacttccgatcctattcgccatcgaccgcgcgaacattattaatactaacgatcaaacccatcaaaatacttttaatctctcttacctacgctacataccgaaaataatcattataaccccgaacgataaaaacgaatatcgccaaa

SEQ ID NO: 11689 - DNA, 706 bp, Artificial Sequence
  chemically treated genomic DNA (Homo sapiens) CpG-island No: 11689
agcgttcggatttagtttttttttcggcgttaattttttgtcgttgagaaaggcggggagtatagtttgcgggttcgcggtcgaggtagtgggggtcgttcggatttttggagagggcgtattgtgattattcgtttcgtgtagtaggaatttaggcggcgcgtgcgcgttttagtttttcgattggggttttttagttcggatttcgagattttaggggattaggttcgttttttttgtttttttgtcgttacgcgcgtttatttggttaggtcggttcggttttcggttttggtcggaggggttttggcgtttgcgtttttagggcggtcgcggttggggttggggttgttagtcgggttcggttaagtttcggggttgggacgagggatagaggggggggcggagagtcgtcgtttttgtttttcgttcgtttcgttttttttttttttttttttcggcggcggttgtaatgaattttagatgtgatcggtcggttggtcggggcgtacgcgggggtcgataggagttgtacggagggttttttgttcgttttttttattcgattttttattttgttttttttagtttttattcgtgagaatcggtcggcgcgaaacgttacgtagtttggtgacgttatagtatttttggttaggtggttttaatttgaaataattgtttttaattttaggttatttttggg

SEQ ID NO: 11690 - DNA, 706 bp, Artificial Sequence
  chemically treated genomic DNA (Homo sapiens) CpG-island No: 11690
cccaaaaataacctaaaattaaaaacaattatttcaaattaaaaccacctaaccaaaaatactataacgtcaccaaactacgtaacgtttcgcgccgaccgattctcacgaataaaaactaaaaaaaacaaaataaaaaatcgaataaaaaaaacgaacaaaaaaccctccgtacaactcctatcgacccccgcgtacgccccgaccaaccgaccgatcacatctaaaattcattacaaccgccgccgaaaaaaaaaaaaaaaaaaaacgaaacgaacgaaaaacaaaaacgacgactctccgcccccccctctatccctcgtcccaaccccgaaacttaaccgaacccgactaacaaccccaaccccaaccgcgaccgccctaaaaacgcaaacgccaaaacccctccgaccaaaaccgaaaaccgaaccgacctaaccaaataaacgcgcgtaacgacaaaaaaacaaaaaaaacgaacctaatcccctaaaatctcgaaatccgaactaaaaaaccccaatcgaaaaactaaaacgcgcacgcgccgcctaaattcctactacacgaaacgaataatcacaatacgccctctccaaaaatccgaacgacccccactacctcgaccgcgaacccgcaaactatactccccgcctttctcaacgacaaaaaattaacgccgaaaaaaaaactaaatccgaacgct

SEQ ID NO: 11691 - DNA, 706 bp, Artificial Sequence
  chemically treated genomic DNA (Homo sapiens) CpG-island No: 11691
tttagaggtaatttggggttgaagatagttgttttaggttgaggttatttggttaggagtattgtgacgttattaggttgcgtgacgtttcgcgtcggtcggtttttacgggtgggggttgggaggggtagagtgagagatcgggtggggggggcggataaagggtttttcgtgtagtttttgtcggttttcgcgtgcgtttcggttagtcggtcggttatatttggaatttattgtagtcgtcgtcggaaaggggaggagaggagggcggggcgagcggggggtagaggcggcggtttttcgtttttttttttgtttttcgttttagtttcgggatttagtcgagttcggttggtaattttagttttagtcgcggtcgttttggggacgtagacgttaaggttttttcggttagggtcgggagtcgggtcggtttagttaggtgagcgcgcgtggcgataaggaggtagaaaaggcgggtttggttttttgaggtttcgggattcgagttgaggggttttaatcggggggttggggcgcgtacgcgtcgtttgggtttttgttgtacggagcgggtggttatagtgcgttttttttaagaattcgggcggtttttattgtttcggtcgcgaattcgtagattgtgtttttcgttttttttagcggtaggaagttggcgtcggggagaaggttgaattcgagcgtt

SEQ ID NO: 11692 - DNA, 706 bp, Artificial Sequence
  chemically treated genomic DNA (Homo sapiens) CpG-island No: 11692
aacgctcgaattcaaccttctccccgacgccaacttcctaccgctaaaaaaaacgaaaaacacaatctacgaattcgcgaccgaaacaataaaaaccgcccgaattcttaaaaaaaacgcactataaccacccgctccgtacaacaaaaacccaaacgacgcgtacgcgccccaaccccccgattaaaacccctcaactcgaatcccgaaacctcaaaaaaccaaacccgccttttctacctccttatcgccacgcgcgctcacctaactaaaccgacccgactcccgaccctaaccgaaaaaaccttaacgtctacgtccccaaaacgaccgcgactaaaactaaaattaccaaccgaactcgactaaatcccgaaactaaaacgaaaaacaaaaaaaaaaacgaaaaaccgccgcctctaccccccgctcgccccgccctcctctcctcccctttccgacgacgactacaataaattccaaatataaccgaccgactaaccgaaacgcacgcgaaaaccgacaaaaactacacgaaaaaccctttatccgccccccccacccgatctctcactctacccctcccaacccccacccgtaaaaaccgaccgacgcgaaacgtcacgcaacctaataacgtcacaatactcctaaccaaataacctcaacctaaaacaactatcttcaaccccaaattacctctaaa

SEQ ID NO: 11693 - DNA, 617 bp, Artificial Sequence
  chemically treated genomic DNA (Homo sapiens) CpG-island No: 11693
tgtggtcgtttttagtaacgtttttttttatttcgtagtcggtttttttttttattatcgtttttttacgtttcgtttttggtttttttcgatttcgcgtggattcggtgtttgggcgttttcgttaacgattttcgcgtattttagcgttggtgtcgttcggtttttttcgcgtacgcgtatcgtggtatttttcgttacgtttttatatcgttttttttaatatttggttggttacgtttttcgggaggtttcggattagtattttgcggcggttacggaattggcgttcggtgtgttttaggcgttttcggattttttttggatttagaggcggtagtttttttttcggcgttcggcgtttcgcggtatcgtcggtttcgatttcggttttagatttagggtttagcgggggtcggtgagtaacggatacgttcgtcgttattttgggaaattcggcgttttttgggattagcgagtcggggcggagcggtatagagcggtaacgagggcgcgttcgtcgattggttgggagaaattttatttttttttcgttttttttgtttcgttggttaagttttagtttattttttaagagtttaagttgcgtttgcgcg

SEQ ID NO: 11694 - DNA, 617 bp, Artificial Sequence
  chemically treated genomic DNA (Homo sapiens) CpG-island No: 11694
cgcgcaaacgcaacttaaactcttaaaaaataaactaaaacttaaccaacgaaacaaaaaaaacgaaaaaaaaataaaatttctcccaaccaatcgacgaacgcgccctcgttaccgctctataccgctccgccccgactcgctaatcccaaaaaacgccgaatttcccaaaataacgacgaacgtatccgttactcaccgacccccgctaaaccctaaatctaaaaccgaaatcgaaaccgacgataccgcgaaacgccgaacgccgaaaaaaaaactaccgcctctaaatccaaaaaaaatccgaaaacgcctaaaacacaccgaacgccaattccgtaaccgccgcaaaatactaatccgaaacctcccgaaaaacgtaaccaaccaaatattaaaaaaaacgatataaaaacgtaacgaaaaataccacgatacgcgtacgcgaaaaaaaccgaacgacaccaacgctaaaatacgcgaaaatcgttaacgaaaacgcccaaacaccgaatccacgcgaaatcgaaaaaaaccaaaaacgaaacgtaaaaaaacgataataaaaaaaaaaaccgactacgaaataaaaaaaaacgttactaaaaacgaccaca

SEQ ID NO: 11695 - DNA, 617 bp, Artificial Sequence
  chemically treated genomic DNA (Homo sapiens) CpG-island No: 11695
cgcgtagacgtagtttgaatttttgagaggtgggttggggtttagttaacggggtaaggggggcgggaaggaggtggggttttttttagttaatcgacgggcgcgttttcgttgtcgttttatgtcgtttcgtttcggttcgttggttttagaaggcgtcgggttttttaagatggcggcggacgtgttcgttatttatcggttttcgttgagttttaagtttggggtcgaagtcgaagtcggcgatgtcgcggagcgtcgggcgtcggaagaagagttgtcgtttttagatttagaagagattcggaaacgtttggaatatatcgagcgttagtttcgtaatcgtcgtaagatattgattcggggtttttcgggggacgtgattaattaggtattggggggggcggtgtaggagcgtggcgggaaatattacggtgcgcgtgcgcggggggaatcgggcgatattaacgttgaggtgcgcgggggtcgttggcgggggcgtttaagtatcggatttacgcgggatcgggagagattaagagcgggacgtgggggggcgatgatgaaaggggaaatcgattgcgaagtgagggagggcgttgttaggggcgattata

SEQ ID NO: 11696 - DNA, 617 bp, Artificial Sequence
  chemically treated genomic DNA (Homo sapiens) CpG-island No: 11696
tataatcgcccctaacaacgccctccctcacttcgcaatcgatttcccctttcatcatcgcccccccacgtcccgctcttaatctctcccgatcccgcgtaaatccgatacttaaacgcccccgccaacgacccccgcgcacctcaacgttaatatcgcccgattccccccgcgcacgcgcaccgtaatatttcccgccacgctcctacaccgccccccccaatacctaattaatcacgtcccccgaaaaaccccgaatcaatatcttacgacgattacgaaactaacgctcgatatattccaaacgtttccgaatctcttctaaatctaaaaacgacaactcttcttccgacgcccgacgctccgcgacatcgccgacttcgacttcgaccccaaacttaaaactcaacgaaaaccgataaataacgaacacgtccgccgccatcttaaaaaacccgacgccttctaaaaccaacgaaccgaaacgaaacgacataaaacgacaacgaaaacgcgcccgtcgattaactaaaaaaaaccccacctccttcccgccccccttaccccgttaactaaaccccaacccacctctcaaaaattcaaactacgtctacgcg

SEQ ID NO: 11697 - DNA, 587 bp, Artificial Sequence
  chemically treated genomic DNA (Homo sapiens) CpG-island No: 11697
tcgtttagcgattaatggttttatcggtataggtggaaaacgaatcggtatcgggcgtggtaatcgttattttcgttaatattcgtataattataattattagtagttcggcgaatagataggttagtaatatcgtcgggttcgtttcggcgatggcgacgttggaatcgataaatagatttgcgtcgataatatcggtaatagataatatggtgacgtggcgtgattttagttcgtcgtttaatttatgtggttgcgatgattgttttattttgaattttttcgaaagtgtgttattgttataagtacgcgtgtttgtaggtcgatttgtattggtttgtatatatttttcgtttaagtagaaacgcggtggagtttagtttgatgattacgttttcgttcggattaattagttgcgaggtcgttttaggattacgtatttttttatcgtgattttgcgtttgatgtagatttatcggcgtttagcgcgggtttgtgtgggtaatagtttttgcgttattgcgattttttttagtttgtcgttttcgttaagtttattgatatcgcgtcggtagtggtaggcgaaa

SEQ ID NO: 11698 - DNA, 587 bp, Artificial Sequence
  chemically treated genomic DNA (Homo sapiens) CpG-island No: 11698
tttcgcctaccactaccgacgcgatatcaataaacttaacgaaaacgacaaactaaaaaaaatcgcaataacgcaaaaactattacccacacaaacccgcgctaaacgccgataaatctacatcaaacgcaaaatcacgataaaaaaatacgtaatcctaaaacgacctcgcaactaattaatccgaacgaaaacgtaatcatcaaactaaactccaccgcgtttctacttaaacgaaaaatatatacaaaccaatacaaatcgacctacaaacacgcgtacttataacaataacacactttcgaaaaaattcaaaataaaacaatcatcgcaaccacataaattaaacgacgaactaaaatcacgccacgtcaccatattatctattaccgatattatcgacgcaaatctatttatcgattccaacgtcgccatcgccgaaacgaacccgacgatattactaacctatctattcgccgaactactaataattataattatacgaatattaacgaaaataacgattaccacgcccgataccgattcgttttccacctataccgataaaaccattaatcgctaaacga

SEQ ID NO: 11699 - DNA, 587 bp, Artificial Sequence
  chemically treated genomic DNA (Homo sapiens) CpG-island No: 11699
tttcgtttgttattgtcgacgcgatattaataaatttgacgaaagcggtaaattgaaaaaagtcgtaatggcgtagaagttattatttatataggttcgcgttggacgtcgatgaatttgtattaggcgtagaattacgatgaaaaagtacgtagttttaaagcggtttcgtagttggttaattcgggcgaaagcgtagttattaagttgggttttatcgcgtttttgtttgggcgggaaatgtgtgtaagttagtgtaaatcgatttgtaggtacgcgtatttatggtagtgatatattttcgagaggatttaggatggggtaattatcgtaattatatgagttaggcggcgggttgaagttacgttacgttattatgttgtttattgtcggtgttatcggcgtaagtttgtttgtcggttttagcgtcgttatcgtcgaagcgggttcggcggtattattggtttatttgttcgtcgggttattggtggttatgattatgcggatgttggcggaaatggcggttgttacgttcgatatcggttcgttttttatttatgtcgataaagttattggtcgttgggcgg

SEQ ID NO: 11700 - DNA, 587 bp, Artificial Sequence
  chemically treated genomic DNA (Homo sapiens) CpG-island No: 11700
ccgcccaacgaccaataactttatcgacataaataaaaaacgaaccgatatcgaacgtaacaaccgccatttccgccaacatccgcataatcataaccaccaataacccgacgaacaaataaaccaataataccgccgaacccgcttcgacgataacgacgctaaaaccgacaaacaaacttacgccgataacaccgacaataaacaacataataacgtaacgtaacttcaacccgccgcctaactcatataattacgataattaccccatcctaaatcctctcgaaaatatatcactaccataaatacgcgtacctacaaatcgatttacactaacttacacacatttcccgcccaaacaaaaacgcgataaaacccaacttaataactacgctttcgcccgaattaaccaactacgaaaccgctttaaaactacgtactttttcatcgtaattctacgcctaatacaaattcatcgacgtccaacgcgaacctatataaataataacttctacgccattacgacttttttcaatttaccgctttcgtcaaatttattaatatcgcgtcgacaataacaaacgaaa

SEQ ID NO: 11701 - DNA, 510 bp, Artificial Sequence
  chemically treated genomic DNA (Homo sapiens) CpG-island No: 11701
aaatttagcggtgtgtcggtaattatcgacgtatcgttggagatggagcgtagttatcgttagtattgcgtgttggacgatttaattttggcgaaggtttattaaagttagcgtaagcgttatagcgaaatgttcgattttttattgttaaatgtcgggtcgttcgtttgcggagcgtcgtttatttcggtaattagcgtatcgttggcgattggcgtaggcggaatgatattggcgggttataatggcgcgatatattttgaagcgttttgtttgcgcgattatttcgtggaagttaaatgttttatttagtacgttcggataaggtaggaaggcgttcgttataattcgtagttcgtcgtcgttattaagatgacgtatcgtatcgcgaattagcgtttgcgtcgtatttaggttggtttgtattttatcgtggaacggcgggttggagatgattatattaaaacgattttttatttcggaaaagacgttgttggtaaagattttatt

SEQ ID NO: 11702 - DNA, 510 bp, Artificial Sequence
  chemically treated genomic DNA (Homo sapiens) CpG-island No: 11702
aataaaatctttaccaacaacgtcttttccgaaataaaaaatcgttttaatataatcatctccaacccgccgttccacgataaaatacaaaccaacctaaatacgacgcaaacgctaattcgcgatacgatacgtcatcttaataacgacgacgaactacgaattataacgaacgccttcctaccttatccgaacgtactaaataaaacatttaacttccacgaaataatcgcgcaaacaaaacgcttcaaaatatatcgcgccattataacccgccaatatcattccgcctacgccaatcgccaacgatacgctaattaccgaaataaacgacgctccgcaaacgaacgacccgacatttaacaataaaaaatcgaacatttcgctataacgcttacgctaactttaataaaccttcgccaaaattaaatcgtccaacacgcaatactaacgataactacgctccatctccaacgatacgtcgataattaccgacacaccgctaaattt

SEQ ID NO: 11703 - DNA, 510 bp, Artificial Sequence
  chemically treated genomic DNA (Homo sapiens) CpG-island No: 11703
ggtgaagtttttgttagtaacgtttttttcgaggtgaaaggtcgttttgatatgattatttttaattcgtcgttttacgatgggatgtaaattagtttggatgcggcgtaaacgttgattcgcggtgcggtgcgttattttaatagcggcggcgagttgcgaattgtagcgaacgtttttttgttttattcggacgtgttggatgagatatttggtttttacgaagtgatcgcgtaaatagggcgttttaaggtgtatcgcgttattatgattcgttagtgttatttcgtttgcgttagtcgttaacgatacgttggttgtcgaagtgagcgacgtttcgtaggcgaacgattcgatatttaataatgaggaatcgagtatttcgttgtaacgtttgcgttggttttgataaattttcgttagggttgggtcgtttagtacgtaatattgacggtaattacgttttatttttagcggtacgtcgatgattgtcggtatatcgttggattt

SEQ ID NO: 11704 - DNA, 510 bp, Artificial Sequence
  chemically treated genomic DNA (Homo sapiens) CpG-island No: 11704
aaatccaacgatataccgacaatcatcgacgtaccgctaaaaataaaacgtaattaccgtcaatattacgtactaaacgacccaaccctaacgaaaatttatcaaaaccaacgcaaacgttacaacgaaatactcgattcctcattattaaatatcgaatcgttcgcctacgaaacgtcgctcacttcgacaaccaacgtatcgttaacgactaacgcaaacgaaataacactaacgaatcataataacgcgatacaccttaaaacgccctatttacgcgatcacttcgtaaaaaccaaatatctcatccaacacgtccgaataaaacaaaaaaacgttcgctacaattcgcaactcgccgccgctattaaaataacgcaccgcaccgcgaatcaacgtttacgccgcatccaaactaatttacatcccatcgtaaaacgacgaattaaaaataatcatatcaaaacgacctttcacctcgaaaaaaacgttactaacaaaaacttcacc

SEQ ID NO: 11705 - DNA, 597 bp, Artificial Sequence
  chemically treated genomic DNA (Homo sapiens) CpG-island No: 11705
acggcgcggtcgattattttcgcgattttggtatgaatatacggtacgtagttatatattgcggggacgatttttatattacgtaggatgttaatgtgtatttattttgttggatttgagacgtatttgttagtcgtgttataagtgatcgcgtttgaatatttgcgggtatagattagtttatgtaggtgcgtcgttgtgtattaaagtaacgttgatttgttatacgtatttcgtgtaggttgaacgtattgattttattacggcgtgcgtagcgtcgacgttttgtatatcgaattaggaagacggtaagtcggaggttcgagtttgattgacgtacgagatagttcggaagaagtagcggacgttaaggttacgtcgtaattacgtatttttgtttttagatcgcgatttggtcgcgagttttatttttattgttcgtttggatattaataagggttttcgtcgtatatggagtacgcggtttacgtgtagcgttatcgtaagttatatgtgtagttcgttaaagatatcggttttggatttgattgtcgtgtgttgtatttgcgtgcgtagtgtgttattaatatcgaatta

SEQ ID NO: 11706 - DNA, 597 bp, Artificial Sequence
  chemically treated genomic DNA (Homo sapiens) CpG-island No: 11706
taattcgatattaataacacactacgcacgcaaatacaacacacgacaatcaaatccaaaaccgatatctttaacgaactacacatataacttacgataacgctacacgtaaaccgcgtactccatatacgacgaaaacccttattaatatccaaacgaacaataaaaataaaactcgcgaccaaatcgcgatctaaaaacaaaaatacgtaattacgacgtaaccttaacgtccgctacttcttccgaactatctcgtacgtcaatcaaactcgaacctccgacttaccgtcttcctaattcgatatacaaaacgtcgacgctacgcacgccgtaataaaatcaatacgttcaacctacacgaaatacgtataacaaatcaacgttactttaatacacaacgacgcacctacataaactaatctatacccgcaaatattcaaacgcgatcacttataacacgactaacaaatacgtctcaaatccaacaaaataaatacacattaacatcctacgtaatataaaaatcgtccccgcaatatataactacgtaccgtatattcataccaaaatcgcgaaaataatcgaccgcgccgt

SEQ ID NO: 11707 - DNA, 597 bp, Artificial Sequence
  chemically treated genomic DNA (Homo sapiens) CpG-island No: 11707
tgattcgatgttgatggtatattgcgtacgtagatatagtatacggtagttaaatttaagatcgatgtttttgacgaattgtatatgtaatttgcggtggcgttgtacgtgggtcgcgtgttttatgtgcggcgagaatttttgttgatgtttagacgggtagtgagagtgagattcgcggttagatcgcggtttgggggtagaagtgcgtgattgcggcgtgattttgacgttcgttgtttttttcggattgtttcgtacgttagttaagttcgaattttcggtttgtcgtttttttggttcggtgtataggacgtcgacgttgcgtacgtcgtggtagagttaatgcgtttaatttgtacgaagtgcgtgtgataaattaacgttgttttagtgtatagcgacgtatttgtatgggttggtttatattcgtaagtgtttagacgcgattatttgtggtacggttaatagatacgttttaggtttagtagagtggatgtatattgatattttgcgtgatatggagatcgttttcgtagtgtgtggttgcgtgtcgtgtgtttatgttagagtcgcgggagtgatcggtcgcgtcgt

SEQ ID NO: 11708 - DNA, 597 bp, Artificial Sequence
  chemically treated genomic DNA (Homo sapiens) CpG-island No: 11708
acgacgcgaccgatcactcccgcgactctaacataaacacacgacacgcaaccacacactacgaaaacgatctccatatcacgcaaaatatcaatatacatccactctactaaacctaaaacgtatctattaaccgtaccacaaataatcgcgtctaaacacttacgaatataaaccaacccatacaaatacgtcgctatacactaaaacaacgttaatttatcacacgcacttcgtacaaattaaacgcattaactctaccacgacgtacgcaacgtcgacgtcctatacaccgaaccaaaaaaacgacaaaccgaaaattcgaacttaactaacgtacgaaacaatccgaaaaaaacaacgaacgtcaaaatcacgccgcaatcacgcacttctacccccaaaccgcgatctaaccgcgaatctcactctcactacccgtctaaacatcaacaaaaattctcgccgcacataaaacacgcgacccacgtacaacgccaccgcaaattacatatacaattcgtcaaaaacatcgatcttaaatttaactaccgtatactatatctacgtacgcaatataccatcaacatcgaatca

SEQ ID NO: 11709 - DNA, 515 bp, Artificial Sequence
  chemically treated genomic DNA (Homo sapiens) CpG-island No: 11709
cgggattttcggtgcggtgatcgtcggtattatcgtttggatgttgtatgagcgtttttataatattcgtttgtcggatgcgttggtatttttcggcggtacggtttcgtattaattattttttcgttggtgatgggttttgtcggtttggtgattttattagtttggtcgattttcgttatgggtattagcggtttgggttatatgataaatagcgcgggtgatttcggatcgatgttgtttggtatcggtgaacgtttgttgttgtcgtttggtttgtattatattttggtggtattaattcgttttatcgacgtagggtagcgagggaaagtttgcggttaaatcgttagcggcgtattgattattttttaggggtaattgagttgttcgattatttacggtttttttgaaagcgggacggttttttttggtaaggtaaaatgggtgcgttttttgggggtttgtaggtgtagcgttagtatgtagtaatgcgcgagttcggaaaatcggta

SEQ ID NO: 11710 - DNA, 515 bp, Artificial Sequence
  chemically treated genomic DNA (Homo sapiens) CpG-island No: 11710
taccgattttccgaactcgcgcattactacatactaacgctacacctacaaacccccaaaaaacgcacccattttaccttaccaaaaaaaaccgtcccgctttcaaaaaaaccgtaaataatcgaacaactcaattacccctaaaaaataatcaatacgccgctaacgatttaaccgcaaactttccctcgctaccctacgtcgataaaacgaattaataccaccaaaatataatacaaaccaaacgacaacaacaaacgttcaccgataccaaacaacatcgatccgaaatcacccgcgctatttatcatataacccaaaccgctaatacccataacgaaaatcgaccaaactaataaaatcaccaaaccgacaaaacccatcaccaacgaaaaaataattaatacgaaaccgtaccgccgaaaaataccaacgcatccgacaaacgaatattataaaaacgctcatacaacatccaaacgataataccgacgatcaccgcaccgaaaatcccg

SEQ ID NO: 11711 - DNA, 515 bp, Artificial Sequence
  chemically treated genomic DNA (Homo sapiens) CpG-island No: 11711
tgtcgatttttcggattcgcgtattattatatattaacgttgtatttgtagatttttaagaaacgtatttattttattttgttaaaggaaatcgtttcgtttttagaaaaatcgtgagtggtcgggtaatttaattgtttttggaagatggttagtgcgtcgttgacggtttgatcgtagattttttttcgttgttttgcgtcggtaaagcgaattaatgttattagaatgtgatgtagattaaacggtaatagtagacgtttatcggtattaaatagtatcggttcgaaattattcgcgttgtttattatatggtttaagtcgttaatatttatggcgaaaatcggttagattaatggaattattaggtcgataaggtttattattagcgaggagataattggtacgaagtcgtatcgtcgaagaatgttagcgtattcggtaggcggatattatggaaacgtttatgtagtatttagacgataatatcggcgattatcgtatcgaggatttcg

SEQ ID NO: 11712 - DNA, 515 bp, Artificial Sequence
  chemically treated genomic DNA (Homo sapiens) CpG-island No: 11712
cgaaatcctcgatacgataatcgccgatattatcgtctaaatactacataaacgtttccataatatccgcctaccgaatacgctaacattcttcgacgatacgacttcgtaccaattatctcctcgctaataataaaccttatcgacctaataattccattaatctaaccgattttcgccataaatattaacgacttaaaccatataataaacaacgcgaataatttcgaaccgatactatttaataccgataaacgtctactattaccgtttaatctacatcacattctaataacattaattcgctttaccgacgcaaaacaacgaaaaaaaatctacgatcaaaccgtcaacgacgcactaaccatcttccaaaaacaattaaattacccgaccactcacgatttttctaaaaacgaaacgatttcctttaacaaaataaaataaatacgtttcttaaaaatctacaaatacaacgttaatatataataatacgcgaatccgaaaaatcgaca

SEQ ID NO: 11713 - DNA, 985 bp, Artificial Sequence
  chemically treated genomic DNA (Homo sapiens) CpG-island No: 11713
ttggtggaggagatgattggtttacgttttcgtaataaacgcgttagtgttttcggtttttacggttggagcggcggtgcggtggatcgtttttttacgcgtttgtaggatgcgggtttcgaaatgtcgtttagtttgaaagcgaaatggcgattagattaggacgttttgaagttatgtcgtgaatacggtcgcgaaatcgttcgttagtgggcgttcgtcggttgtcgtagagtacggtgaatacggtagttaaagaagaaatttttgttattacgacggttgatttcggtttacggatgtagtgtagcgtttgttagtggatttacgattcggtaaaaggcgagttaatgtaggacgttgcgttaggaacgtcgtggagtgaagtttcggataattttttttgttcggaatgttttttcggtaaagacgttttggaagaattggtatcggaggtaaatgagtaacggtattgtgattatcgttcgggtttttataatgtatgtttgttagtttatatattatcgtcgtatttagttaatttattcgtcgcgaatcggttttttttttattttcgggtaataatacgttatatatgttacgattcggaatggtgtcgtcgttggtaatcgttaataattgagcgttaggtcgggcggttaatatttcggtttttttgttttagattagtttggggcgaaaagtagaaaaatcgttagagggatagcgttcggaaagtatatttagcgtggcgttaaaaatacgttttggtagatttttttacggtgcggtacggcgtacgcgggagtattattcgtttatttgtaatgtatttatcgtcgcggcggtaacggtttgttgcgtaaggacgtcgagaggattatgcggtggtgttaggttttttagtttgtttgcgaatatatattttataatgattgcggaatcgattaaattatatttggcggttttttttggtaatcgttaa

SEQ ID NO: 11714 - DNA, 985 bp, Artificial Sequence
  chemically treated genomic DNA (Homo sapiens) CpG-island No: 11714
ttaacgattaccaaaaaaaaccgccaaatataatttaatcgattccgcaatcattataaaatatatattcgcaaacaaactaaaaaacctaacaccaccgcataatcctctcgacgtccttacgcaacaaaccgttaccgccgcgacgataaatacattacaaataaacgaataatactcccgcgtacgccgtaccgcaccgtaaaaaaatctaccaaaacgtatttttaacgccacgctaaatatactttccgaacgctatccctctaacgatttttctacttttcgccccaaactaatctaaaacaaaaaaaccgaaatattaaccgcccgacctaacgctcaattattaacgattaccaacgacgacaccattccgaatcgtaacatatataacgtattattacccgaaaataaaaaaaaaaccgattcgcgacgaataaattaactaaatacgacgataatatataaactaacaaacatacattataaaaacccgaacgataatcacaataccgttactcatttacctccgataccaattcttccaaaacgtctttaccgaaaaaacattccgaacaaaaaaaattatccgaaacttcactccacgacgttcctaacgcaacgtcctacattaactcgccttttaccgaatcgtaaatccactaacaaacgctacactacatccgtaaaccgaaatcaaccgtcgtaataacaaaaatttcttctttaactaccgtattcaccgtactctacgacaaccgacgaacgcccactaacgaacgatttcgcgaccgtattcacgacataacttcaaaacgtcctaatctaatcgccatttcgctttcaaactaaacgacatttcgaaacccgcatcctacaaacgcgtaaaaaaacgatccaccgcaccgccgctccaaccgtaaaaaccgaaaacactaacgcgtttattacgaaaacgtaaaccaatcatctcctccaccaa

SEQ ID NO: 11715 - DNA, 985 bp, Artificial Sequence
  chemically treated genomic DNA (Homo sapiens) CpG-island No: 11715
ttaacggttgttagaaagagtcgttagatgtgatttagtcgatttcgtagttattgtagagtgtatgttcgtaggtaggttggaaaatttgatattatcgtataattttttcgacgtttttgcgtagtaaatcgttgtcgtcgcggcgatggatgtattataggtagacgaatggtattttcgcgtacgtcgtgtcgtatcgtggaaagatttgttaagacgtgtttttgacgttacgttggatatgtttttcgggcgttatttttttggcgatttttttgtttttcgttttaaattggtttggaatagggagatcgggatattgatcgttcgatttggcgtttaattgttggcggttattagcggcggtattatttcggatcgtggtatgtatagcgtgttattattcgaaggtgaagaaaaggtcggttcgcggcgggtgggttaattggatgcggcgatggtatatgggttggtaggtatgtattgtggaagttcgaacgatgattataatgtcgttatttatttgttttcgatgttagtttttttaagacgtttttgtcgagggagtatttcgggtagaggaagttattcgggattttattttacggcgtttttggcgtaacgttttgtattggttcgttttttgtcggatcgtaaatttattggtagacgttgtattgtattcgtgggtcgaggttagtcgtcgtggtggtagaggttttttttttaattatcgtatttatcgtgttttgcggtagtcggcgagcgtttattgacgggcgatttcgcgatcgtgtttacggtataattttagagcgttttggtttggtcgttatttcgtttttaggttaagcgatatttcgaaattcgtattttgtaggcgcgtggaaagacgatttatcgtatcgtcgttttagtcgtgagagtcgaaagtattggcgcgtttgttacggaagcgtaaattagttattttttttattag

SEQ ID NO: 11716 - DNA, 985 bp, Artificial Sequence
  chemically treated genomic DNA (Homo sapiens) CpG-island No: 11716
ctaataaaaaaaataactaatttacgcttccgtaacaaacgcgccaatactttcgactctcacgactaaaacgacgatacgataaatcgtctttccacgcgcctacaaaatacgaatttcgaaatatcgcttaacctaaaaacgaaataacgaccaaaccaaaacgctctaaaattataccgtaaacacgatcgcgaaatcgcccgtcaataaacgctcgccgactaccgcaaaacacgataaatacgataattaaaaaaaaaacctctaccaccacgacgactaacctcgacccacgaatacaatacaacgtctaccaataaatttacgatccgacaaaaaacgaaccaatacaaaacgttacgccaaaaacgccgtaaaataaaatcccgaataacttcctctacccgaaatactccctcgacaaaaacgtcttaaaaaaactaacatcgaaaacaaataaataacgacattataatcatcgttcgaacttccacaatacatacctaccaacccatataccatcgccgcatccaattaacccacccgccgcgaaccgaccttttcttcaccttcgaataataacacgctatacataccacgatccgaaataataccgccgctaataaccgccaacaattaaacgccaaatcgaacgatcaatatcccgatctccctattccaaaccaatttaaaacgaaaaacaaaaaaatcgccaaaaaaataacgcccgaaaaacatatccaacgtaacgtcaaaaacacgtcttaacaaatctttccacgatacgacacgacgtacgcgaaaataccattcgtctacctataatacatccatcgccgcgacgacaacgatttactacgcaaaaacgtcgaaaaaattatacgataatatcaaattttccaacctacctacgaacatacactctacaataactacgaaatcgactaaatcacatctaacgactctttctaacaaccgttaa

SEQ ID NO: 11717 - DNA, 517 bp, Artificial Sequence
  chemically treated genomic DNA (Homo sapiens) CpG-island No: 11717
gcgatttattgtaacggtgtttagttatttggcgtattttattgttgtttattttttatcgacgtggtgtttaggtcgtcgggttggagtagatgtgttttcgtcgtcgtcgttattttgttggcgcgatttttcgttgtcgtattgacgtatagcgggaatagggcggtcgcggttaattgattgcgtatttaatgttttttttattcgatttttattgattataaaggcgcgattggtttagtatcgttaacgtcgcgcgttattattttttggcgttcggtattaatttgttagcgtaaattttgacgttgggtttcgtttgttagatgtagcggtaatttcggcgttttgatttttattagtatcgtcgggagttttagcggcgtgttattgtcgagaagattttttgttagtattatcgcgttaagttgaatcggttggaggaacggtaatatttgatcgttaattttcgcgtaatcgtttagcgcgtaaatatcggtattattggtttgta

SEQ ID NO: 11718 - DNA, 517 bp, Artificial Sequence
  chemically treated genomic DNA (Homo sapiens) CpG-island No: 11718
tacaaaccaataataccgatatttacgcgctaaacgattacgcgaaaattaacgatcaaatattaccgttcctccaaccgattcaacttaacgcgataatactaacaaaaaatcttctcgacaataacacgccgctaaaactcccgacgatactaataaaaatcaaaacgccgaaattaccgctacatctaacaaacgaaacccaacgtcaaaatttacgctaacaaattaataccgaacgccaaaaaataataacgcgcgacgttaacgatactaaaccaatcgcgcctttataatcaataaaaatcgaataaaaaaaacattaaatacgcaatcaattaaccgcgaccgccctattcccgctatacgtcaatacgacaacgaaaaatcgcgccaacaaaataacgacgacgacgaaaacacatctactccaacccgacgacctaaacaccacgtcgataaaaaataaacaacaataaaatacgccaaataactaaacaccgttacaataaatcgc

SEQ ID NO: 11719 - DNA, 517 bp, Artificial Sequence
  chemically treated genomic DNA (Homo sapiens) CpG-island No: 11719
tgtaaattagtaatatcgatatttacgcgttgggcgattgcgcggaaattaacggttaggtattgtcgtttttttagtcgatttaatttagcgcgatggtgttggtaaaaaattttttcggtaataatacgtcgttgaaattttcggcgatgttggtgaaaattaaaacgtcggaattatcgttgtatttggtaggcgaaatttagcgttaggatttacgttggtaaattaatatcgaacgttagggaatggtggcgcgcggcgttgacgatgttgaattagtcgcgtttttgtggttagtgaggatcggatgaaagaggtattaagtgcgtaattagttaatcgcggtcgttttgttttcgttgtacgttaatgcggtagcgaaagatcgcgttaataaaatggcgacggcgacgaaaatatatttgttttaattcggcggtttgaatattacgtcggtgaaaagtgggtaataatgggatgcgttaaatggttgggtatcgttatagtgggtcgt

SEQ ID NO: 11720 - DNA, 517 bp, Artificial Sequence
  chemically treated genomic DNA (Homo sapiens) CpG-island No: 11720
acgacccactataacgatacccaaccatttaacgcatcccattattacccacttttcaccgacgtaatattcaaaccgccgaattaaaacaaatatattttcgtcgccgtcgccattttattaacgcgatctttcgctaccgcattaacgtacaacgaaaacaaaacgaccgcgattaactaattacgcacttaatacctctttcatccgatcctcactaaccacaaaaacgcgactaattcaacatcgtcaacgccgcgcgccaccattccctaacgttcgatattaatttaccaacgtaaatcctaacgctaaatttcgcctaccaaatacaacgataattccgacgttttaattttcaccaacatcgccgaaaatttcaacgacgtattattaccgaaaaaattttttaccaacaccatcgcgctaaattaaatcgactaaaaaaacgacaatacctaaccgttaatttccgcgcaatcgcccaacgcgtaaatatcgatattactaatttaca

SEQ ID NO: 11721 - DNA, 503 bp, Artificial Sequence
  chemically treated genomic DNA (Homo sapiens) CpG-island No: 11721
atcgcgcgtacgtatcgaagcgtaaatgtacggcggcggttacgagcgcggtatgcgtttcggtattttgtttgtttattagatcgttcggaatggggttaggtttatcgtattttaaaaaaagagatggcgatcgagatggaacgtttgcgcggtttgcgtaatcgtttgtggaacggtattaaagatatcgaagaagtttatttgatcgtggtcgcgtttgtttttttttattcgagtcgtttttttcgttaggataattataaaagcgtatcgtgtcgttttgtttatattgttttagttattttttgacggttattgtagcggtaaaggcggcggtttttagtaaattgtgttcgtaatcgtgattatttttatcgggcgttacggatgtaggttgcgcgtaatttgtttgttgatttaaatttgttagggcgttatatttttttagtagggcgataatcggtttgttttgattaaacgaagtaataaaggtatttggg

SEQ ID NO: 11722 - DNA, 503 bp, Artificial Sequence
  chemically treated genomic DNA (Homo sapiens) CpG-island No: 11722
cccaaatacctttattacttcgtttaatcaaaacaaaccgattatcgccctactaaaaaaatataacgccctaacaaatttaaatcaacaaacaaattacgcgcaacctacatccgtaacgcccgataaaaataatcacgattacgaacacaatttactaaaaaccgccgcctttaccgctacaataaccgtcaaaaaataactaaaacaatataaacaaaacgacacgatacgcttttataattatcctaacgaaaaaaacgactcgaataaaaaaaaacaaacgcgaccacgatcaaataaacttcttcgatatctttaataccgttccacaaacgattacgcaaaccgcgcaaacgttccatctcgatcgccatctctttttttaaaatacgataaacctaaccccattccgaacgatctaataaacaaacaaaataccgaaacgcataccgcgctcgtaaccgccgccgtacatttacgcttcgatacgtacgcgcgat

SEQ ID NO: 11723 - DNA, 503 bp, Artificial Sequence
  chemically treated genomic DNA (Homo sapiens) CpG-island No: 11723
tttaaatgtttttattgtttcgtttggttaaggtaaatcggttatcgttttgttgggagaatatgacgttttggtaggtttaagttagtaagtaggttgcgcgtaatttatattcgtgacgttcggtgaaaatggttacggttgcggatataatttgttgggaatcgtcgtttttgtcgttgtaatagtcgttaagaaatggttggaataatatgggtaaggcggtacggtgcgtttttatggttgttttggcgaagaaggcggttcgggtaaagaggagtaggcgcgattacgattaggtaaattttttcgatatttttgatgtcgttttatagacggttacgtaggtcgcgtagacgttttatttcggtcgttatttttttttttgggatgcgataggtttggttttatttcgaacgatttggtgaataggtagagtgtcggaacgtatatcgcgttcgtgatcgtcgtcgtgtatttgcgtttcgatgcgtacgcgcggt

SEQ ID NO: 11724 - DNA, 503 bp, Artificial Sequence
  chemically treated genomic DNA (Homo sapiens) CpG-island No: 11724
accgcgcgtacgcatcgaaacgcaaatacacgacgacgatcacgaacgcgatatacgttccgacactctacctattcaccaaatcgttcgaaataaaaccaaacctatcgcatcccaaaaaaaaaaataacgaccgaaataaaacgtctacgcgacctacgtaaccgtctataaaacgacatcaaaaatatcgaaaaaatttacctaatcgtaatcgcgcctactcctctttacccgaaccgccttcttcgccaaaacaaccataaaaacgcaccgtaccgccttacccatattattccaaccatttcttaacgactattacaacgacaaaaacgacgattcccaacaaattatatccgcaaccgtaaccattttcaccgaacgtcacgaatataaattacgcgcaacctacttactaacttaaacctaccaaaacgtcatattctcccaacaaaacgataaccgatttaccttaaccaaacgaaacaataaaaacatttaaa

SEQ ID NO: 11725 - DNA, 504 bp, Artificial Sequence
  chemically treated genomic DNA (Homo sapiens) CpG-island No: 11725
cgttttacggatgaaacgcgtttttagtcggcgggtaggttcgacgtttgttggttttatagttttcgttttaggaattcgttcgtttggtgttcggtttttttttttgatcgagtgttggtaggttagttttttatgtttgtaggtttagtcgggtgttcgaaagtaggtgcgagtaaagatcgaaaatagtcgtcgtttttttttgtgtatcggcggtaaagcgtttgttgtagcggcgaaattcgtttgtcgttttttttagcgtttcggttagtcgttcgcgttttagagtcggatttagcgttgatgtttgatatatttgttttattaaaggtaacgtggtattttgttagttttcggtaatcgttatattaggtgttgtcggtaatgcgcggattcgcgtttggcgatattgtttaaataaggtagttaattgcgattgagaaagaatagttgttatttgggtggtaagcgttattaggaaggattttttattttcgt

SEQ ID NO: 11726 - DNA, 504 bp, Artificial Sequence
  chemically treated genomic DNA (Homo sapiens) CpG-island No: 11726
acgaaaataaaaaatccttcctaataacgcttaccacccaaataacaactattctttctcaatcgcaattaactaccttatttaaacaatatcgccaaacgcgaatccgcgcattaccgacaacacctaatataacgattaccgaaaactaacaaaataccacgttacctttaataaaacaaatatatcaaacatcaacgctaaatccgactctaaaacgcgaacgactaaccgaaacgctaaaaaaaacgacaaacgaatttcgccgctacaacaaacgctttaccgccgatacacaaaaaaaaacgacgactattttcgatctttactcgcacctactttcgaacacccgactaaacctacaaacataaaaaactaacctaccaacactcgatcaaaaaaaaaaaccgaacaccaaacgaacgaattcctaaaacgaaaactataaaaccaacaaacgtcgaacctacccgccgactaaaaacgcgtttcatccgtaaaacg

SEQ ID NO: 11727 - DNA, 504 bp, Artificial Sequence
  chemically treated genomic DNA (Homo sapiens) CpG-island No: 11727
acgaaagtgaagaattttttttggtgacgtttgttatttagatggtagttatttttttttagtcgtagttgattgttttgtttgggtaatatcgttagacgcgaattcgcgtattatcggtagtatttggtgtggcgattgtcgaaggttggtaggatgttacgttatttttaatggaataggtgtattaggtattaacgttggattcggttttggaacgcgaacgattgatcggggcgttggaagaagcggtaaacgagtttcgtcgttatagtaaacgttttgtcgtcggtgtataaaaagaaacggcggttattttcgatttttattcgtatttgttttcggatattcggttggatttgtaggtatgaaagattaatttattagtattcggttagagagaagggtcgggtattaagcggacggatttttgaaacgggggttataaagttaataaacgtcggatttattcgtcgattgaagacgcgttttattcgtagagcg

SEQ ID NO: 11728 - DNA, 504 bp, Artificial Sequence
  chemically treated genomic DNA (Homo sapiens) CpG-island No: 11728
cgctctacgaataaaacgcgtcttcaatcgacgaataaatccgacgtttattaactttataacccccgtttcaaaaatccgtccgcttaatacccgacccttctctctaaccgaatactaataaattaatctttcatacctacaaatccaaccgaatatccgaaaacaaatacgaataaaaatcgaaaataaccgccgtttctttttatacaccgacgacaaaacgtttactataacgacgaaactcgtttaccgcttcttccaacgccccgatcaatcgttcgcgttccaaaaccgaatccaacgttaatacctaatacacctattccattaaaaataacgtaacatcctaccaaccttcgacaatcgccacaccaaatactaccgataatacgcgaattcgcgtctaacgatattacccaaacaaaacaatcaactacgactaaaaaaaaataactaccatctaaataacaaacgtcaccaaaaaaaattcttcactttcgt

SEQ ID NO: 11729 - DNA, 631 bp, Artificial Sequence
  chemically treated genomic DNA (Homo sapiens) CpG-island No: 11729
ggtcgtcgttttataaatagcgaaatagtcgttattatgattacggtttttttggtcgtcgttttataattaggaaatatttttttttatgttttcggtttttttgttcgtttttttataatcgggaaattttttgttttttttttcgggtttttttggttcgttttttaagaaacggaatttttcgttttttttttttcggtttttttgtttcgtttttttttaatttggaaaatttttttttttttttttcggtttttttgttcggttttttttcggcggggaatttttttttttttttttcggtttttttcgttcggttttttttaatcgggaaatttttttttttttgtttttcgtttttttttttttttttttttcgagggggaatttttttttttcgttttttcggtttttcgtttcgtttttttttttcggggggaattttttttttcgttttttcggttttttcgttcgtttttttttacgaggaaaattttttttttttttttttcgttttttttttttttttttttttcggggaaaaatttttttttcgttttttttttttttttttttttttttttttaggggaaatttttttttcgttttttttttttttggttttttt

SEQ ID NO: 11730 - DNA, 631 bp, Artificial Sequence
  chemically treated genomic DNA (Homo sapiens) CpG-island No: 11730
aaaaaaaccaaaaaaaaaaaaaacgaaaaaaaaatttcccctaaaaaaaaaaaaaaaaaaaaaaaaaaaaaacgaaaaaaaaatttttccccgaaaaaaaaaaaaaaaaaaaaaacgaaaaaaaaaaaaaaaaaattttcctcgtaaaaaaaaacgaacgaaaaaaccgaaaaaacgaaaaaaaaaattccccccgaaaaaaaaaaacgaaacgaaaaaccgaaaaaacgaaaaaaaaaaattccccctcgaaaaaaaaaaaaaaaaaaaaacgaaaaacaaaaaaaaaaaaatttcccgattaaaaaaaaccgaacgaaaaaaaccgaaaaaaaaaaaaaaaaattccccgccgaaaaaaaaccgaacaaaaaaaccgaaaaaaaaaaaaaaaaattttccaaattaaaaaaaaacgaaacaaaaaaaccgaaaaaaaaaaaacgaaaaattccgtttcttaaaaaacgaaccaaaaaaacccgaaaaaaaaaacaaaaaatttcccgattataaaaaaacgaacaaaaaaaccgaaaacataaaaaaaaatatttcctaattataaaacgacgaccaaaaaaaccgtaatcataataacgactatttcgctatttataaaacgacgacc

SEQ ID NO: 11731 - DNA, 631 bp, Artificial Sequence
  chemically treated genomic DNA (Homo sapiens) CpG-island No: 11731
aaaagggttaaaaaaagggaaaacggggggggggttttttttgaaaaaaaaggggggaaaaaaagggaaaaacggggggggggttttttttcggaaaaaaaagggggggaaaaaacgggaaaaggggggggggggtttttttcgtgaaaaaaaacgggcggaaaaatcggaaaaacgggggggggggtttttttcgggaaaaaaaagcggggcggaaaatcgggaaaacggggggggggggttttttttcggaaaaaaaggggggggaaaaacgggaaataggggggggggggtttttcgattggaaaaagtcgggcgagaaaaatcgaaaaaagggggggggggtttttcgtcgggaaaaagtcgggtagaaaaatcggaaaaaaggggggggggttttttagattggaaaaaaacggggtagagaaatcggaaaaagggggacggggggtttcgttttttaaaaaacgggttagagaaattcgaaaaagggggtagggggtttttcgattgtaaaaaaacgggtagggaaatcggaaatatggggaggggtgttttttgattgtaaaacggcggttagggaaatcgtaattatggtgacggttgtttcgttgtttgtaaaacgacggtt

SEQ ID NO: 11732 - DNA, 631 bp, Artificial Sequence
  chemically treated genomic DNA (Homo sapiens) CpG-island No: 11732
aaccgtcgttttacaaacaacgaaacaaccgtcaccataattacgatttccctaaccgccgttttacaatcaaaaaacacccctccccatatttccgatttccctacccgtttttttacaatcgaaaaaccccctaccccctttttcgaatttctctaacccgttttttaaaaaacgaaaccccccgtccccctttttccgatttctctaccccgtttttttccaatctaaaaaaccccccccccttttttccgatttttctacccgactttttcccgacgaaaaacccccccccccttttttcgatttttctcgcccgactttttccaatcgaaaaacccccccccccctatttcccgtttttcccccccctttttttccgaaaaaaaaccccccccccccgttttcccgattttccgccccgcttttttttcccgaaaaaaacccccccccccgtttttccgatttttccgcccgttttttttcacgaaaaaaaccccccccccccttttcccgttttttcccccccttttttttccgaaaaaaaaccccccccccgtttttccctttttttccccccttttttttcaaaaaaaaccccccccccgttttccctttttttaaccctttt

SEQ ID NO: 11733 - DNA, 1161 bp, Artificial Sequence
  chemically treated genomic DNA (Homo sapiens) CpG-island No: 11733
cgttacgtgatgcgatcgggtttcgtttcggcggtaatacgttgtatagacgcgtcgggtgtttcgtgcgtatgcgcggtaggtttttcgggacgagttggaggtagagcgtgagtataaagtgatcggtttcggtcgtacgtagtagtttttttatttttcggttaagttagggttttttttttttcgcggagtcgtaattacgggtagttcgtgtaggtaacggtaggtttaggttttcgtatgagcggagggtttttcgcgcgattttgaatggttcgggcgcgcgcggtcgtgtgggagttgtagtttttcgttttcgttcgcgcggatttcgtttttcgtggtgtttcgggcggttcgttttcggcgtagttagttacgagtcggcgtacgcggtttcggttcggttgattttgcggagttatggagggcggtttcggtttcgatttcgggggtttcggtagcgggaagttggatttagggtttataatggagtaggtgaaagtgtagatcgtcgtggttaacgcgtaggagttgttgtaggtgcggggttggtcggggacgggcgttgggggcgatagggttatttttgggggtcgacgtcgcggttaaagtttcgcgtgtttttatagaggatgacggataagtgttttcggaagtgtatagggaaatttgggggttttttggataatttcgagtaggtgagattcgcggaggttcggggtaagggtcgcgagggtttagattcgaggggggaggtgtttgcgcgtgcgtagattaacggggaggtgcgacggagtggttattgtacgtgcgtagtttgtagttcgggcgttttggagtcggggttagggcggttttcggggtcgcgaagtttcgagttgagtcgtgcgttttttcgttttcgtagaagtgtatcgttatgtgtatggatcgttatatggacgtttggaatatcgtgtttcgcgtttataattcgcggttgtagcgggaacgagttaatatgtgatcggcgagcgcgggttattttattttgtttatttttataaacgtgttttgagaggcggggttcgtatgtacgtattgtttgttcggggtttaggagggtggtatcggtgttgggatatacgggattgtgttttcgttatttttcgtttt

SEQ ID NO: 11734 - DNA, 1161 bp, Artificial Sequence
  chemically treated genomic DNA (Homo sapiens) CpG-island No: 11734
aaaacgaaaaataacgaaaacacaatcccgtatatcccaacaccgataccaccctcctaaaccccgaacaaacaatacgtacatacgaaccccgcctctcaaaacacgtttataaaaataaacaaaataaaataacccgcgctcgccgatcacatattaactcgttcccgctacaaccgcgaattataaacgcgaaacacgatattccaaacgtccatataacgatccatacacataacgatacacttctacgaaaacgaaaaaacgcacgactcaactcgaaacttcgcgaccccgaaaaccgccctaaccccgactccaaaacgcccgaactacaaactacgcacgtacaataaccactccgtcgcacctccccgttaatctacgcacgcgcaaacacctcccccctcgaatctaaaccctcgcgacccttaccccgaacctccgcgaatctcacctactcgaaattatccaaaaaacccccaaatttccctatacacttccgaaaacacttatccgtcatcctctataaaaacacgcgaaactttaaccgcgacgtcgacccccaaaaataaccctatcgcccccaacgcccgtccccgaccaaccccgcacctacaacaactcctacgcgttaaccacgacgatctacactttcacctactccattataaaccctaaatccaacttcccgctaccgaaacccccgaaatcgaaaccgaaaccgccctccataactccgcaaaatcaaccgaaccgaaaccgcgtacgccgactcgtaactaactacgccgaaaacgaaccgcccgaaacaccacgaaaaacgaaatccgcgcgaacgaaaacgaaaaactacaactcccacacgaccgcgcgcgcccgaaccattcaaaatcgcgcgaaaaaccctccgctcatacgaaaacctaaacctaccgttacctacacgaactacccgtaattacgactccgcgaaaaaaaaaaaaccctaacttaaccgaaaaataaaaaaactactacgtacgaccgaaaccgatcactttatactcacgctctacctccaactcgtcccgaaaaacctaccgcgcatacgcacgaaacacccgacgcgtctatacaacgtattaccgccgaaacgaaacccgatcgcatcacgtaacg

SEQ ID NO: 11735 - DNA, 1161 bp, Artificial Sequence
  chemically treated genomic DNA (Homo sapiens) CpG-island No: 11735
agggcggggggtggcgaggatatagtttcgtgtgttttagtatcggtgttatttttttaagtttcgggtaggtagtacgtatatgcggatttcgttttttaaagtacgtttatggaaatgaatagggtggggtggttcgcgttcgtcggttatatgttggttcgttttcgttgtagtcgcgagttgtaggcgcgagatacggtgttttaggcgtttatgtagcggtttatgtatatggcgatgtatttttgcgggagcggaggggcgtacggtttagttcgggatttcgcggtttcggggatcgttttgatttcggttttaggacgttcgggttgtagattacgtacgtgtagtgattatttcgtcgtattttttcgttagtttgcgtacgcgtagatattttttttttcgaatttaggttttcgcgatttttgtttcgaattttcgcgggttttatttgttcggagttgtttagggagtttttaggtttttttatatattttcggaaatatttgttcgttattttttgtggagatacgcgaggttttagtcgcgacgtcggtttttaggggtggttttgtcgtttttagcgttcgttttcggttagtttcgtatttgtagtagtttttgcgcgttggttacggcgatttgtatttttatttgttttattatgagttttgggtttagtttttcgttgtcggagttttcgaaatcggagtcgaagtcgttttttatggtttcgtaaagttaatcggatcgaggtcgcgtgcgtcgattcgtaattaattgcgtcggaagcgggtcgttcggggtattacgggaaacggagttcgcgcggacggggacggaggattataatttttatacgatcgcgcgcgttcgggttatttaaggtcgcgcggggggtttttcgtttatgcggaggtttggatttgtcgttatttatacgagttattcgtggttgcgatttcgcgggaagagggaggttttgatttggtcggggagtaggggggttattacgtgcggtcgaggtcgattattttgtatttacgttttgtttttagttcgtttcgaagggtttgtcgcgtatgcgtacgaggtattcggcgcgtttatatagcgtgttgtcgtcggggcggagttcggtcgtattacgtgacg

SEQ ID NO: 11736 - DNA, 1161 bp, Artificial Sequence
  chemically treated genomic DNA (Homo sapiens) CpG-island No: 11736
cgtcacgtaatacgaccgaactccgccccgacgacaacacgctatataaacgcgccgaatacctcgtacgcatacgcgacaaacccttcgaaacgaactaaaaacaaaacgtaaatacaaaataatcgacctcgaccgcacgtaataacccccctactccccgaccaaatcaaaacctccctcttcccgcgaaatcgcaaccacgaataactcgtataaataacgacaaatccaaacctccgcataaacgaaaaaccccccgcgcgaccttaaataacccgaacgcgcgcgatcgtataaaaattataatcctccgtccccgtccgcgcgaactccgtttcccgtaataccccgaacgacccgcttccgacgcaattaattacgaatcgacgcacgcgacctcgatccgattaactttacgaaaccataaaaaacgacttcgactccgatttcgaaaactccgacaacgaaaaactaaacccaaaactcataataaaacaaataaaaatacaaatcgccgtaaccaacgcgcaaaaactactacaaatacgaaactaaccgaaaacgaacgctaaaaacgacaaaaccacccctaaaaaccgacgtcgcgactaaaacctcgcgtatctccacaaaaaataacgaacaaatatttccgaaaatatataaaaaaacctaaaaactccctaaacaactccgaacaaataaaacccgcgaaaattcgaaacaaaaatcgcgaaaacctaaattcgaaaaaaaaaatatctacgcgtacgcaaactaacgaaaaaatacgacgaaataatcactacacgtacgtaatctacaacccgaacgtcctaaaaccgaaatcaaaacgatccccgaaaccgcgaaatcccgaactaaaccgtacgcccctccgctcccgcaaaaatacatcgccatatacataaaccgctacataaacgcctaaaacaccgtatctcgcgcctacaactcgcgactacaacgaaaacgaaccaacatataaccgacgaacgcgaaccaccccaccctattcatttccataaacgtactttaaaaaacgaaatccgcatatacgtactacctacccgaaacttaaaaaaataacaccgatactaaaacacacgaaactatatcctcgccaccccccgccct

SEQ ID NO: 11737 - DNA, 531 bp, Artificial Sequence
  chemically treated genomic DNA (Homo sapiens) CpG-island No: 11737
gaagcggcggtaggtttgttcgttgaggaggcgtacggtcgttttttgtagttgtcgcgttatggagtttgcgggcgggcgagcgagacggggcgggtggggatcgcgttcggtcgtttttcgagtttcgtattatcgcggtttcgggcgcgtttatttttttcgcgtatcgagttttagtcggtgatgacgtagcgcgtgtcgttcgggggtcgcggcgcgggttcgggtaggtagatgggacgtattaggcggttgcgacgtatcggtttcgttagttttagtagcgttacgtcgtagtcgagcgtgtagagattgtagaacgggtgtttgtagatgcgcgttacgcgttttagttgttttttcgcgtcgtttaggaacggcgtgtttaggaaggtcgtttattgtttggggttttcgtagttgcggggcgcgcgaggataggcgtcggttcgagtttttacgttttcggttttcgtttttgtggtgttttttagcggtcggttggtattttgggtagggttattggtt

SEQ ID NO: 11738 - DNA, 531 bp, Artificial Sequence
  chemically treated genomic DNA (Homo sapiens) CpG-island No: 11738
aaccaataaccctacccaaaataccaaccgaccgctaaaaaacaccacaaaaacgaaaaccgaaaacgtaaaaactcgaaccgacgcctatcctcgcgcgccccgcaactacgaaaaccccaaacaataaacgaccttcctaaacacgccgttcctaaacgacgcgaaaaaacaactaaaacgcgtaacgcgcatctacaaacacccgttctacaatctctacacgctcgactacgacgtaacgctactaaaactaacgaaaccgatacgtcgcaaccgcctaatacgtcccatctacctacccgaacccgcgccgcgacccccgaacgacacgcgctacgtcatcaccgactaaaactcgatacgcgaaaaaaataaacgcgcccgaaaccgcgataatacgaaactcgaaaaacgaccgaacgcgatccccacccgccccgtctcgctcgcccgcccgcaaactccataacgcgacaactacaaaaaacgaccgtacgcctcctcaacgaacaaacctaccgccgcttc

SEQ ID NO: 11739 - DNA, 531 bp, Artificial Sequence
  chemically treated genomic DNA (Homo sapiens) CpG-island No: 11739
ggttaataattttgtttagggtgttagtcggtcgttgggggatattataggggcgggggtcgggggcgtgggggttcgggtcgacgtttgttttcgcgcgtttcgtagttacggggattttaagtagtgggcggtttttttaggtacgtcgtttttgagcggcgcggaggggtagttggagcgcgtggcgcgtatttataagtattcgttttataatttttatacgttcgattacgacgtggcgttgttggagttggcggggtcggtgcgtcgtagtcgtttggtgcgttttatttgtttgttcgagttcgcgtcgcgattttcggacggtacgcgttgcgttattatcggttggggttcggtgcgcgaaggaggtaggcgcgttcggggtcgcggtggtgcggggttcggggggcggtcggacgcggtttttattcgtttcgtttcgttcgttcgttcgtaggttttatggcgcggtagttgtagaaggcggtcgtgcgtttttttagcgagtagatttgtcgtcgtttt

SEQ ID NO: 11740 - DNA, 531 bp, Artificial Sequence
  chemically treated genomic DNA (Homo sapiens) CpG-island No: 11740
aaaacgacgacaaatctactcgctaaaaaaacgcacgaccgccttctacaactaccgcgccataaaacctacgaacgaacgaacgaaacgaaacgaataaaaaccgcgtccgaccgccccccgaaccccgcaccaccgcgaccccgaacgcgcctacctccttcgcgcaccgaaccccaaccgataataacgcaacgcgtaccgtccgaaaatcgcgacgcgaactcgaacaaacaaataaaacgcaccaaacgactacgacgcaccgaccccgccaactccaacaacgccacgtcgtaatcgaacgtataaaaattataaaacgaatacttataaatacgcgccacgcgctccaactacccctccgcgccgctcaaaaacgacgtacctaaaaaaaccgcccactacttaaaatccccgtaactacgaaacgcgcgaaaacaaacgtcgacccgaacccccacgcccccgacccccgcccctataatatcccccaacgaccgactaacaccctaaacaaaattattaacc

SEQ ID NO: 11741 - DNA, 793 bp, Artificial Sequence
  chemically treated genomic DNA (Homo sapiens) CpG-island No: 11741
cgtttcggtcgcgcgtattttgggcgtgatacgagcgcggcgtcgcgtgaatcggttacgatgggtagcgaggtttgcgtcgataggaagtcgaggatgggcgcgacgggggcggtcgtaagtcgttttcgaagatttacgtcgtgtaggcgtaattttcgatagtaggttcgtagagttagtagtacgaggttgcgcgggttcgagtcgttgagtacgtagcgttacgggtcgtacgtttgaggtatcgggtgcgtattagtcgtcgttacggttagggtttaggcgtgtcgttttacgggcgtacgcgggtttcgagaatacgagcgttacgttgagcggtcgcgtttcgtcgaggtcgttagtcgggtttatcggtttcgttcggtttcggcgtttttttcgggaacgggttggcgtaggttagcgttagtagtagtagtattttagcggggtttcgagggtcgcgggggttatcggcgtcgcgtatcgtttgcgggtttcgtcgggcggtttttgagcgttcgggtcgggagagacggggaggagagggaggtatagacgggagacgtagggatagggagacgagataaagagacgtatagaggaggagatgtagcgagggataggcgtcgagatggggaggatagggagcggtcggggtgatggaatagagggagagataggaacggaggacgagagagatggaagggagagagatagagggagagagaaatggaggagagatagagggagagacgggtagaggtagagagagatggaggggagagag

SEQ ID NO: 11742 - DNA, 793 bp, Artificial Sequence
  chemically treated genomic DNA (Homo sapiens) CpG-island No: 11742
ctctctcccctccatctctctctacctctacccgtctctccctctatctctcctccatttctctctccctctatctctctcccttccatctctctcgtcctccgttcctatctctccctctattccatcaccccgaccgctccctatcctccccatctcgacgcctatccctcgctacatctcctcctctatacgtctctttatctcgtctccctatccctacgtctcccgtctatacctccctctcctccccgtctctcccgacccgaacgctcaaaaaccgcccgacgaaacccgcaaacgatacgcgacgccgataacccccgcgaccctcgaaaccccgctaaaatactactactactaacgctaacctacgccaacccgttcccgaaaaaaacgccgaaaccgaacgaaaccgataaacccgactaacgacctcgacgaaacgcgaccgctcaacgtaacgctcgtattctcgaaacccgcgtacgcccgtaaaacgacacgcctaaaccctaaccgtaacgacgactaatacgcacccgatacctcaaacgtacgacccgtaacgctacgtactcaacgactcgaacccgcgcaacctcgtactactaactctacgaacctactatcgaaaattacgcctacacgacgtaaatcttcgaaaacgacttacgaccgcccccgtcgcgcccatcctcgacttcctatcgacgcaaacctcgctacccatcgtaaccgattcacgcgacgccgcgctcgtatcacgcccaaaatacgcgcgaccgaaacg

SEQ ID NO: 11743 - DNA, 793 bp, Artificial Sequence
  chemically treated genomic DNA (Homo sapiens) CpG-island No: 11743
tttttttttttttatttttttttatttttgttcgtttttttttttgttttttttttatttttttttttttttgttttttttttttttatttttttcgtttttcgtttttgtttttttttttgttttattatttcgatcgttttttgttttttttatttcggcgtttgtttttcgttgtatttttttttttgtgcgtttttttatttcgtttttttgtttttgcgtttttcgtttgtgtttttttttttttttcgtttttttcggttcgggcgtttagaggtcgttcggcggggttcgtaggcgatgcgcggcgtcggtggttttcgcggttttcggggtttcgttaagatgttgttgttgttggcgttggtttgcgttagttcgttttcggaggaggcgtcggggtcgggcggggtcggtgggttcggttggcggtttcggcggggcgcggtcgtttaacgtggcgttcgtgttttcggggttcgcgtacgttcgtagagcggtacgtttgggttttggtcgtggcggcggttggtgcgtattcggtgttttagacgtgcggttcgtggcgttgcgtgtttaacggttcggattcgcgtagtttcgtgttgttagttttgcgagtttgttgtcgggggttgcgtttgtacggcgtgggttttcgaagacgatttgcggtcgttttcgtcgcgtttattttcgattttttgtcggcgtagatttcgttgtttatcgtggtcggtttacgcggcgtcgcgttcgtgttacgtttaaggtgcgcgcgatcggggcg

SEQ ID NO: 11744 - DNA, 793 bp, Artificial Sequence
  chemically treated genomic DNA (Homo sapiens) CpG-island No: 11744
cgccccgatcgcgcgcaccttaaacgtaacacgaacgcgacgccgcgtaaaccgaccacgataaacaacgaaatctacgccgacaaaaaatcgaaaataaacgcgacgaaaacgaccgcaaatcgtcttcgaaaacccacgccgtacaaacgcaacccccgacaacaaactcgcaaaactaacaacacgaaactacgcgaatccgaaccgttaaacacgcaacgccacgaaccgcacgtctaaaacaccgaatacgcaccaaccgccgccacgaccaaaacccaaacgtaccgctctacgaacgtacgcgaaccccgaaaacacgaacgccacgttaaacgaccgcgccccgccgaaaccgccaaccgaacccaccgaccccgcccgaccccgacgcctcctccgaaaacgaactaacgcaaaccaacgccaacaacaacaacatcttaacgaaaccccgaaaaccgcgaaaaccaccgacgccgcgcatcgcctacgaaccccgccgaacgacctctaaacgcccgaaccgaaaaaaacgaaaaaaaaaaaaaaacacaaacgaaaaacgcaaaaacaaaaaaacgaaataaaaaaacgcacaaaaaaaaaaatacaacgaaaaacaaacgccgaaataaaaaaaacaaaaaacgatcgaaataataaaacaaaaaaaaaaacaaaaacgaaaaacgaaaaaaataaaaaaaaaaaaaacaaaaaaaaaaaaaaataaaaaaaaaacaaaaaaaaaaacgaacaaaaataaaaaaaaataaaaaaaaaaaaa

SEQ ID NO: 11745 - DNA, 522 bp, Artificial Sequence
  chemically treated genomic DNA (Homo sapiens) CpG-island No: 11745
agaagtcgaaggcgtttgcggaaagttggggacgggttggcgaagaagacgggcgaggagggcggcgaacgcgggcggcggggcgcgcgcggggttaggggttcgggtaggaacgtttcgtttttagtcgttatcgttatcgggaaggttattagttgtagtttcgggatgcggtttaggtcgcgcggtcgcgttatggtcgcggggcggtttcgtttcggcgggcgttggggagttgcgtcgtttatttcgttaggtttacgtaggtcgtttgtttagtttcgggttcgcgggttttatttcgttttgtcgtttcggttttttcggtttcgcgttggagtcgtttttagggcggggcgggtttggggcgttcgtacggttttggtggggattttttcgtagattttaaagtcgttcgcgttggttttaatgtttttataatcgtcggacgcgtttttataaatattagggatatttttaaatttgtggggatatttttgtaaatttttcgtggtgttgata

SEQ ID NO: 11746 - DNA, 522 bp, Artificial Sequence
  chemically treated genomic DNA (Homo sapiens) CpG-island No: 11746
tatcaacaccacgaaaaatttacaaaaatatccccacaaatttaaaaatatccctaatatttataaaaacgcgtccgacgattataaaaacattaaaaccaacgcgaacgactttaaaatctacgaaaaaatccccaccaaaaccgtacgaacgccccaaacccgccccgccctaaaaacgactccaacgcgaaaccgaaaaaaccgaaacgacaaaacgaaataaaacccgcgaacccgaaactaaacaaacgacctacgtaaacctaacgaaataaacgacgcaactccccaacgcccgccgaaacgaaaccgccccgcgaccataacgcgaccgcgcgacctaaaccgcatcccgaaactacaactaataaccttcccgataacgataacgactaaaaacgaaacgttcctacccgaacccctaaccccgcgcgcgccccgccgcccgcgttcgccgccctcctcgcccgtcttcttcgccaacccgtccccaactttccgcaaacgccttcgacttct

SEQ ID NO: 11747 - DNA, 522 bp, Artificial Sequence
  chemically treated genomic DNA (Homo sapiens) CpG-island No: 11747
tgttaatattacggggagtttgtaggagtgtttttatagatttgggggtgtttttggtgtttgtggggacgcgttcggcgattgtgaggatattagagttaacgcgggcggttttggggtttgcgggagagtttttattagagtcgtgcgggcgttttagattcgtttcgttttgggggcggttttagcgcgaagtcggaagggtcgaggcgatagggcggggtggggttcgcgggttcggggttgggtaggcggtttgcgtgggtttggcggggtgggcggcgtagttttttagcgttcgtcgaggcggggtcgtttcgcggttatggcgcggtcgcgcggtttaggtcgtatttcggagttgtaattggtggttttttcggtggcggtggcggttgaggacgaggcgtttttgttcgagtttttggtttcgcgcgcgtttcgtcgttcgcgttcgtcgtttttttcgttcgtttttttcgttagttcgtttttaatttttcgtagacgttttcggttttt

SEQ ID NO: 11748 - DNA, 522 bp, Artificial Sequence
  chemically treated genomic DNA (Homo sapiens) CpG-island No: 11748
aaaaaccgaaaacgtctacgaaaaattaaaaacgaactaacgaaaaaaacgaacgaaaaaaacgacgaacgcgaacgacgaaacgcgcgcgaaaccaaaaactcgaacaaaaacgcctcgtcctcaaccgccaccgccaccgaaaaaaccaccaattacaactccgaaatacgacctaaaccgcgcgaccgcgccataaccgcgaaacgaccccgcctcgacgaacgctaaaaaactacgccgcccaccccgccaaacccacgcaaaccgcctacccaaccccgaacccgcgaaccccaccccgccctatcgcctcgacccttccgacttcgcgctaaaaccgcccccaaaacgaaacgaatctaaaacgcccgcacgactctaataaaaactctcccgcaaaccccaaaaccgcccgcgttaactctaatatcctcacaatcgccgaacgcgtccccacaaacaccaaaaacacccccaaatctataaaaacactcctacaaactccccgtaatattaaca

SEQ ID NO: 11749 - DNA, 856 bp, Artificial Sequence
  chemically treated genomic DNA (Homo sapiens) CpG-island No: 11749
ggcgcgtcgttttcggtttcggttcggtcgcgttgtcgtcggtttttgaattagttgttgatttgcgtgagcgataggtcggtgagtgtggttaggcggcgtttttcgttcggcgtggggtagcggttgtcgcggtagtaggttttgagcgttgcgcgggagcgttttttgaagtagtagattgttttttcgtcgttttagatggttttgggtagcgggaattttttgcgtagtcgatatttgtttattgcgttaagcgcgcggtcgcgggttcgttcggttttatggtagcgcgcgcgtaggtagaggttttgtaggaaggcgtggtgggcggcggggaaggggcggttttcgagtagtcggtagagttcggcgtattcgtttcgttggaaggttattagggttcgcgcgcgtaatatcgggtcgttgttacgtaggcgttcggtcgggggtagtgcgtttaggaagcggtttaagcggtcggcgtggttcgtttggagtagcgtttcgtagacgtacgttatttgttcgggcgagaagcggaggttcgtgggcggttcggaagcggtttcggggggcgattcggggacgttcggggatttcgggtttttagttttcgtagtcgttgcgttcgtttcggtttcggtcgtcgtcgtcgttttattttcggtcgtttgtaaagtttgtaagagttggcgcgttttttttttttttttttcggtcgtcgtcgtcgtcgttatcgttttttttttagtcgtcggtttcgcgttcggtttcgtaggtaaggtagttatgttttgtaattttgggaagtttttttttttttttttttttttttcgggttttttttagtttt

SEQ ID NO: 11750 - DNA, 856 bp, Artificial Sequence
  chemically treated genomic DNA (Homo sapiens) CpG-island No: 11750
aaaactaaaaaaaacccgaaaaaaaaaaaaaaaaaaaaaaaaacttcccaaaattacaaaacataactaccttacctacgaaaccgaacgcgaaaccgacgactaaaaaaaaaacgataacgacgacgacgacgaccgaaaaaaaaaaaaaaaaaacgcgccaactcttacaaactttacaaacgaccgaaaataaaacgacgacgacgaccgaaaccgaaacgaacgcaacgactacgaaaactaaaaacccgaaatccccgaacgtccccgaatcgccccccgaaaccgcttccgaaccgcccacgaacctccgcttctcgcccgaacaaataacgtacgtctacgaaacgctactccaaacgaaccacgccgaccgcttaaaccgcttcctaaacgcactacccccgaccgaacgcctacgtaacaacgacccgatattacgcgcgcgaaccctaataaccttccaacgaaacgaatacgccgaactctaccgactactcgaaaaccgccccttccccgccgcccaccacgccttcctacaaaacctctacctacgcgcgcgctaccataaaaccgaacgaacccgcgaccgcgcgcttaacgcaataaacaaatatcgactacgcaaaaaattcccgctacccaaaaccatctaaaacgacgaaaaaacaatctactacttcaaaaaacgctcccgcgcaacgctcaaaacctactaccgcgacaaccgctaccccacgccgaacgaaaaacgccgcctaaccacactcaccgacctatcgctcacgcaaatcaacaactaattcaaaaaccgacgacaacgcgaccgaaccgaaaccgaaaacgacgcgcc

SEQ ID NO: 11751 - DNA, 856 bp, Artificial Sequence
  chemically treated genomic DNA (Homo sapiens) CpG-island No: 11751
gaggttggggaaagttcgagggaggaagagagggagggaggaattttttaaagttgtaaaatatggttattttgtttgcggagtcgagcgcggggtcggcggttgggggggaggcggtggcggcggcggcggcgatcgaagaggaggaggaggaagcgcgttagtttttgtagattttgtaggcggtcgagggtgaggcggcggcggcggtcggggtcggggcgggcgtagcggttgcgggagttgagggttcgggattttcgggcgttttcgggtcgtttttcgaggtcgttttcgaatcgtttacgggttttcgtttttcgttcgagtaggtggcgtgcgtttgcgaggcgttgttttaggcgggttacgtcggtcgtttgagtcgttttttgggcgtattgttttcggtcgagcgtttacgtggtagcgattcggtgttgcgcgcgcgggttttggtggttttttagcggggcgagtacgtcgagttttatcggttattcgagagtcgtttttttttcgtcgtttattacgtttttttgtaggatttttatttgcgcgcgcgttattatgaggtcgagcgggttcgcggtcgcgcgtttggcgtagtggataagtatcgattgcgtaagaagttttcgttgtttaagattatttgggacggcgaggagatagtttattgttttaaggagcgttttcgcgtagcgtttaaggtttgttatcgcggtaatcgttattttacgtcggacgagaagcgtcgtttggttatatttatcggtttgtcgtttacgtaggttagtaattggtttaagaatcggcgatagcgcgatcggatcggggtcggaggcggcgcgtt

SEQ ID NO: 11752 - DNA, 856 bp, Artificial Sequence
  chemically treated genomic DNA (Homo sapiens) CpG-island No: 11752
aacgcgccgcctccgaccccgatccgatcgcgctatcgccgattcttaaaccaattactaacctacgtaaacgacaaaccgataaatataaccaaacgacgcttctcgtccgacgtaaaataacgattaccgcgataacaaaccttaaacgctacgcgaaaacgctccttaaaacaataaactatctcctcgccgtcccaaataatcttaaacaacgaaaacttcttacgcaatcgatacttatccactacgccaaacgcgcgaccgcgaacccgctcgacctcataataacgcgcgcgcaaataaaaatcctacaaaaaaacgtaataaacgacgaaaaaaaaacgactctcgaataaccgataaaactcgacgtactcgccccgctaaaaaaccaccaaaacccgcgcgcgcaacaccgaatcgctaccacgtaaacgctcgaccgaaaacaatacgcccaaaaaacgactcaaacgaccgacgtaacccgcctaaaacaacgcctcgcaaacgcacgccacctactcgaacgaaaaacgaaaacccgtaaacgattcgaaaacgacctcgaaaaacgacccgaaaacgcccgaaaatcccgaaccctcaactcccgcaaccgctacgcccgccccgaccccgaccgccgccgccgcctcaccctcgaccgcctacaaaatctacaaaaactaacgcgcttcctcctcctcctcttcgatcgccgccgccgccgccaccgcctcccccccaaccgccgaccccgcgctcgactccgcaaacaaaataaccatattttacaactttaaaaaattcctccctccctctcttcctccctcgaactttccccaacctc

SEQ ID NO: 11753 - DNA, 508 bp, Artificial Sequence
  chemically treated genomic DNA (Homo sapiens) CpG-island No: 11753
gggcggggaacgggttagaaagtttgtagtaatttttttcgagtttgcgttttaggagcggatgcgcgtggcgtgcgtaggcgtagtggaaggaggatggtcgcgcgcgttgttagtttagtttttttttttcgacgttcggtggtatagttgggttatagttgggcgggggcggtgttttcgggtggttcgttcgtttttttattggtcggacgttaaagtttcgtttcgtggtttttttttttttaattttgattcggtcgtttcgtatttcgttagttttttttagattttcggtcgtttttatacgttttcggattggttcgttgcggagttttcggtttataacgtaaatcgcggatattgtggagtttagagttttgggtagatggagggttttttattcgcgagggtcgggggtgggggtttaggtggggatagataataaatatcgaggaatgtcggggttttagtgtatttaaaacgtggattggggttgttgggggtt

SEQ ID NO: 11754 - DNA, 508 bp, Artificial Sequence
  chemically treated genomic DNA (Homo sapiens) CpG-island No: 11754
aacccccaacaaccccaatccacgttttaaatacactaaaaccccgacattcctcgatatttattatctatccccacctaaacccccacccccgaccctcgcgaataaaaaaccctccatctacccaaaactctaaactccacaatatccgcgatttacgttataaaccgaaaactccgcaacgaaccaatccgaaaacgtataaaaacgaccgaaaatctaaaaaaaactaacgaaatacgaaacgaccgaatcaaaattaaaaaaaaaaaaaccacgaaacgaaactttaacgtccgaccaataaaaaaacgaacgaaccacccgaaaacaccgcccccgcccaactataacccaactataccaccgaacgtcgaaaaaaaaaaactaaactaacaacgcgcgcgaccatcctccttccactacgcctacgcacgccacgcgcatccgctcctaaaacgcaaactcgaaaaaaattactacaaactttctaacccgttccccgccc

SEQ ID NO: 11755 - DNA, 508 bp, Artificial Sequence
  chemically treated genomic DNA (Homo sapiens) CpG-island No: 11755
gatttttaataattttaatttacgttttggatgtattgagatttcgatatttttcggtatttattgtttgtttttatttagatttttattttcgattttcgcgaataaaaggttttttatttgtttaaagttttggattttatagtgttcgcggtttgcgttgtgggtcggaggtttcgtagcgggttaattcggaggcgtgtggaggcggtcgaaggtttgggaggagttagcgggatgcgaagcggtcgaattagggttgggggaggaaaagttacggggcggggttttggcgttcggttaataggagggcgagcgggttattcggaggtatcgttttcgtttagttgtggtttagttgtgttatcgagcgtcgagaagagggggttgggttggtagcgcgcgcggttattttttttttattgcgtttgcgtacgttacgcgtattcgtttttgggacgtaagttcgagaaaagttgttgtaaattttttagttcgtttttcgttt

SEQ ID NO: 11756 - DNA, 508 bp, Artificial Sequence
  chemically treated genomic DNA (Homo sapiens) CpG-island No: 11756
aaacgaaaaacgaactaaaaaatttacaacaacttttctcgaacttacgtcccaaaaacgaatacgcgtaacgtacgcaaacgcaataaaaaaaaaataaccgcgcgcgctaccaacccaaccccctcttctcgacgctcgataacacaactaaaccacaactaaacgaaaacgatacctccgaataacccgctcgccctcctattaaccgaacgccaaaaccccgccccgtaacttttcctcccccaaccctaattcgaccgcttcgcatcccgctaactcctcccaaaccttcgaccgcctccacacgcctccgaattaacccgctacgaaacctccgacccacaacgcaaaccgcgaacactataaaatccaaaactttaaacaaataaaaaaccttttattcgcgaaaatcgaaaataaaaatctaaataaaaacaaacaataaataccgaaaaatatcgaaatctcaatacatccaaaacgtaaattaaaattattaaaaatc

SEQ ID NO: 11757 - DNA, 747 bp, Artificial Sequence
  chemically treated genomic DNA (Homo sapiens) CpG-island No: 11757
tacggtttaagttgaagtagacgcggttttttttcgagtttagtttcgcgggcgtggcgggcggtttttcggtttcggcgttgttcggtttttcgaggcgtacgaggttgaggcgtacggcgggtagggcgggttcgggttcggggtttgcgggcggcggggacgacgcggggtttgtagcgtcgggatcggaggcggaggtagggtcgggcgggggttgcggtggttgaggcggtatcggagtttgggcggaagtcggattcgatttgcgagcggcgtcgtcgttcgggagtagtttgtagaaattttcgcgcgtgcggaattgcgatttaattttcgcgtagttttttatggcggcgtcggggttcgagtcgtttttcgcgtcgttcgtcgttattttgggcgtttttcgggtttcgttattgtcggattgtcgttcgtagtcgggttttttttcggaagtcgttggttcgcgtcggaaaaggtggggtcgtcgttcgggtaacgttttttcgattggtatttagattcggaggcgggacgaattttcgcggtcgttcgggtaacggtgttgggattgtgggcggggcgagaaggtgggcgcggtttttgagtttgtgatcgatttgtggttggttgcgggggcggagttcgtaatggaaagaggcgtggttagttagaaagtttaagtttttagtaatcgcgttttgggaacgtttgtttagtaacggagggattttttttttt

SEQ ID NO: 11758 - DNA, 747 bp, Artificial Sequence
  chemically treated genomic DNA (Homo sapiens) CpG-island No: 11758
aaaaaaaaaaatccctccgttactaaacaaacgttcccaaaacgcgattactaaaaacttaaactttctaactaaccacgcctctttccattacgaactccgcccccgcaaccaaccacaaatcgatcacaaactcaaaaaccgcgcccaccttctcgccccgcccacaatcccaacaccgttacccgaacgaccgcgaaaattcgtcccgcctccgaatctaaataccaatcgaaaaaacgttacccgaacgacgaccccaccttttccgacgcgaaccaacgacttccgaaaaaaaacccgactacgaacgacaatccgacaataacgaaacccgaaaaacgcccaaaataacgacgaacgacgcgaaaaacgactcgaaccccgacgccgccataaaaaactacgcgaaaattaaatcgcaattccgcacgcgcgaaaatttctacaaactactcccgaacgacgacgccgctcgcaaatcgaatccgacttccgcccaaactccgataccgcctcaaccaccgcaacccccgcccgaccctacctccgcctccgatcccgacgctacaaaccccgcgtcgtccccgccgcccgcaaaccccgaacccgaacccgccctacccgccgtacgcctcaacctcgtacgcctcgaaaaaccgaacaacgccgaaaccgaaaaaccgcccgccacgcccgcgaaactaaactcgaaaaaaaaccgcgtctacttcaacttaaaccgta

SEQ ID NO: 11759 - DNA, 747 bp, Artificial Sequence
  chemically treated genomic DNA (Homo sapiens) CpG-island No: 11759
aaaaaaaaaaattttttcgttgttaggtaaacgtttttagggcgcggttgttaaggatttgagttttttaattggttacgtttttttttattgcgggtttcgttttcgtagttaattataagtcggttataggtttaaaggtcgcgtttattttttcgtttcgtttatagttttagtatcgttattcgagcgatcgcggggattcgtttcgttttcggatttgggtgttaatcgaagaggcgttgttcgggcgacgattttatttttttcggcgcgggttagcggttttcgggagggggttcggttgcgggcggtagttcggtagtggcggggttcggggggcgtttaagatggcggcgggcggcgcggagggcggttcgggtttcggcgtcgttatgggggattgcgcggagattaagtcgtaatttcgtacgcgcgagggtttttataagttattttcgggcgacggcgtcgttcgtaggtcgggttcggttttcgtttagatttcggtgtcgttttagttatcgtagttttcgttcggttttgttttcgttttcggtttcggcgttgtaggtttcgcgtcgttttcgtcgttcgtaggtttcggattcgggttcgttttgttcgtcgtgcgttttagtttcgtgcgtttcggggagtcggatagcgtcggggtcggggagtcgttcgttacgttcgcggggttgggttcggggggagatcgcgtttgttttaatttgggtcgtg

SEQ ID NO: 11760 - DNA, 747 bp, Artificial Sequence
  chemically treated genomic DNA (Homo sapiens) CpG-island No: 11760
cacgacccaaattaaaacaaacgcgatctccccccgaacccaaccccgcgaacgtaacgaacgactccccgaccccgacgctatccgactccccgaaacgcacgaaactaaaacgcacgacgaacaaaacgaacccgaatccgaaacctacgaacgacgaaaacgacgcgaaacctacaacgccgaaaccgaaaacgaaaacaaaaccgaacgaaaactacgataactaaaacgacaccgaaatctaaacgaaaaccgaacccgacctacgaacgacgccgtcgcccgaaaataacttataaaaaccctcgcgcgtacgaaattacgacttaatctccgcgcaatcccccataacgacgccgaaacccgaaccgccctccgcgccgcccgccgccatcttaaacgccccccgaaccccgccactaccgaactaccgcccgcaaccgaaccccctcccgaaaaccgctaacccgcgccgaaaaaaataaaatcgtcgcccgaacaacgcctcttcgattaacacccaaatccgaaaacgaaacgaatccccgcgatcgctcgaataacgatactaaaactataaacgaaacgaaaaaataaacgcgacctttaaacctataaccgacttataattaactacgaaaacgaaacccgcaataaaaaaaaacgtaaccaattaaaaaactcaaatccttaacaaccgcgccctaaaaacgtttacctaacaacgaaaaaattttttttttt

SEQ ID NO: 11761 - DNA, 560 bp, Artificial Sequence
  chemically treated genomic DNA (Homo sapiens) CpG-island No: 11761
ttagtacggggatgttttcgaagttcgggtttttttcgtaggagtcgcgtttagtattatttttttttttttcgtcgtttttttttttattaaattggtagaagtttagcgggttgatttgcgtggcggtcgagatgcgggttatttgggttcgtaggtagttggtttcgttgttcgggaagggtgggtagttgacgattggcgtgtttaggtagtttgtgaagaattttttgatttttcgggcgtttacgatttgggttggagtgacgtggggtagtcgcgtttatggtaggttcggttcgttgtatataaagtataggtatttgttggcgtttgagcggtttttttttttggggattacgggcggcggtttttatacggatttagggacgatgtttacggtttttttttcgtttttttcgttttttttttcgtcgtgcgtttttatgatttcgttatttttcgttattttttttattttttttttttttgtttttttttcgttttttcggaattttatttcggttattaggtagttgcgtttgatttttaggattttg

SEQ ID NO: 11762 - DNA, 560 bp, Artificial Sequence
  chemically treated genomic DNA (Homo sapiens) CpG-island No: 11762
caaaatcctaaaaatcaaacgcaactacctaataaccgaaataaaattccgaaaaaacgaaaaaaaaacaaaaaaaaaaaaaataaaaaaaataacgaaaaataacgaaatcataaaaacgcacgacgaaaaaaaaaacgaaaaaaacgaaaaaaaaaccgtaaacatcgtccctaaatccgtataaaaaccgccgcccgtaatccccaaaaaaaaaaaccgctcaaacgccaacaaatacctatactttatatacaacgaaccgaacctaccataaacgcgactaccccacgtcactccaacccaaatcgtaaacgcccgaaaaatcaaaaaattcttcacaaactacctaaacacgccaatcgtcaactacccacccttcccgaacaacgaaaccaactacctacgaacccaaataacccgcatctcgaccgccacgcaaatcaacccgctaaacttctaccaatttaataaaaaaaaaaacgacgaaaaaaaaaaaaataatactaaacgcgactcctacgaaaaaaacccgaacttcgaaaacatccccgtactaa

SEQ ID NO: 11763 - DNA, 560 bp, Artificial Sequence
  chemically treated genomic DNA (Homo sapiens) CpG-island No: 11763
taagattttgggaattaaacgtagttatttggtggtcgaggtggaatttcgggagggcgaggaggaggtagaggaggaggaggtggaggagatgacggaaggtggcgaggttatggaggcgtacggcgaggaggagggcgaggaggacgaggagaaggtcgtggatatcgtttttaagttcgtatggaagtcgtcgttcgtgatttttaaggaggagagtcgtttaggcgttaataagtatttgtattttgtgtgtaacgagtcgggtttgttatggacgcggttgttttacgttattttagtttagatcgtgaacgttcgaaagattaagaagttttttataggttatttggatacgttagtcgttagttatttatttttttcgggtaacgaggttaattatttgcgggtttagatagttcgtatttcggtcgttacgtaggttagttcgttgggtttttattagtttagtgaggaggagggcgacgaggaggaggaaggtggtgttgggcgcgatttttacgaggagaattcggatttcgagggtattttcgtgttgg

SEQ ID NO: 11764 - DNA, 560 bp, Artificial Sequence
  chemically treated genomic DNA (Homo sapiens) CpG-island No: 11764
ccaacacgaaaataccctcgaaatccgaattctcctcgtaaaaatcgcgcccaacaccaccttcctcctcctcgtcgccctcctcctcactaaactaataaaaacccaacgaactaacctacgtaacgaccgaaatacgaactatctaaacccgcaaataattaacctcgttacccgaaaaaaataaataactaacgactaacgtatccaaataacctataaaaaacttcttaatctttcgaacgttcacgatctaaactaaaataacgtaaaacaaccgcgtccataacaaacccgactcgttacacacaaaatacaaatacttattaacgcctaaacgactctcctccttaaaaatcacgaacgacgacttccatacgaacttaaaaacgatatccacgaccttctcctcgtcctcctcgccctcctcctcgccgtacgcctccataacctcgccaccttccgtcatctcctccacctcctcctcctctacctcctcctcgccctcccgaaattccacctcgaccaccaaataactacgtttaattcccaaaatctta

SEQ ID NO: 11765 - DNA, 853 bp, Artificial Sequence
  chemically treated genomic DNA (Homo sapiens) CpG-island No: 11765
  misc_feature (799)..(799): n is either a, c, g or t
  misc_feature (804)..(807): n is either a, c, g or t
  misc_feature (810)..(810): n is either a, c, g or t
  misc_feature (816)..(816): n is either a, c, g or t
  misc_feature (828)..(828): n is either a, c, g or t
  misc_feature (830)..(830): n is either a, c, g or t
  misc_feature (833)..(833): n is either a, c, g or t
ttagcggcgtttatatatttatcgtcgtatgcgcgtatcgttcgcggttcgggtggagcggttttcggggatatagtttggggattcgtacgttttttaggttcgcggtttcgggcgcgttttttcgtaggcggggcgcgggtggacgtcgtgggagtcgtttaattttttttttttcggtttttttggggcgcgtttttttcgggcgtttttcgttttttttttttttcgtttcgtcgtttttttggggtttacgtttttttttattcgttttttttgtttttttgcgtttagattttggttttgcggtttattttattcgtcgcgtcgtagggcggaggatgtttgggtgcgtgggaggggggcgtttcgcggttattcggggagtttttttagatgcggagtttcgcgcgtcggggttatttcggggcgggtttcggatacgttagaggttatcgaggagttttgaggatatcggtttggcgcgtagttcggttttttataggggatttaagaaaggtttttcgcgggttcggatttttaggtttcgtcgcgtcgatcggtttttcgggaggcggtatttgaagtcgttgtacgggtggatgatttaggttttcgtcgatttgacgcgtttttgttcgcgatttacggtttattggttgtcgaatattcgtagcgagaatttgttgacgttcggttgtaggagcgcgtcgaattggcgttgtatgaagttggtttggtagtcgcgcggatttttcgtcgggttcgttttttcgatgttaggattattcgtaggttntgttnnnnaangtcgtngttgaatgtaantnttnaataaattttaaaattttaa

SEQ ID NO: 11766 - DNA, 853 bp, Artificial Sequence
  chemically treated genomic DNA (Homo sapiens) CpG-island No: 11766
  misc_feature (21)..(21): n is either a, c, g or t
  misc_feature (24)..(24): n is either a, c, g or t
  misc_feature (26)..(26): n is either a, c, g or t
  misc_feature (38)..(38): n is either a, c, g or t
  misc_feature (44)..(44): n is either a, c, g or t
  misc_feature (47)..(50): n is either a, c, g or t
  misc_feature (55)..(55): n is either a, c, g or t
ttaaaattttaaaatttattnaananttacattcaacnacgacnttnnnnaacanaacctacgaataatcctaacatcgaaaaaacgaacccgacgaaaaatccgcgcgactaccaaaccaacttcatacaacgccaattcgacgcgctcctacaaccgaacgtcaacaaattctcgctacgaatattcgacaaccaataaaccgtaaatcgcgaacaaaaacgcgtcaaatcgacgaaaacctaaatcatccacccgtacaacgacttcaaataccgcctcccgaaaaaccgatcgacgcgacgaaacctaaaaatccgaacccgcgaaaaacctttcttaaatcccctataaaaaaccgaactacgcgccaaaccgatatcctcaaaactcctcgataacctctaacgtatccgaaacccgccccgaaataaccccgacgcgcgaaactccgcatctaaaaaaactccccgaataaccgcgaaacgcccccctcccacgcacccaaacatcctccgccctacgacgcgacgaataaaataaaccgcaaaaccaaaatctaaacgcaaaaaaacaaaaaaaacgaataaaaaaaaacgtaaaccccaaaaaaacgacgaaacgaaaaaaaaaaaaaacgaaaaacgcccgaaaaaaacgcgccccaaaaaaaccgaaaaaaaaaaaattaaacgactcccacgacgtccacccgcgccccgcctacgaaaaaacgcgcccgaaaccgcgaacctaaaaaacgtacgaatccccaaactatatccccgaaaaccgctccacccgaaccgcgaacgatacgcgcatacgacgataaatatataaacgccgctaa

SEQ ID NO: 11767 - DNA, 853 bp, Artificial Sequence
  chemically treated genomic DNA (Homo sapiens) CpG-island No: 11767
  misc_feature (21)..(21): n is either a, c, g or t
  misc_feature (24)..(24): n is either a, c, g or t
  misc_feature (26)..(26): n is either a, c, g or t
  misc_feature (38)..(38): n is either a, c, g or t
  misc_feature (44)..(44): n is either a, c, g or t
  misc_feature (47)..(50): n is either a, c, g or t
  misc_feature (55)..(55): n is either a, c, g or t
ttggggttttggggtttattnggnanttgtatttagtngcggtnttnnnnagtanggtttgcggatagttttggtatcgaggaggcgggttcggcgggggattcgcgcggttgttaggttagttttatgtagcgttagttcggcgcgtttttgtagtcgggcgttaataagttttcgttgcggatgttcggtagttagtaggtcgtggatcgcgagtaggagcgcgttaagtcggcgggggtttggattatttattcgtatagcgattttaggtatcgtttttcggagggtcggtcggcgcgacggggtttggggattcgggttcgcggggagttttttttggattttttgtggagggtcgggttgcgcgttaggtcggtgtttttagggtttttcggtgatttttggcgtgttcgggattcgtttcggagtgatttcggcgcgcgaggtttcgtatttgggggggtttttcgggtgatcgcggagcgttttttttttacgtatttagatatttttcgttttgcggcgcggcgggtggggtgggtcgtagggttagggtttgagcgtagaggggtagagaggacgaatagaggggaacgtgggttttagagaggcggcggagcgggagggaggaggaacgaagggcgttcgggaaggacgcgttttagggaggtcgggggagagggggttaagcggtttttacggcgtttattcgcgtttcgtttgcgaggaggcgcgttcggggtcgcgggtttggaaagcgtgcgggtttttaggttgtgttttcgggagtcgttttattcgagtcgcgggcggtgcgcgtatgcggcggtgggtgtgtagacgtcgttga

SEQ ID NO: 11768 - DNA, 853 bp, Artificial Sequence
  chemically treated genomic DNA (Homo sapiens) CpG-island No: 11768
  misc_feature (799)..(799): n is either a, c, g or t
  misc_feature (804)..(807): n is either a, c, g or t
  misc_feature (810)..(810): n is either a, c, g or t
  misc_feature (816)..(816): n is either a, c, g or t
  misc_feature (828)..(828): n is either a, c, g or t
  misc_feature (830)..(830): n is either a, c, g or t
  misc_feature (833)..(833): n is either a, c, g or t
tcaacgacgtctacacacccaccgccgcatacgcgcaccgcccgcgactcgaataaaacgactcccgaaaacacaacctaaaaacccgcacgctttccaaacccgcgaccccgaacgcgcctcctcgcaaacgaaacgcgaataaacgccgtaaaaaccgcttaaccccctctcccccgacctccctaaaacgcgtccttcccgaacgcccttcgttcctcctccctcccgctccgccgcctctctaaaacccacgttcccctctattcgtcctctctacccctctacgctcaaaccctaaccctacgacccaccccacccgccgcgccgcaaaacgaaaaatatctaaatacgtaaaaaaaaaacgctccgcgatcacccgaaaaacccccccaaatacgaaacctcgcgcgccgaaatcactccgaaacgaatcccgaacacgccaaaaatcaccgaaaaaccctaaaaacaccgacctaacgcgcaacccgaccctccacaaaaaatccaaaaaaaactccccgcgaacccgaatccccaaaccccgtcgcgccgaccgaccctccgaaaaacgatacctaaaatcgctatacgaataaataatccaaacccccgccgacttaacgcgctcctactcgcgatccacgacctactaactaccgaacatccgcaacgaaaacttattaacgcccgactacaaaaacgcgccgaactaacgctacataaaactaacctaacaaccgcgcgaatcccccgccgaacccgcctcctcgataccaaaactatccgcaaaccntactnnnnaanaccgcnactaaatacaantnccnaataaaccccaaaaccccaa

SEQ ID NO: 11769 - DNA, 723 bp, Artificial Sequence
  chemically treated genomic DNA (Homo sapiens) CpG-island No: 11769
ttttttcgcgtttattttttttttttttcgtttttttttttattttttttttgtttttttttgggttttattttatatttttagttatttttttcgtgttttcgcgtttttttttcgttttttttttttttttttttttcgtttattttttttcgttttttttttttttttttatcgtgtttttttattttttttttttttgtttttcgtttcgttttttttgtcgtttttttattttttgttttttttttttttttttcgtttttttttttcgtcgttttatttttttttttatttttttgttttttttttttcgcgtcgtttttttttttttttttttttttttttttttcgttttttagtatttttttcgtatttttttcgttttttcgttgtcgttttttttttttcgtttttttttttttttttttttcgtttattttttttttatttttgttttttttttcgttttttttgttcgtttgtttattcgttttttttttttttgttttttttttttttttttttatttttttttttttacgttttttgtttttattggttgtttggtcgtcgtattgatagaatttagagtcggtttcgttttttacggtatatgggcgcgaatcgttgataagttggtattaatcgatagtaaaggtgaaaagttatattatcgggcgaaaggcgatgcgttggagatgttcgatcgtgaaggtaatt

SEQ ID NO: 11770 - DNA, 723 bp, Artificial Sequence
  chemically treated genomic DNA (Homo sapiens) CpG-island No: 11770
aattaccttcacgatcgaacatctccaacgcatcgcctttcgcccgataatataacttttcacctttactatcgattaataccaacttatcaacgattcgcgcccatataccgtaaaaaacgaaaccgactctaaattctatcaatacgacgaccaaacaaccaataaaaacaaaaaacgtaaaaaaaaaaaaataaaaaaaaaaaaaaaaaaaacaaaaaaaaaaaaaacgaataaacaaacgaacaaaaaaaacgaaaaaaaaaacaaaaataaaaaaaaaataaacgaaaaaaaaaaaaaaaaaaaaacgaaaaaaaaaaaacgacaacgaaaaaacgaaaaaaatacgaaaaaaatactaaaaaacgaaaaaaaaaaaaaaaaaaaaaaaaaaaaaaacgacgcgaaaaaaaaaaaacaaaaaaataaaaaaaaaaataaaacgacgaaaaaaaaaaacgaaaaaaaaaaaaaaaaaacaaaaaataaaaaaacgacaaaaaaaacgaaacgaaaaacaaaaaaaaaaaaaataaaaaaacacgataaaaaaaaaaaaaaaaaacgaaaaaaaataaacgaaaaaaaaaaaaaaaaaaaaaacgaaaaaaaaacgcgaaaacacgaaaaaaataactaaaaatataaaataaaacccaaaaaaaaacaaaaaaaaaataaaaaaaaaaacgaaaaaaaaaaaaaataaacgcgaaaaaa

SEQ ID NO: 11771 - DNA, 723 bp, Artificial Sequence
  chemically treated genomic DNA (Homo sapiens) CpG-island No: 11771
gattgtttttacgatcgagtatttttagcgtatcgtttttcgttcgataatatgattttttatttttgttgtcggttaatattagtttgttagcggttcgcgtttatgtatcgtaggaagcggagtcgattttaggttttgttaatacgacggttaggtaattagtgaaagtaaaagacgtggagaggaggggatgagggagaaagaagaggaagtaaggagaagagaagcgggtgggtaagcgggtagggaggacgagaaggggaataagagtggaaagagagtgggcgagaagaggaagaggggggagacggggggaaggaggcggtagcggggagacgaaaggagtgcggggaaagtgttgggagacgaggaggagggaagagagggaaagagggaggacggcgcgaaggggaggaaatagaagagtggagaggagagtggagcgacgaaggaggggagcgggggggaggggggaggagtaggaagtgggaagacggtagagagagcgaggcggggagtaaaagagggagaagtggaggggtacggtgggagggaggagagagaacgaggaggagtggacgaggagggagagggagagaggagcgaagggggggcgcgaagatacgaggagagtaattggggatgtggagtaggatttagggagaagtagagagagagtggggggagaagcgaagggagggagggataagcgcggggggg

SEQ ID NO: 11772 - DNA, 723 bp, Artificial Sequence
  chemically treated genomic DNA (Homo sapiens) CpG-island No: 11772
cccccccgcgcttatccctccctcccttcgcttctccccccactctctctctacttctccctaaatcctactccacatccccaattactctcctcgtatcttcgcgcccccccttcgctcctctctccctctccctcctcgtccactcctcctcgttctctctcctccctcccaccgtacccctccacttctccctcttttactccccgcctcgctctctctaccgtcttcccacttcctactcctcccccctcccccccgctcccctccttcgtcgctccactctcctctccactcttctatttcctccccttcgcgccgtcctccctctttccctctcttccctcctcctcgtctcccaacactttccccgcactcctttcgtctccccgctaccgcctccttccccccgtctcccccctcttcctcttctcgcccactctctttccactcttattccccttctcgtcctccctacccgcttacccacccgcttctcttctccttacttcctcttctttctccctcatcccctcctctccacgtcttttactttcactaattacctaaccgtcgtattaacaaaacctaaaatcgactccgcttcctacgatacataaacgcgaaccgctaacaaactaatattaaccgacaacaaaaataaaaaatcatattatcgaacgaaaaacgatacgctaaaaatactcgatcgtaaaaacaatc

SEQ ID NO: 11773 - DNA, 700 bp, Artificial Sequence
  chemically treated genomic DNA (Homo sapiens) CpG-island No: 11773
gttttcgtagggtcgtttttaataataacgtgagcgtggtttacgagtgtttgagcgtcggcgggcgtaggaagaggtcggggttggacgggcgtatttatagcgagttgtttaggcgtatttgtcgggacggttaagttttcgaggaggtggtggcgtcgttgttgcgtaaggtgtagtgtcgtgattacgaggcggtgtcgttgagcgtttttcgcgcgggtatatttatttgtttcgtgttgttggagttcgtggcgcgcgtcggcgcgtttttttagttgttggaggattcggtcgtcgtcgtggtcgatcgtcgcgtgggttaggtcgtgttggatattttggagggcgcgttgtaggttagcgacgtcgtcgcgttcgcgcgttttttggaggtcggttcgcgtttggggttcgatagtttggcgttggcgttggatcgcgtcgtcggggggcggcggtttagcgcgtttatgattcgcgaggagtttttggagagggtcgtcgcgttttttatcgcgaaggttaagtcggtgggttgaggttcgtgggtcgcgcggattcgggatttgcgttggggggttttcgcgtgcggggcgcgcggagtttttttttcgttttggtgaggttttgttataattaggcgtttagttttgcggaggaggtcggggtttttaggaagcggacgttcggtttt

SEQ ID NO: 11774 - DNA, 700 bp, Artificial Sequence
  chemically treated genomic DNA (Homo sapiens) CpG-island No: 11774
aaaaccgaacgtccgcttcctaaaaaccccgacctcctccgcaaaactaaacgcctaattataacaaaacctcaccaaaacgaaaaaaaaactccgcgcgccccgcacgcgaaaaccccccaacgcaaatcccgaatccgcgcgacccacgaacctcaacccaccgacttaaccttcgcgataaaaaacgcgacgaccctctccaaaaactcctcgcgaatcataaacgcgctaaaccgccgccccccgacgacgcgatccaacgccaacgccaaactatcgaaccccaaacgcgaaccgacctccaaaaaacgcgcgaacgcgacgacgtcgctaacctacaacgcgccctccaaaatatccaacacgacctaacccacgcgacgatcgaccacgacgacgaccgaatcctccaacaactaaaaaaacgcgccgacgcgcgccacgaactccaacaacacgaaacaaataaatatacccgcgcgaaaaacgctcaacgacaccgcctcgtaatcacgacactacaccttacgcaacaacgacgccaccacctcctcgaaaacttaaccgtcccgacaaatacgcctaaacaactcgctataaatacgcccgtccaaccccgacctcttcctacgcccgccgacgctcaaacactcgtaaaccacgctcacgttattattaaaaacgaccctacgaaaac

SEQ ID NO: 11775 - DNA, 700 bp, Artificial Sequence
  chemically treated genomic DNA (Homo sapiens) CpG-island No: 11775
gggatcgggcgttcgttttttgggagtttcggtttttttcgtagggttgggcgtttggttatggtagggttttattagggcgaagggaaggtttcgcgcgtttcgtacgcggggattttttagcgtagatttcggattcgcgcggtttacgggttttagtttatcggtttgattttcgcgatgaagagcgcggcggttttttttagaaatttttcgcgggttatgggcgcgttgggtcgtcgtttttcgacggcgcggtttagcgttagcgttaggttgtcgggttttaagcgcgagtcggtttttaggaagcgcgcgggcgcggcggcgtcgttggtttgtagcgcgttttttagggtgtttagtacggtttggtttacgcggcggtcggttacggcggcggtcgagttttttagtagttggaagagcgcgtcggcgcgcgttacgaattttagtagtacgaagtaggtgagtgtgttcgcgcggaagacgtttagcggtatcgtttcgtggttacggtattgtattttgcgtagtagcggcgttattattttttcgggggtttggtcgtttcggtagatgcgtttgagtagttcgttgtaggtgcgttcgtttagtttcggtttttttttgcgttcgtcggcgtttaggtattcgtaggttacgtttacgttgttgttgaaggcggttttgcggagat

SEQ ID NO: 11776 - DNA, 700 bp, Artificial Sequence
  chemically treated genomic DNA (Homo sapiens) CpG-island No: 11776
atctccgcaaaaccgccttcaacaacaacgtaaacgtaacctacgaatacctaaacgccgacgaacgcaaaaaaaaaccgaaactaaacgaacgcacctacaacgaactactcaaacgcatctaccgaaacgaccaaacccccgaaaaaataataacgccgctactacgcaaaatacaataccgtaaccacgaaacgataccgctaaacgtcttccgcgcgaacacactcacctacttcgtactactaaaattcgtaacgcgcgccgacgcgctcttccaactactaaaaaactcgaccgccgccgtaaccgaccgccgcgtaaaccaaaccgtactaaacaccctaaaaaacgcgctacaaaccaacgacgccgccgcgcccgcgcgcttcctaaaaaccgactcgcgcttaaaacccgacaacctaacgctaacgctaaaccgcgccgtcgaaaaacgacgacccaacgcgcccataacccgcgaaaaatttctaaaaaaaaccgccgcgctcttcatcgcgaaaatcaaaccgataaactaaaacccgtaaaccgcgcgaatccgaaatctacgctaaaaaatccccgcgtacgaaacgcgcgaaaccttcccttcgccctaataaaaccctaccataaccaaacgcccaaccctacgaaaaaaaccgaaactcccaaaaaacgaacgcccgatccc

SEQ ID NO: 11777 - DNA, 527 bp, Artificial Sequence
  chemically treated genomic DNA (Homo sapiens) CpG-island No: 11777
gtgagtacgggtcgggggtttagtattttcggtgagtacgggtcgagggtttagtagtaatttcggtgagtacgggtcgggggtttagtattttagtgagtacgggtcgggggttcggtatttttagtgagtacgggtcgggtgtttcgtagtattttcggtgagtacgggtcgggggtttagtagtattttcggtgagtacgggtcgggggtttagtattttcggtgagtacgggtcgggggtttagtagtattttcggtgagtacgggtcgggggtttagtagtattttcggtgagtacgggtcgggggtttagtatttttagtgagtacgggtcgggggtttcgtagtattttcggtgagtacgggtcgggggtttagcggtattttcggtgagtacgggtcgggggtttagcggtattttcggtgagtacgggtcgggggtttagcggtattttcggtgagtacgggttgggggttgagtaataggatataaaatataggagagtcgggcgcggtggtttacg

SEQ ID NO: 11778 - DNA, 527 bp, Artificial Sequence
  chemically treated genomic DNA (Homo sapiens) CpG-island No: 11778
cgtaaaccaccgcgcccgactctcctatattttatatcctattactcaacccccaacccgtactcaccgaaaataccgctaaacccccgacccgtactcaccgaaaataccgctaaacccccgacccgtactcaccgaaaataccgctaaacccccgacccgtactcaccgaaaatactacgaaacccccgacccgtactcactaaaaatactaaacccccgacccgtactcaccgaaaatactactaaacccccgacccgtactcaccgaaaatactactaaacccccgacccgtactcaccgaaaatactaaacccccgacccgtactcaccgaaaatactactaaacccccgacccgtactcaccgaaaatactacgaaacacccgacccgtactcactaaaaataccgaacccccgacccgtactcactaaaatactaaacccccgacccgtactcaccgaaattactactaaaccctcgacccgtactcaccgaaaatactaaacccccgacccgtactcac

SEQ ID NO: 11779 - DNA, 527 bp, Artificial Sequence
  chemically treated genomic DNA (Homo sapiens) CpG-island No: 11779
cgtgagttatcgcgttcggtttttttgtgttttgtgttttgttgtttagtttttagttcgtgtttatcggaaatgtcgttgagttttcggttcgtgtttatcggaaatgtcgttgagttttcggttcgtgtttatcggaaatgtcgttgagttttcggttcgtgtttatcggaaatgttgcggagttttcggttcgtgtttattggaaatgttgagttttcggttcgtgtttatcggaaatgttgttgagttttcggttcgtgtttatcggaaatgttgttgagttttcggttcgtgtttatcggaaatgttgagttttcggttcgtgtttatcggaaatgttgttgagttttcggttcgtgtttatcggaaatgttgcggagtattcggttcgtgtttattggaaatgtcgagttttcggttcgtgtttattgaaatgttgagttttcggttcgtgtttatcggaattgttgttgagttttcggttcgtgtttatcggaaatgttgagttttcggttcgtgtttat

SEQ ID NO: 11780 - DNA, 527 bp, Artificial Sequence
  chemically treated genomic DNA (Homo sapiens) CpG-island No: 11780
ataaacacgaaccgaaaactcaacatttccgataaacacgaaccgaaaactcaacaacaattccgataaacacgaaccgaaaactcaacatttcaataaacacgaaccgaaaactcgacatttccaataaacacgaaccgaatactccgcaacatttccgataaacacgaaccgaaaactcaacaacatttccgataaacacgaaccgaaaactcaacatttccgataaacacgaaccgaaaactcaacaacatttccgataaacacgaaccgaaaactcaacaacatttccgataaacacgaaccgaaaactcaacatttccaataaacacgaaccgaaaactccgcaacatttccgataaacacgaaccgaaaactcaacgacatttccgataaacacgaaccgaaaactcaacgacatttccgataaacacgaaccgaaaactcaacgacatttccgataaacacgaactaaaaactaaacaacaaaacacaaaacacaaaaaaaccgaacgcgataactcacg

SEQ ID NO: 11781 - DNA, 1127 bp, Artificial Sequence
  chemically treated genomic DNA (Homo sapiens) CpG-island No: 11781
atcgaggtagcgtcgcgtttggaagttaggtttgcggatttcgtttcgttttcgtttttttttttttttcgcgtggttagcgcgattttaggatagatttcgcgttcgttttttgtatagacggggaaacggagacggggacgcggggtcgcgtcggatggatcggttttgttttttcggtttcggttaggatttcgcgtcgcgtttcgtttatcgttcgcggtttcgtttcgcgtcggtacgttataaaataattttaaagtcgggggatcgggtcggtgacggcgtagagtagttttgttcgtttttttgcgtatagcgttcgcggtgttggtcgagtagggggcgacggcggcggtttcggggatcggaagagttcggggttgcgcgttcgaattttttttttcggcggaggcgttcggcgtcgtaggcgggatcggggtcgggattttatttttcggcgttttttgcggtcgggcgcgtaggcgtaagtcggatttggtcgcggagcgtaggcgtagtcggggttaggcggtgcgcgtaggcgtagcggggggcggggcgcgcgggttcggttaaggtaagcgtcggtggggcggcggcgttagagttgttggagcgttcggggttttcgggcggcggcggcggcgtagaggaggaggtaggcggcggtttcggtggttttttttcggacggtgcgcggttcggttcgtttcgcgaattcgcggtggtcgcgcggtttcgcgttgtttcgatttcgggttttttcgtcgtcgttatggttcggtcgttagtgtttagttcgtagaaggcgttgttgttggagtttaaggggttgtaggaagagtcggtcgagggatttcgcgtgatattggtggacgagggcgatttatataattgggaggtggttattttcgggttttttaatatttattacgagggcggttattttaaggtgagcgcggcgattttcgttcgggtttcggagtttacgagcgatttcgggcgtcgggaattagttttttgtttcgcggttttagcgttgttgttgggcgggtttcgaagttttttggtttgggttcgttttttttttatggttacgtttttttatttagttttgttcggtt

SEQ ID NO: 11782 - DNA, 1127 bp, Artificial Sequence
  chemically treated genomic DNA (Homo sapiens) CpG-island No: 11782
aaccgaacaaaactaaataaaaaaacgtaaccataaaaaaaaaacgaacccaaaccaaaaaacttcgaaacccgcccaacaacaacgctaaaaccgcgaaacaaaaaactaattcccgacgcccgaaatcgctcgtaaactccgaaacccgaacgaaaatcgccgcgctcaccttaaaataaccgccctcgtaataaatattaaaaaacccgaaaataaccacctcccaattatataaatcgccctcgtccaccaatatcacgcgaaatccctcgaccgactcttcctacaaccccttaaactccaacaacaacgccttctacgaactaaacactaacgaccgaaccataacgacgacgaaaaaacccgaaatcgaaacaacgcgaaaccgcgcgaccaccgcgaattcgcgaaacgaaccgaaccgcgcaccgtccgaaaaaaaaccaccgaaaccgccgcctacctcctcctctacgccgccgccgccgcccgaaaaccccgaacgctccaacaactctaacgccgccgccccaccgacgcttaccttaaccgaacccgcgcgccccgccccccgctacgcctacgcgcaccgcctaaccccgactacgcctacgctccgcgaccaaatccgacttacgcctacgcgcccgaccgcaaaaaacgccgaaaaataaaatcccgaccccgatcccgcctacgacgccgaacgcctccgccgaaaaaaaaaattcgaacgcgcaaccccgaactcttccgatccccgaaaccgccgccgtcgccccctactcgaccaacaccgcgaacgctatacgcaaaaaaacgaacaaaactactctacgccgtcaccgacccgatcccccgactttaaaattattttataacgtaccgacgcgaaacgaaaccgcgaacgataaacgaaacgcgacgcgaaatcctaaccgaaaccgaaaaaacaaaaccgatccatccgacgcgaccccgcgtccccgtctccgtttccccgtctatacaaaaaacgaacgcgaaatctatcctaaaatcgcgctaaccacgcgaaaaaaaaaaaaaaacgaaaacgaaacgaaatccgcaaacctaacttccaaacgcgacgctacctcgat

SEQ ID NO: 11783 - DNA, 1127 bp, Artificial Sequence
  chemically treated genomic DNA (Homo sapiens) CpG-island No: 11783
ggtcgggtagagttgggtgggggaacgtggttatagaagggaaacgagtttaagttaggaggtttcggggttcgtttagtaatagcgttaggatcgcggggtagggagttggttttcggcgttcgaggtcgttcgtgggtttcgggattcgggcgggggtcgtcgcgtttattttgaagtagtcgttttcgtagtaggtgttggggggttcgaagatggttattttttagttgtatagatcgttttcgtttattagtgttacgcggaatttttcgatcggttttttttgtagttttttgagttttagtagtagcgttttttgcgagttgggtattagcggtcgagttatggcggcggcggaggggttcggggtcggagtagcgcggggtcgcgcgattatcgcgagttcgcgagacgggtcgggtcgcgtatcgttcgggggggagttatcggggtcgtcgtttgtttttttttttgcgtcgtcgtcgtcgttcggggatttcgagcgttttagtagttttggcgtcgtcgttttatcggcgtttgttttggtcgggttcgcgcgtttcgtttttcgttgcgtttgcgcgtatcgtttggtttcgattgcgtttgcgtttcgcggttaggttcgatttgcgtttgcgcgttcggtcgtaggggacgtcgggaggtggagtttcggtttcggtttcgtttacggcgtcgagcgttttcgtcgggagggagggttcgagcgcgtagtttcgggttttttcgattttcgaggtcgtcgtcgtcgttttttgttcgattagtatcgcggacgttgtgcgtaaggaggcgggtagggttgttttgcgtcgttatcggttcggtttttcggttttggggttgttttgtgacgtgtcggcgcggggcggggtcgcgggcggtgaacggggcgcggcgcggggttttgatcgggatcggaggggtagggtcggtttattcggcgcgatttcgcgttttcgttttcgttttttcgtttgtgtaggggacgggcgcgaagtttgttttagggtcgcgttggttacgcggaagggaggaaggggcgggagcgaggcgggattcgtagatttggtttttaggcgcggcgttgtttcggt

SEQ ID NO: 11784 - DNA, 1127 bp, Artificial Sequence
  chemically treated genomic DNA (Homo sapiens) CpG-island No: 11784
accgaaacaacgccgcgcctaaaaaccaaatctacgaatcccgcctcgctcccgccccttcctcccttccgcgtaaccaacgcgaccctaaaacaaacttcgcgcccgtcccctacacaaacgaaaaaacgaaaacgaaaacgcgaaatcgcgccgaataaaccgaccctacccctccgatcccgatcaaaaccccgcgccgcgccccgttcaccgcccgcgaccccgccccgcgccgacacgtcacaaaacaaccccaaaaccgaaaaaccgaaccgataacgacgcaaaacaaccctacccgcctccttacgcacaacgtccgcgatactaatcgaacaaaaaacgacgacgacgacctcgaaaatcgaaaaaacccgaaactacgcgctcgaaccctccctcccgacgaaaacgctcgacgccgtaaacgaaaccgaaaccgaaactccacctcccgacgtcccctacgaccgaacgcgcaaacgcaaatcgaacctaaccgcgaaacgcaaacgcaatcgaaaccaaacgatacgcgcaaacgcaacgaaaaacgaaacgcgcgaacccgaccaaaacaaacgccgataaaacgacgacgccaaaactactaaaacgctcgaaatccccgaacgacgacgacgacgcaaaaaaaaaaacaaacgacgaccccgataactcccccccgaacgatacgcgacccgacccgtctcgcgaactcgcgataatcgcgcgaccccgcgctactccgaccccgaacccctccgccgccgccataactcgaccgctaatacccaactcgcaaaaaacgctactactaaaactcaaaaaactacaaaaaaaaccgatcgaaaaattccgcgtaacactaataaacgaaaacgatctatacaactaaaaaataaccatcttcgaaccccccaacacctactacgaaaacgactacttcaaaataaacgcgacgacccccgcccgaatcccgaaacccacgaacgacctcgaacgccgaaaaccaactccctaccccgcgatcctaacgctattactaaacgaaccccgaaacctcctaacttaaactcgtttcccttctataaccacgttcccccacccaactctacccgacc

SEQ ID NO: 11785 - DNA, 621 bp, Artificial Sequence
  chemically treated genomic DNA (Homo sapiens) CpG-island No: 11785
cgtttcgtcgggtcgggtttgtttattgcgtgtcggcgtgttcgggcgggcggagcgcgggcgcggcgggggcgggcggttaggtagtcgggcgggtgcgcggggcgttcggggttcggggttagagttggagcggagtcgggcgggcgttatggaggggttgcggcgggggttgtcgcgttgaagcgttattatattaaggtgtatttggcggacgaggcgttgttgttacgttgatcgtgcggtcgcgggatacgtttagcgatttgcgcgtttagttgtgggttagggcgtgagtttttggaagcgcgttttttattataacgcgcgcggttggacgattattagacggtgcgcgacgcgcgtttgtaggacggtcggtgttgttgttcgttagcgattttaggtggtcgcggggttcggggtgggtggggcgggggcggcggtcggggatttttggagagcggcgggggagggggcgtttaaggcggtttttcgggtcggtattgtttttttatttcgcgcgttcgttcggttttttttttgattcggttttgtcggtgttaggttttgtttcgggttttttgtttgtgtttgtttttttgtttgtttttgtttttg

SEQ ID NO: 11786 - DNA, 621 bp, Artificial Sequence
  chemically treated genomic DNA (Homo sapiens) CpG-island No: 11786
caaaaacaaaaacaaacaaaaaaacaaacacaaacaaaaaacccgaaacaaaacctaacaccgacaaaaccgaatcaaaaaaaaaaccgaacgaacgcgcgaaataaaaaaacaataccgacccgaaaaaccgccttaaacgccccctcccccgccgctctccaaaaatccccgaccgccgcccccgccccacccaccccgaaccccgcgaccacctaaaatcgctaacgaacaacaacaccgaccgtcctacaaacgcgcgtcgcgcaccgtctaataatcgtccaaccgcgcgcgttataataaaaaacgcgcttccaaaaactcacgccctaacccacaactaaacgcgcaaatcgctaaacgtatcccgcgaccgcacgatcaacgtaacaacaacgcctcgtccgccaaatacaccttaatataataacgcttcaacgcgacaacccccgccgcaacccctccataacgcccgcccgactccgctccaactctaaccccgaaccccgaacgccccgcgcacccgcccgactacctaaccgcccgcccccgccgcgcccgcgctccgcccgcccgaacacgccgacacgcaataaacaaacccgacccgacgaaacg

SEQ ID NO: 11787 - DNA, 621 bp, Artificial Sequence
  chemically treated genomic DNA (Homo sapiens) CpG-island No: 11787
tagagatagaaataggtagagaaataggtatagatagagagttcgaagtaagatttgatatcggtaaggtcgggttaggagagaggtcgggcgggcgcgcgaggtgggaaagtagtgtcggttcgggaggtcgttttgggcgttttttttttcgtcgttttttaggggttttcggtcgtcgttttcgttttatttatttcgagtttcgcggttatttggggtcgttgacgagtagtagtatcggtcgttttgtaggcgcgcgtcgcgtatcgtttggtggtcgtttagtcgcgcgcgttgtagtagaaggcgcgtttttaggagtttacgttttggtttatagttgggcgcgtaggtcgttgagcgtgtttcgcggtcgtacggttagcgtagtagtagcgtttcgttcgttaggtgtattttgatgtggtagcgttttagcgcgatagttttcgtcgtagtttttttatggcgttcgttcggtttcgttttagttttggtttcgggtttcgagcgtttcgcgtattcgttcgattatttggtcgttcgttttcgtcgcgttcgcgtttcgttcgttcggatacgtcggtacgtagtgggtaggttcggttcggcggggcg

SEQ ID NO: 11788 - DNA, 621 bp, Artificial Sequence
  chemically treated genomic DNA (Homo sapiens) CpG-island No: 11788
cgccccgccgaaccgaacctacccactacgtaccgacgtatccgaacgaacgaaacgcgaacgcgacgaaaacgaacgaccaaataatcgaacgaatacgcgaaacgctcgaaacccgaaaccaaaactaaaacgaaaccgaacgaacgccataaaaaaactacgacgaaaactatcgcgctaaaacgctaccacatcaaaatacacctaacgaacgaaacgctactactacgctaaccgtacgaccgcgaaacacgctcaacgacctacgcgcccaactataaaccaaaacgtaaactcctaaaaacgcgccttctactacaacgcgcgcgactaaacgaccaccaaacgatacgcgacgcgcgcctacaaaacgaccgatactactactcgtcaacgaccccaaataaccgcgaaactcgaaataaataaaacgaaaacgacgaccgaaaacccctaaaaaacgacgaaaaaaaaaacgcccaaaacgacctcccgaaccgacactactttcccacctcgcgcgcccgcccgacctctctcctaacccgaccttaccgatatcaaatcttacttcgaactctctatctatacctatttctctacctatttctatctcta

SEQ ID NO: 11789 - DNA, 1375 bp, Artificial Sequence
  chemically treated genomic DNA (Homo sapiens) CpG-island No: 11789
acggggtcgaagtttttagagaagagttttcgcgtgacgatttcgcggggggatattttaattcgcgttttagaggtaattttgagttgtttgaggtcgttagtttagttggcgcgaggttagtagtgagcgcgtcgtgagttagttttggtgcggttcgttcggttttgtcgtcggtgagttggttacgatttttcgtttgcggagggcgttgggattcggcggggagggagttagtcggagttcggtgggaaattagcgcgtttaacgaggtgtcgcgtgggagcgcgtcggagggggcggtgttttcggggcggtatcgttcggtttcgtttttttaatttagggttcgttttttacgtttggagtttcgtttacgagtttttttttttttttaggtttcgtttttcggtcgttacgtttcgtttagtcgggcgcgggcggcggcgtcgtttttaagagtttttcggtgttttgggggtcgcgggtcggcgcgttgatttggtgcgtatgtttcgggcggtgacgtcggcgtcgggtttatgtgtgcggtcgaggggcgtattatttggtcggcggcgcgggcgggcggcggatcggcgtagcgagcgtcgcgggttcgggcggttttataggcggacgagcgcgcgcggttcggcgttttcggttttttcgtcgttcggtttcggggcgatttcggattagtagttttcgtaatttgcgcgttgttttagggtcggtcgattcgcggttcggtaagttttggattaaatttggcggggggcggggttggggacgtacggttgagattggagcggcgcgggtcgcgtagggtggggtttcggggggttttgaaggatttttgtatgagcgtggaaaagtgaagcgagcgagttttattttttgtattttgggagcgtttttttgcgttgtttggaaagttttttgtttcgaggcggttcgggtacgtgggggtcgggcgggcgggggtttcggaaagtcgcggcgtcgtttcgttttcgttttgcgtttttgcggggtcgggggaagggttgggtcgcgaggcgtttttttcgagtgtcgggacgggtggaggcggcgggaagacggtacgtgggcgcgcggggcggggtttcgtttaggggcgggggttcggggcgggttgggtagtaacgttgatttcgcggcggcggcggcggcggcggcggcggatttcgtgttagaatagagttttcgcgcgtttacggttggagggtcggtttttttttagttcgcgtttttttgtttaattttcgggagtcgcgggatttttttttttttttgatttcggttttttttaaggttcgatattttaaatttgtttttttatttaggg

SEQ ID NO: 11790 - DNA, 1375 bp, Artificial Sequence
  chemically treated genomic DNA (Homo sapiens) CpG-island No: 11790
ccctaaataaaaaaacaaatttaaaatatcgaaccttaaaaaaaaccgaaatcaaaaaaaaaaaaaaatcccgcgactcccgaaaattaaacaaaaaaacgcgaactaaaaaaaaaccgaccctccaaccgtaaacgcgcgaaaactctattctaacacgaaatccgccgccgccgccgccgccgccgccgcgaaatcaacgttactacccaacccgccccgaacccccgcccctaaacgaaaccccgccccgcgcgcccacgtaccgtcttcccgccgcctccacccgtcccgacactcgaaaaaaacgcctcgcgacccaacccttcccccgaccccgcaaaaacgcaaaacgaaaacgaaacgacgccgcgactttccgaaacccccgcccgcccgacccccacgtacccgaaccgcctcgaaacaaaaaactttccaaacaacgcaaaaaaacgctcccaaaatacaaaaaataaaactcgctcgcttcacttttccacgctcatacaaaaatccttcaaaaccccccgaaaccccaccctacgcgacccgcgccgctccaatctcaaccgtacgtccccaaccccgccccccgccaaatttaatccaaaacttaccgaaccgcgaatcgaccgaccctaaaacaacgcgcaaattacgaaaactactaatccgaaatcgccccgaaaccgaacgacgaaaaaaccgaaaacgccgaaccgcgcgcgctcgtccgcctataaaaccgcccgaacccgcgacgctcgctacgccgatccgccgcccgcccgcgccgccgaccaaataatacgcccctcgaccgcacacataaacccgacgccgacgtcaccgcccgaaacatacgcaccaaatcaacgcgccgacccgcgacccccaaaacaccgaaaaactcttaaaaacgacgccgccgcccgcgcccgactaaacgaaacgtaacgaccgaaaaacgaaacctaaaaaaaaaaaaaaactcgtaaacgaaactccaaacgtaaaaaacgaaccctaaattaaaaaaacgaaaccgaacgataccgccccgaaaacaccgccccctccgacgcgctcccacgcgacacctcgttaaacgcgctaatttcccaccgaactccgactaactccctccccgccgaatcccaacgccctccgcaaacgaaaaatcgtaaccaactcaccgacgacaaaaccgaacgaaccgcaccaaaactaactcacgacgcgctcactactaacctcgcgccaactaaactaacgacctcaaacaactcaaaattacctctaaaacgcgaattaaaatatccccccgcgaaatcgtcacgcgaaaactcttctctaaaaacttcgaccccgt

SEQ ID NO: 11791 - DNA, 1375 bp, Artificial Sequence
  chemically treated genomic DNA (Homo sapiens) CpG-island No: 11791
ttttagatggggaggtaaatttaaagtgtcgggttttgagaaaggtcggaattagagaggggaaagggtttcgcggttttcgggggttaggtaggaaggcgcgagttgggggagggtcggttttttagtcgtgggcgcgcggggattttattttgatacgggattcgtcgtcgtcgtcgtcgtcgtcgtcgcggggttagcgttgttgtttaattcgtttcggattttcgtttttgagcgggatttcgtttcgcgcgtttacgtgtcgttttttcgtcgtttttattcgtttcgatattcggaagaggcgtttcgcggtttagtttttttttcgatttcgtaggagcgtaggacggaagcggggcgacgtcgcgatttttcgggattttcgttcgttcggtttttacgtgttcgggtcgtttcggggtaaggaattttttaggtagcgtaagaagacgtttttagaatataaggagtagaattcgttcgttttatttttttacgtttatgtaggggttttttagagtttttcgaggttttattttgcgcggttcgcgtcgttttagttttagtcgtgcgtttttagtttcgtttttcgttaagtttggtttagaatttatcgggtcgcgggtcggtcggttttagggtagcgcgtaggttacgggggttgttggttcggggtcgtttcggggtcgggcggcggaggggtcgggggcgtcgggtcgcgcgcgttcgttcgtttgtggggtcgttcgggttcgcggcgttcgttgcgtcggttcgtcgttcgttcgcgtcgtcggttagataatgcgtttttcggtcgtatatatgagttcggcgtcggcgttatcgttcgggatatgcgtattaggttagcgcgtcggttcgcggtttttaaaatatcggggagtttttaaaggcgacgtcgtcgttcgcgttcggttgggcggggcgtggcgatcgaggggcggggtttgagagaagggaggagttcgtgggcggggttttaggcgtagaaggcgggttttgagttgagggggcggggtcggacggtatcgtttcggaagtatcgtttttttcggcgcgtttttacgcgatatttcgttgggcgcgttggttttttatcgggtttcggttggtttttttttcgtcgagttttagcgtttttcgtaggcgaagggtcgtggttaatttatcggcggtaaagtcgggcgggtcgtattaaggttgatttacgacgcgtttattgttgatttcgcgttagttgagttggcgattttaagtaatttagggttgtttttgaaacgcgggttagaatgttttttcgcggggtcgttacgcggaagtttttttttgggaatttcggtttcgt

SEQ ID NO: 11792 - DNA, 1375 bp, Artificial Sequence
  chemically treated genomic DNA (Homo sapiens) CpG-island No: 11792
acgaaaccgaaattcccaaaaaaaaacttccgcgtaacgaccccgcgaaaaaacattctaacccgcgtttcaaaaacaaccctaaattacttaaaatcgccaactcaactaacgcgaaatcaacaataaacgcgtcgtaaatcaaccttaatacgacccgcccgactttaccgccgataaattaaccacgacccttcgcctacgaaaaacgctaaaactcgacgaaaaaaaaaccaaccgaaacccgataaaaaaccaacgcgcccaacgaaatatcgcgtaaaaacgcgccgaaaaaaacgatacttccgaaacgataccgtccgaccccgccccctcaactcaaaacccgccttctacgcctaaaaccccgcccacgaactcctcccttctctcaaaccccgcccctcgatcgccacgccccgcccaaccgaacgcgaacgacgacgtcgcctttaaaaactccccgatattttaaaaaccgcgaaccgacgcgctaacctaatacgcatatcccgaacgataacgccgacgccgaactcatatatacgaccgaaaaacgcattatctaaccgacgacgcgaacgaacgacgaaccgacgcaacgaacgccgcgaacccgaacgaccccacaaacgaacgaacgcgcgcgacccgacgcccccgacccctccgccgcccgaccccgaaacgaccccgaaccaacaacccccgtaacctacgcgctaccctaaaaccgaccgacccgcgacccgataaattctaaaccaaacttaacgaaaaacgaaactaaaaacgcacgactaaaactaaaacgacgcgaaccgcgcaaaataaaacctcgaaaaactctaaaaaacccctacataaacgtaaaaaaataaaacgaacgaattctactccttatattctaaaaacgtcttcttacgctacctaaaaaattccttaccccgaaacgacccgaacacgtaaaaaccgaacgaacgaaaatcccgaaaaatcgcgacgtcgccccgcttccgtcctacgctcctacgaaatcgaaaaaaaaactaaaccgcgaaacgcctcttccgaatatcgaaacgaataaaaacgacgaaaaaacgacacgtaaacgcgcgaaacgaaatcccgctcaaaaacgaaaatccgaaacgaattaaacaacaacgctaaccccgcgacgacgacgacgacgacgacgacgaatcccgtatcaaaataaaatccccgcgcgcccacgactaaaaaaccgaccctcccccaactcgcgccttcctacctaacccccgaaaaccgcgaaaccctttcccctctctaattccgacctttctcaaaacccgacactttaaatttacctccccatctaaaa

SEQ ID NO: 11793 - DNA, 612 bp, Artificial Sequence
  chemically treated genomic DNA (Homo sapiens) CpG-island No: 11793
  misc_feature (49)..(49): n is either a, c, g or t
ggtagtcgttcgagggaaaaaggggcgatcgaaagcggagggggagganatagaaggggagggaggaaggggagtcgcgggcgaacggcgacggattaaggggatggtttttgattggtttcgcggttcgtttttatttattattggtaggatgtttggtagttattcggtttcgttttttcggatttgtttcggcgggcggcgcgatcgcgagaattagtcggttcgcgcgttcgttggtcgtcgttttataaggggtgagtttggcggtgggttgggggggggtggggttgtatcggcgcgttcgtttttgggtttgtggtgttatttgggttgcgtacggttgtttgatttgtcgtgggtggcgtgcggtggtagtgtgcgtatcggttgttgaggtgtgtttgtagggggaggggtgggcggttttttgggcggggtcgtgttggatgttgtgcggggggagttggtattcggggttggcggggtgtgtgcgggatggttgtcgttgttttaggcgcggtgatattgtggtattagtggttgagttttgtgagagtttcgtatggttattggtagatgttgggtgtgtggaggtgttgtcggtgtagt

SEQ ID NO: 11794 - DNA, 612 bp, Artificial Sequence
  chemically treated genomic DNA (Homo sapiens) CpG-island No: 11794
  misc_feature (564)..(564): n is either a, c, g or t
actacaccgacaacacctccacacacccaacatctaccaataaccatacgaaactctcacaaaactcaaccactaataccacaatatcaccgcgcctaaaacaacgacaaccatcccgcacacaccccgccaaccccgaataccaactccccccgcacaacatccaacacgaccccgcccaaaaaaccgcccacccctccccctacaaacacacctcaacaaccgatacgcacactaccaccgcacgccacccacgacaaatcaaacaaccgtacgcaacccaaataacaccacaaacccaaaaacgaacgcgccgatacaaccccacccccccccaacccaccgccaaactcaccccttataaaacgacgaccaacgaacgcgcgaaccgactaattctcgcgatcgcgccgcccgccgaaacaaatccgaaaaaacgaaaccgaataactaccaaacatcctaccaataataaataaaaacgaaccgcgaaaccaatcaaaaaccatccccttaatccgtcgccgttcgcccgcgactccccttcctccctccccttctatntcctccccctccgctttcgatcgcccctttttccctcgaacgactacc

SEQ ID NO: 11795 - DNA, 612 bp, Artificial Sequence
  chemically treated genomic DNA (Homo sapiens) CpG-island No: 11795
  misc_feature (564)..(564): n is either a, c, g or t
attatatcgataatatttttatatatttagtatttattaatgattatacgaaatttttataaaatttaattattgatattatagtattatcgcgtttgaagtagcgataattatttcgtatatatttcgttaatttcgaatattaatttttttcgtataatatttagtacgatttcgtttagaaaatcgtttatttttttttttataagtatattttaataatcggtacgtatattgttatcgtacgttatttacgataaattaaatagtcgtacgtagtttaaatgatattataaatttaaaaacgaacgcgtcggtatagttttatttttttttaatttatcgttaagtttattttttgtaaaacgacggttagcgagcgcgcgggtcggttggttttcgcgatcgcgtcgttcgtcggggtaagttcgaggaggcgggatcgaatgattgttaggtattttgttaatggtagatgggagcgggtcgcggagttaattaaaggttatttttttggttcgtcgtcgttcgttcgcggtttttttttttttttttttttttgtntttttttttttcgttttcggtcgtttttttttttttcgggcggttgtt

SEQ ID NO: 11796 - DNA, 612 bp, Artificial Sequence
  chemically treated genomic DNA (Homo sapiens) CpG-island No: 11796
  misc_feature (49)..(49): n is either a, c, g or t
aacaaccgcccgaaaaaaaaaaaaacgaccgaaaacgaaaaaaaaaaanacaaaaaaaaaaaaaaaaaaaaaaaccgcgaacgaacgacgacgaaccaaaaaaataacctttaattaactccgcgacccgctcccatctaccattaacaaaatacctaacaatcattcgatcccgcctcctcgaacttaccccgacgaacgacgcgatcgcgaaaaccaaccgacccgcgcgctcgctaaccgtcgttttacaaaaaataaacttaacgataaattaaaaaaaaataaaactataccgacgcgttcgtttttaaatttataatatcatttaaactacgtacgactatttaatttatcgtaaataacgtacgataacaatatacgtaccgattattaaaatatacttataaaaaaaaaaataaacgattttctaaacgaaatcgtactaaatattatacgaaaaaaattaatattcgaaattaacgaaatatatacgaaataattatcgctacttcaaacgcgataatactataatatcaataattaaattttataaaaatttcgtataatcattaataaatactaaatatataaaaatattatcgatataat

SEQ ID NO: 11797 - DNA, 791 bp, Artificial Sequence
  chemically treated genomic DNA (Homo sapiens) CpG-island No: 11797
  misc_feature (98)..(98): n is either a, c, g or t
  misc_feature (333)..(333): n is either a, c, g or t
  misc_feature (364)..(364): n is either a, c, g or t
  misc_feature (372)..(372): n is either a, c, g or t
  misc_feature (498)..(498): n is either a, c, g or t
gtcgtggggggcgtgcgtgttgtcgggtaattttttatttcgacgttggcgtgtacggaatggagttttgtttgggttcggtttttgttttttggagnggtcgggtggagtcggttatatatgagcgacgtgcgatttttttttcgtgtatcgtatttttagttgtagtgtcgtcggtttatgtggtcgtcgacgcgcggtagtttgcgtggacgttttttgttcgtgttgggggttttgtggcgtttttggcgtttggatagtcgtggagagtcgtgtttgtgtatcgttttcgttgttcgtatcgagtaggtttgtgggtacgtcgtgagnttttttcgcgcgttttagagtgtttttttgngttggtgnagagtttcggtcgcgtattcgcgttttcggtttattgtatttttggttattggcgtcggcggcgagtatgtttttttcgagcggtttttttgtagtttcgcgtgcgggtggtgattcgtgagaggnagttttcgttcgcgtttttgttttattattgggggtgaggttattatcgaggttcgttttttaagggtttttatggtgtggttttcgttggtttgttcggagggtggggttttcgtcgatcgtgttgagtgcgtttcgtttttcgttttgttttgaagttaattcggtggggagatttttttcggttcgcgtttttataatcgttttttgttttcgtagggttgagggggttcgttttttttgttttttggttttttttacggtggattagtatttttatcgcgttttgtttt

SEQ ID NO: 11798 - DNA, 791 bp, Artificial Sequence
  chemically treated genomic DNA (Homo sapiens) CpG-island No: 11798
  misc_feature (294)..(294): n is either a, c, g or t
  misc_feature (420)..(420): n is either a, c, g or t
  misc_feature (428)..(428): n is either a, c, g or t
  misc_feature (459)..(459): n is either a, c, g or t
  misc_feature (694)..(694): n is either a, c, g or t
aaaacaaaacgcgataaaaatactaatccaccgtaaaaaaaaccaaaaaacaaaaaaaacgaaccccctcaaccctacgaaaacaaaaaacgattataaaaacgcgaaccgaaaaaaatctccccaccgaattaacttcaaaacaaaacgaaaaacgaaacgcactcaacacgatcgacgaaaaccccaccctccgaacaaaccaacgaaaaccacaccataaaaacccttaaaaaacgaacctcgataataacctcacccccaataataaaacaaaaacgcgaacgaaaactncctctcacgaatcaccacccgcacgcgaaactacaaaaaaaccgctcgaaaaaaacatactcgccgccgacgccaataaccaaaaatacaataaaccgaaaacgcgaatacgcgaccgaaactctncaccaacncaaaaaaacactctaaaacgcgcgaaaaaanctcacgacgtacccacaaacctactcgatacgaacaacgaaaacgatacacaaacacgactctccacgactatccaaacgccaaaaacgccacaaaacccccaacacgaacaaaaaacgtccacgcaaactaccgcgcgtcgacgaccacataaaccgacgacactacaactaaaaatacgatacacgaaaaaaaaatcgcacgtcgctcatatataaccgactccacccgaccnctccaaaaaacaaaaaccgaacccaaacaaaactccattccgtacacgccaacgtcgaaataaaaaattacccgacaacacgcacgccccccacgac

SEQ ID NO: 11799 - DNA, 791 bp, Artificial Sequence
  chemically treated genomic DNA (Homo sapiens) CpG-island No: 11799
  misc_feature (294)..(294): n is either a, c, g or t
  misc_feature (420)..(420): n is either a, c, g or t
  misc_feature (428)..(428): n is either a, c, g or t
  misc_feature (459)..(459): n is either a, c, g or t
  misc_feature (694)..(694): n is either a, c, g or t
ggaataaggcgcggtaaaaatgttgatttatcgtagggagggttagaggataaggaagacgggtttttttaattttgcgggggtagggggcggttataaaagcgcgagtcggaaggaatttttttatcgaattggttttaaaatagagcggagggcggggcgtatttagtacggtcggcggagattttatttttcggataaattagcgagaattatattataaaaatttttgaaagacgagtttcggtaatggttttatttttaatggtgaggtaagggcgcgaacgggaattnttttttacgaattattattcgtacgcgggattgtaaggaaatcgttcgaggaggatatattcgtcgtcggcgttagtagttaagaatgtagtggatcgaaaacgcggatgcgcgatcggggttttntattaatntagaggaatattttagggcgcgcgggggagntttacggcgtatttatagatttgttcggtgcgggtaacgaaaacgatatataggtacggttttttacgattatttaagcgttaggggcgttataaggtttttagtacgagtagggagcgtttacgtaggttatcgcgcgtcggcgattatataggtcggcggtattatagttgggagtgcggtgtacgaagagaagatcgtacgtcgtttatatgtaatcgattttattcggttnttttagaggatagaagtcgagtttaagtagggttttatttcgtgtacgttaacgtcggggtgaggagttattcggtagtacgtacgttttttacggt

SEQ ID NO: 11800 - DNA, 791 bp, Artificial Sequence
  chemically treated genomic DNA (Homo sapiens) CpG-island No: 11800
  misc_feature (98)..(98): n is either a, c, g or t
  misc_feature (333)..(333): n is either a, c, g or t
  misc_feature (364)..(364): n is either a, c, g or t
  misc_feature (372)..(372): n is either a, c, g or t
  misc_feature (498)..(498): n is either a, c, g or t
accgtaaaaaacgtacgtactaccgaataactcctcaccccgacgttaacgtacacgaaataaaaccctacttaaactcgacttctatcctctaaaanaaccgaataaaatcgattacatataaacgacgtacgatcttctcttcgtacaccgcactcccaactataataccgccgacctatataatcgccgacgcgcgataacctacgtaaacgctccctactcgtactaaaaaccttataacgcccctaacgcttaaataatcgtaaaaaaccgtacctatatatcgttttcgttacccgcaccgaacaaatctataaatacgccgtaaanctcccccgcgcgccctaaaatattcctctanattaatanaaaaccccgatcgcgcatccgcgttttcgatccactacattcttaactactaacgccgacgacgaatatatcctcctcgaacgatttccttacaatcccgcgtacgaataataattcgtaaaaaanaattcccgttcgcgcccttacctcaccattaaaaataaaaccattaccgaaactcgtctttcaaaaatttttataatataattctcgctaatttatccgaaaaataaaatctccgccgaccgtactaaatacgccccgccctccgctctattttaaaaccaattcgataaaaaaattccttccgactcgcgcttttataaccgccccctacccccgcaaaattaaaaaaacccgtcttccttatcctctaaccctccctacgataaatcaacatttttaccgcgccttattcc

SEQ ID NO: 11801 - DNA, 503 bp, Artificial Sequence
  chemically treated genomic DNA (Homo sapiens) CpG-island No: 11801
ggagtcggattcgggaagtgggggcgcggatcggagagtgggggtacggatcgaggagttggggggcggattcggagagtgagggggtggattcgggaatggaggcgcggattagtgtagtgggggggcggatcggggagtggggcgcggatcggggattagggggcggatcggggagtagggggcggaataggtaaatggggacgtggagttcggtttttttttttttagcgagcgtttcggagcgttaggaggggtgttttcggttgagttatagtgagtggtttcgtacggtagttttgggcgttcgatatcggcgcgataacgggagggcgcggtattgtgaagtttcggtgagagcgtggattgggttcgagtggaaggagggtagttagcgcggcgtacgttaaggttgcgggtgttattcggtgatagttttttaggggtggggttttagttcgtttttttttcgaagataataaaagaatagaaggaaaaaatta

SEQ ID NO: 11802 - DNA, 503 bp, Artificial Sequence
  chemically treated genomic DNA (Homo sapiens) CpG-island No: 11802
taattttttccttctattcttttattatcttcgaaaaaaaaacgaactaaaaccccacccctaaaaaactatcaccgaataacacccgcaaccttaacgtacgccgcgctaactaccctccttccactcgaacccaatccacgctctcaccgaaacttcacaataccgcgccctcccgttatcgcgccgatatcgaacgcccaaaactaccgtacgaaaccactcactataactcaaccgaaaacacccctcctaacgctccgaaacgctcgctaaaaaaaaaaaaaccgaactccacgtccccatttacctattccgccccctactccccgatccgccccctaatccccgatccgcgccccactccccgatccgcccccccactacactaatccgcgcctccattcccgaatccaccccctcactctccgaatccgccccccaactcctcgatccgtacccccactctccgatccgcgcccccacttcccgaatccgactcc

SEQ ID NO: 11803 - DNA, 503 bp, Artificial Sequence
  chemically treated genomic DNA (Homo sapiens) CpG-island No: 11803
tagttttttttttttatttttttattgttttcggggaggggacgggttggggttttatttttgggaagttgttatcgagtggtattcgtagttttgacgtgcgtcgcgttggttgttttttttttattcggatttagtttacgtttttatcggggttttatagtgtcgcgttttttcgttgtcgcgtcgatgtcgagcgtttaaggttgtcgtgcggggttatttattgtagtttagtcggggatattttttttggcgtttcggggcgttcgttgggggaggggaaatcggattttacgtttttatttatttgtttcgttttttatttttcggttcgttttttaattttcggttcgcgttttatttttcggttcgtttttttattgtattggttcgcgtttttattttcgggtttatttttttatttttcgggttcgttttttaatttttcggttcgtgtttttatttttcggttcgcgtttttatttttcgggttcgatttt

SEQ ID NO: 11804 - DNA, 503 bp, Artificial Sequence
  chemically treated genomic DNA (Homo sapiens) CpG-island No: 11804
aaaatcgaacccgaaaaataaaaacgcgaaccgaaaaataaaaacacgaaccgaaaaattaaaaaacgaacccgaaaaataaaaaaataaacccgaaaataaaaacgcgaaccaatacaataaaaaaacgaaccgaaaaataaaacgcgaaccgaaaattaaaaaacgaaccgaaaaataaaaaacgaaacaaataaataaaaacgtaaaatccgatttcccctcccccaacgaacgccccgaaacgccaaaaaaaatatccccgactaaactacaataaataaccccgcacgacaaccttaaacgctcgacatcgacgcgacaacgaaaaaacgcgacactataaaaccccgataaaaacgtaaactaaatccgaataaaaaaaaaacaaccaacgcgacgcacgtcaaaactacgaataccactcgataacaacttcccaaaaataaaaccccaacccgtcccctccccgaaaacaataaaaaaataaaaaaaaaaaacta

SEQ ID NO: 11805 - DNA, 522 bp, Artificial Sequence
  chemically treated genomic DNA (Homo sapiens) CpG-island No: 11805
  misc_feature (64)..(64): n is either a, c, g or t
  misc_feature (67)..(67): n is either a, c, g or t
  misc_feature (257)..(257): n is either a, c, g or t
ggggtttcgtggggtttagaagttcggaatttgagcgttaatttagtgtgttcgtgcgaggggnttnatggtatgtgtagttttatattggttcggaatacgttggtcgacgcgtgggttatcgttcgatggtgtgtataggatatacggtggttcgtacgtttgtttttgcgggggggtgtgcgcgaggaggggggtggttattttgcgtttttgggcgggagattggtggtttgtttgtgtgtttgcgtgggttnggggtagcgtagatgcggtgttcggcgggcggcggcgagtaggtatgaatcgtatttaggcgcgatatgcgttgggggggttggagagtagtattagcggtgtcgcgtgtttgcggtcgggtgggagcgtagcgtgggattaataagaataattttttcggcgtggtttattagtttacgttggaatcggttttttgggagggcgggggggattttttcgggggtgggttcggcgtttcgaatattatggggggtattggggggg

SEQ ID NO: 11806 - DNA, 522 bp, Artificial Sequence
  chemically treated genomic DNA (Homo sapiens) CpG-island No: 11806
  misc_feature (266)..(266): n is either a, c, g or t
  misc_feature (456)..(456): n is either a, c, g or t
  misc_feature (459)..(459): n is either a, c, g or t
cccccccaataccccccataatattcgaaacgccgaacccacccccgaaaaaatcccccccgccctcccaaaaaaccgattccaacgtaaactaataaaccacgccgaaaaaattattcttattaatcccacgctacgctcccacccgaccgcaaacacgcgacaccgctaatactactctccaacccccccaacgcatatcgcgcctaaatacgattcatacctactcgccgccgcccgccgaacaccgcatctacgctaccccnaacccacgcaaacacacaaacaaaccaccaatctcccgcccaaaaacgcaaaataaccacccccctcctcgcgcacacccccccgcaaaaacaaacgtacgaaccaccgtatatcctatacacaccatcgaacgataacccacgcgtcgaccaacgtattccgaaccaatataaaactacacataccatnaancccctcgcacgaacacactaaattaacgctcaaattccgaacttctaaaccccacgaaacccc

SEQ ID NO: 11807 - DNA, 522 bp, Artificial Sequence
  chemically treated genomic DNA (Homo sapiens) CpG-island No: 11807
  misc_feature (266)..(266): n is either a, c, g or t
  misc_feature (456)..(456): n is either a, c, g or t
  misc_feature (459)..(459): n is either a, c, g or t
tttttttagtgttttttatggtattcgggacgtcgaatttattttcgggagagtttttttcgtttttttaagaggtcgattttagcgtgggttagtaaattacgtcgagagggttgtttttattggttttacgttgcgtttttattcggtcgtaggtacgcgatatcgttggtgttattttttagtttttttagcgtatatcgcgtttgagtgcggtttatatttgttcgtcgtcgttcgtcggatatcgtatttgcgttgttttnagtttacgtagatatataggtaggttattagtttttcgtttagaggcgtaagatagttattttttttttcgcgtatattttttcgtaaggatagacgtgcgggttatcgtgtgttttatatatattatcgaacgatgatttacgcgtcggttagcgtgtttcgggttaatgtggaattgtatatattatnaantttttcgtacgaatatattagattggcgtttaagtttcgagtttttagattttacgagatttt

SEQ ID NO: 11808 - DNA, 522 bp, Artificial Sequence
  chemically treated genomic DNA (Homo sapiens) CpG-island No: 11808
  misc_feature (64)..(64): n is either a, c, g or t
  misc_feature (67)..(67): n is either a, c, g or t
  misc_feature (257)..(257): n is either a, c, g or t
aaaatctcgtaaaatctaaaaactcgaaacttaaacgccaatctaatatattcgtacgaaaaanttnataatatatacaattccacattaacccgaaacacgctaaccgacgcgtaaatcatcgttcgataatatatataaaacacacgataacccgcacgtctatccttacgaaaaaatatacgcgaaaaaaaaaataactatcttacgcctctaaacgaaaaactaataacctacctatatatctacgtaaactnaaaacaacgcaaatacgatatccgacgaacgacgacgaacaaatataaaccgcactcaaacgcgatatacgctaaaaaaactaaaaaataacaccaacgatatcgcgtacctacgaccgaataaaaacgcaacgtaaaaccaataaaaacaaccctctcgacgtaatttactaacccacgctaaaatcgacctcttaaaaaaacgaaaaaaactctcccgaaaataaattcgacgtcccgaataccataaaaaacactaaaaaaa

SEQ ID NO: 11809 - DNA, 564 bp, Artificial Sequence
  chemically treated genomic DNA (Homo sapiens) CpG-island No: 11809
  misc_feature (452)..(452): n is either a, c, g or t
atttacgaggattagtttgagtaggtgagtgggcgcgtttcgcgtggcgcgttaggtatttgttcgtgggttagtggggtttggtgaaggtttacgttgtacgggcgtgtgtgttgagtcggcgcgtcgatttgagtagttcgggggttcgttgttgtagttgttgttttcgtgttgtttgttttttttgtggcgtgcgcgtcggattagcgtggttgggttatttgcgtttgagcgtgggattgtgttcgagtaggtattcgcgttcgcgtgaggacgtatatttttggcggcgtttcgacgtggttttattagtcgtgatggtttattggtgcgatgtagtttgtaagttggtggtttcgttagttagtagggcgtcggttcggttcggttgtgggtttttgggtttgcgcgtattcgttttttcggtgggtttcgtaagtttgaacggnttggttggacgcgggcgttatttcgggggtttttatcgggtttagaatttcgagttgaacgttatttggttaacgttattgtattatatgtgggtttatgggggggatttta

SEQ ID NO: 11810 - DNA, 564 bp, Artificial Sequence
  chemically treated genomic DNA (Homo sapiens) CpG-island No: 11810
  misc_feature (113)..(113): n is either a, c, g or t
taaaatcccccccataaacccacatataatacaataacgttaaccaaataacgttcaactcgaaattctaaacccgataaaaacccccgaaataacgcccgcgtccaaccaanccgttcaaacttacgaaacccaccgaaaaaacgaatacgcgcaaacccaaaaacccacaaccgaaccgaaccgacgccctactaactaacgaaaccaccaacttacaaactacatcgcaccaataaaccatcacgactaataaaaccacgtcgaaacgccgccaaaaatatacgtcctcacgcgaacgcgaatacctactcgaacacaatcccacgctcaaacgcaaataacccaaccacgctaatccgacgcgcacgccacaaaaaaaacaaacaacacgaaaacaacaactacaacaacgaacccccgaactactcaaatcgacgcgccgactcaacacacacgcccgtacaacgtaaaccttcaccaaaccccactaacccacgaacaaatacctaacgcgccacgcgaaacgcgcccactcacctactcaaactaatcctcgtaaat

SEQ ID NO: 11811 - DNA, 564 bp, Artificial Sequence
  chemically treated genomic DNA (Homo sapiens) CpG-island No: 11811
  misc_feature (113)..(113): n is either a, c, g or t
taaggttttttttataaatttatatgtagtgtagtggcgttggttaggtagcgtttaattcgggattttgagttcgataggaattttcggagtggcgttcgcgtttagttagntcgtttaaatttacgaaatttatcgagggggcgggtgcgcgtaaatttagaagtttatagtcgggtcgggtcggcgttttattggttggcgaggttattagtttgtagattgtatcgtattaatggattattacgattaatggggttacgtcgaagcgtcgttaaaggtgtacgtttttacgcgggcgcgggtgtttgttcgaatataattttacgtttagacgtaagtgatttagttacgttgattcgacgcgtacgttatagggagggtaagtagtacggaagtaatagttatagtagcgaattttcgagttgtttaaatcgacgcgtcggtttagtatatacgttcgtgtaacgtgggtttttattaggttttattggtttacgagtaggtgtttaacgcgttacgcgggacgcgtttatttatttgtttaaattggttttcgtaagt

SEQ ID NO: 11812 - DNA, 564 bp, Artificial Sequence
  chemically treated genomic DNA (Homo sapiens) CpG-island No: 11812
  misc_feature (452)..(452): n is either a, c, g or t
acttacgaaaaccaatttaaacaaataaataaacgcgtcccgcgtaacgcgttaaacacctactcgtaaaccaataaaacctaataaaaacccacgttacacgaacgtatatactaaaccgacgcgtcgatttaaacaactcgaaaattcgctactataactattacttccgtactacttaccctccctataacgtacgcgtcgaatcaacgtaactaaatcacttacgtctaaacgtaaaattatattcgaacaaacacccgcgcccgcgtaaaaacgtacacctttaacgacgcttcgacgtaaccccattaatcgtaataatccattaatacgatacaatctacaaactaataacctcgccaaccaataaaacgccgacccgacccgactataaacttctaaatttacgcgcacccgccccctcgataaatttcgtaaatttaaacganctaactaaacgcgaacgccactccgaaaattcctatcgaactcaaaatcccgaattaaacgctacctaaccaacgccactacactacatataaatttataaaaaaaacctta

SEQ ID NO: 11813 - DNA, 1247 bp, Artificial Sequence
  chemically treated genomic DNA (Homo sapiens) CpG-island No: 11813
gatcgtacgatcgagaatatacgtgtgtattagtttagtaattgatcgatcgtataacgtagacgatcgtgtttaatcgagcgttgttcggttttatacgtagatatcgtggttttagtttacgaggtacggtttatattagatatcgttttatttacgtttttcgtttatattagatatcgtgttttatttacgttttcggtttatattagatatcgttttatttacgttttcggtttatattagatatcgtgttttatttacgttttcggtttatattagatatcgtgttttatttacgttttcggtttatattagatatcgttttatttacgttttcggtttatattagatatcgtgttttatttacgtttatcgtttatattagatatcgtgttttatttacgttttcggtttatattagatatcgttttatttacgttttcggtttatattagataatgtgttttatttacgttttcggtttatattagatatcgtgttttatttacgttttcggtttatattagatatcgtgttttatttacgttttcggtttatattagatatcgttttatttacgtttttcgtttatattagatatcgtgttttatttacgttgtcggtttatattagatatcgttttatttacgtttttcgtttatattagatatcgtgttttatttacgttgtcggtttatattagatatcgttttatttacgttttcggtttatattagatatcgtgttttatttacgttgtcggtttatattagatatcgttttatttacgtttttcgtttatattagatatcgtgttttatttacgttttcggtttatattagatatcgttttatttacgttttcggtttatattagatatcgtgttttatttacgttttcggtttatattagatatcgtgttttatttacgttttcggtttatattagatatcgttttatttacgttttcggtttatattagatatcgtgttttatttacgtttatcgtttatattagatatcgtgttttatttacggtttcggtttatattagatatcgttttattacgttttcggtttatattagataatgtgttttatttacgttttcggtttatattagatatcgttttatttacgttttcggtttatattagatatcgtgttttatttacgttttcggtatatataagatatcgttttatttacgttcggttagagtttatatataatgtataatata

SEQ ID NO: 11814 - DNA, 1247 bp, Artificial Sequence
  chemically treated genomic DNA (Homo sapiens) CpG-island No: 11814
tatattatacattatatataaactctaaccgaacgtaaataaaacgatatcttatatataccgaaaacgtaaataaaacacgatatctaatataaaccgaaaacgtaaataaaacgatatctaatataaaccgaaaacgtaaataaaacacattatctaatataaaccgaaaacgtaataaaacgatatctaatataaaccgaaaccgtaaataaaacacgatatctaatataaacgataaacgtaaataaaacacgatatctaatataaaccgaaaacgtaaataaaacgatatctaatataaaccgaaaacgtaaataaaacacgatatctaatataaaccgaaaacgtaaataaaacacgatatctaatataaaccgaaaacgtaaataaaacgatatctaatataaaccgaaaacgtaaataaaacacgatatctaatataaacgaaaaacgtaaataaaacgatatctaatataaaccgacaacgtaaataaaacacgatatctaatataaaccgaaaacgtaaataaaacgatatctaatataaaccgacaacgtaaataaaacacgatatctaatataaacgaaaaacgtaaataaaacgatatctaatataaaccgacaacgtaaataaaacacgatatctaatataaacgaaaaacgtaaataaaacgatatctaatataaaccgaaaacgtaaataaaacacgatatctaatataaaccgaaaacgtaaataaaacacgatatctaatataaaccgaaaacgtaaataaaacacattatctaatataaaccgaaaacgtaaataaaacgatatctaatataaaccgaaaacgtaaataaaacacgatatctaatataaacgataaacgtaaataaaacacgatatctaatataaaccgaaaacgtaaataaaacgatatctaatataaaccgaaaacgtaaataaaacacgatatctaatataaaccgaaaacgtaaataaaacacgatatctaatataaaccgaaaacgtaaataaaacgatatctaatataaaccgaaaacgtaaataaaacacgatatctaatataaacgaaaaacgtaaataaaacgatatctaatataaaccgtacctcgtaaactaaaaccacgatatctacgtataaaaccgaacaacgctcgattaaacacgatcgtctacgttatacgatcgatcaattactaaactaatacacacgtatattctcgatcgtacgatc

SEQ ID NO: 11815 - DNA, 1247 bp, Artificial Sequence
  chemically treated genomic DNA (Homo sapiens) CpG-island No: 11815
tgtattatgtattatatgtaagttttggtcgagcgtgggtgggacggtgttttgtgtatatcgggagcgtgggtgggatacggtgtttggtgtagatcgggagcgtgggtgggacggtgtttggtgtagatcgggaacgtgggtgggatatattgtttggtgtagatcgggagcgtggtgggacggtgtttggtgtagatcgggatcgtgggtgggatacggtgtttggtgtagacggtaagcgtgggtgggatacggtgtttggtgtagatcgggagcgtgggtgggacggtgtttggtgtagatcgggagcgtgggtgggatacggtgtttggtgtagatcgggagcgtgggtgggatacggtgtttggtgtagatcgggagcgtgggtgggacggtgtttggtgtagatcgggagcgtgggtgggatacggtgtttggtgtagacggggagcgtgggtgggacggtgtttggtgtagatcggtagcgtgggtgggatacggtgtttggtgtagatcgggagcgtgggtgggacggtgtttggtgtagatcggtagcgtgggtgggatacggtgtttggtgtagacggggagcgtgggtgggacggtgtttggtgtagatcggtagcgtgggtgggatacggtgtttggtgtagacggggagcgtgggtgggacggtgtttggtgtagatcgggagcgtgggtgggatacggtgtttggtgtagatcgggagcgtgggtgggatacggtgtttggtgtagatcgggagcgtgggtgggatatattgtttggtgtagatcgggagcgtgggtgggacggtgtttggtgtagatcgggagcgtgggtgggatacggtgtttggtgtagacggtaagcgtgggtgggatacggtgtttggtgtagatcgggagcgtgggtgggacggtgtttggtgtagatcgggagcgtgggtgggatacggtgtttggtgtagatcgggagcgtgggtgggatacggtgtttggtgtagatcgggagcgtgggtgggacggtgtttggtgtagatcgggagcgtgggtgggatacggtgtttggtgtagacggggagcgtgggtgggacggtgtttggtgtagatcgtgtttcgtgggttgggattacggtgtttgcgtgtaggatcgggtagcgttcggttgggtacggtcgtttgcgttgtacggtcggttagttgttgggttggtgtatacgtgtgttttcggtcgtacgatt

SEQ ID NO: 11816 - DNA, 1247 bp, Artificial Sequence
  chemically treated genomic DNA (Homo sapiens) CpG-island No: 11816
aatcgtacgaccgaaaacacacgtatacaccaacccaacaactaaccgaccgtacaacgcaaacgaccgtacccaaccgaacgctacccgatcctacacgcaaacaccgtaatcccaacccacgaaacacgatctacaccaaacaccgtcccacccacgctccccgtctacaccaaacaccgtatcccacccacgctcccgatctacaccaaacaccgtcccacccacgctcccgatctacaccaaacaccgtatcccacccacgctcccgatctacaccaaacaccgtatcccacccacgctcccgatctacaccaaacaccgtcccacccacgctcccgatctacaccaaacaccgtatcccacccacgcttaccgtctacaccaaacaccgtatcccacccacgctcccgatctacaccaaacaccgtcccacccacgctcccgatctacaccaaacaatatatcccacccacgctcccgatctacaccaaacaccgtatcccacccacgctcccgatctacaccaaacaccgtatcccacccacgctcccgatctacaccaaacaccgtcccacccacgctccccgtctacaccaaacaccgtatcccacccacgctaccgatctacaccaaacaccgtcccacccacgctccccgtctacaccaaacaccgtatcccacccacgctaccgatctacaccaaacaccgtcccacccacgctcccgatctacaccaaacaccgtatcccacccacgctaccgatctacaccaaacaccgtcccacccacgctccccgtctacaccaaacaccgtatcccacccacgctcccgatctacaccaaacaccgtcccacccacgctcccgatctacaccaaacaccgtatcccacccacgctcccgatctacaccaaacaccgtatcccacccacgctcccgatctacaccaaacaccgtcccacccacgctcccgatctacaccaaacaccgtatcccacccacgcttaccgtctacaccaaacaccgtatcccacccacgatcccgatctacaccaaacaccgtcccaccacgctcccgatctacaccaaacaatatatcccacccacgttcccgatctacaccaaacaccgtcccacccacgctcccgatctacaccaaacaccgtatcccacccacgctcccgatatacacaaaacaccgtcccacccacgctcgaccaaaacttacatataatacataataca

SEQ ID NO: 11817 - DNA, 570 bp, Artificial Sequence
  chemically treated genomic DNA (Homo sapiens) CpG-island No: 11817
tagatcgggagcgtgggtgggatagtgtttggtgtagatcgggagcgtgggtgggatacggtgtttggtgtagatcgggagcgtgggtgggatacggtgtttggtgtagacggggagcgtgggtgggacggtgtttggtgtagatcgggagcgtgggtgggatacggtgtttggtgtagacggggagcgtgggtgggacggtgtttggtgtagatcggtagcgtgggtgggatacggtgtttggtgtagatcgggagcgtgggtgggacggtgtttggtgtagatcgggagcgtgggtgggatacggtgtttggtgtagacggggagcgtgggtgggacggtgtttggtgtagatcggtagcgtgggtgggatacggtgtttggtgtagacggtaagcgtgggtgggatacggtgtttggtgtagatcgggagcgtgggtgggacgtagtttttggtttatacggagagtttgcgtgagatcgcgttcggtgtatatgtttaggttgcgtttgattttttttgcgttagttgtttgttagcgtgttttttatgggggttgaggatgattg

SEQ ID NO: 11818 - DNA, 570 bp, Artificial Sequence
  chemically treated genomic DNA (Homo sapiens) CpG-island No: 11818
caatcatcctcaacccccataaaaaacacgctaacaaacaactaacgcaaaaaaaatcaaacgcaacctaaacatatacaccgaacgcgatctcacgcaaactctccgtataaaccaaaaactacgtcccacccacgctcccgatctacaccaaacaccgtatcccacccacgcttaccgtctacaccaaacaccgtatcccacccacgctaccgatctacaccaaacaccgtcccacccacgctccccgtctacaccaaacaccgtatcccacccacgctcccgatctacaccaaacaccgtcccacccacgctcccgatctacaccaaacaccgtatcccacccacgctaccgatctacaccaaacaccgtcccacccacgctccccgtctacaccaaacaccgtatcccacccacgctcccgatctacaccaaacaccgtcccacccacgctccccgtctacaccaaacaccgtatcccacccacgctcccgatctacaccaaacaccgtatcccacccacgctcccgatctacaccaaacactatcccacccacgctcccgatcta

SEQ ID NO: 11819 - DNA, 570 bp, Artificial Sequence
  chemically treated genomic DNA (Homo sapiens) CpG-island No: 11819
tagttatttttaatttttatggaggatacgttggtaggtagttagcgtagggagggttagacgtagtttgggtatatatatcggacgcggttttacgtagatttttcgtgtagattagagattgcgttttatttacgttttcggtttatattagatatcgtgttttatttacgtttatcgtttatattagatatcgtgttttatttacgttgtcggtttatattagatatcgttttatttacgtttttcgtttatattagatatcgtgttttatttacgttttcggtttatattagatatcgttttatttacgttttcggtttatattagatatcgtgttttatttacgttgtcggtttatattagatatcgttttatttacgtttttcgtttatattagatatcgtgttttatttacgttttcggtttatattagatatcgttttatttacgtttttcgtttatattagatatcgtgttttatttacgttttcggtttatattagatatcgtgttttatttacgttttcggtttatattagatattgttttatttacgttttcggttta

SEQ ID NO: 11820 - DNA, 570 bp, Artificial Sequence
  chemically treated genomic DNA (Homo sapiens) CpG-island No: 11820
taaaccgaaaacgtaaataaaacaatatctaatataaaccgaaaacgtaaataaaacacgatatctaatataaaccgaaaacgtaaataaaacacgatatctaatataaacgaaaaacgtaaataaaacgatatctaatataaaccgaaaacgtaaataaaacacgatatctaatataaacgaaaaacgtaaataaaacgatatctaatataaaccgacaacgtaaataaaacacgatatctaatataaaccgaaaacgtaaataaaacgatatctaatataaaccgaaaacgtaaataaaacacgatatctaatataaacgaaaaacgtaaataaaacgatatctaatataaaccgacaacgtaaataaaacacgatatctaatataaacgataaacgtaaataaaacacgatatctaatataaaccgaaaacgtaaataaaacgcaatctctaatctacacgaaaaatctacgtaaaaccgcgtccgatatatatacccaaactacgtctaaccctccctacgctaactacctaccaacgtatcctccataaaaattaaaaataacta

SEQ ID NO: 11821 - DNA, 915 bp, Artificial Sequence
  chemically treated genomic DNA (Homo sapiens) CpG-island No: 11821
tagatcgggagcgtgggtgggatagtgtttggtgtagatcgggagcgtgggtgggatacggtgtttggtgtagatcgggagcgtgggtgggacggtgtttggtgtagacggggagcgtgggtgggacggtgtttggtgtagatcgggagcgtgggtgggatacggtttttggtgtagatcgggagcgtgggtgggatacggtgtttggtgtagatcgggagcgtgggtgggacggtgtttggtaaagatcgggagcgtggggtgggatatattgtttggtgtagatcgggagcgtgggtgggatagtgtttggtgtagatcgggagcgtgggtgggatacggtgtttggtgtagacggtaagcgtgggtgggatacggtgtttggtgtagatcgggagcgtgggtgggacggtgtttggtgtagatcgggagcgtgggtgggatacggtgtttggtgtagacggggagcgtgggtgggacggtgtttggtgtagatcggtagcgtgggtgggatacggtgtttggtgtagatcgggagcgtgggtgggatatattgtttggtgtatatcgggagcgtgggtgggacggtgtttggtgtagatcgggagcgtgggtgggatacggtgtttggtgtagatcgggagcgtgggtgggacggtgtttggtgtatatcgggagcgtgggtgggatacggtgtttggtgtagacggggagcgtgggtgggatacggtgtttggtgtagacggggagcgtgggtgggacggtgtttggtgtagacggggagcgtgggtgggatacggtgtttggtgtagatcgggagcgtgggtgggatacggtgtttggtgtagaatggaatgggagtgtgtgtttgtgatatggtgttttacgtagaaggaatagtaaggttttgatatt

SEQ ID NO: 11822 - DNA, 915 bp, Artificial Sequence
  chemically treated genomic DNA (Homo sapiens) CpG-island No: 11822
aatatcaaaaccttactattccttctacgtaaaacaccatatcacaaacacacactcccattccattctacaccaaacaccgtatcccacccacgctcccgatctacaccaaacaccgtatcccacccacgctccccgtctacaccaaacaccgtcccacccacgctccccgtctacaccaaacaccgtatcccacccacgctccccgtctacaccaaacaccgtatcccacccacgctcccgatatacaccaaacaccgtcccacccacgctcccgatctacaccaaacaccgtatcccacccacgctcccgatctacaccaaacaccgtcccacccacgctcccgatatacaccaaacaatatatcccacccacgctcccgatctacaccaaacaccgtatcccacccacgctaccgatctacaccaaacaccgtcccacccacgctccccgtctacaccaaacaccgtatcccacccacgctcccgatctacaccaaacaccgtcccacccacgctcccgatctacaccaaacaccgtatcccacccacgcttaccgtctacaccaaacaccgtatcccacccacgctcccgatctacaccaaacactatcccacccacgctcccgatctacaccaaacaatatatcccaccccacgctcccgatctttaccaaacaccgtcccacccacgctcccgatctacaccaaacaccgtatcccacccacgctcccgatctacaccaaaaaccgtatcccacccacgctcccgatctacaccaaacaccgtcccacccacgctccccgtctacaccaaacaccgtcccacccacgctcccgatctacaccaaacaccgtatcccacccacgctcccgatctacaccaaacactatcccacccacgctcccgatcta

SEQ ID NO: 11823 - DNA, 915 bp, Artificial Sequence
  chemically treated genomic DNA (Homo sapiens) CpG-island No: 11823
aatgttaagattttgttgttttttttacgtgagatattatgttataaatatatatttttattttattttatattagatatcgtgttttatttacgttttcggtttatattagatatcgtgttttatttacgtttttcgtttatattagatatcgttttatttacgtttttcgtttatattagatatcgtgttttatttacgtttttcgtttatattagatatcgtgttttatttacgttttcggtatatattagatatcgttttatttacgttttcggtttatattagatatcgtgttttatttacgttttcggtttatattagatatcgttttatttacgttttcggtatatattagataatgtgttttatttacgttttcggtttatattagatatcgtgttttatttacgttgtcggtttatattagatatcgttttatttacgtttttcgtttatattagatatcgtgttttatttacgttttcggtttatattagatatcgttttatttacgttttcggtttatattagatatcgtgttttatttacgtttatcgtttatattagatatcgtgttttatttacgttttcggtttatattagatattgttttatttacgttttcggtttatattagataatgtgttttattttacgttttcggtttttattagatatcgttttatttacgttttcggtttatattagatatcgtgttttatttacgttttcggtttatattagagatcgtgttttatttacgttttcggtttatattagatatcgttttatttacgtttttcgtttatattagatatcgttttatttacgttttcggtttatattagatatcgtgttttatttacgttttcggtttatattagatattgttttatttacgttttcggttta

SEQ ID NO: 11824 - DNA, 915 bp, Artificial Sequence
  chemically treated genomic DNA (Homo sapiens) CpG-island No: 11824
taaaccgaaaacgtaaataaaacaatatctaatataaaccgaaaacgtaaataaaacacgatatctaatataaaccgaaaacgtaaataaaacgatatctaatataaacgaaaaacgtaaataaaacgatatctaatataaaccgaaaacgtaaataaaacacgatctctaatataaaccgaaaacgtaaataaaacacgatatctaatataaaccgaaaacgtaaataaaacgatatctaataaaaaccgaaaacgtaaaataaaacacattatctaatataaaccgaaaacgtaaataaaacaatatctaatataaaccgaaaacgtaaataaaacacgatatctaatataaacgataaacgtaaataaaacacgatatctaatataaaccgaaaacgtaaataaaacgatatctaatataaaccgaaaacgtaaataaaacacgatatctaatataaacgaaaaacgtaaataaaacgatatctaatataaaccgacaacgtaaataaaacacgatatctaatataaaccgaaaacgtaaataaaacacattatctaatatataccgaaaacgtaaataaaacgatatctaatataaaccgaaaacgtaaataaaacacgatatctaatataaaccgaaaacgtaaataaaacgatatctaatatataccgaaaacgtaaataaaacacgatatctaatataaacgaaaaacgtaaataaaacacgatatctaatataaacgaaaaacgtaaataaaacgatatctaatataaacgaaaaacgtaaataaaacacgatatctaatataaaccgaaaacgtaaataaaacacgatatctaatataaaataaaataaaaatatatatttataacataatatctcacgtaaaaaaaacaacaaaatcttaacatt

SEQ ID NO: 11825 - DNA, 877 bp, Artificial Sequence
  chemically treated genomic DNA (Homo sapiens) CpG-island No: 11825
ggtagcgcggtgacgttacggttgaggatttcgttttacgaagggtttattttacgcgatttacgtcgttcgttcgttttttttttttacgtagtatttcggttgtttcgtggggaaattgagtttggatttttcgtgttcgttcgggagaaggacgcgggaggcgcggtcgagttgcggggagaggttgggtttatttcgggttagagcgagttcgcgtaaacgggagtgtttatcgttggcgggttagttattagcgttggttacgcgtcggttattcgggcgataggaggcggggcggcgcggaagttattttttaattaggtgtttcgggggcgggttcggaaaattgtttaattaaggtacggggcggatatcgggaagcggattgtaggtttgtagtagtgtttaatcgaaggttttaggggtgaagggggcgtgtttaaaacgttgttcgtttagagcgttgaaagggcgggggtttagagattgtttaattagggcgtcgttttttgagtttcgaggtttcgagggcgggacgtttcgttttttttgtcgcgcgtgttttgtttattacgagcggttcgggagtatttgtattttttagttgcgtcggtcgcgaggttacggagagttcgttttggagagtttaggagtaggggagatatggtgagtgcgaggtaggagtagagttaggggacggtcggagcgacgggaatcggttggaattagagttcgtcgaagtttgcggtcgggattggttgagggacgcgcggggcggcgtaggattagtatttgggattcggggacgttattatagcggtcgggttggaggattgggggtagtttggggggacggaaggggcggtaaggagtt

SEQ ID NO: 11826 - DNA, 877 bp, Artificial Sequence
  chemically treated genomic DNA (Homo sapiens) CpG-island No: 11826
aactccttaccgccccttccgtccccccaaactacccccaatcctccaacccgaccgctataataacgtccccgaatcccaaatactaatcctacgccgccccgcgcgtccctcaaccaatcccgaccgcaaacttcgacgaactctaattccaaccgattcccgtcgctccgaccgtcccctaactctactcctacctcgcactcaccatatctcccctactcctaaactctccaaaacgaactctccgtaacctcgcgaccgacgcaactaaaaaatacaaatactcccgaaccgctcgtaataaacaaaacacgcgcgacaaaaaaaacgaaacgtcccgccctcgaaacctcgaaactcaaaaaacgacgccctaattaaacaatctctaaacccccgccctttcaacgctctaaacgaacaacgttttaaacacgcccccttcacccctaaaaccttcgattaaacactactacaaacctacaatccgcttcccgatatccgccccgtaccttaattaaacaattttccgaacccgcccccgaaacacctaattaaaaaataacttccgcgccgccccgcctcctatcgcccgaataaccgacgcgtaaccaacgctaataactaacccgccaacgataaacactcccgtttacgcgaactcgctctaacccgaaataaacccaacctctccccgcaactcgaccgcgcctcccgcgtccttctcccgaacgaacacgaaaaatccaaactcaatttccccacgaaacaaccgaaatactacgtaaaaaaaaaaaacgaacgaacgacgtaaatcgcgtaaaataaacccttcgtaaaacgaaatcctcaaccgtaacgtcaccgcgctacc

SEQ ID NO: 11827 - DNA, 877 bp, Artificial Sequence
  chemically treated genomic DNA (Homo sapiens) CpG-island No: 11827
agttttttgtcgtttttttcgtttttttaaattgtttttagttttttagttcggtcgttgtgatggcgttttcgggttttaggtgttagttttgcgtcgtttcgcgcgttttttagttaatttcggtcgtagatttcggcggattttggttttagtcggttttcgtcgtttcgatcgttttttggttttgtttttgtttcgtatttattatgttttttttgtttttgggttttttaaggcgagtttttcgtggtttcgcggtcggcgtagttgaaaggtataggtattttcgggtcgttcgtggtaggtagggtacgcgcggtagggaggacgaaacgtttcgttttcggggtttcggagtttaggaagcggcgttttgattggataatttttaagttttcgtttttttaacgttttgagcggatagcgttttggatacgttttttttatttttggggttttcgattggatattattgtaaatttgtaattcgtttttcggtgttcgtttcgtgttttgattggatagtttttcggattcgttttcggagtatttgattggaagataattttcgcgtcgtttcgttttttgtcgttcgagtgatcggcgcgtagttaacgttagtggttgattcgttagcggtggatattttcgtttgcgcgaattcgttttggttcggggtgagtttaattttttttcgtagttcggtcgcgtttttcgcgtttttttttcgaacgggtacgagaagtttagatttagtttttttacggagtagtcggagtgttgcgtggaggggaggggcgagcgagcggcgtgggtcgcgtggggtgagtttttcgtggggcggggtttttagtcgtgacgttatcgcgttgtt

SEQ ID NO: 11828 - DNA, 877 bp, Artificial Sequence
  chemically treated genomic DNA (Homo sapiens) CpG-island No: 11828
aacaacgcgataacgtcacgactaaaaaccccgccccacgaaaaactcaccccacgcgacccacgccgctcgctcgcccctcccctccacgcaacactccgactactccgtaaaaaaactaaatctaaacttctcgtacccgttcgaaaaaaaaacgcgaaaaacgcgaccgaactacgaaaaaaaattaaactcaccccgaaccaaaacgaattcgcgcaaacgaaaatatccaccgctaacgaatcaaccactaacgttaactacgcgccgatcactcgaacgacaaaaaacgaaacgacgcgaaaattatcttccaatcaaatactccgaaaacgaatccgaaaaactatccaatcaaaacacgaaacgaacaccgaaaaacgaattacaaatttacaataatatccaatcgaaaaccccaaaaataaaaaaaacgtatccaaaacgctatccgctcaaaacgttaaaaaaacgaaaacttaaaaattatccaatcaaaacgccgcttcctaaactccgaaaccccgaaaacgaaacgtttcgtcctccctaccgcgcgtaccctacctaccacgaacgacccgaaaatacctatacctttcaactacgccgaccgcgaaaccacgaaaaactcgccttaaaaaacccaaaaacaaaaaaaacataataaatacgaaacaaaaacaaaaccaaaaaacgatcgaaacgacgaaaaccgactaaaaccaaaatccgccgaaatctacgaccgaaattaactaaaaaacgcgcgaaacgacgcaaaactaacacctaaaacccgaaaacgccatcacaacgaccgaactaaaaaactaaaaacaatttaaaaaaacgaaaaaaacgacaaaaaact

SEQ ID NO: 11829 - DNA, 583 bp, Artificial Sequence
  chemically treated genomic DNA (Homo sapiens) CpG-island No: 11829
cgcgttcgtagtttttcggtcgggattcgtaacgcgcgttagtcgtcgtcgtcgttatttcggagtagacgtagtagtagttggagtaggaaggcgtttaggacggtcggtagtttttattcgttcggttttgggaagtttgggagggcgatggaaagagaggtcgggtcgtttcggtaagcgtttttttttttatcgggtcgtaggtttcgcgtagttttcgcgtttcgaggatcgggcgtgggatttgttgtcggatttgggtcgttcgaggtaggtttttcgggaggggaagggattttttcgggaagataggaatgcgttttcggaatttcggagattattcgtattcgtttatcgtgatatattttttacgtatatttttttttgcgtgcgttttttataattttatatatttatatttttttgcgcgtgtattttattttcgcgatatttgtgtgtttttatatttatattatttatacgttttacgcgtttttttatacgtagtattatattcgttttggagggtgttggagttgatatttgtttttttagagaaggttttagttgtaggaggatt

SEQ ID NO: 11830 - DNA, 583 bp, Artificial Sequence
  chemically treated genomic DNA (Homo sapiens) CpG-island No: 11830
aatcctcctacaactaaaaccttctctaaaaaaacaaatatcaactccaacaccctccaaaacgaatataatactacgtataaaaaaacgcgtaaaacgtataaataatataaatataaaaacacacaaatatcgcgaaaataaaatacacgcgcaaaaaaatataaatatataaaattataaaaaacgcacgcaaaaaaaaatatacgtaaaaaatatatcacgataaacgaatacgaataatctccgaaattccgaaaacgcattcctatcttcccgaaaaaatcccttcccctcccgaaaaacctacctcgaacgacccaaatccgacaacaaatcccacgcccgatcctcgaaacgcgaaaactacgcgaaacctacgacccgataaaaaaaaaaacgcttaccgaaacgacccgacctctctttccatcgccctcccaaacttcccaaaaccgaacgaataaaaactaccgaccgtcctaaacgccttcctactccaactactactacgtctactccgaaataacgacgacgacgactaacgcgcgttacgaatcccgaccgaaaaactacgaacgcg

SEQ ID NO: 11831 - DNA, 583 bp, Artificial Sequence
  chemically treated genomic DNA (Homo sapiens) CpG-island No: 11831
ggtttttttataattagaattttttttagaaaggtagatgttaattttagtattttttagggcgagtgtgatattgcgtgtgagagggcgcgtggggcgtgtaaatgatgtgagtgtgaggatatataggtgtcgcgggaatggggtgtacgcgtaggaggatatgagtgtgtaaagttgtgggagacgtacgtagaagaaggtgtgcgtgaagagtgtgttacggtgggcgagtgcgagtggttttcggggtttcgaaagcgtatttttgttttttcggaggggtttttttttttttcggaaggtttgtttcgggcggtttaaattcggtagtaaattttacgttcggttttcggagcgcggagattgcgcggggtttacgattcggtgggaagagaggcgtttgtcggggcggttcggtttttttttttatcgtttttttagattttttagggtcgggcgggtggggattgtcgatcgttttgggcgtttttttgttttagttgttgttgcgtttgtttcgaggtggcggcggcggcggttggcgcgcgttgcgggtttcggtcgaggggttgcgggcgcg

SEQ ID NO: 11832 - DNA, 583 bp, Artificial Sequence
  chemically treated genomic DNA (Homo sapiens) CpG-island No: 11832
cgcgcccgcaacccctcgaccgaaacccgcaacgcgcgccaaccgccgccgccgccacctcgaaacaaacgcaacaacaactaaaacaaaaaaacgcccaaaacgatcgacaatccccacccgcccgaccctaaaaaatctaaaaaaacgataaaaaaaaaaaccgaaccgccccgacaaacgcctctcttcccaccgaatcgtaaaccccgcgcaatctccgcgctccgaaaaccgaacgtaaaatttactaccgaatttaaaccgcccgaaacaaaccttccgaaaaaaaaaaaaacccctccgaaaaaacaaaaatacgctttcgaaaccccgaaaaccactcgcactcgcccaccgtaacacactcttcacgcacaccttcttctacgtacgtctcccacaactttacacactcatatcctcctacgcgtacaccccattcccgcgacacctatatatcctcacactcacatcatttacacgccccacgcgccctctcacacgcaatatcacactcgccctaaaaaatactaaaattaacatctacctttctaaaaaaaattctaattataaaaaaacc

SEQ ID NO: 11833 - DNA, 554 bp, Artificial Sequence
  chemically treated genomic DNA (Homo sapiens) CpG-island No: 11833
tttggttcgttaagtcggttgttcgtttttgtgtttagtatttttcggtagggtaggatttagggatcgtgaagtcgttttttagttcggtttcgaaagggaatttttaagcgcggggtcgcgcgcggtttagggtttttttcgtttgtttaggtttcgcgaggggagcggttttttttaggcggttgtcgggagttgcgggcgtagaagtcgattcgggttttcggcgggataggttacgttttgcgtattgttttcggtggtttttcggggtacgcgcgcgtgcgtggggtcggggggggcgcgggggattttaggcggcgaggggattcgcggttatttgggtttttggttttgcgtttcgcggacggttgtattttttgttttttttcggcggtcgcgtgggttttattcggtggagcgtgggggtttttgcgggagggacgtaggcgtttcgggtttagattttaattcgcgtttggtgtttttggcggtttttgggtcgtttagttattggatattgtgttttgagagggtttattcggatttttttt

SEQ ID NO: 11834 - DNA, 554 bp, Artificial Sequence
  chemically treated genomic DNA (Homo sapiens) CpG-island No: 11834
aaaaaaaatccgaataaaccctctcaaaacacaatatccaataactaaacgacccaaaaaccgccaaaaacaccaaacgcgaattaaaatctaaacccgaaacgcctacgtccctcccgcaaaaacccccacgctccaccgaataaaacccacgcgaccgccgaaaaaaaacaaaaaatacaaccgtccgcgaaacgcaaaaccaaaaacccaaataaccgcgaatcccctcgccgcctaaaatcccccgcgccccccccgaccccacgcacgcgcgcgtaccccgaaaaaccaccgaaaacaatacgcaaaacgtaacctatcccgccgaaaacccgaatcgacttctacgcccgcaactcccgacaaccgcctaaaaaaaaccgctcccctcgcgaaacctaaacaaacgaaaaaaaccctaaaccgcgcgcgaccccgcgcttaaaaattccctttcgaaaccgaactaaaaaacgacttcacgatccctaaatcctaccctaccgaaaaatactaaacacaaaaacgaacaaccgacttaacgaaccaaa

SEQ ID NO: 11835 - DNA, 554 bp, Artificial Sequence
  chemically treated genomic DNA (Homo sapiens) CpG-island No: 11835
gaaagaagttcggatgggtttttttagaatataatgtttaatagttgagcggtttagggatcgttagaaatattaagcgcgggttggagtttgaattcgaggcgtttgcgtttttttcgtagggatttttacgttttatcgggtggggtttacgcggtcgtcgggagggggtaggaaatgtaatcgttcgcgagacgtagagttaaaaatttaaatgatcgcgggttttttcgtcgtttggggtttttcgcgtttttttcgattttacgtacgcgcgcgtgtttcgggaagttatcggggatagtgcgtagggcgtggtttgtttcgtcgggggttcggatcggtttttgcgttcgtagttttcggtagtcgtttagggaaggtcgtttttttcgcgaggtttgggtaggcgggaagggttttaggtcgcgcgcggtttcgcgtttgggagttttttttcggggtcgggttggggagcggttttacggtttttggattttgttttgtcgagaagtgttgggtataggagcgagtagtcggtttagcgggttagg

SEQ ID NO: 11836 - DNA, 554 bp, Artificial Sequence
  chemically treated genomic DNA (Homo sapiens) CpG-island No: 11836
cctaacccgctaaaccgactactcgctcctatacccaacacttctcgacaaaacaaaatccaaaaaccgtaaaaccgctccccaacccgaccccgaaaaaaaactcccaaacgcgaaaccgcgcgcgacctaaaacccttcccgcctacccaaacctcgcgaaaaaaacgaccttccctaaacgactaccgaaaactacgaacgcaaaaaccgatccgaacccccgacgaaacaaaccacgccctacgcactatccccgataacttcccgaaacacgcgcgcgtacgtaaaatcgaaaaaaacgcgaaaaaccccaaacgacgaaaaaacccgcgatcatttaaatttttaactctacgtctcgcgaacgattacatttcctaccccctcccgacgaccgcgtaaaccccacccgataaaacgtaaaaatccctacgaaaaaaacgcaaacgcctcgaattcaaactccaacccgcgcttaatatttctaacgatccctaaaccgctcaactattaaacattatattctaaaaaaacccatccgaacttctttc

SEQ ID NO: 11837 - DNA, 647 bp, Artificial Sequence
  chemically treated genomic DNA (Homo sapiens) CpG-island No: 11837
ggatgtcgggagcggggcgagcgggcgggggttgttagttcgatttcgcgagagaggacggaagtttgtgggagttcgtggtttttaaagtgtcgtttagtttttttttttaggggtgttttgtaaatacggttgtgtttagggttcgcgggtgatcgaaaggattatgaattagtgatttggaaaggtgagtaacgatgggtagaggttagtagggttggagattgtagggatacggagaaagaaggcgttaatatggcgacgtcgtttagtatagtttttatttttcgttttttattatttcgggtgtttttgacgtgttttttagtttttggggcgattgtggttgtgttgttatttcggcggttcgcgcggtgtgggttttgggaatttgattggttgggtcggatcgttaggtaattagcgttcgttgtttcggtttttttttttcgcgcgtttttttaaggtagaggaaaaaggaataacggtttttttttagattttttttttcgaattatttttattttatttgggttagtttagaggttttcggggcgcgcgtcgagttagtcgtgtgcgtagggagattttttttatttatagtttttgggttgggcggggagagggtttattttggtttttttatt

SEQ ID NO: 11838 - DNA, 647 bp, Artificial Sequence
  chemically treated genomic DNA (Homo sapiens) CpG-island No: 11838
aataaaaaaaccaaaataaaccctctccccgcccaacccaaaaactataaataaaaaaaatctccctacgcacacgactaactcgacgcgcgccccgaaaacctctaaactaacccaaataaaataaaaataattcgaaaaaaaaaatctaaaaaaaaaccgttattcctttttcctctaccttaaaaaaacgcgcgaaaaaaaaaaaccgaaacaacgaacgctaattacctaacgatccgacccaaccaatcaaattcccaaaacccacaccgcgcgaaccgccgaaataacaacacaaccacaatcgccccaaaaactaaaaaacacgtcaaaaacacccgaaataataaaaaacgaaaaataaaaactatactaaacgacgtcgccatattaacgccttctttctccgtatccctacaatctccaaccctactaacctctacccatcgttactcacctttccaaatcactaattcataatcctttcgatcacccgcgaaccctaaacacaaccgtatttacaaaacacccctaaaaaaaaaaactaaacgacactttaaaaaccacgaactcccacaaacttccgtcctctctcgcgaaatcgaactaacaacccccgcccgctcgccccgctcccgacatcc

SEQ ID NO: 11839 - DNA, 647 bp, Artificial Sequence
  chemically treated genomic DNA (Homo sapiens) CpG-island No: 11839
ggtggggagattagagtgggtttttttttcgtttaatttaaggattgtgggtgggagaggtttttttgcgtatacggttgattcgacgcgcgtttcgaggatttttgaattgatttaagtagggtgaagataattcggagggaggggtttaagagggagtcgttattttttttttttttgttttaggaaagcgcgcgagagggaggggtcggaataacgaacgttggttatttaacggttcggtttagttagttaggtttttaaagtttatatcgcgcgggtcgtcgaggtggtagtatagttataatcgttttaagggttaaggagtacgttaggagtattcgaggtgatgggaaacggggggtggggattgtgttgagcgacgtcgttatgttagcgtttttttttttcgtatttttatagtttttagttttgttgatttttgtttatcgttatttatttttttaggttattagtttatgattttttcggttattcgcgagttttgagtatagtcgtgtttataaagtatttttggaggaaaaggttgaacggtattttaaaggttacgggtttttataggttttcgttttttttcgcgagatcggattgataattttcgttcgttcgtttcgttttcggtattt

SEQ ID NO: 11840 - DNA, 647 bp, Artificial Sequence
  chemically treated genomic DNA (Homo sapiens) CpG-island No: 11840
aaataccgaaaacgaaacgaacgaacgaaaattatcaatccgatctcgcgaaaaaaaacgaaaacctataaaaacccgtaacctttaaaataccgttcaaccttttcctccaaaaatactttataaacacgactatactcaaaactcgcgaataaccgaaaaaatcataaactaataacctaaaaaaataaataacgataaacaaaaatcaacaaaactaaaaactataaaaatacgaaaaaaaaaaacgctaacataacgacgtcgctcaacacaatccccaccccccgtttcccatcacctcgaatactcctaacgtactccttaacccttaaaacgattataactatactaccacctcgacgacccgcgcgatataaactttaaaaacctaactaactaaaccgaaccgttaaataaccaacgttcgttattccgacccctccctctcgcgcgctttcctaaaacaaaaaaaaaaaaaataacgactccctcttaaacccctccctccgaattatcttcaccctacttaaatcaattcaaaaatcctcgaaacgcgcgtcgaatcaaccgtatacgcaaaaaaacctctcccacccacaatccttaaattaaacgaaaaaaaaacccactctaatctccccacc

SEQ ID NO: 11841 - DNA, 539 bp, Artificial Sequence
  chemically treated genomic DNA (Homo sapiens) CpG-island No: 11841
agtagtaaatttgtcgtatttggttaggttatttggggggtttcgtcgtttagtcgtcgtcgttttgggaggggaaatagagttcgttggaaaatcggaaatagcgtaacgttagcgttttttagttttttatcggtagttcggggaggtggtttagttagggtagggggtaggcggtaagcgggtcgcgatgcgtagcgcggcgtagcgtagcgtttttattttgtgcgttaggatttggaggaggatgcggaggatgggacgttcgtttatttgttttttcgcgttttttttgttttcggatcgagtagggagcgcggtttttgtaggggaagtttgggattgtattgttttagtgttcgtttttagttcgtaggggcgcgggaggaatcgtgttattttttgttttcgggatttatcggtatgatagtgggggtggtgcgtgaggagaaggcgaagaagagataacgggtttttggtattattttatgaacgtggtaatgggacgtagggcgtgttttttgtttttggttagtagt

SEQ ID NO: 11842 - DNA, 539 bp, Artificial Sequence
  chemically treated genomic DNA (Homo sapiens) CpG-island No: 11842
actactaaccaaaaacaaaaaacacgccctacgtcccattaccacgttcataaaataataccaaaaacccgttatctcttcttcgccttctcctcacgcaccacccccactatcataccgataaatcccgaaaacaaaaaataacacgattcctcccgcgcccctacgaactaaaaacgaacactaaaacaatacaatcccaaacttcccctacaaaaaccgcgctccctactcgatccgaaaacaaaaaaaacgcgaaaaaacaaataaacgaacgtcccatcctccgcatcctcctccaaatcctaacgcacaaaataaaaacgctacgctacgccgcgctacgcatcgcgacccgcttaccgcctaccccctaccctaactaaaccacctccccgaactaccgataaaaaactaaaaaacgctaacgttacgctatttccgattttccaacgaactctatttcccctcccaaaacgacgacgactaaacgacgaaaccccccaaataacctaaccaaatacgacaaatttactact

SEQ ID NO: 11843 - DNA, 539 bp, Artificial Sequence
  chemically treated genomic DNA (Homo sapiens) CpG-island No: 11843
gttgttggttaaaggtagggggtacgttttgcgttttattattacgtttataggatggtgttaggagttcgttatttttttttcgttttttttttacgtattatttttattgttatgtcgataaatttcgggagtaaagggtggtacgatttttttcgcgtttttgcgggttgaaggcgggtattaaagtagtgtagttttaagttttttttgtagaagtcgcgttttttattcggttcgggggtagagggggcgcgagagagtaagtgggcgggcgttttatttttcgtatttttttttaggttttggcgtatagggtgggagcgttgcgttgcgtcgcgttgcgtatcgcggttcgtttgtcgtttgttttttgttttagttgggttattttttcgggttgtcggtggagggttaagaggcgttaacgttacgttgttttcggttttttagcgggttttgtttttttttttaaggcggcggcggttgagcggcggagttttttaaatggtttggttagatgcggtaggtttgttgtt

SEQ ID NO: 11844 - DNA, 539 bp, Artificial Sequence
  chemically treated genomic DNA (Homo sapiens) CpG-island No: 11844
aacaacaaacctaccgcatctaaccaaaccatttaaaaaactccgccgctcaaccgccgccgccttaaaaaaaaaaacaaaacccgctaaaaaaccgaaaacaacgtaacgttaacgcctcttaaccctccaccgacaacccgaaaaaataacccaactaaaacaaaaaacaaacgacaaacgaaccgcgatacgcaacgcgacgcaacgcaacgctcccaccctatacgccaaaacctaaaaaaaaatacgaaaaataaaacgcccgcccacttactctctcgcgccccctctacccccgaaccgaataaaaaacgcgacttctacaaaaaaaacttaaaactacactactttaatacccgccttcaacccgcaaaaacgcgaaaaaaatcgtaccaccctttactcccgaaatttatcgacataacaataaaaataatacgtaaaaaaaaaacgaaaaaaaaataacgaactcctaacaccatcctataaacgtaataataaaacgcaaaacgtaccccctacctttaaccaacaac

SEQ ID NO: 11845 - DNA, 583 bp, Artificial Sequence
  chemically treated genomic DNA (Homo sapiens) CpG-island No: 11845
tcgagttattacggttacgatggcgttacgcgacgcgtaagtcgtcgttaatgtcgattttgtacgacgttgtcgttcgatgattatgtattcgacgttcgatattaagcgtagttttacgtcgttattcggtgacgagtcgaatgtttattattattttcgacgtcgacgttacgattttatacgtcggatggtatgatcgatttagcgtacgagtcgacgtttatttgttcgattgtacgtaattgtttttatgtgtttcgtttggttattatttgtatttacgatatcgttcgcgtttatttttatcgtatgtttcgttatttatgttattattatattgtatcgttcgatattattttttatatcgtttttatttattttttttttaatttattatttttacgtattttttttttattttatttattttttatatttttttttttcgtattttttttttttttttttagattaattattacgtacgttttatattttcgtggtgaatgttatgattgtttttacgtttttttcggcgacgattattatattgtcgatattatggtatcgcgtcgtgata

SEQ ID NO: 11846 - DNA, 583 bp, Artificial Sequence
  chemically treated genomic DNA (Homo sapiens) CpG-island No: 11846
tatcacgacgcgataccataatatcgacaatataataatcgtcgccgaaaaaaacgtaaaaacaatcataacattcaccacgaaaatataaaacgtacgtaataattaatctaaaaaaaaaaaaaaaaaatacgaaaaaaaaaaatataaaaaataaataaaataaaaaaaaaatacgtaaaaataataaattaaaaaaaaaataaataaaaacgatataaaaaataatatcgaacgatacaatataataataacataaataacgaaacatacgataaaaataaacgcgaacgatatcgtaaatacaaataataaccaaacgaaacacataaaaacaattacgtacaatcgaacaaataaacgtcgactcgtacgctaaatcgatcataccatccgacgtataaaatcgtaacgtcgacgtcgaaaataataataaacattcgactcgtcaccgaataacgacgtaaaactacgcttaatatcgaacgtcgaatacataatcatcgaacgacaacgtcgtacaaaatcgacattaacgacgacttacgcgtcgcgtaacgccatcgtaaccgtaataactcga

SEQ ID NO: 11847 - DNA, 583 bp, Artificial Sequence
  chemically treated genomic DNA (Homo sapiens) CpG-island No: 11847
tgttacgacgcggtgttatgatgtcgataatgtgatggtcgtcgtcgggaggagcgtgggaatagttatggtatttattacgagagtgtagagcgtgcgtgatgattgatttggaaaggggaagaggaagtacgagaagaggggatgtaaagggtgggtagagtgagaggaggatgcgtagaggtagtaggttggggagaaggtaggtgagagcgatatgaaggatgatgtcgagcgatgtaatgtggtagtagtatgagtggcggggtatgcgatgagagtgagcgcgggcgatatcgtaagtgtaggtagtggttagacgagatatatgagggtaattgcgtgtagtcggatagatgagcgtcgattcgtgcgttggatcgattatattattcggcgtgtagagtcgtggcgtcgacgtcgagggtggtgatggatattcgattcgttatcgagtggcgacgtggaattacgtttagtgtcgaacgtcgagtgtatggttatcgagcggtagcgtcgtgtagggtcggtattggcggcgatttacgcgtcgcgtgacgttatcgtagtcgtgatggttcgg

SEQ ID NO: 11848 - DNA, 583 bp, Artificial Sequence
  chemically treated genomic DNA (Homo sapiens) CpG-island No: 11848
ccgaaccatcacgactacgataacgtcacgcgacgcgtaaatcgccgccaataccgaccctacacgacgctaccgctcgataaccatacactcgacgttcgacactaaacgtaattccacgtcgccactcgataacgaatcgaatatccatcaccaccctcgacgtcgacgccacgactctacacgccgaataatataatcgatccaacgcacgaatcgacgctcatctatccgactacacgcaattaccctcatatatctcgtctaaccactacctacacttacgatatcgcccgcgctcactctcatcgcataccccgccactcatactactaccacattacatcgctcgacatcatccttcatatcgctctcacctaccttctccccaacctactacctctacgcatcctcctctcactctacccaccctttacatcccctcttctcgtacttcctcttcccctttccaaatcaatcatcacgcacgctctacactctcgtaataaataccataactattcccacgctcctcccgacgacgaccatcacattatcgacatcataacaccgcgtcgtaaca

SEQ ID NO: 11849 - DNA, 525 bp, Artificial Sequence
  chemically treated genomic DNA (Homo sapiens) CpG-island No: 11849
agagggcgcgtttcgaagatgtttattcgtagtatcgcgtaggttgacgtttttttttttttcgggttggaggtgagagcgtttttttttttattacgtttttattttttcggtttcggattacgttatagttggtaaaaggatttttttatgagaaaatagataagttaattagcgcgtcgtatattcgattttttaggttcgtacgggcggtcgttcgggtttttagttcgatatagcgttttaggggttgataaggaggtcgcggggttacgttttttggggtaacggttcgagggtttcgcggaatttcggtgtagaagtttggatttttcgagtagttttcgcgtttttttcggttcggtttcgagtttgtagacggcgttttcggggttaatttagcgcgagaagaggaagcgacgtagcgagtaataggttgtatggacggatagcggattgaaggggggtgtgtgtgtgtttgtttgttaataaggtcgttttattttttcgttgtcgagtcgggta

SEQ ID NO: 11850 - DNA, 525 bp, Artificial Sequence
  chemically treated genomic DNA (Homo sapiens) CpG-island No: 11850
tacccgactcgacaacgaaaaaataaaacgaccttattaacaaacaaacacacacacaccccccttcaatccgctatccgtccatacaacctattactcgctacgtcgcttcctcttctcgcgctaaattaaccccgaaaacgccgtctacaaactcgaaaccgaaccgaaaaaaacgcgaaaactactcgaaaaatccaaacttctacaccgaaattccgcgaaaccctcgaaccgttaccccaaaaaacgtaaccccgcgacctccttatcaacccctaaaacgctatatcgaactaaaaacccgaacgaccgcccgtacgaacctaaaaaatcgaatatacgacgcgctaattaacttatctattttctcataaaaaaatccttttaccaactataacgtaatccgaaaccgaaaaaataaaaacgtaataaaaaaaaaaacgctctcacctccaacccgaaaaaaaaaaaaacgtcaacctacgcgatactacgaataaacatcttcgaaacgcgccctct

SEQ ID NO: 11851 - DNA, 525 bp, Artificial Sequence
  chemically treated genomic DNA (Homo sapiens) CpG-island No: 11851
tgttcggttcggtagcgggaaggtgagacggttttgttggtaggtagatatatatatatttttttttagttcgttgttcgtttatatagtttgttattcgttgcgtcgtttttttttttcgcgttgagttagtttcgggggcgtcgtttgtaggttcggagtcgagtcggagggggcgcggaggttgttcggagggtttagatttttgtatcgggatttcgcgagattttcgggtcgttgttttagggagcgtgatttcgcggtttttttgttagtttttggagcgttgtgtcgggttgagagttcgggcggtcgttcgtgcgagtttgggaggtcgagtgtgcggcgcgttggttgatttgtttgtttttttatgaaaaagtttttttgttagttgtggcgtaattcgaggtcgggaaggtagggacgtggtaggaggaagggcgtttttatttttagttcgagaggaggggaggcgttagtttgcgcggtgttgcgggtggatattttcgggacgcgtttttt

SEQ ID NO: 11852 - DNA, 525 bp, Artificial Sequence
  chemically treated genomic DNA (Homo sapiens) CpG-island No: 11852
aaaaaacgcgtcccgaaaatatccacccgcaacaccgcgcaaactaacgcctcccctcctctcgaactaaaaataaaaacgcccttcctcctaccacgtccctaccttcccgacctcgaattacgccacaactaacaaaaaaactttttcataaaaaaacaaacaaatcaaccaacgcgccgcacactcgacctcccaaactcgcacgaacgaccgcccgaactctcaacccgacacaacgctccaaaaactaacaaaaaaaccgcgaaatcacgctccctaaaacaacgacccgaaaatctcgcgaaatcccgatacaaaaatctaaaccctccgaacaacctccgcgccccctccgactcgactccgaacctacaaacgacgcccccgaaactaactcaacgcgaaaaaaaaaaacgacgcaacgaataacaaactatataaacgaacaacgaactaaaaaaaaatatatatatatctacctaccaacaaaaccgtctcaccttcccgctaccgaaccgaaca

SEQ ID NO: 11853 - DNA, 852 bp, Artificial Sequence
  chemically treated genomic DNA (Homo sapiens) CpG-island No: 11853
tcgtcgttttttttcgttgttaatgcgtaggcgttggcgggatagcgcgtcgtcgagtcgagaaagaggttacgaattttgattttttagaaatatttaaatatagaaagtttttttcgtcgtgaatttcgattttatatttcgtcggttttttttaattttttttttcggagcgttttttaatttacgagtggtagtcgcgggattgtcgcgtcggcgttcgacgtcggagttagtagggcgtaaaagcgtcggtaagaaacgttgggtggggatattagcgatcgcgtcgggggcgggggttagggggtgttttttattttaatcgttaacggacgcggttttagcgtatttttcggtcggcgttttgcggttagcggagtcgtttagtttgggagcgtcgtttggggttgttcgatttcggttgggagcgcggagttgcggcgttaaatgcgcggggtttcgggagaggcgggggcgataggggcggcgggacgcggggtcggacggcgagcggtttggagtatataattttttttttagttgcgtttatcgtagcgtttttgatttttaatttgtagggaaagttttcgcggcgttgtagtttttttcgttcgggagagtcgcgcgtagcgtcggggtttttagggcgtacggttaacgtcggtacgagtgagacgtgggagaggtcgattttcggttagtggtcgtaagtttcggtttgtatttcgttattaattttcgtgtttttacgggacggatagaatgattttttttatttttattttttttttacggtaaatttggttagggtcgtcgtttgttgtgggtttggatttttttagaagaaat

SEQ ID NO: 11854 - DNA, 852 bp, Artificial Sequence
  chemically treated genomic DNA (Homo sapiens) CpG-island No: 11854
atttcttctaaaaaaatccaaacccacaacaaacgacgaccctaaccaaatttaccgtaaaaaaaaaataaaaataaaaaaaatcattctatccgtcccgtaaaaacacgaaaattaataacgaaatacaaaccgaaacttacgaccactaaccgaaaatcgacctctcccacgtctcactcgtaccgacgttaaccgtacgccctaaaaaccccgacgctacgcgcgactctcccgaacgaaaaaaactacaacgccgcgaaaactttccctacaaattaaaaatcaaaaacgctacgataaacgcaactaaaaaaaaaattatatactccaaaccgctcgccgtccgaccccgcgtcccgccgcccctatcgcccccgcctctcccgaaaccccgcgcatttaacgccgcaactccgcgctcccaaccgaaatcgaacaaccccaaacgacgctcccaaactaaacgactccgctaaccgcaaaacgccgaccgaaaaatacgctaaaaccgcgtccgttaacgattaaaataaaaaacaccccctaacccccgcccccgacgcgatcgctaatatccccacccaacgtttcttaccgacgcttttacgccctactaactccgacgtcgaacgccgacgcgacaatcccgcgactaccactcgtaaattaaaaaacgctccgaaaaaaaaaattaaaaaaaaccgacgaaatataaaatcgaaattcacgacgaaaaaaactttctatatttaaatatttctaaaaaatcaaaattcgtaacctctttctcgactcgacgacgcgctatcccgccaacgcctacgcattaacaacgaaaaaaaacgacga

SEQ ID NO: 11855 - DNA, 852 bp, Artificial Sequence
  chemically treated genomic DNA (Homo sapiens) CpG-island No: 11855
attttttttgaaaagatttaggtttatagtaagcgacgattttggttagatttgtcgtgagagaaaagtgaaagtggggggagttattttgttcgtttcgtgaaagtacgggagttagtgacgggatgtaggtcgggatttgcggttattagtcgagggtcggttttttttacgttttattcgtgtcggcgttagtcgtgcgttttggaagtttcggcgttgcgcgcggttttttcgggcggggaaagttgtagcgtcgcggaagttttttttgtaggttaaaggttagaggcgttgcggtaagcgtagttggaaagggggttgtgtgttttaagtcgttcgtcgttcggtttcgcgtttcgtcgtttttgtcgttttcgtttttttcggggtttcgcgtatttggcgtcgtagtttcgcgtttttagtcgaagtcgagtagttttaagcggcgtttttaaattgaacggtttcgttggtcgtaggacgtcggtcgggggatgcgttgggatcgcgttcgttggcggttggggtgaagggtattttttggttttcgttttcgacgcggtcgttggtgtttttatttagcgttttttatcggcgtttttgcgttttgttgatttcggcgtcgggcgtcgacgcgatagtttcgcggttgttattcgtggattggggggcgtttcgggaagagaggttgaagaaagtcgacgggatgtgggatcgagatttacggcggagagagttttttgtgtttgggtatttttggggggttagagttcgtgatttttttttcggttcggcggcgcgttatttcgttagcgtttgcgtattagtaacggggagaagcggcga

SEQ ID NO: 11856 - DNA, 852 bp, Artificial Sequence
  chemically treated genomic DNA (Homo sapiens) CpG-island No: 11856
tcgccgcttctccccgttactaatacgcaaacgctaacgaaataacgcgccgccgaaccgaaaaaaaaatcacgaactctaaccccccaaaaatacccaaacacaaaaaactctctccgccgtaaatctcgatcccacatcccgtcgactttcttcaacctctcttcccgaaacgccccccaatccacgaataacaaccgcgaaactatcgcgtcgacgcccgacgccgaaatcaacaaaacgcaaaaacgccgataaaaaacgctaaataaaaacaccaacgaccgcgtcgaaaacgaaaaccaaaaaatacccttcaccccaaccgccaacgaacgcgatcccaacgcatcccccgaccgacgtcctacgaccaacgaaaccgttcaatttaaaaacgccgcttaaaactactcgacttcgactaaaaacgcgaaactacgacgccaaatacgcgaaaccccgaaaaaaacgaaaacgacaaaaacgacgaaacgcgaaaccgaacgacgaacgacttaaaacacacaaccccctttccaactacgcttaccgcaacgcctctaacctttaacctacaaaaaaaacttccgcgacgctacaactttccccgcccgaaaaaaccgcgcgcaacgccgaaacttccaaaacgcacgactaacgccgacacgaataaaacgtaaaaaaaaccgaccctcgactaataaccgcaaatcccgacctacatcccgtcactaactcccgtactttcacgaaacgaacaaaataactccccccactttcacttttctctcacgacaaatctaaccaaaatcgtcgcttactataaacctaaatcttttcaaaaaaaat

SEQ ID NO: 11857 - DNA, 564 bp, Artificial Sequence
  chemically treated genomic DNA (Homo sapiens) CpG-island No: 11857
cgtcgattttcgttagcgagtcgtcggatttcggggtcgatattcggttattcggagattcgattattcgttacgcgattacgtcggggtttttggtttagcgttcgtcggttttcgcggtttcggttttaagttcgagttttaggttagttaagttcgttttttcgtcgtcgttcgtttggcgtagcgcgaggtcgggtcggaggaatgtggttttgaagtgggcggggtagggcgggggcggggtcggagggcgagttgggggcggggtcggagggcgagttgggggcggggttgcgcgcgggggcgagattgtacggagcgtgtggggaagagagtataggaggcgtggttatacggcgtcgcggaagaagtatagggggcggggggttaggggcggggcgttaggggcggggttacgcgtaggggcggggtcgagtcgaggcgcggggtgtagagcgtaagggcggagttttagatattgtatttaggttttagcgcgcgaagtttttgttttggaaggaggattttgcgtagtttttttaatattggcgtttttcggga

SEQ ID NO: 11858 - DNA, 564 bp, Artificial Sequence
  chemically treated genomic DNA (Homo sapiens) CpG-island No: 11858
tcccgaaaaacgccaatattaaaaaaactacgcaaaatcctccttccaaaacaaaaacttcgcgcgctaaaacctaaatacaatatctaaaactccgcccttacgctctacaccccgcgcctcgactcgaccccgcccctacgcgtaaccccgcccctaacgccccgcccctaaccccccgccccctatacttcttccgcgacgccgtataaccacgcctcctatactctcttccccacacgctccgtacaatctcgcccccgcgcgcaaccccgcccccaactcgccctccgaccccgcccccaactcgccctccgaccccgcccccgccctaccccgcccacttcaaaaccacattcctccgacccgacctcgcgctacgccaaacgaacgacgacgaaaaaacgaacttaactaacctaaaactcgaacttaaaaccgaaaccgcgaaaaccgacgaacgctaaaccaaaaaccccgacgtaatcgcgtaacgaataatcgaatctccgaataaccgaatatcgaccccgaaatccgacgactcgctaacgaaaatcgacg

SEQ ID NO: 11859 - DNA, 564 bp, Artificial Sequence
  chemically treated genomic DNA (Homo sapiens) CpG-island No: 11859
tttcgggaggcgttagtgttggaggggttgcgtaaagttttttttttagaatagaggtttcgcgcgttgggatttggatgtagtgtttgggatttcgtttttgcgttttgtatttcgcgtttcggttcggtttcgtttttgcgcgtagtttcgtttttgacgtttcgtttttgatttttcgttttttgtgtttttttcgcggcgtcgtgtggttacgttttttgtgtttttttttttatacgtttcgtgtagtttcgttttcgcgcgtagtttcgtttttagttcgtttttcggtttcgtttttagttcgtttttcggtttcgttttcgttttgtttcgtttattttagggttatattttttcggttcggtttcgcgttgcgttaagcgggcggcggcggaggggcgggtttggttggtttggggttcggatttggggtcggagtcgcgggagtcggcggacgttggattaggagtttcgacgtgatcgcgtggcgggtggtcgggttttcgggtggtcgggtgtcggtttcgggattcggcggttcgttggcgggagtcggcg

SEQ ID NO: 11860 - DNA, 564 bp, Artificial Sequence
  chemically treated genomic DNA (Homo sapiens) CpG-island No: 11860
cgccgactcccgccaacgaaccgccgaatcccgaaaccgacacccgaccacccgaaaacccgaccacccgccacgcgatcacgtcgaaactcctaatccaacgtccgccgactcccgcgactccgaccccaaatccgaaccccaaaccaaccaaacccgcccctccgccgccgcccgcttaacgcaacgcgaaaccgaaccgaaaaaatataaccctaaaataaacgaaacaaaacgaaaacgaaaccgaaaaacgaactaaaaacgaaaccgaaaaacgaactaaaaacgaaactacgcgcgaaaacgaaactacacgaaacgtataaaaaaaaaaacacaaaaaacgtaaccacacgacgccgcgaaaaaaacacaaaaaacgaaaaatcaaaaacgaaacgtcaaaaacgaaactacgcgcaaaaacgaaaccgaaccgaaacgcgaaatacaaaacgcaaaaacgaaatcccaaacactacatccaaatcccaacgcgcgaaacctctattctaaaaaaaaaactttacgcaacccctccaacactaacgcctcccgaaa

SEQ ID NO: 11861 - DNA, 1055 bp, Artificial Sequence
  chemically treated genomic DNA (Homo sapiens) CpG-island No: 11861
atttggtttgaggtgcgtttgttcgttgtttattgggggtttggggtagtttgagggaaatgtcgggggtcgtagtgttttcggtttcgcgtttggatttcgcgtatttcgtttttttgatttattcgttgtagcggttgtatcgatttgagcgttttttattcgtttaggttcgggtgacgtcggcggtcggggcggtatcgtttttttcgttttttagtatagtcgcgtacgtatatatatttttcgaggggggaaattgaggttaggcgcggcgaggttattcgttaaggttacggcgtacgggcggtggggcgggtaggagggcggcgcgcggggaggtcgtttcgtcggtggcgttggtatcgggttcgggtttcggtttcggttttcgagcgttcgttttcgttttttcgcgttcggttatcggacgttttggggtcgcgtcggtcgcggggacggcgcgttttcggcggttgcgggcggattcgcgaggtaggaggcgggtcggcgggggacgcgttcggcgatcggtgcggtgcggggtttcgggcgggggtcgttggggttgtagtcgggaatgtttttcgcggggcggtttgggcggtagtttcgttttcggggtcgcggttgtatcgatacgtagttggttttcgggaatttggggcgcgcggggatcgcggcgggtttcgcggagcgggtttcggaaggaggttgcgaggtcgtagttgttaagttcgtatcggtcgtagggttgtggggttggggattagcggtcgttaagtttacgggaatgggggtcggggcgcgttagcgttagtttttttgagttgggttgtgcggtgtcgttttttgggattggagcggtgaggacgtagaagttttaattttcgcggttatgtagacggtttatttcgaagttttgcgaacgttaaaggcgcgatattgggggtcggggaggggcggggtgttttatttttttattagtgtagttggttgttttttcgaagcgggggtacgtgaatttagatttcgagggtcgttatgtaaagtat

SEQ ID NO: 11862 - DNA, 1055 bp, Artificial Sequence
  chemically treated genomic DNA (Homo sapiens) CpG-island No: 11862
atactttacataacgaccctcgaaatctaaattcacgtacccccgcttcgaaaaaacaaccaactacactaataaaaaaataaaacaccccgcccctccccgacccccaatatcgcgcctttaacgttcgcaaaacttcgaaataaaccgtctacataaccgcgaaaattaaaacttctacgtcctcaccgctccaatcccaaaaaacgacaccgcacaacccaactcaaaaaaactaacgctaacgcgccccgacccccattcccgtaaacttaacgaccgctaatccccaaccccacaaccctacgaccgatacgaacttaacaactacgacctcgcaacctccttccgaaacccgctccgcgaaacccgccgcgatccccgcgcgccccaaattcccgaaaaccaactacgtatcgatacaaccgcgaccccgaaaacgaaactaccgcccaaaccgccccgcgaaaaacattcccgactacaaccccaacgacccccgcccgaaaccccgcaccgcaccgatcgccgaacgcgtcccccgccgacccgcctcctacctcgcgaatccgcccgcaaccgccgaaaacgcgccgtccccgcgaccgacgcgaccccaaaacgtccgataaccgaacgcgaaaaaacgaaaacgaacgctcgaaaaccgaaaccgaaacccgaacccgataccaacgccaccgacgaaacgacctccccgcgcgccgccctcctacccgccccaccgcccgtacgccgtaaccttaacgaataacctcgccgcgcctaacctcaatttcccccctcgaaaaatatatatacgtacgcgactatactaaaaaacgaaaaaaacgataccgccccgaccgccgacgtcacccgaacctaaacgaataaaaaacgctcaaatcgatacaaccgctacaacgaataaatcaaaaaaacgaaatacgcgaaatccaaacgcgaaaccgaaaacactacgacccccgacatttccctcaaactaccccaaacccccaataaacaacgaacaaacgcacctcaaaccaaat

SEQ ID NO: 11863 - DNA, 1055 bp, Artificial Sequence
  chemically treated genomic DNA (Homo sapiens) CpG-island No: 11863
gtgttttgtatggcgattttcggggtttggatttacgtattttcgtttcggggaggtaattaattgtattgatgaagagatggagtatttcgttttttttcgatttttaatatcgcgtttttagcgttcgtaaggtttcgggataagtcgtttgtatagtcgcggaggttggggtttttgcgtttttatcgttttagttttagagagcgatatcgtatagtttagtttagaaagattggcgttggcgcgtttcggtttttattttcgtgagtttggcggtcgttgatttttaattttataattttgcggtcggtgcgggtttagtaattgcggtttcgtaattttttttcgagattcgtttcgcgaagttcgtcgcgattttcgcgcgttttaggttttcgagagttaattgcgtgtcggtgtaatcgcggtttcgggggcggagttgtcgtttaggtcgtttcgcggagggtattttcggttgtagttttagcgattttcgttcggggtttcgtatcgtatcggtcgtcgggcgcgtttttcgtcggttcgttttttatttcgcgggttcgttcgtagtcgtcgagagcgcgtcgttttcgcggtcggcgcggttttagagcgttcggtggtcgggcgcgggggggcgggggcgggcgttcgggagtcggagtcggagttcgagttcgatattagcgttatcggcggggcggttttttcgcgcgtcgtttttttgttcgttttatcgttcgtgcgtcgtgattttggcgggtggtttcgtcgcgtttggttttagttttttttttcggaaggtgtgtgtgcgtgcgcggttgtgttggggggcggggaggacggtgtcgtttcggtcgtcgacgttattcgagtttggacgagtggagggcgtttaggtcggtgtagtcgttgtagcggatgggttaggagagcggggtacgcggggtttaggcgcggaatcgggggtattgcgattttcggtattttttttagattattttagatttttaataaatagcgaataaacgtattttaggttaagt

SEQ ID NO: 11864 - DNA, 1055 bp, Artificial Sequence
  chemically treated genomic DNA (Homo sapiens) CpG-island No: 11864
acttaacctaaaatacgtttattcgctatttattaaaaatctaaaataatctaaaaaaaataccgaaaatcgcaatacccccgattccgcgcctaaaccccgcgtaccccgctctcctaacccatccgctacaacgactacaccgacctaaacgccctccactcgtccaaactcgaataacgtcgacgaccgaaacgacaccgtcctccccgccccccaacacaaccgcgcacgcacacacaccttccgaaaaaaaaaactaaaaccaaacgcgacgaaaccacccgccaaaatcacgacgcacgaacgataaaacgaacaaaaaaacgacgcgcgaaaaaaccgccccgccgataacgctaatatcgaactcgaactccgactccgactcccgaacgcccgcccccgcccccccgcgcccgaccaccgaacgctctaaaaccgcgccgaccgcgaaaacgacgcgctctcgacgactacgaacgaacccgcgaaataaaaaacgaaccgacgaaaaacgcgcccgacgaccgatacgatacgaaaccccgaacgaaaatcgctaaaactacaaccgaaaataccctccgcgaaacgacctaaacgacaactccgcccccgaaaccgcgattacaccgacacgcaattaactctcgaaaacctaaaacgcgcgaaaatcgcgacgaacttcgcgaaacgaatctcgaaaaaaaattacgaaaccgcaattactaaacccgcaccgaccgcaaaattataaaattaaaaatcaacgaccgccaaactcacgaaaataaaaaccgaaacgcgccaacgccaatctttctaaactaaactatacgatatcgctctctaaaactaaaacgataaaaacgcaaaaaccccaacctccgcgactatacaaacgacttatcccgaaaccttacgaacgctaaaaacgcgatattaaaaatcgaaaaaaaacgaaatactccatctcttcatcaatacaattaattacctccccgaaacgaaaatacgtaaatccaaaccccgaaaatcgccatacaaaacac

SEQ ID NO: 11865 - DNA, 634 bp, Artificial Sequence
  chemically treated genomic DNA (Homo sapiens) CpG-island No: 11865
cgcggggcgagttatattttcgggggtggcgggtttttttagggaggttggggcgggagcggggggcggcgttagtagcgggttgtggagggttttggtacgtagcgcgcgtttatatcgtgtttaggagcgagcgaggacgtcgagtaatcgtggtcgttaggttgggcgggggcgtttatttcgttgttatttgggtttattttggggtttttttttttcgtttattcggggtgcggggcgcggggatgaggaggggagggtcgagagaaggttgtttcgggtttgttttcgtagtattcggagaaggggcgggcgcgtcggagttttttttatttttcgcgtttaaggagtaacgtagtgcggtcgcgtcggattaatcgtcgaggcgttggtcgttatggtaatagtagtattaggcgcggtcgtttcgttgcgttttcgcggtaaagttatatattcggcggggcgcggggcgtcggtttttttttggttcgcgttggaaatttggaagtttgttgttaaaatgtacgcgtcgcgcggagtttacgatgatattattttttaaggcggtttttttgttttcggtattgagatacgcgagtcgcggagttttcggggttttggttttgga

SEQ ID NO: 11866 - DNA, 634 bp, Artificial Sequence
  chemically treated genomic DNA (Homo sapiens) CpG-island No: 11866
tccaaaaccaaaaccccgaaaactccgcgactcgcgtatctcaataccgaaaacaaaaaaaccgccttaaaaaataatatcatcgtaaactccgcgcgacgcgtacattttaacaacaaacttccaaatttccaacgcgaaccaaaaaaaaaccgacgccccgcgccccgccgaatatataactttaccgcgaaaacgcaacgaaacgaccgcgcctaatactactattaccataacgaccaacgcctcgacgattaatccgacgcgaccgcactacgttactccttaaacgcgaaaaataaaaaaaactccgacgcgcccgccccttctccgaatactacgaaaacaaacccgaaacaaccttctctcgaccctcccctcctcatccccgcgccccgcaccccgaataaacgaaaaaaaaaaaccccaaaataaacccaaataacaacgaaataaacgcccccgcccaacctaacgaccacgattactcgacgtcctcgctcgctcctaaacacgatataaacgcgcgctacgtaccaaaaccctccacaacccgctactaacgccgccccccgctcccgccccaacctccctaaaaaaacccgccacccccgaaaatataactcgccccgcg

SEQ ID NO: 11867 - DNA, 634 bp, Artificial Sequence
  chemically treated genomic DNA (Homo sapiens) CpG-island No: 11867
tttagggttagagtttcgagagtttcgcggttcgcgtgttttagtgtcgaaggtagaaaagtcgttttggaaagtagtgttatcgtaggtttcgcgcggcgcgtgtattttagtaatagatttttaggtttttagcgcgggttaggaaggggtcggcgtttcgcgtttcgtcgggtgtgtgattttgtcgcgagggcgtagcggagcggtcgcgtttgatgttgttgttgttatggcgattagcgtttcggcgattggttcggcgcggtcgtattacgttgttttttggacgcggggggtgggggaggtttcggcgcgttcgtttttttttcggatgttgcgagagtaaattcggggtagttttttttcgatttttttttttttattttcgcgtttcgtatttcggatggacgggagggaaaaattttaaggtgggtttaggtagtagcgaggtggacgttttcgtttagtttggcgattacggttattcgacgttttcgttcgtttttgggtacggtgtgagcgcgcgttacgtgttagggttttttatagttcgttgttggcgtcgtttttcgttttcgttttagtttttttggaggagttcgttattttcgggaatgtgattcgtttcgcg

SEQ ID NO: 11868 - DNA, 634 bp, Artificial Sequence
  chemically treated genomic DNA (Homo sapiens) CpG-island No: 11868
cgcgaaacgaatcacattcccgaaaataacgaactcctccaaaaaaactaaaacgaaaacgaaaaacgacgccaacaacgaactataaaaaaccctaacacgtaacgcgcgctcacaccgtacccaaaaacgaacgaaaacgtcgaataaccgtaatcgccaaactaaacgaaaacgtccacctcgctactacctaaacccaccttaaaatttttccctcccgtccatccgaaatacgaaacgcgaaaataaaaaaaaaaaaatcgaaaaaaaactaccccgaatttactctcgcaacatccgaaaaaaaaacgaacgcgccgaaacctcccccaccccccgcgtccaaaaaacaacgtaatacgaccgcgccgaaccaatcgccgaaacgctaatcgccataacaacaacaacatcaaacgcgaccgctccgctacgccctcgcgacaaaatcacacacccgacgaaacgcgaaacgccgaccccttcctaacccgcgctaaaaacctaaaaatctattactaaaatacacgcgccgcgcgaaacctacgataacactactttccaaaacgacttttctaccttcgacactaaaacacgcgaaccgcgaaactctcgaaactctaaccctaaa

SEQ ID NO: 11869 - DNA, 735 bp, Artificial Sequence
  chemically treated genomic DNA (Homo sapiens) CpG-island No: 11869
  misc_feature (612)..(612): n is either a, c, g or t
tcgaggcgtaggcgttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggaacggaagattttggtttcggggtgtattcggtattgttggacgcggttttgtacgtaacggttgttcgagatatggatgacgtacgtttgtcgttttagtgggaaggtgtgtttttgtacgttaaggtcgcgtcggttttgcgggttcgcgtggtttcggttggtgacgatgttaagtttttggttggttgtgatgggatcggtcgatcggtgatttcggtggatcgattcgttttggcggtcggtttgnggtcgggaggatcgtttcgcgtttatagcgtttttaagtttcgtttgttttcgtttgagttcgattacgggtttatttgtggatattcgtttagtttttgttttggtttttttttcgagattt

SEQ ID NO: 11870 - DNA, 735 bp, Artificial Sequence
  chemically treated genomic DNA (Homo sapiens) CpG-island No: 11870
  misc_feature (124)..(124): n is either a, c, g or t
aaatctcgaaaaaaaaaccaaaacaaaaactaaacgaatatccacaaataaacccgtaatcgaactcaaacgaaaacaaacgaaacttaaaaacgctataaacgcgaaacgatcctcccgaccncaaaccgaccgccaaaacgaatcgatccaccgaaatcaccgatcgaccgatcccatcacaaccaaccaaaaacttaacatcgtcaccaaccgaaaccacgcgaacccgcaaaaccgacgcgaccttaacgtacaaaaacacaccttcccactaaaacgacaaacgtacgtcatccatatctcgaacaaccgttacgtacaaaaccgcgtccaacaataccgaatacaccccgaaaccaaaatcttccgttcccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaacgcctacgcctcga

SEQ ID NO: 11871 - DNA, 735 bp, Artificial Sequence
  chemically treated genomic DNA (Homo sapiens) CpG-island No: 11871
  misc_feature (124)..(124): n is either a, c, g or t
aggtttcgaaaaaaaagttagagtagagattgaacggatgtttataaatgaattcgtggtcgagtttaaacgggaataaacggagtttgagggcgttatgggcgcgagacggttttttcggttntaagtcggtcgttaaaacgagtcggtttatcgagattatcggtcgatcggttttattataattagttagggatttggtatcgttattagtcgggattacgcggattcgtaaagtcggcgcggttttggcgtgtagggatatatttttttattggaacggtaagcgtgcgttatttatgtttcggatagtcgttgcgtgtagagtcgcgtttagtagtgtcggatgtatttcgaaattagaatttttcgttttcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattagcgtttgcgtttcga

SEQ ID NO: 11872 - DNA, 735 bp, Artificial Sequence
  chemically treated genomic DNA (Homo sapiens) CpG-island No: 11872
  misc_feature (612)..(612): n is either a, c, g or t
tcgaaacgcaaacgctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaaaacgaaaaattctaatttcgaaatacatccgacactactaaacgcgactctacacgcaacgactatccgaaacataaataacgcacgcttaccgttccaataaaaaaatatatccctacacgccaaaaccgcgccgactttacgaatccgcgtaatcccgactaataacgataccaaatccctaactaattataataaaaccgatcgaccgataatctcgataaaccgactcgttttaacgaccgacttanaaccgaaaaaaccgtctcgcgcccataacgccctcaaactccgtttattcccgtttaaactcgaccacgaattcatttataaacatccgttcaatctctactctaacttttttttcgaaacct

SEQ ID NO: 11873 - DNA, 572 bp, Artificial Sequence
  chemically treated genomic DNA (Homo sapiens) CpG-island No: 11873
taatcgggagttttagtgggggatgaataattttcgttagtagatcggtaattattaatagtaacgtatttgttagggtcgaaataggtagtagtttgcggtgacgtttatcggtgatgttacgtattatatgcggtattacgagattaataaagttaatcgggtcgtaggcggttacgtcggtagatgttatggcgatagttagtaataaagtttagaatcgggtatggggtatcgatatatcgagcgtggtggcgcgcgtatcgtcgagtgtaaggaggtcgagatcgcggtaaaaatttaagtttagcggtagaaataaaatttttagcgggatggttatttttataaagttttagttacggttttataagttgtcggtaagttttagaaaggcgttgttatattttgcgggcgcgagaagtatagaatattcgttaggttgttttagtttgttaaaagggttttcgtcggtgagcgtttatttttatattggttgtgggttttttggtcgtattttttagtaaaattaaatttcgttattttcggttcgtaaagtttaataagggaag

SEQ ID NO: 11874 - DNA, 572 bp, Artificial Sequence
  chemically treated genomic DNA (Homo sapiens) CpG-island No: 11874
cttcccttattaaactttacgaaccgaaaataacgaaatttaattttactaaaaaatacgaccaaaaaacccacaaccaatataaaaataaacgctcaccgacgaaaacccttttaacaaactaaaacaacctaacgaatattctatacttctcgcgcccgcaaaatataacaacgcctttctaaaacttaccgacaacttataaaaccgtaactaaaactttataaaaataaccatcccgctaaaaattttatttctaccgctaaacttaaatttttaccgcgatctcgacctccttacactcgacgatacgcgcgccaccacgctcgatatatcgataccccatacccgattctaaactttattactaactatcgccataacatctaccgacgtaaccgcctacgacccgattaactttattaatctcgtaataccgcatataatacgtaacatcaccgataaacgtcaccgcaaactactacctatttcgaccctaacaaatacgttactattaataattaccgatctactaacgaaaattattcatcccccactaaaactcccgatta

SEQ ID NO: 11875 - DNA, 572 bp, Artificial Sequence
  chemically treated genomic DNA (Homo sapiens) CpG-island No: 11875
ttttttttgttgggttttgcgggtcgggaatggcggggtttaattttgttaaaagatgcggttaaaaaatttataattaatataaaagtgggcgtttatcggcgggggtttttttggtaagttggggtagtttgacgaatattttatgtttttcgcgttcgtagaatgtaataacgtttttttgggatttgtcggtagtttatggggtcgtgattggagttttgtaaagatggttatttcgttgaagattttatttttgtcgttgagtttgagtttttgtcgcgatttcgatttttttgtattcggcgatgcgcgcgttattacgttcggtgtgtcggtgttttatattcgattttgggttttgttattagttgtcgttatgatatttatcggcgtggtcgtttgcggttcgattagttttattggtttcgtggtgtcgtatatgatgcgtagtattatcggtggacgttatcgtagattgttgtttgtttcggttttgataggtgcgttgttgttggtggttgtcgatttgttggcgagaattatttattttttattggagttttcggttg

SEQ ID NO: 11876 - DNA, 572 bp, Artificial Sequence
  chemically treated genomic DNA (Homo sapiens) CpG-island No: 11876
caaccgaaaactccaataaaaaataaataattctcgccaacaaatcgacaaccaccaacaacaacgcacctatcaaaaccgaaacaaacaacaatctacgataacgtccaccgataatactacgcatcatatacgacaccacgaaaccaataaaactaatcgaaccgcaaacgaccacgccgataaatatcataacgacaactaataacaaaacccaaaatcgaatataaaacaccgacacaccgaacgtaataacgcgcgcatcgccgaatacaaaaaaatcgaaatcgcgacaaaaactcaaactcaacgacaaaaataaaatcttcaacgaaataaccatctttacaaaactccaatcacgaccccataaactaccgacaaatcccaaaaaaacgttattacattctacgaacgcgaaaaacataaaatattcgtcaaactaccccaacttaccaaaaaaacccccgccgataaacgcccacttttatattaattataaattttttaaccgcatcttttaacaaaattaaaccccgccattcccgacccgcaaaacccaacaaaaaaaa

SEQ ID NO: 11877 - DNA, 708 bp, Artificial Sequence
  chemically treated genomic DNA (Homo sapiens) CpG-island No: 11877
  misc_feature (360)..(360): n is either a, c, g or t
  misc_feature (473)..(473): n is either a, c, g or t
  misc_feature (544)..(544): n is either a, c, g or t
  misc_feature (589)..(590): n is either a, c, g or t
gtatattagcgaagtgttggggttgaattacgataagtcgtaggtagtagatagtacgtcgaaatcgtagttgaaatcgtaattcgtttaaaaagaagtggcggatattgcgttgtaatgatacgttatattcggtatggtatgtcggatgtggcgtatgttgataagacgcgttagcgtcgtattaggtaatcggttcgggcgttagatgttggatgcggcgtaatcgttttatttaatttacggggtggagtattttatagcggtgtaggtttgataagacgcgttagcgtcgtattaggtaatcggtttgggcgttagatgtcggatgcggcgtaatcgttttattcgatttacggngtggagtattttatagcggtgtaggtttgataagacgcgttagcgtcgtattaggtaatcggttcggacgttggatgtcggatgcggcgtaatcgttttatttaatttacggngtggagtattttatagcggtgtaggtttgataagacgcgttagcgtcgtattaggtaatcggtttgggcgntagatgttcggaatgcggcgttaatcgttttattcgatttacggnngtggagtattttatagtcggtgtaggtttgataagacgcgttagcgtcgtattaggtaatcggttcggcgtttggatgttcggatgtcggcgtgatcgttttgtttgatttacgggga

SEQ ID NO: 11878 - DNA, 708 bp, Artificial Sequence
  chemically treated genomic DNA (Homo sapiens) CpG-island No: 11878
  misc_feature (119)..(120): n is either a, c, g or t
  misc_feature (165)..(165): n is either a, c, g or t
  misc_feature (236)..(236): n is either a, c, g or t
  misc_feature (349)..(349): n is either a, c, g or t
tccccgtaaatcaaacaaaacgatcacgccgacatccgaacatccaaacgccgaaccgattacctaatacgacgctaacgcgtcttatcaaacctacaccgactataaaatactccacnnccgtaaatcgaataaaacgattaacgccgcattccgaacatctancgcccaaaccgattacctaatacgacgctaacgcgtcttatcaaacctacaccgctataaaatactccacnccgtaaattaaataaaacgattacgccgcatccgacatccaacgtccgaaccgattacctaatacgacgctaacgcgtcttatcaaacctacaccgctataaaatactccacnccgtaaatcgaataaaacgattacgccgcatccgacatctaacgcccaaaccgattacctaatacgacgctaacgcgtcttatcaaacctacaccgctataaaatactccaccccgtaaattaaataaaacgattacgccgcatccaacatctaacgcccgaaccgattacctaatacgacgctaacgcgtcttatcaacatacgccacatccgacataccataccgaatataacgtatcattacaacgcaatatccgccacttctttttaaacgaattacgatttcaactacgatttcgacgtactatctactacctacgacttatcgtaattcaaccccaacacttcgctaatatac

SEQ ID NO: 11879 - DNA, 708 bp, Artificial Sequence
  chemically treated genomic DNA (Homo sapiens) CpG-island No: 11879
  misc_feature (119)..(120): n is either a, c, g or t
  misc_feature (165)..(165): n is either a, c, g or t
  misc_feature (236)..(236): n is either a, c, g or t
  misc_feature (349)..(349): n is either a, c, g or t
ttttcgtaggttagataaggcggttacgtcggtattcgaatatttaaacgtcgagtcggttgtttgatgcgacgttggcgcgttttattaggtttatatcggttgtgaagtgttttatnntcgtaggtcggataaggcggttaacgtcgtatttcggatatttancgtttaagtcggttgtttgatgcgacgttggcgcgttttattaggtttatatcgttgtgaagtgttttatntcgtaggttggataaggcggttacgtcgtattcgatatttaacgttcgagtcggttgtttgatgcgacgttggcgcgttttattaggtttatatcgttgtgaagtgttttatntcgtaggtcggataaggcggttacgtcgtattcgatatttaacgtttaagtcggttgtttgatgcgacgttggcgcgttttattaggtttatatcgttgtgaagtgttttatttcgtaggttggataaggcggttacgtcgtatttaatatttaacgttcgagtcggttgtttgatgcgacgttggcgcgttttattagtatacgttatattcggtatattatgtcggatgtggcgtattattataacgtaatattcgttatttttttttgaacgggttgcggttttaattgcggtttcggcgtattatttgttgtttgcggtttgtcgtagtttaattttagtatttcgttggtgtat

SEQ ID NO: 11880 - DNA, 708 bp, Artificial Sequence
  chemically treated genomic DNA (Homo sapiens) CpG-island No: 11880
  misc_feature (360)..(360): n is either a, c, g or t
  misc_feature (473)..(473): n is either a, c, g or t
  misc_feature (544)..(544): n is either a, c, g or t
  misc_feature (589)..(590): n is either a, c, g or t
atacaccaacgaaatactaaaattaaactacgacaaaccgcaaacaacaaataatacgccgaaaccgcaattaaaaccgcaacccgttcaaaaaaaaataacgaatattacgttataataatacgccacatccgacataatataccgaatataacgtatactaataaaacgcgccaacgtcgcatcaaacaaccgactcgaacgttaaatattaaatacgacgtaaccgccttatccaacctacgaaataaaacacttcacaacgatataaacctaataaaacgcgccaacgtcgcatcaaacaaccgacttaaacgttaaatatcgaatacgacgtaaccgccttatccgacctacganataaaacacttcacaacgatataaacctaataaaacgcgccaacgtcgcatcaaacaaccgactcgaacgttaaatatcgaatacgacgtaaccgccttatccaacctacganataaaacacttcacaacgatataaacctaataaaacgcgccaacgtcgcatcaaacaaccgacttaaacgntaaatatccgaaatacgacgttaaccgccttatccgacctacgannataaaacacttcacaaccgatataaacctaataaaacgcgccaacgtcgcatcaaacaaccgactcgacgtttaaatattcgaataccgacgtaaccgccttatctaacctacgaaaa

SEQ ID NO: 11881 - DNA, 829 bp, Artificial Sequence
  chemically treated genomic DNA (Homo sapiens) CpG-island No: 11881
cgatttttatttcggtaaggtttgtttcgaaagcggaaacggtttaaggcgaggtggtttcgtttttagaaagacggtcggggattgttttcggatagtgagttcgaaggtattcgtatagaaggcggatgagatcggaacggttttttgggtcggtagttgttgggttttttgaggtggtttcgtttagacgcgtgtcgcgagcgtgagaaattttttagttgttgttgagaagaggacgatgacgaggaagagttatcgttttcgttagatttatcgtttcgggtcgagtgaggaggttttcgtcgcggatagggtaatagttcgtcgtcgttgttgttgttgttgtttcgatttcgtatttggttgttattatcgtcgttattgatttttttatttttaagtttttttttttttttcggcgagaggttattggaggtcggggtcggagtatttgcggtcgttattcggggagtagcgttttttatataattttagtttttcgttcggggattcgttcgataattgtttcgtttttttttttttttaacggattgggtcggtgcggttttattttattcggatattaagcggtttttgttttttaattttttcgtattttagtattttagttttttttcgtcggatcgtcgtaatttagtttttttttttagcgtttttttgttttttagcgatcggggttttttcgtttcgcgagaaagggattttggtagcggttgtattcgaaacgttattttttgcgatacgtaggaaataaaggtttttagtttacgcgataataagattaattcgatatttattaggattt

SEQ ID NO: 11882 - DNA, 829 bp, Artificial Sequence
  chemically treated genomic DNA (Homo sapiens) CpG-island No: 11882
aaatcctaataaatatcgaattaatcttattatcgcgtaaactaaaaacctttatttcctacgtatcgcaaaaaataacgtttcgaatacaaccgctaccaaaatccctttctcgcgaaacgaaaaaaccccgatcgctaaaaaacaaaaaaacgctaaaaaaaaaaactaaattacgacgatccgacgaaaaaaaactaaaatactaaaatacgaaaaaattaaaaaacaaaaaccgcttaatatccgaataaaataaaaccgcaccgacccaatccgttaaaaaaaaaaaaaaacgaaacaattatcgaacgaatccccgaacgaaaaactaaaattatataaaaaacgctactccccgaataacgaccgcaaatactccgaccccgacctccaataacctctcgccgaaaaaaaaaaaaaaacttaaaaataaaaaaatcaataacgacgataataacaaccaaatacgaaatcgaaacaacaacaacaacaacgacgacgaactattaccctatccgcgacgaaaacctcctcactcgacccgaaacgataaatctaacgaaaacgataactcttcctcgtcatcgtcctcttctcaacaacaactaaaaaatttctcacgctcgcgacacgcgtctaaacgaaaccacctcaaaaaacccaacaactaccgacccaaaaaaccgttccgatctcatccgccttctatacgaataccttcgaactcactatccgaaaacaatccccgaccgtctttctaaaaacgaaaccacctcgccttaaaccgtttccgctttcgaaacaaaccttaccgaaataaaaatcg

SEQ ID NO: 11883 - DNA, 829 bp, Artificial Sequence
  chemically treated genomic DNA (Homo sapiens) CpG-island No: 11883
aaattttagtgagtatcgagttggttttattatcgcgtgaattgggagtttttgttttttgcgtgtcgtaggaagtgacgtttcgggtatagtcgttattagagtttttttttcgcgaggcggaagaatttcgatcgttgaggagtaagggggcgttaggaaagggaattgggttgcgacggttcggcgagagagagttggggtgttggggtgcggggaagttggggagtagaggtcgtttggtgttcgagtagggtaagatcgtatcgatttagttcgttaggaaagaagggaaacgaggtaattgtcgggcggattttcggacggagggttaaggttgtgtggaaggcgttgtttttcggatggcgatcgtagatatttcggtttcggtttttagtggtttttcgtcgaaggaagaaggggagtttgaagatggggaaattagtgacgacgataataatagttagatacggagtcggagtagtagtagtagtagcggcggcgggttgttattttattcgcggcgaaggtttttttattcggttcggggcggtggatttggcggaggcggtggttttttttcgttatcgttttttttttagtagtagttgaggaattttttacgttcgcggtacgcgtttgagcggggttattttaggggatttagtagttatcgatttaaagaatcgtttcggttttattcgttttttgtacggatgttttcgagtttattgttcgaaagtagttttcggtcgtttttttgggagcggagttatttcgttttggatcgttttcgttttcgaggtaggttttatcggggtgggagtcg

SEQ ID NO: 11884 - DNA, 829 bp, Artificial Sequence
  chemically treated genomic DNA (Homo sapiens) CpG-island No: 11884
cgactcccaccccgataaaacctacctcgaaaacgaaaacgatccaaaacgaaataactccgctcccaaaaaaacgaccgaaaactactttcgaacaataaactcgaaaacatccgtacaaaaaacgaataaaaccgaaacgattctttaaatcgataactactaaatcccctaaaataaccccgctcaaacgcgtaccgcgaacgtaaaaaattcctcaactactactaaaaaaaaaacgataacgaaaaaaaaccaccgcctccgccaaatccaccgccccgaaccgaataaaaaaaccttcgccgcgaataaaataacaacccgccgccgctactactactactactccgactccgtatctaactattattatcgtcgtcactaatttccccatcttcaaactccccttcttccttcgacgaaaaaccactaaaaaccgaaaccgaaatatctacgatcgccatccgaaaaacaacgccttccacacaaccttaaccctccgtccgaaaatccgcccgacaattacctcgtttcccttctttcctaacgaactaaatcgatacgatcttaccctactcgaacaccaaacgacctctactccccaacttccccgcaccccaacaccccaactctctctcgccgaaccgtcgcaacccaattccctttcctaacgcccccttactcctcaacgatcgaaattcttccgcctcgcgaaaaaaaaactctaataacgactatacccgaaacgtcacttcctacgacacgcaaaaaacaaaaactcccaattcacgcgataataaaaccaactcgatactcactaaaattt

SEQ ID NO: 11885 - DNA, 728 bp, Artificial Sequence
  chemically treated genomic DNA (Homo sapiens) CpG-island No: 11885
gattttttggttttttaattttacgatttatagtatcgtcgtacggaagtattttcggggttttatataatacggtatattttattttttatttcggtttcgcgtatcgtttatttatcgttttaacgttttttaaattatacgtttttatttatattggtgtatttcgagtttcgttttttttaacgtggtcgttagattaattatacgtcggatagtatattttattattttatttcgtaatcgtattttttttcgtgttgtgttattaatcgacgttttttttgtacgcggttatagttaatattcgttttgttgcgtattttttattttttttttcgttttcgttatcggcgtatagaagtatcgattgtatattcgttttcgttattttttttttttttgtcgtttttaaggtgtttacgtttttacgttaacgttacgcgtattttaattagcgtcgattttcgttttttttttcgatttttattttttttatttttttgatatcgtttcgtttcgtagttatatttacgttttttttttttatttttttttttttttttttatcgatcgcgatcgtttttatttattttaattttattttatttattcgttttttttatttttttaagttttttttatttatcgttatttatttttattatttgtacggcgtttttacggtattttatttttcgcgttcgttacgttattttttttttttt

SEQ ID NO: 11886 - DNA, 728 bp, Artificial Sequence
  chemically treated genomic DNA (Homo sapiens) CpG-island No: 11886
aaaaaaaaaaaaataacgtaacgaacgcgaaaaataaaataccgtaaaaacgccgtacaaataataaaaataaataacgataaataaaaaaaacttaaaaaaataaaaaaaacgaataaataaaataaaattaaaataaataaaaacgatcgcgatcgataaaaaaaaaaaaaaaaaaataaaaaaaaaaaacgtaaatataactacgaaacgaaacgatatcaaaaaaataaaaaaaataaaaatcgaaaaaaaaaacgaaaatcgacgctaattaaaatacgcgtaacgttaacgtaaaaacgtaaacaccttaaaaacgacaaaaaaaaaaaaaataacgaaaacgaatatacaatcgatacttctatacgccgataacgaaaacgaaaaaaaaaataaaaaatacgcaacaaaacgaatattaactataaccgcgtacaaaaaaaacgtcgattaataacacaacacgaaaaaaaatacgattacgaaataaaataataaaatatactatccgacgtataattaatctaacgaccacgttaaaaaaaacgaaactcgaaatacaccaatataaataaaaacgtataatttaaaaaacgttaaaacgataaataaacgatacgcgaaaccgaaataaaaaataaaatataccgtattatataaaaccccgaaaatacttccgtacgacgatactataaatcgtaaaattaaaaaaccaaaaaatc

SEQ ID NO: 11887 - DNA, 728 bp, Artificial Sequence
  chemically treated genomic DNA (Homo sapiens) CpG-island No: 11887
agggagagggaggtgacgtggcggacgcggggggtgaggtgtcgtgggggcgtcgtgtaaatggtgaaggtgggtggcggtggatgggggaagtttgggagggtgagaggggcgaatgggtgaggtagagttgggatgggtgggggcgatcgcgatcgatggggaaggaggggaagaagtggggagaaggggcgtggatgtggttacggagcggggcgatattaggggggtgggagaagtggggatcggaaggggaggcgggagtcggcgttggttagggtacgcgtgacgttagcgtaggagcgtgagtattttgagaacggtagagggaggaggggtagcggagacgggtgtgtaatcggtgtttttgtacgtcggtggcggagacggggagaggggtaaaaggtgcgtagtagggcggatattgattgtaatcgcgtatagaggaggcgtcggttggtagtatagtacggggagaggtgcgattacggagtgaggtagtagggtgtgttgttcgacgtgtagttgatttggcgattacgttgaggagggcggggttcgggatgtattagtgtaaataaaagcgtatggtttgaggggcgttggagcggtgggtaagcggtacgcgaggtcgagatgggggatggagtgtgtcgtgttatgtggggtttcgggggtgttttcgtgcgacgatgttatggatcgtggggttggggggttagaggatt

SEQ ID NO: 11888 - DNA, 728 bp, Artificial Sequence
  chemically treated genomic DNA (Homo sapiens) CpG-island No: 11888
aatcctctaaccccccaaccccacgatccataacatcgtcgcacgaaaacacccccgaaaccccacataacacgacacactccatcccccatctcgacctcgcgtaccgcttacccaccgctccaacgcccctcaaaccatacgcttttatttacactaatacatcccgaaccccgccctcctcaacgtaatcgccaaatcaactacacgtcgaacaacacaccctactacctcactccgtaatcgcacctctccccgtactatactaccaaccgacgcctcctctatacgcgattacaatcaatatccgccctactacgcaccttttacccctctccccgtctccgccaccgacgtacaaaaacaccgattacacacccgtctccgctacccctcctccctctaccgttctcaaaatactcacgctcctacgctaacgtcacgcgtaccctaaccaacgccgactcccgcctccccttccgatccccacttctcccacccccctaatatcgccccgctccgtaaccacatccacgccccttctccccacttcttcccctccttccccatcgatcgcgatcgcccccacccatcccaactctacctcacccattcgcccctctcaccctcccaaacttcccccatccaccgccacccaccttcaccatttacacgacgcccccacgacacctcaccccccgcgtccgccacgtcacctccctctccct

SEQ ID NO: 11889 - DNA, 828 bp, Artificial Sequence
  chemically treated genomic DNA (Homo sapiens) CpG-island No: 11889
  misc_feature (518)..(518): n is either a, c, g or t
  misc_feature (576)..(576): n is either a, c, g or t
  misc_feature (638)..(638): n is either a, c, g or t
atagggcgtttacgtcgtattcggtagtcgttgtttgatgcgacgtttgtcgcgttttattatgtttataggtttgtgtcgaatcgtaggtcggataaggcgtttacgtcgtattcggtagttggcgtataatgtttgatgcgacgtttgacgcgttttattaggtttataagtttgtgtcgaatcgtaggtcgtattcggtatgttataaatagagcgtcggaaatattaatcggtttatttcgcgtatttttaacgtattagttaacggtttaacgtttttcggcgtggcgttcgtttagttttgcgtttcgttatatacgtcgtgggtatgaaacgcgtttaggcgtatcggaatatcgtcgagttttttgataaacgtcgttagtttttcgatgtgttgtaaataatttatttggttagggattattagtaaacgtagtttcgttagtttgtcgcgttttgttagtaaatagatgttgcgtttaatttgttgattatcgcgttcggtgagttgntgatgatattcgtttttttacgttttgagatcgagtattgcgtcgtcgtatatcgggnagtattttttttagtcggtttcgtttaatatgtcggtattgtttattagataggtgaagggngttagttgcggaatcgttttgaaagtagtaaatagcgttattataaacggagttggggcggggggtttatcggtatttatcggtaattttttcgataatagtattgtttttcggatatggttaattattttttttatttaattgggatgcggatggggcggggtatgttttcgggatattttttaggtag

SEQ ID NO: 11890 - DNA, 828 bp, Artificial Sequence
  chemically treated genomic DNA (Homo sapiens) CpG-island No: 11890
  misc_feature (191)..(191): n is either a, c, g or t
  misc_feature (253)..(253): n is either a, c, g or t
  misc_feature (311)..(311): n is either a, c, g or t
ctacctaaaaaatatcccgaaaacataccccgccccatccgcatcccaattaaataaaaaaaataattaaccatatccgaaaaacaatactattatcgaaaaaattaccgataaataccgataaaccccccgccccaactccgtttataataacgctatttactactttcaaaacgattccgcaactaacncccttcacctatctaataaacaataccgacatattaaacgaaaccgactaaaaaaaatactncccgatatacgacgacgcaatactcgatctcaaaacgtaaaaaaacgaatatcatcancaactcaccgaacgcgataatcaacaaattaaacgcaacatctatttactaacaaaacgcgacaaactaacgaaactacgtttactaataatccctaaccaaataaattatttacaacacatcgaaaaactaacgacgtttatcaaaaaactcgacgatattccgatacgcctaaacgcgtttcatacccacgacgtatataacgaaacgcaaaactaaacgaacgccacgccgaaaaacgttaaaccgttaactaatacgttaaaaatacgcgaaataaaccgattaatatttccgacgctctatttataacataccgaatacgacctacgattcgacacaaacttataaacctaataaaacgcgtcaaacgtcgcatcaaacattatacgccaactaccgaatacgacgtaaacgccttatccgacctacgattcgacacaaacctataaacataataaaacgcgacaaacgtcgcatcaaacaacgactaccgaatacgacgtaaacgccctat

SEQ ID NO: 11891 - DNA, 828 bp, Artificial Sequence
  chemically treated genomic DNA (Homo sapiens) CpG-island No: 11891
  misc_feature (191)..(191): n is either a, c, g or t
  misc_feature (253)..(253): n is either a, c, g or t
  misc_feature (311)..(311): n is either a, c, g or t
ttgtttgaaaagtgtttcgaaaatatgtttcgttttattcgtattttaattaggtggaggaagtggttagttatgttcgaaaagtagtgttgttatcgaagggattatcggtgaatgtcggtaaatttttcgttttagtttcgtttgtggtggcgttgtttattgtttttaaaacgatttcgtaattggtnttttttatttgtttggtggatagtatcggtatgttgagcgaaatcggttgggaaaaatgttnttcggtgtgcgacggcgtaatgttcgattttaaagcgtgggggagcgaatgttattantaatttatcggacgcgataattagtagattaagcgtagtatttatttgttggtagagcgcggtaagttggcggaattgcgtttgttggtgatttttggttaggtggattatttgtaatatatcgaagaattggcggcgtttattaagggattcggcgatgtttcggtacgtttgaacgcgttttatgtttacggcgtgtatggcgaggcgtaaagttgggcgagcgttacgtcggaagacgttgagtcgttggttgatgcgttaaaggtgcgcggggtgagtcggttgatattttcggcgttttatttgtgatatgtcggatacggtttacggttcggtatagatttgtaggtttgataagacgcgttaagcgtcgtattaggtattgtgcgttaattgtcggatgcggcgtaaacgttttattcggtttacggttcggtataaatttgtaggtatgataagacgcgataagcgtcgtattaggtaacggttgtcggatgcggcgtgaacgttttat

SEQ ID NO: 11892 - DNA, 828 bp, Artificial Sequence
  chemically treated genomic DNA (Homo sapiens) CpG-island No: 11892
  misc_feature (518)..(518): n is either a, c, g or t
  misc_feature (576)..(576): n is either a, c, g or t
  misc_feature (638)..(638): n is either a, c, g or t
ataaaacgttcacgccgcatccgacaaccgttacctaatacgacgcttatcgcgtcttatcatacctacaaatttataccgaaccgtaaaccgaataaaacgtttacgccgcatccgacaattaacgcacaatacctaatacgacgcttaacgcgtcttatcaaacctacaaatctataccgaaccgtaaaccgtatccgacatatcacaaataaaacgccgaaaatatcaaccgactcaccccgcgcacctttaacgcatcaaccaacgactcaacgtcttccgacgtaacgctcgcccaactttacgcctcgccatacacgccgtaaacataaaacgcgttcaaacgtaccgaaacatcgccgaatcccttaataaacgccgccaattcttcgatatattacaaataatccacctaaccaaaaatcaccaacaaacgcaattccgccaacttaccgcgctctaccaacaaataaatactacgcttaatctactaattatcgcgtccgataaattantaataacattcgctcccccacgctttaaaatcgaacattacgccgtcgcacaccgaanaacatttttcccaaccgatttcgctcaacataccgatactatccaccaaacaaataaaaaanaccaattacgaaatcgttttaaaaacaataaacaacgccaccacaaacgaaactaaaacgaaaaatttaccgacattcaccgataatcccttcgataacaacactacttttcgaacataactaaccacttcctccacctaattaaaatacgaataaaacgaaacatattttcgaaacacttttcaaacaa

SEQ ID NO: 11893 - DNA, 1217 bp, Artificial Sequence
  chemically treated genomic DNA (Homo sapiens) CpG-island No: 11893
gtgaatagtaacgagtggcgttggtacgagtttttaatggtcgatttgatgtgttgtttgtcgacgaatttatcggtaattttgatcgttagacgggcgataaaattgtcgatttgttgtttttttttaatcgtgaatatggtattacgttgattatggtgatttacgatttgtaattggcggtacgttgcgatcgttgtttacggttggtgaacgggtagttgtaggaggaagtatgattgtacgttggttttggcgcgaatggcgttcgtcgtcgttattaattgtttggttggcgttaagtttggcggtggtttgcgtgttggcgttgggtaatattagcgatcgtatggagaagggtttaagttagtaaagtcgtgagtttatggcgggcgatcgggcgttgcgtagtttacgcgaagtgtcgtaagcgtggttggaggaagcgtaaaagcgcggtttgaaagtcggtaagtagttgattttcgttataatgatttttgtaggcgatatatcgtagttggcgaacgttaaagcggtggatgatatttattcgatgtatggcgatttgtaaattaatttttttggtttgaaatcgtaggcgggtagcgtattgttggttttacgtttgatggtattgtttaatttgaaaacgggcgatattattgacgtgggcgatgttattttgcggattgtcggagaagtgatttaggaatcggatttcggttttaattttttttagatggtttcgcgtttgatgatgaatttggcggatgtcgataaaatcggagtcgtgtagtcggggagtcgggttatttggcgttataaattcggcggtaacgagaattagttcgacggttatgagaaatggttgttattttagtttaaattcgaataacgttggtacggtttggaataggacgaaggcgcgttggggcgatcgatggaacgttcgtaatagtttttgttgttttcggcgtttttgattttgttgttggtagtggtagcggtggcggtagcgatgaattattattgtcgtagtcgttacgatttggtggcgatttttaaaacgttgggggtagggcgagcgtaattgcgtaagttaatcgtcggttagtggttgatggtgttgacgtttttagtcgttatcggtggggttataggtttgttgttcgaaaacgtgttgaggtgttgtttaatgatgaattataagtagt

SEQ ID NO: 11894 - DNA, 1217 bp, Artificial Sequence
  chemically treated genomic DNA (Homo sapiens) CpG-island No: 11894
actacttataattcatcattaaacaacacctcaacacgttttcgaacaacaaacctataaccccaccgataacgactaaaaacgtcaacaccatcaaccactaaccgacgattaacttacgcaattacgctcgccctacccccaacgttttaaaaatcgccaccaaatcgtaacgactacgacaataataattcatcgctaccgccaccgctaccactaccaacaacaaaatcaaaaacgccgaaaacaacaaaaactattacgaacgttccatcgatcgccccaacgcgccttcgtcctattccaaaccgtaccaacgttattcgaatttaaactaaaataacaaccatttctcataaccgtcgaactaattctcgttaccgccgaatttataacgccaaataacccgactccccgactacacgactccgattttatcgacatccgccaaattcatcatcaaacgcgaaaccatctaaaaaaaattaaaaccgaaatccgattcctaaatcacttctccgacaatccgcaaaataacatcgcccacgtcaataatatcgcccgttttcaaattaaacaataccatcaaacgtaaaaccaacaatacgctacccgcctacgatttcaaaccaaaaaaattaatttacaaatcgccatacatcgaataaatatcatccaccgctttaacgttcgccaactacgatatatcgcctacaaaaatcattataacgaaaatcaactacttaccgactttcaaaccgcgcttttacgcttcctccaaccacgcttacgacacttcgcgtaaactacgcaacgcccgatcgcccgccataaactcacgactttactaacttaaacccttctccatacgatcgctaatattacccaacgccaacacgcaaaccaccgccaaacttaacgccaaccaaacaattaataacgacgacgaacgccattcgcgccaaaaccaacgtacaatcatacttcctcctacaactacccgttcaccaaccgtaaacaacgatcgcaacgtaccgccaattacaaatcgtaaatcaccataatcaacgtaataccatattcacgattaaaaaaaaacaacaaatcgacaattttatcgcccgtctaacgatcaaaattaccgataaattcgtcgacaaacaacacatcaaatcgaccattaaaaactcgtaccaacgccactcgttactattcac

SEQ ID NO: 11895 - DNA, 1217 bp, Artificial Sequence
  chemically treated genomic DNA (Homo sapiens) CpG-island No: 11895
gttgtttgtagtttattattgagtagtattttaatacgttttcgaataataggtttatggttttatcggtaacggttgaaagcgttagtattattaattattgatcgacgattagtttacgtagttgcgttcgttttgtttttagcgttttgaggatcgttattagatcgtagcgattgcgatagtaatgatttatcgttatcgttatcgttgttattgttagtagtaaggttagaagcgtcgaaagtagtaggaattgttgcgagcgttttatcgatcgttttagcgcgttttcgttttgttttagatcgtattagcgttgttcgggtttaagttgaggtaataattattttttatagtcgtcgagttggttttcgttgtcgtcgaatttataacgttaggtgattcgatttttcggttgtacggtttcggttttatcgatattcgttagatttattattagacgcggagttatttggaaggggttaaaatcggaattcggtttttgaattattttttcggtaattcgtaaggtggtatcgtttacgttaatggtgtcgttcgtttttaggttaagtagtgttattaggcgtggggttagtaatacgttgttcgtttgcggttttaggttagggggattagtttgtagatcgttatatatcgggtagatattatttatcgttttgacgttcgttagttgcggtgtgtcgtttgtaaaggttattgtggcgaaagttagttgtttgtcgatttttaggtcgcgtttttgcgttttttttagttacgtttgcggtatttcgcgtgaattgcgtaacgttcgatcgttcgttataaatttacggttttgttggtttaagtttttttttatgcgatcgttgatattgtttagcgttagtacgtaggttatcgttaggtttagcgttagttagataattaatagcgacggcgaacgttattcgcgttagaattaacgtgtaattatgtttttttttgtaattgttcgtttattagtcgtaagtagcggtcgtagcgtgtcgttagttgtaggtcgtgggttattataattaacgtggtgttatgtttacggttgaggaaaaatagtaggtcggtaattttatcgttcgtttggcggttaaggttgtcggtgggttcgtcggtaaatagtatattaggtcgattattaaaggttcgtgttagcgttattcgttgttgtttat

SEQ ID NO: 11896 - DNA, 1217 bp, Artificial Sequence
  chemically treated genomic DNA (Homo sapiens) CpG-island No: 11896
ataaacaacaacgaataacgctaacacgaacctttaataatcgacctaatatactatttaccgacgaacccaccgacaaccttaaccgccaaacgaacgataaaattaccgacctactatttttcctcaaccgtaaacataacaccacgttaattataataacccacgacctacaactaacgacacgctacgaccgctacttacgactaataaacgaacaattacaaaaaaaaacataattacacgttaattctaacgcgaataacgttcgccgtcgctattaattatctaactaacgctaaacctaacgataacctacgtactaacgctaaacaatatcaacgatcgcataaaaaaaaacttaaaccaacaaaaccgtaaatttataacgaacgatcgaacgttacgcaattcacgcgaaataccgcaaacgtaactaaaaaaaacgcaaaaacgcgacctaaaaatcgacaaacaactaactttcgccacaataacctttacaaacgacacaccgcaactaacgaacgtcaaaacgataaataatatctacccgatatataacgatctacaaactaatccccctaacctaaaaccgcaaacgaacaacgtattactaaccccacgcctaataacactacttaacctaaaaacgaacgacaccattaacgtaaacgataccaccttacgaattaccgaaaaaataattcaaaaaccgaattccgattttaaccccttccaaataactccgcgtctaataataaatctaacgaatatcgataaaaccgaaaccgtacaaccgaaaaatcgaatcacctaacgttataaattcgacgacaacgaaaaccaactcgacgactataaaaaataattattacctcaacttaaacccgaacaacgctaatacgatctaaaacaaaacgaaaacgcgctaaaacgatcgataaaacgctcgcaacaattcctactactttcgacgcttctaaccttactactaacaataacaacgataacgataacgataaatcattactatcgcaatcgctacgatctaataacgatcctcaaaacgctaaaaacaaaacgaacgcaactacgtaaactaatcgtcgatcaataattaataatactaacgctttcaaccgttaccgataaaaccataaacctattattcgaaaacgtattaaaatactactcaataataaactacaaacaac

SEQ ID NO: 11897 - DNA, 536 bp, Artificial Sequence
  chemically treated genomic DNA (Homo sapiens) CpG-island No: 11897
cggatagcgtattttcggtttttcgttaataaaagtatggcgtattttgtttattatcgttttcggttttaacgtaaagcgggcggcgatgtcgggattttcgattggtttattattttgcgtttggttgacgttgtcggtgaagcgagtacgaatgggatcgggttcgattaggttgattttaatttcgttgtggcgtagttttatgcgtagtgtatttgattacgtttttagcgtatatttattggtcgcgtaagcgttacgattcggcgtggagattaattttattatcgatgatgttattataatacgttttttatcgtgcggtaatatcgcgggtaataggcgtatggtgagttggtgtgcgtcgaaaaagttggcggaaaattgttgttttatttgcgtacggttgatggtggaaagggggttatatatgtcgaattcggtattgttaaagattttatatagataattatcggttagggcgattatttcgtcggttgcgcgattaatattttttggtgaatttagatcga

SEQ ID NO: 11898 - DNA, 536 bp, Artificial Sequence
  chemically treated genomic DNA (Homo sapiens) CpG-island No: 11898
tcgatctaaattcaccaaaaaatattaatcgcgcaaccgacgaaataatcgccctaaccgataattatctatataaaatctttaacaataccgaattcgacatatataaccccctttccaccatcaaccgtacgcaaataaaacaacaattttccgccaactttttcgacgcacaccaactcaccatacgcctattacccgcgatattaccgcacgataaaaaacgtattataataacatcatcgataataaaattaatctccacgccgaatcgtaacgcttacgcgaccaataaatatacgctaaaaacgtaatcaaatacactacgcataaaactacgccacaacgaaattaaaatcaacctaatcgaacccgatcccattcgtactcgcttcaccgacaacgtcaaccaaacgcaaaataataaaccaatcgaaaatcccgacatcgccgcccgctttacgttaaaaccgaaaacgataataaacaaaatacgccatacttttattaacgaaaaaccgaaaatacgctatccg

SEQ ID NO: 11899 - DNA, 536 bp, Artificial Sequence
  chemically treated genomic DNA (Homo sapiens) CpG-island No: 11899
tcgatttggatttattagaaagtgttgatcgcgtagtcgacgaggtgatcgttttgatcgataattgtttgtatgggatttttaataatgtcggattcggtatgtatggttttttttttattattagtcgtgcgtagatggaatagtagtttttcgttaattttttcggcgtatattagtttattatgcgtttgttattcgcgatgttatcgtacggtgaagggcgtattgtgatgatattatcggtgatgggattaatttttacgtcgggtcgtggcgtttacgcggttagtaaatatgcgttggaggcgtggttagatgtattgcgtatggagttgcgttatagcggaattaaagttagtttgatcgaattcggttttattcgtattcgttttatcgataacgttaattagacgtaaagtgataaattagtcgaaaatttcggtatcgtcgttcgttttacgttgggatcggaagcggtggtggataaagtacgttatgtttttattagcgagaagtcgaagatgcgttattcg

SEQ ID NO: 11900 - DNA, 536 bp, Artificial Sequence
  chemically treated genomic DNA (Homo sapiens) CpG-island No: 11900
cgaataacgcatcttcgacttctcgctaataaaaacataacgtactttatccaccaccgcttccgatcccaacgtaaaacgaacgacgataccgaaattttcgactaatttatcactttacgtctaattaacgttatcgataaaacgaatacgaataaaaccgaattcgatcaaactaactttaattccgctataacgcaactccatacgcaatacatctaaccacgcctccaacgcatatttactaaccgcgtaaacgccacgacccgacgtaaaaattaatcccatcaccgataatatcatcacaatacgcccttcaccgtacgataacatcgcgaataacaaacgcataataaactaatatacgccgaaaaaattaacgaaaaactactattccatctacgcacgactaataataaaaaaaaaaccatacataccgaatccgacattattaaaaatcccatacaaacaattatcgatcaaaacgatcacctcgtcgactacgcgatcaacactttctaataaatccaaatcga

SEQ ID NO: 11901 - DNA, 661 bp, Artificial Sequence
  chemically treated genomic DNA (Homo sapiens) CpG-island No: 11901
aatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttataaatgcgtttttcgtacgtcggataagacgcgttagcgtcgtatacgatattcgaattacgaggcgaataatgattaacgtataaaacgttagtaaaatttttattttgtattagtaaaacggcgtgcgtttgttcgtttttaatcgcgtttcgtttatcgttaacgcgggcgaatgcgtggtgttatacggttatttcggtagcggtaaattaattttgttacgttcgttgtacgttaattatttgttcgacgaaggttaaatttagattaaatacggtgacgaatgggtagatttggttatcgcgttagcgcgtaaagtggtggaaattcgtataattatcgttcgttgggtgagttagttttttgtcgttatttcgcgtattttagtattggaagggtgatgtaatcgttgttcgattacgcggttcgcgtggaattttgttcg

SEQ ID NO: 11902 - DNA, 661 bp, Artificial Sequence
  chemically treated genomic DNA (Homo sapiens) CpG-island No: 11902
cgaacaaaattccacgcgaaccgcgtaatcgaacaacgattacatcacccttccaatactaaaatacgcgaaataacgacaaaaaactaactcacccaacgaacgataattatacgaatttccaccactttacgcgctaacgcgataaccaaatctacccattcgtcaccgtatttaatctaaatttaaccttcgtcgaacaaataattaacgtacaacgaacgtaacaaaattaatttaccgctaccgaaataaccgtataacaccacgcattcgcccgcgttaacgataaacgaaacgcgattaaaaacgaacaaacgcacgccgttttactaatacaaaataaaaattttactaacgttttatacgttaatcattattcgcctcgtaattcgaatatcgtatacgacgctaacgcgtcttatccgacgtacgaaaaacgcatttataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaatt

SEQ ID NO: 11903 - DNA, 661 bp, Artificial Sequence
  chemically treated genomic DNA (Homo sapiens) CpG-island No: 11903
cgagtaaggttttacgcgaatcgcgtaatcgagtagcgattgtattatttttttagtgttgagatacgcgggatgacggtaagaaattggtttatttagcggacggtggttgtgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtgtagtattacgtattcgttcgcgttgacggtgagcgaggcgcgattgaggacgggtaggcgtacgtcgttttgttggtgtaggatgaaggttttattgacgttttgtacgttaattattgttcgtttcgtggttcgggtgtcgtatgcgacgttgacgcgttttattcgacgtacggggagcgtatttgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtt

SEQ ID NO: 11904 - DNA, 661 bp, Artificial Sequence
  chemically treated genomic DNA (Homo sapiens) CpG-island No: 11904
aacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacaaatacgctccccgtacgtcgaataaaacgcgtcaacgtcgcatacgacacccgaaccacgaaacgaacaataattaacgtacaaaacgtcaataaaaccttcatcctacaccaacaaaacgacgtacgcctacccgtcctcaatcgcgcctcgctcaccgtcaacgcgaacgaatacgtaatactacacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcacaaccaccgtccgctaaataaaccaatttcttaccgtcatcccgcgtatctcaacactaaaaaaataatacaatcgctactcgattacgcgattcgcgtaaaaccttactcg

SEQ ID NO: 11905 - DNA, 704 bp, Artificial Sequence
  chemically treated genomic DNA (Homo sapiens) CpG-island No: 11905
cggtaaatgaggcggttttagggtcgcggcggagaggaggggggtttcgtttttacgtgtttgttttgttgtcggttcggcgcggtcggggttaattcggagcggaaggatttcgtagcgtgtgcgtagaattgtagagttatagtttttttttcgagagggcgggattttttcgtcgtttcgttttaatataaaatagggtcgtttttttttttttttttttttttcgagtggggtgtttcgggtaaaaggttttttcggatttagcgtcgaaggttttacgaatttttacgatcgttgtttagtttttgggttaggaaatagttttttcgtaggaattattttatcggtcgaataggaggcggagggggggaggcggagcggcgtcgcgttgtattattttttttttcggttgtaaatggttgtttcgttttttatttttcgtttagttttttgatttttcggtgtcgggagtcggggttgggttatgtatttttaggtcgtttgcgattatagttagtcgggggtcgagggggtgttatcgattagagtcggttaggtcgggggcggggtagttttcgaggttagaggggaagggaggcgagcgtagggtttggagcggtcggaggggagcgggtagagggttcgtatcgttcgtttttttttttttttcgtttatttagttttttttttttttcgggggg

SEQ ID NO: 11906 - DNA, 704 bp, Artificial Sequence
  chemically treated genomic DNA (Homo sapiens) CpG-island No: 11906
ccccccgaaaaaaaaaaaaaactaaataaacgaaaaaaaaaaaaaaacgaacgatacgaaccctctacccgctcccctccgaccgctccaaaccctacgctcgcctcccttcccctctaacctcgaaaactaccccgcccccgacctaaccgactctaatcgataacaccccctcgacccccgactaactataatcgcaaacgacctaaaaatacataacccaaccccgactcccgacaccgaaaaatcaaaaaactaaacgaaaaataaaaaacgaaacaaccatttacaaccgaaaaaaaaaataatacaacgcgacgccgctccgcctccccccctccgcctcctattcgaccgataaaataattcctacgaaaaaactatttcctaacccaaaaactaaacaacgatcgtaaaaattcgtaaaaccttcgacgctaaatccgaaaaaaccttttacccgaaacaccccactcgaaaaaaaaaaaaaaaaaaaaaaacgaccctattttatattaaaacgaaacgacgaaaaaatcccgccctctcgaaaaaaaaactataactctacaattctacgcacacgctacgaaatccttccgctccgaattaaccccgaccgcgccgaaccgacaacaaaacaaacacgtaaaaacgaaacccccctcctctccgccgcgaccctaaaaccgcctcatttaccg

SEQ ID NO: 11907 - DNA, 704 bp, Artificial Sequence
  chemically treated genomic DNA (Homo sapiens) CpG-island No: 11907
tttttcggggaagggaggaggttaggtaggcgaggaaaaggaaggggcgggcggtgcgagttttttgttcgttttttttcggtcgttttaggttttgcgttcgtttttttttttttttggtttcgggagttgtttcgttttcggtttggtcggttttggtcggtggtattttttcgattttcggttgattgtgatcgtaggcggtttagaggtgtatggtttaatttcggttttcggtatcggggggttaggaaattgagcggaaagtggggaacgaggtagttatttgtaatcggagaggaaagtagtgtagcgcggcgtcgtttcgttttttttttttcgttttttgttcggtcggtagggtggtttttgcgaaggggttattttttggtttaagagttgggtagcggtcgtgaagattcgtgaagttttcggcgttagattcgggggggttttttgttcggggtattttattcgagagggggagaaaggagaagaggcggttttattttgtgttggagcggagcggcggagggatttcgttttttcggaggaaaggttgtgattttgtagttttacgtatacgttgcgggattttttcgtttcgggttaatttcgatcgcgtcgggtcggtagtagggtagatacgtgggaacgaagtttttttttttttcgtcgcggttttggagtcgttttatttatcg

SEQ ID NO: 11908 - DNA, 704 bp, Artificial Sequence
  chemically treated genomic DNA (Homo sapiens) CpG-island No: 11908
cgataaataaaacgactccaaaaccgcgacgaaaaaaaaaaaaacttcgttcccacgtatctaccctactaccgacccgacgcgatcgaaattaacccgaaacgaaaaaatcccgcaacgtatacgtaaaactacaaaatcacaacctttcctccgaaaaaacgaaatccctccgccgctccgctccaacacaaaataaaaccgcctcttctcctttctccccctctcgaataaaataccccgaacaaaaaacccccccgaatctaacgccgaaaacttcacgaatcttcacgaccgctacccaactcttaaaccaaaaaataaccccttcgcaaaaaccaccctaccgaccgaacaaaaaacgaaaaaaaaaaaacgaaacgacgccgcgctacactactttcctctccgattacaaataactacctcgttccccactttccgctcaatttcctaaccccccgataccgaaaaccgaaattaaaccatacacctctaaaccgcctacgatcacaatcaaccgaaaatcgaaaaaataccaccgaccaaaaccgaccaaaccgaaaacgaaacaactcccgaaaccaaaaaaaaaaaaaaacgaacgcaaaacctaaaacgaccgaaaaaaaacgaacaaaaaactcgcaccgcccgccccttccttttcctcgcctacctaacctcctcccttccccgaaaaa

SEQ ID NO: 11909 - DNA, 994 bp, Artificial Sequence
  chemically treated genomic DNA (Homo sapiens) CpG-island No: 11909
gtcgcgatttagagcgtatgcgtaaagcgtagtggcggtttttcgtttaggagcggcgggaaggtaacggtcgcgcgtgcgcgtttttgtttttagttgttttttattttcgtttttcgcgtttaagaggaagtgagggttggaagagttcgcgcgcgcgtttatttaaggcggagtaagggtatgcgttggaaaggattgcggggattcgagggatcgtatttaggatatagttacgcgataaaagagagtttcggatacggcggagggtagttcgagttttttattttttttagagttcgagaagaaattttggcgtttttcgattttttcgggttttcgttatttatatatatcgaggttttattattttcgttttggtttttcgtttcgtttttcgttttttaaacggacggttttgaggttagtttttttcggttgtatatagggttttagcgtttcgtcggttcgtttttttttgtttttttgaaagtagtcgggagtcgtacggtttatttattatagtggttagggattaggaggcgaaggcgataggagtagatatcgggtttcgggtatcgttttcgataagttaagagtcgaggtaagtaacgtattagggcggggtcggcgttggagttttttaagtagcggttgcggaggggcgggcgggtataggcggtgtcgcggtcgttggtttttttttcggtttcgcgcgtttatttcgcgttcggtttggtcgtcgtagaggcgggtttcgagtttcgagtttttttttttcgcgcggtcgcggggtggggtttgtcgcgtttgcgggtaacgcgcgttagtattgtagtgtgcggcgtatggttgcgagggtttgtcgaggggcgggcgcgagtcggaaagatatcgattagggaatgggcgacgaggtttgttttaattcggaggaaatttaggatttgagagagttatataatttgaaagacgaagtatcgtgaaatgtaga

SEQ ID NO: 11910 - DNA, 994 bp, Artificial Sequence
  chemically treated genomic DNA (Homo sapiens) CpG-island No: 11910
tctacatttcacgatacttcgtctttcaaattatataactctctcaaatcctaaatttcctccgaattaaaacaaacctcgtcgcccattccctaatcgatatctttccgactcgcgcccgcccctcgacaaaccctcgcaaccatacgccgcacactacaatactaacgcgcgttacccgcaaacgcgacaaaccccaccccgcgaccgcgcgaaaaaaaaaaactcgaaactcgaaacccgcctctacgacgaccaaaccgaacgcgaaataaacgcgcgaaaccgaaaaaaaaaccaacgaccgcgacaccgcctatacccgcccgcccctccgcaaccgctacttaaaaaactccaacgccgaccccgccctaatacgttacttacctcgactcttaacttatcgaaaacgatacccgaaacccgatatctactcctatcgccttcgcctcctaatccctaaccactataataaataaaccgtacgactcccgactactttcaaaaaaacaaaaaaaaacgaaccgacgaaacgctaaaaccctatatacaaccgaaaaaaactaacctcaaaaccgtccgtttaaaaaacgaaaaacgaaacgaaaaaccaaaacgaaaataataaaacctcgatatatataaataacgaaaacccgaaaaaatcgaaaaacgccaaaatttcttctcgaactctaaaaaaaataaaaaactcgaactaccctccgccgtatccgaaactctcttttatcgcgtaactatatcctaaatacgatccctcgaatccccgcaatcctttccaacgcatacccttactccgccttaaataaacgcgcgcgcgaactcttccaaccctcacttcctcttaaacgcgaaaaacgaaaataaaaaacaactaaaaacaaaaacgcgcacgcgcgaccgttaccttcccgccgctcctaaacgaaaaaccgccactacgctttacgcatacgctctaaatcgcgac

SEQ ID NO: 11911 - DNA, 994 bp, Artificial Sequence
  chemically treated genomic DNA (Homo sapiens) CpG-island No: 11911
tttgtattttacggtgtttcgttttttaaattgtatggtttttttaagttttgggtttttttcgaattaaggtaagtttcgtcgtttattttttggtcggtgttttttcgattcgcgttcgtttttcggtaggttttcgtagttatgcgtcgtatattgtagtattggcgcgcgttgttcgtaggcgcggtagattttatttcgcggtcgcgcgaggggagggggttcggggttcggagttcgtttttgcggcggttaggtcgggcgcggagtgggcgcgcggggtcggaggaggggttagcgatcgcggtatcgtttgtgttcgttcgttttttcgtagtcgttatttaagaggttttagcgtcggtttcgttttagtgcgttatttatttcgatttttagtttgtcggggacggtattcgggattcggtgtttgtttttgtcgttttcgttttttaatttttagttattatggtgagtaagtcgtgcggttttcggttgtttttagggaagtagggaaaagcgagtcggcggggcgttggggttttgtatatagtcgggaagggttggttttagagtcgttcgtttggagggcggaaaacgaggcgagaggttagggcgggagtggtgagatttcggtgtgtgtaaatagcgggggttcggaaaggtcgaggggcgttaggattttttttcggattttggaagggatggggggttcgggttgtttttcgtcgtattcggagtttttttttgtcgcgtaattgtgttttgggtgcggtttttcgagttttcgtagttttttttagcgtatgtttttatttcgttttgggtggacgcgcgcgcggatttttttagtttttatttttttttgagcgcgaaaagcgggggtgggaagtagttggagataaaagcgcgtacgcgcgatcgttattttttcgtcgtttttgggcgggaaatcgttattgcgttttgcgtatgcgttttgggtcgcgat

SEQ ID NO: 11912 - DNA, 994 bp, Artificial Sequence
  chemically treated genomic DNA (Homo sapiens) CpG-island No: 11912
atcgcgacccaaaacgcatacgcaaaacgcaataacgatttcccgcccaaaaacgacgaaaaaataacgatcgcgcgtacgcgcttttatctccaactacttcccacccccgcttttcgcgctcaaaaaaaaataaaaactaaaaaaatccgcgcgcgcgtccacccaaaacgaaataaaaacatacgctaaaaaaaactacgaaaactcgaaaaaccgcacccaaaacacaattacgcgacaaaaaaaaactccgaatacgacgaaaaacaacccgaaccccccatcccttccaaaatccgaaaaaaaatcctaacgcccctcgacctttccgaacccccgctatttacacacaccgaaatctcaccactcccgccctaacctctcgcctcgttttccgccctccaaacgaacgactctaaaaccaacccttcccgactatatacaaaaccccaacgccccgccgactcgcttttccctacttccctaaaaacaaccgaaaaccgcacgacttactcaccataataactaaaaattaaaaaacgaaaacgacaaaaacaaacaccgaatcccgaataccgtccccgacaaactaaaaatcgaaataaataacgcactaaaacgaaaccgacgctaaaacctcttaaataacgactacgaaaaaacgaacgaacacaaacgataccgcgatcgctaacccctcctccgaccccgcgcgcccactccgcgcccgacctaaccgccgcaaaaacgaactccgaaccccgaaccccctcccctcgcgcgaccgcgaaataaaatctaccgcgcctacgaacaacgcgcgccaatactacaatatacgacgcataactacgaaaacctaccgaaaaacgaacgcgaatcgaaaaaacaccgaccaaaaaataaacgacgaaacttaccttaattcgaaaaaaacccaaaacttaaaaaaaccatacaatttaaaaaacgaaacaccgtaaaatacaaa

SEQ ID NO: 11913 - DNA, 520 bp, Artificial Sequence
  chemically treated genomic DNA (Homo sapiens) CpG-island No: 11913
ggcggagttcggcgcggcgcggtttagtagtttttcgggcgttcggttttttggcgttagacgtgttgtgttgtgattacgtgggtagtttcgggcgcggcgtttgttttggtttttttttaatttgtttacggtagtttcggggtgagcgatttttttgtattagttgtcgcgtttgtttatattttgatttcgttttcgggttttttgagttcgtagtttcgtaagtttttggggcgggtttttgttatgtcgttagttcgttataggaaggtggttattttcggatatcgttgtgtaggtgagtttttcgttttgtagagttcggacgcgtagtagttttgtagttagaagaggcgcgttgtcgtgggaacgcgatttagggaggaatgatgatatcgtaaggatggggttgtagagcgaggattggaagagtggaggaatggaagagtggaggattggaagagttggtggtgtgtggaggttgtaggaagcgggagtatttaagggttaatgcgga

SEQ ID NO: 11914 - DNA, 520 bp, Artificial Sequence
  chemically treated genomic DNA (Homo sapiens) CpG-island No: 11914
tccgcattaacccttaaatactcccgcttcctacaacctccacacaccaccaactcttccaatcctccactcttccattcctccactcttccaatcctcgctctacaaccccatccttacgatatcatcattcctccctaaatcgcgttcccacgacaacgcgcctcttctaactacaaaactactacgcgtccgaactctacaaaacgaaaaactcacctacacaacgatatccgaaaataaccaccttcctataacgaactaacgacataacaaaaacccgccccaaaaacttacgaaactacgaactcaaaaaacccgaaaacgaaatcaaaatataaacaaacgcgacaactaatacaaaaaaatcgctcaccccgaaactaccgtaaacaaattaaaaaaaaaccaaaacaaacgccgcgcccgaaactacccacgtaatcacaacacaacacgtctaacgccaaaaaaccgaacgcccgaaaaactactaaaccgcgccgcgccgaactccgcc

SEQ ID NO: 11915 - DNA, 520 bp, Artificial Sequence
  chemically treated genomic DNA (Homo sapiens) CpG-island No: 11915
ttcgtattaatttttaagtgttttcgttttttgtagtttttatatattattaatttttttaattttttatttttttatttttttatttttttaattttcgttttataattttatttttacgatgttattatttttttttgggtcgcgtttttacggtagcgcgttttttttggttataaagttgttgcgcgttcgagttttgtagggcgggagatttatttatatagcggtattcgaggatgattatttttttgtagcggattagcggtatggtaggagttcgttttaggggtttgcggaattgcgggtttagagagttcgaaaacgaggttagggtgtgagtaggcgcggtagttggtgtaggaaagtcgtttatttcgaagttgtcgtgggtaagttagaaggaaattaaaataagcgtcgcgttcggagttgtttacgtgattataatatagtacgtttaacgttagggagtcgggcgttcggggaattattgagtcgcgtcgcgtcgggtttcgtt

SEQ ID NO: 11916 - DNA, 520 bp, Artificial Sequence
  chemically treated genomic DNA (Homo sapiens) CpG-island No: 11916
aacgaaacccgacgcgacgcgactcaataattccccgaacgcccgactccctaacgttaaacgtactatattataatcacgtaaacaactccgaacgcgacgcttattttaatttccttctaacttacccacgacaacttcgaaataaacgactttcctacaccaactaccgcgcctactcacaccctaacctcgttttcgaactctctaaacccgcaattccgcaaacccctaaaacgaactcctaccataccgctaatccgctacaaaaaaataatcatcctcgaataccgctatataaataaatctcccgccctacaaaactcgaacgcgcaacaactttataaccaaaaaaaacgcgctaccgtaaaaacgcgacccaaaaaaaaataataacatcgtaaaaataaaattataaaacgaaaattaaaaaaataaaaaaataaaaaaataaaaaattaaaaaaattaataatatataaaaactacaaaaaacgaaaacacttaaaaattaatacgaa

SEQ ID NO: 11917 - DNA, 745 bp, Artificial Sequence
  chemically treated genomic DNA (Homo sapiens) CpG-island No: 11917
cgggcgtttcgaggtttttatgtttgggacgtttagtttagtagttttttcgttaagcggtagaggagtcgagagtattaatgtatgttagtcggttggacggtttcgtcggggagtagcgtttttagcgcgtgtagtagttttaagggggtaaaagcgcggtgcgtttattggtgattttttagaatcgcgtagtaagaggttaggatatcgtttattagtagcgtttcgtgcgcggtgagcggcgcgaatacgtttacggttttttttcgcgttatacgggttacgcgcgttggtcgaagcgtattttcgtcgggcgttagtatcgagtttttagcgcgtagtcggcgcgcgaatatcggtgtaaagtcgtttggcgcgggcgtcggttttcgagcggtaaatattaggtgttagggcgtgagtaatagtttgcgtggaggttattcggtttttatagttataaatgaagttcggcgttgtaagtttcggtttaggaagagtagtatcggcgtgggtattattcggtttgacgtatcggtcgttaaaatttagttttcgcggtgtagttttcgtagtttttttcgttcgtcgttttataggcgtatagttgtatttttcggaaagtagtcgttcgttcggatcgttagtgagttatttgtagggaataattatagggaggattgaattaagattagcggttttagaacgatttttaaggttagcgtagatatcgttagttatg

SEQ ID NO: 11918 - DNA, 745 bp, Artificial Sequence
  chemically treated genomic DNA (Homo sapiens) CpG-island No: 11918
cataactaacgatatctacgctaaccttaaaaatcgttctaaaaccgctaatcttaattcaatcctccctataattattccctacaaataactcactaacgatccgaacgaacgactactttccgaaaaatacaactatacgcctataaaacgacgaacgaaaaaaactacgaaaactacaccgcgaaaactaaattttaacgaccgatacgtcaaaccgaataatacccacgccgatactactcttcctaaaccgaaacttacaacgccgaacttcatttataactataaaaaccgaataacctccacgcaaactattactcacgccctaacacctaatatttaccgctcgaaaaccgacgcccgcgccaaacgactttacaccgatattcgcgcgccgactacgcgctaaaaactcgatactaacgcccgacgaaaatacgcttcgaccaacgcgcgtaacccgtataacgcgaaaaaaaaccgtaaacgtattcgcgccgctcaccgcgcacgaaacgctactaataaacgatatcctaacctcttactacgcgattctaaaaaatcaccaataaacgcaccgcgcttttacccccttaaaactactacacgcgctaaaaacgctactccccgacgaaaccgtccaaccgactaacatacattaatactctcgactcctctaccgcttaacgaaaaaactactaaactaaacgtcccaaacataaaaacctcgaaacgcccg

SEQ ID NO: 11919 - DNA, 745 bp, Artificial Sequence
  chemically treated genomic DNA (Homo sapiens) CpG-island No: 11919
tatgattggcgatatttgcgttggttttgagaatcgttttggaatcgttggttttgatttaattttttttgtggttgttttttgtagataatttattggcggttcgggcgggcggttgtttttcgggaaatgtaattgtgcgtttgtggagcggcgagcggaaagggttgcgggaattgtatcgcggagattgggttttggcggtcgatgcgttaggtcgggtggtgtttacgtcggtgttgttttttttggatcgggatttgtagcgtcgggttttatttgtggttgtggagatcgagtggtttttacgtaaattgttgtttacgttttggtatttggtgtttgtcgttcgagggtcggcgttcgcgttaggcgattttgtatcggtgttcgcgcgtcggttacgcgttggggattcggtgttggcgttcggcggggatgcgtttcggttagcgcgcgtggttcgtgtggcgcgggaggaagtcgtgggcgtgttcgcgtcgtttatcgcgtacgggacgttgttggtgaacgatgttttggttttttgttacgcggttttggagagttattagtgggcgtatcgcgtttttgtttttttgagattgttgtacgcgttaggggcgttgtttttcggcggggtcgtttagtcgattggtatgtattggtattttcggtttttttatcgtttagcggaggagttattgggttgagcgttttaggtatagaaatttcgaagcgttcg

SEQ ID NO: 11920 - DNA, 745 bp, Artificial Sequence
  chemically treated genomic DNA (Homo sapiens) CpG-island No: 11920
cgaacgcttcgaaatttctatacctaaaacgctcaacccaataactcctccgctaaacgataaaaaaaccgaaaataccaatacataccaatcgactaaacgaccccgccgaaaaacaacgcccctaacgcgtacaacaatctcaaaaaaacaaaaacgcgatacgcccactaataactctccaaaaccgcgtaacaaaaaaccaaaacatcgttcaccaacaacgtcccgtacgcgataaacgacgcgaacacgcccacgacttcctcccgcgccacacgaaccacgcgcgctaaccgaaacgcatccccgccgaacgccaacaccgaatccccaacgcgtaaccgacgcgcgaacaccgatacaaaatcgcctaacgcgaacgccgaccctcgaacgacaaacaccaaataccaaaacgtaaacaacaatttacgtaaaaaccactcgatctccacaaccacaaataaaacccgacgctacaaatcccgatccaaaaaaaacaacaccgacgtaaacaccacccgacctaacgcatcgaccgccaaaacccaatctccgcgatacaattcccgcaaccctttccgctcgccgctccacaaacgcacaattacatttcccgaaaaacaaccgcccgcccgaaccgccaataaattatctacaaaaaacaaccacaaaaaaaattaaatcaaaaccaacgattccaaaacgattctcaaaaccaacgcaaatatcgccaatcata

SEQ ID NO: 11921 - DNA, 722 bp, Artificial Sequence
  chemically treated genomic DNA (Homo sapiens) CpG-island No: 11921
  misc_feature (576)..(576): n is either a, c, g or t
  misc_feature (691)..(691): n is either a, c, g or t
tagtttttatcgaaataattttatttttggtagattgattttcgcgtaaatttattttcgtagatgaatatatttttttattgcgtttttttcgcgtcgagaaaattttttgagtataattatttgtttatggtacgtcgttggtaattttttttcggggggtgtcgaattaaaaacgtttttttttacgtgcggtttttaatacgttaacgtattcgcgttttaatatttttcgtagcgtaataaatttataagagcgggttttttatatattttttttttacgtttagtagatttttttttatataattatatatagcggtcgcgcgatgattagtttatcgtgtttattacgagatttgtagttatcgtcgtagttacggttatgatagtatgattatttttacgagagttcgtttcgttataatgttattcgatgtcgttaacgattgtttatattcggacgattttcgtattatcgtacgatcgtattgtgtttttatattcgatatatttatttaaacgtttatttacgttcggttgtatcgttagtagcgcgtttattttacgtttgantacgtatcgattatatgatattttttattcgatgaaatgaaattttattttagttatttttttttattggttagtcgttcgttattacgtcgtcgtttttatttatttttttatntgttacgtttttattattatacgttattcgt

SEQ ID NO: 11922 - DNA, 722 bp, Artificial Sequence
  chemically treated genomic DNA (Homo sapiens) CpG-island No: 11922
  misc_feature (32)..(32): n is either a, c, g or t
  misc_feature (147)..(147): n is either a, c, g or t
acgaataacgtataataataaaaacgtaacanataaaaaaataaataaaaacgacgacgtaataacgaacgactaaccaataaaaaaaaataactaaaataaaatttcatttcatcgaataaaaaatatcatataatcgatacgtantcaaacgtaaaataaacgcgctactaacgatacaaccgaacgtaaataaacgtttaaataaatatatcgaatataaaaacacaatacgatcgtacgataatacgaaaatcgtccgaatataaacaatcgttaacgacatcgaataacattataacgaaacgaactctcgtaaaaataatcatactatcataaccgtaactacgacgataactacaaatctcgtaataaacacgataaactaatcatcgcgcgaccgctatatataattatataaaaaaaaatctactaaacgtaaaaaaaaaatatataaaaaacccgctcttataaatttattacgctacgaaaaatattaaaacgcgaatacgttaacgtattaaaaaccgcacgtaaaaaaaaacgtttttaattcgacaccccccgaaaaaaaattaccaacgacgtaccataaacaaataattatactcaaaaaattttctcgacgcgaaaaaaacgcaataaaaaaatatattcatctacgaaaataaatttacgcgaaaatcaatctaccaaaaataaaattatttcgataaaaacta

SEQ ID NO: 11923 - DNA, 722 bp, Artificial Sequence
  chemically treated genomic DNA (Homo sapiens) CpG-island No: 11923
  misc_feature (32)..(32): n is either a, c, g or t
  misc_feature (147)..(147): n is either a, c, g or t
acgggtggcgtgtgatgatggagacgtgatangtggagaggtggatagaggcgacgacgtgataacgagcggttagttagtggaggagagtgattgaggtgggattttattttatcgagtggagagtgttatatggtcgatacgtgnttagacgtggagtaagcgcgttgttaacgatatagtcgggcgtaggtgggcgtttagatgagtatgtcgagtgtgagagtatagtgcgatcgtacggtagtgcggagatcgttcgagtgtaagtagtcgttagcgatatcgagtagtattatgacgagacgggttttcgtggagatagttatgttgttataatcgtggttacggcggtagttgtagatttcgtgatgggtacgatgggttagttatcgcgcgatcgttgtatgtagttatgtaaagaggggtttgttgggcgtgaaagaggggtgtgtagaggattcgtttttgtgagtttgttacgttgcgagaggtgttgagacgcgagtgcgttggcgtgttgagggtcgtacgtaaaggggggcgtttttggttcggtatttttcgaggagggattgttagcgacgtattatgagtaggtagttgtgtttagagggttttttcggcgcggagagaacgtagtagagagatgtgtttatttgcggaaatggatttgcgcgagaattagtttgttaaaagtggggttgtttcggtaggaattg

SEQ ID NO: 11924 - DNA, 722 bp, Artificial Sequence
  chemically treated genomic DNA (Homo sapiens) CpG-island No: 11924
  misc_feature (576)..(576): n is either a, c, g or t
  misc_feature (691)..(691): n is either a, c, g or t
caattcctaccgaaacaaccccacttttaacaaactaattctcgcgcaaatccatttccgcaaataaacacatctctctactacgttctctccgcgccgaaaaaaccctctaaacacaactacctactcataatacgtcgctaacaatccctcctcgaaaaataccgaaccaaaaacgcccccctttacgtacgaccctcaacacgccaacgcactcgcgtctcaacacctctcgcaacgtaacaaactcacaaaaacgaatcctctacacacccctctttcacgcccaacaaacccctctttacataactacatacaacgatcgcgcgataactaacccatcgtacccatcacgaaatctacaactaccgccgtaaccacgattataacaacataactatctccacgaaaacccgtctcgtcataatactactcgatatcgctaacgactacttacactcgaacgatctccgcactaccgtacgatcgcactatactctcacactcgacatactcatctaaacgcccacctacgcccgactatatcgttaacaacgcgcttactccacgtctaancacgtatcgaccatataacactctccactcgataaaataaaatcccacctcaatcactctcctccactaactaaccgctcgttatcacgtcgtcgcctctatccacctctccacntatcacgtctccatcatcacacgccacccgt

SEQ ID NO: 11925 - DNA, 507 bp, Artificial Sequence
  chemically treated genomic DNA (Homo sapiens) CpG-island No: 11925
  misc_feature (61)..(61): n is either a, c, g or t
gggggggcggggcgggcgggcgggcggtttcgtcgcgggggcggggcgtcgcgggcgtcgngggttcgtggcgcgggcgcggcgtttcggcgcgttcgcgcggggcgcgttttttttcggtcggcggtcgcgcgggcgtcggcgggggtcgggcgcgcgcggggggggggcgcggttcgtgtcgggttttcgtcggtggcgcgttttttcggtcgggcggtcgtcgttcgcggtttcgttcgcggttttttcgcggggcggcgtgtcgtcgtcgtttttttcggtcgcgcgcgcgggtttttcgcgggttcggttttgtgcgtttcggtcgttcggcgcgcggtcgcggcgcggtcggcgggtcggcgttgttttcgggggttgcgtgcggtttcggggttgtcggttgtcggcgcggttttttcgtgggtcgggtcgcgggggcgtcgcggtcggcgggtgcggttcgcgggttttgcgtcgcgcgcgcgggcgtcgatataagga

SEQ ID NO: 11926 - DNA, 507 bp, Artificial Sequence
  chemically treated genomic DNA (Homo sapiens) CpG-island No: 11926
  misc_feature (447)..(447): n is either a, c, g or t
tccttatatcgacgcccgcgcgcgcgacgcaaaacccgcgaaccgcacccgccgaccgcgacgcccccgcgacccgacccacgaaaaaaccgcgccgacaaccgacaaccccgaaaccgcacgcaacccccgaaaacaacgccgacccgccgaccgcgccgcgaccgcgcgccgaacgaccgaaacgcacaaaaccgaacccgcgaaaaacccgcgcgcgcgaccgaaaaaaacgacgacgacacgccgccccgcgaaaaaaccgcgaacgaaaccgcgaacgacgaccgcccgaccgaaaaaacgcgccaccgacgaaaacccgacacgaaccgcgccccccccccgcgcgcgcccgacccccgccgacgcccgcgcgaccgccgaccgaaaaaaaacgcgccccgcgcgaacgcgccgaaacgccgcgcccgcgccacgaacccncgacgcccgcgacgccccgcccccgcgacgaaaccgcccgcccgcccgccccgccccccc

SEQ ID NO: 11927 - DNA, 507 bp, Artificial Sequence
  chemically treated genomic DNA (Homo sapiens) CpG-island No: 11927
  misc_feature (447)..(447): n is either a, c, g or t
tttttgtgtcggcgttcgcgcgcgcggcgtagggttcgcgggtcgtattcgtcggtcgcggcgttttcgcggttcggtttacgggggagtcgcgtcggtagtcgatagtttcggggtcgtacgtagttttcgagggtagcgtcggttcgtcggtcgcgtcgcggtcgcgcgtcgggcggtcgaggcgtatagagtcggattcgcggagggttcgcgcgcgcggtcggggggggcggcggcggtacgtcgtttcgcgggggggtcgcgggcgggatcgcgggcggcggtcgttcggtcgggggagcgcgttatcgacggaggttcggtacggatcgcgtttttttttcgcgcgcgttcgattttcgtcggcgttcgcgcggtcgtcgatcgggggggggcgcgtttcgcgcgggcgcgtcggggcgtcgcgttcgcgttacgagtttncggcgttcgcggcgtttcgttttcgcggcggggtcgttcgttcgttcgtttcgttttttt

SEQ ID NO: 11928 - DNA, 507 bp, Artificial Sequence
  chemically treated genomic DNA (Homo sapiens) CpG-island No: 11928
  misc_feature (61)..(61): n is either a, c, g or t
aaaaaaacgaaacgaacgaacgaacgaccccgccgcgaaaacgaaacgccgcgaacgccgnaaactcgtaacgcgaacgcgacgccccgacgcgcccgcgcgaaacgcgcccccccccgatcgacgaccgcgcgaacgccgacgaaaatcgaacgcgcgcgaaaaaaaaacgcgatccgtaccgaacctccgtcgataacgcgctcccccgaccgaacgaccgccgcccgcgatcccgcccgcgacccccccgcgaaacgacgtaccgccgccgccccccccgaccgcgcgcgcgaaccctccgcgaatccgactctatacgcctcgaccgcccgacgcgcgaccgcgacgcgaccgacgaaccgacgctaccctcgaaaactacgtacgaccccgaaactatcgactaccgacgcgactcccccgtaaaccgaaccgcgaaaacgccgcgaccgacgaatacgacccgcgaaccctacgccgcgcgcgcgaacgccgacacaaaaa

SEQ ID NO: 11929 - DNA, 703 bp, Artificial Sequence
  chemically treated genomic DNA (Homo sapiens) CpG-island No: 11929
tttattaggtggcgatgttagcggcgggcgggtttggtcggattggtcgcgtcgtttttgtcgtgggtgtcgacggcggcgtcgggacgggcgtggggggtagggcgagttatatgattcgttcggttttttgggtttggttgttgtcgttcgtcggtgttcgttcgtgtcgcgtcggggtattaaggagtcgttggagggttcgggcggaggttcgttcgtgtggaagtcgtcgacgtcgtcgttcgttcgttttttcgttcgttttcgttttcggtcgttattatgttggcgtttatttttcgtttgttggattggtttcgttcgtttttttggaaggaagagatggagttgacgttcgtggggttgtagtattcgggtaagattattttcgttaatgttatcgcggtgagcgttcgtttatttattcgttcggggtttcgtagttaggagttcggttcggcgtttttttaaggtttgagttggggtttttttcggcgcgatgggattgatggcggggggcgtgcgaagttgggtttgttatttttcgagggttagtatttggaatttttcgcgtgttggcggcgcggggagtagtattgagatcggtagcggaagggttaagttagtgtagatattttttaagggttgtgtttttaacgtcgcgggggttcggaaagagttaaattgaattcgttatatt

SEQ ID NO: 11930 - DNA, 703 bp, Artificial Sequence
  chemically treated genomic DNA (Homo sapiens) CpG-island No: 11930
aatataacgaattcaatttaactctttccgaacccccgcgacgttaaaaacacaacccttaaaaaatatctacactaacttaacccttccgctaccgatctcaatactactccccgcgccgccaacacgcgaaaaattccaaatactaaccctcgaaaaataacaaacccaacttcgcacgccccccgccatcaatcccatcgcgccgaaaaaaaccccaactcaaaccttaaaaaaacgccgaaccgaactcctaactacgaaaccccgaacgaataaataaacgaacgctcaccgcgataacattaacgaaaataatcttacccgaatactacaaccccacgaacgtcaactccatctcttccttccaaaaaaacgaacgaaaccaatccaacaaacgaaaaataaacgccaacataataacgaccgaaaacgaaaacgaacgaaaaaacgaacgaacgacgacgtcgacgacttccacacgaacgaacctccgcccgaaccctccaacgactccttaataccccgacgcgacacgaacgaacaccgacgaacgacaacaaccaaacccaaaaaaccgaacgaatcatataactcgccctaccccccacgcccgtcccgacgccgccgtcgacacccacgacaaaaacgacgcgaccaatccgaccaaacccgcccgccgctaacatcgccacctaataaa

SEQ ID NO: 11931 - DNA, 703 bp, Artificial Sequence
  chemically treated genomic DNA (Homo sapiens) CpG-island No: 11931
aatgtgacgagtttaatttaatttttttcgagttttcgcggcgttgaggatatagtttttggaaaatgtttatattgatttaattttttcgttgtcgattttagtgttatttttcgcgtcgttaatacgcgggaaattttaaatgttggttttcgggagatgataggtttagtttcgtacgtttttcgttattagttttatcgcgtcgaggggggttttaatttaggttttggagaagcgtcgggtcggatttttggttgcggagtttcgggcgagtgagtgggcgggcgtttatcgcgatgatattgacgaaggtggttttgttcgagtattgtagttttacgagcgttagttttattttttttttttagaagagcgaacggaattagtttagtaggcgggagatgagcgttagtatgatggcggtcgggagcgagaacggacgggaggacggacgagcggcggcgtcgacgatttttatacgagcgggttttcgttcggattttttaacggttttttggtgtttcggcgcgatacgggcggatatcggcgggcggtagtagttagatttaggaagtcgagcggattatatgattcgttttattttttacgttcgtttcggcgtcgtcgtcggtatttacggtaagagcggcgcggttaattcggttaggttcgttcgtcgttggtatcgttatttggtggg

SEQ ID NO: 11932 - DNA, 703 bp, Artificial Sequence
  chemically treated genomic DNA (Homo sapiens) CpG-island No: 11932
cccaccaaataacgataccaacgacgaacgaacctaaccgaattaaccgcgccgctcttaccgtaaataccgacgacgacgccgaaacgaacgtaaaaaataaaacgaatcatataatccgctcgacttcctaaatctaactactaccgcccgccgatatccgcccgtatcgcgccgaaacaccaaaaaaccgttaaaaaatccgaacgaaaacccgctcgtataaaaatcgtcgacgccgccgctcgtccgtcctcccgtccgttctcgctcccgaccgccatcatactaacgctcatctcccgcctactaaactaattccgttcgctcttctaaaaaaaaaaaataaaactaacgctcgtaaaactacaatactcgaacaaaaccaccttcgtcaatatcatcgcgataaacgcccgcccactcactcgcccgaaactccgcaaccaaaaatccgacccgacgcttctccaaaacctaaattaaaacccccctcgacgcgataaaactaataacgaaaaacgtacgaaactaaacctatcatctcccgaaaaccaacatttaaaatttcccgcgtattaacgacgcgaaaaataacactaaaatcgacaacgaaaaaattaaatcaatataaacattttccaaaaactatatcctcaacgccgcgaaaactcgaaaaaaattaaattaaactcgtcacatt

SEQ ID NO: 11933 - DNA, 929 bp, Artificial Sequence
  chemically treated genomic DNA (Homo sapiens) CpG-island No: 11933
  misc_feature (484)..(484): n is either a, c, g or t
  misc_feature (486)..(486): n is either a, c, g or t
  misc_feature (489)..(489): n is either a, c, g or t
  misc_feature (512)..(512): n is either a, c, g or t
  misc_feature (576)..(576): n is either a, c, g or t
  misc_feature (579)..(579): n is either a, c, g or t
  misc_feature (584)..(585): n is either a, c, g or t
tttattcgaatatacgaaaagcggattcgagcggggggtttaaggtttcgtatattcgttttcggtcgtttttttcgtttttattttataaaatgtcgacgtcgaggtcgttagtgaaaaagattttcgtcggtggttataattcgggttaggggaatttaggagttttagtttttcgttgggacggaaacggcggaatttaaaagtgatagtatgataggatttttagagtcgatagattagtttttagtaatttttatttttttaagtcggttcggttttttcggttttcggttttttattcgttcggtttcgttcggttttattcggtttcgttcggttttattttgtttcgttcggttttatttattttcgtttggtattattcgattcgcgtttcgtttttgttcggtttgtattcggttatttcggttgcgttttattttttcggttcgtttatttggttttattcgtttcgttgggntncgntttttcgttttgtttcgatcggntcgcgcgttcgttttttttgttaggtggaataacgcgggatgttttgttcgtttcgtcgggttncgngtggnnggtcgtttgttttatttggtttagttttcgtttcggttttagcgggttgcgtcgggtataggtcggttttatcgggtttgttttttttttttttttcggttatttacgaggttagttcgtgtatttgttttttttttatttattcgatagttttagggtagttcggttcgaaacgatttaggaggggttttgtaaagttttttattatcgtgggtatcgtttaggttgaggaacgaatttagtttcggggtattttgatttggcgacgcgtttcgggatttttatattatatttggatgttttggggtagttttcgtatatttgagtttttttatttgtaaaat

SEQ ID NO: 11934 - DNA, 929 bp, Artificial Sequence
  chemically treated genomic DNA (Homo sapiens) CpG-island No: 11934
  misc_feature (345)..(346): n is either a, c, g or t
  misc_feature (351)..(351): n is either a, c, g or t
  misc_feature (354)..(354): n is either a, c, g or t
  misc_feature (418)..(418): n is either a, c, g or t
  misc_feature (441)..(441): n is either a, c, g or t
  misc_feature (444)..(444): n is either a, c, g or t
  misc_feature (446)..(446): n is either a, c, g or t
attttacaaataaaaaaactcaaatatacgaaaactaccccaaaacatccaaatataatataaaaatcccgaaacgcgtcgccaaatcaaaataccccgaaactaaattcgttcctcaacctaaacgatacccacgataataaaaaactttacaaaacccctcctaaatcgtttcgaaccgaactaccctaaaactatcgaataaataaaaaaaaaacaaatacacgaactaacctcgtaaataaccgaaaaaaaaaaaaaaaacaaacccgataaaaccgacctatacccgacgcaacccgctaaaaccgaaacgaaaactaaaccaaataaaacaaacgaccnnccacncgnaacccgacgaaacgaacaaaacatcccgcgttattccacctaacaaaaaaaacgaacgcgcganccgatcgaaacaaaacgaaaaancgnancccaacgaaacgaataaaaccaaataaacgaaccgaaaaaataaaacgcaaccgaaataaccgaatacaaaccgaacaaaaacgaaacgcgaatcgaataataccaaacgaaaataaataaaaccgaacgaaacaaaataaaaccgaacgaaaccgaataaaaccgaacgaaaccgaacgaataaaaaaccgaaaaccgaaaaaaccgaaccgacttaaaaaaataaaaattactaaaaactaatctatcgactctaaaaatcctatcatactatcacttttaaattccgccgtttccgtcccaacgaaaaactaaaactcctaaattcccctaacccgaattataaccaccgacgaaaatctttttcactaacgacctcgacgtcgacattttataaaataaaaacgaaaaaaacgaccgaaaacgaatatacgaaaccttaaaccccccgctcgaatccgcttttcgtatattcgaataaa

SEQ ID NO: 11935 - DNA, 929 bp, Artificial Sequence
  chemically treated genomic DNA (Homo sapiens) CpG-island No: 11935
  misc_feature (345)..(346): n is either a, c, g or t
  misc_feature (351)..(351): n is either a, c, g or t
  misc_feature (354)..(354): n is either a, c, g or t
  misc_feature (418)..(418): n is either a, c, g or t
  misc_feature (441)..(441): n is either a, c, g or t
  misc_feature (444)..(444): n is either a, c, g or t
  misc_feature (446)..(446): n is either a, c, g or t
attttgtagatggggagatttagatgtgcgagggttattttagggtatttaggtgtgatgtgggggtttcgagacgcgtcgttaagttaagatatttcggagttaagttcgttttttagtttgagcggtgtttacgatgatggaagattttgtaagattttttttgggtcgtttcgaatcgagttgttttagagttgtcgggtaggtgagggggagataggtgtacgagttgatttcgtaggtgatcgaagaaggggagggaagtaggttcgatggagtcgatttgtattcgacgtaattcgttggggtcgaaacgggagttaagttagatggaataaacgattnnttatncgnagttcggcggggcgaataggatatttcgcgttgttttatttggtaaaaagggcgagcgcgcggntcgatcggagtagagcgagaggncgngntttaacggagcggatggggttaagtggacgagtcgagggagtggggcgtagtcgaagtagtcgagtgtaagtcgaatagagacgaggcgcgggtcgggtggtgttaagcggaaatgagtggggtcgagcggggtagggtggagtcgagcggagtcgggtggagtcgagcggagtcgagcgagtgagaagtcggaggtcgagagggtcgggtcgatttgaagaggtggggattgttgagggttggtttgtcggttttggaaattttgttatattgttatttttggatttcgtcgttttcgttttaacggaaaattggggtttttggatttttttgattcgagttgtaattatcgacgagaattttttttattggcggtttcggcgtcggtattttataaaatgagagcggggagggcggtcgaagacgagtgtgcggagttttaggtttttcgttcgggttcgtttttcgtatattcgggtagg

SEQ ID NO: 11936 - DNA, 929 bp, Artificial Sequence
  chemically treated genomic DNA (Homo sapiens) CpG-island No: 11936
  misc_feature (484)..(484): n is either a, c, g or t
  misc_feature (486)..(486): n is either a, c, g or t
  misc_feature (489)..(489): n is either a, c, g or t
  misc_feature (512)..(512): n is either a, c, g or t
  misc_feature (576)..(576): n is either a, c, g or t
  misc_feature (579)..(579): n is either a, c, g or t
  misc_feature (584)..(585): n is either a, c, g or t
cctacccgaatatacgaaaaacgaacccgaacgaaaaacctaaaactccgcacactcgtcttcgaccgccctccccgctctcattttataaaataccgacgccgaaaccgccaataaaaaaaattctcgtcgataattacaactcgaatcaaaaaaatccaaaaaccccaattttccgttaaaacgaaaacgacgaaatccaaaaataacaatataacaaaatttccaaaaccgacaaaccaaccctcaacaatccccacctcttcaaatcgacccgaccctctcgacctccgacttctcactcgctcgactccgctcgactccacccgactccgctcgactccaccctaccccgctcgaccccactcatttccgcttaacaccacccgacccgcgcctcgtctctattcgacttacactcgactacttcgactacgccccactccctcgactcgtccacttaaccccatccgctccgttaaancncgncctctcgctctactccgatcganccgcgcgctcgccctttttaccaaataaaacaacgcgaaatatcctattcgccccgccgaactncgnataannaatcgtttattccatctaacttaactcccgtttcgaccccaacgaattacgtcgaatacaaatcgactccatcgaacctacttccctccccttcttcgatcacctacgaaatcaactcgtacacctatctccccctcacctacccgacaactctaaaacaactcgattcgaaacgacccaaaaaaaatcttacaaaatcttccatcatcgtaaacaccgctcaaactaaaaaacgaacttaactccgaaatatcttaacttaacgacgcgtctcgaaacccccacatcacacctaaataccctaaaataaccctcgcacatctaaatctccccatctacaaaat

SEQ ID NO: 11937 - DNA, 515 bp, Artificial Sequence
  chemically treated genomic DNA (Homo sapiens) CpG-island No: 11937
cggcgggagggcggttcgcgggcgggcggggcggttaggggaggttattttttgttgttttttttttttgtttttttcgttattcgtgtttttttttttcgtttttaattaaaaaggagataaagtcgtacgcggttcgagttaatcggttcgagttaatcggttttattggttttttggatgttgaatgtgcgcggggcggcggggcgcgggttaagatgaagattaaagtaggggaaaaaaaggaaagttatttagacgcgggcgaattaataatatttaaaatatatcggtaggttggcggtattggcgcgagtttcgtagtcgttttttcgtcgttggtcgggttggcggtttttggtcggttttgtacgtatttgttagcggtcgcggtcggataatttgcgaaattttcgttttagagacgtggattggggaagtgacggggtaggggggtagtagtgataaaatataaagggtttgttacgtatattttttcgtcgtagtttttgcgg

SEQ ID NO: 11938 - DNA, 515 bp, Artificial Sequence
  chemically treated genomic DNA (Homo sapiens) CpG-island No: 11938
ccgcaaaaactacgacgaaaaaatatacgtaacaaaccctttatattttatcactactacccccctaccccgtcacttccccaatccacgtctctaaaacgaaaatttcgcaaattatccgaccgcgaccgctaacaaatacgtacaaaaccgaccaaaaaccgccaacccgaccaacgacgaaaaaacgactacgaaactcgcgccaataccgccaacctaccgatatattttaaatattattaattcgcccgcgtctaaataactttcctttttttcccctactttaatcttcatcttaacccgcgccccgccgccccgcgcacattcaacatccaaaaaaccaataaaaccgattaactcgaaccgattaactcgaaccgcgtacgactttatctcctttttaattaaaaacgaaaaaaaaaaacacgaataacgaaaaaaacaaaaaaaaaaaacaacaaaaaataacctcccctaaccgccccgcccgcccgcgaaccgccctcccgccg

SEQ ID NO: 11939 - DNA, 515 bp, Artificial Sequence
  chemically treated genomic DNA (Homo sapiens) CpG-island No: 11939
tcgtaggggttgcggcgaggggatgtgcgtggtagattttttgtgttttgttattattatttttttatttcgttatttttttagtttacgtttttggagcggggatttcgtaagttgttcggtcgcggtcgttagtaggtgcgtgtagagtcgattaggggtcgttagttcgattagcggcggagaggcggttgcggggttcgcgttagtatcgttagtttgtcggtgtgttttaagtgttattgattcgttcgcgtttgggtggttttttttttttttttttgttttaatttttattttggttcgcgtttcgtcgtttcgcgtatatttagtatttaggaagttagtagggtcgattggttcgagtcgattgattcgggtcgcgtgcggttttattttttttttaattagaaacggggaggagggatacgggtggcgggggagatagaaagggaaaatagtagaaaataattttttttggtcgtttcgttcgttcgcgggtcgttttttcgtcg

SEQ ID NO: 11940 - DNA, 515 bp, Artificial Sequence
  chemically treated genomic DNA (Homo sapiens) CpG-island No: 11940
cgacgaaaaaacgacccgcgaacgaacgaaacgaccaaaaaaaattattttctactattttccctttctatctcccccgccacccgtatccctcctccccgtttctaattaaaaaaaaaataaaaccgcacgcgacccgaatcaatcgactcgaaccaatcgaccctactaacttcctaaatactaaatatacgcgaaacgacgaaacgcgaaccaaaataaaaattaaaacaaaaaaaaaaaaaaaaaaccacccaaacgcgaacgaatcaataacacttaaaacacaccgacaaactaacgatactaacgcgaaccccgcaaccgcctctccgccgctaatcgaactaacgacccctaatcgactctacacgcacctactaacgaccgcgaccgaacaacttacgaaatccccgctccaaaaacgtaaactaaaaaaataacgaaataaaaaaataataataacaaaacacaaaaaatctaccacgcacatcccctcgccgcaacccctacga

SEQ ID NO: 11941 - DNA, 752 bp, Artificial Sequence
  chemically treated genomic DNA (Homo sapiens) CpG-island No: 11941
ttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacgggtcggcgttggatgagcgaacggtggtgttggggtcggatcgtgaaacgtttgttgggcggcgtgaaagcgtttgtttgtcggttatgaggtttttggggttggtgatcggattttgggggggttggggggtcgatcgggtttgtgttttttcgtttcggtggtttaatgttgggggttggtcggggggtttttcggggtttttcgggggttcgttggtgtttttggcgaagttgggtttaattggaagttaata

SEQ ID NO: 11942 - DNA, 752 bp, Artificial Sequence
  chemically treated genomic DNA (Homo sapiens) CpG-island No: 11942
tattaacttccaattaaacccaacttcgccaaaaacaccaacgaacccccgaaaaaccccgaaaaaccccccgaccaacccccaacattaaaccaccgaaacgaaaaaacacaaacccgatcgaccccccaacccccccaaaatccgatcaccaaccccaaaaacctcataaccgacaaacaaacgctttcacgccgcccaacaaacgtttcacgatccgaccccaacaccaccgttcgctcatccaacgccgacccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataa

SEQ ID NO: 11943 - DNA, 752 bp, Artificial Sequence
  chemically treated genomic DNA (Homo sapiens) CpG-island No: 11943
tattggtttttagttgggtttaatttcgttaaaggtattaacgaattttcggaaagtttcggaaaatttttcggttaatttttagtattgaattatcgggacggagaagtataaattcgatcggttttttagtttttttaagattcggttattaattttagaagttttatgatcggtaggtaagcgtttttacgtcgtttaatagacgttttacggttcgattttagtattatcgttcgtttatttagcgtcgattcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtgg

SEQ ID NO: 11944 - DNA, 752 bp, Artificial Sequence
  chemically treated genomic DNA (Homo sapiens) CpG-island No: 11944
ccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgaatcgacgctaaataaacgaacgataatactaaaatcgaaccgtaaaacgtctattaaacgacgtaaaaacgcttacctaccgatcataaaacttctaaaattaataaccgaatcttaaaaaaactaaaaaaccgatcgaatttatacttctccgtcccgataattcaatactaaaaattaaccgaaaaattttccgaaactttccgaaaattcgttaatacctttaacgaaattaaacccaactaaaaaccaata

SEQ ID NO: 11945 - DNA, 522 bp, Artificial Sequence
  chemically treated genomic DNA (Homo sapiens) CpG-island No: 11945
ttgagttcgcgggggaattttttatttttttttcgattaggcgcgggtttcgtggggtttttattttgtcgatttcggttttattcgtttttcgttcgttcgtttaaggtttttcgggttcgtcgtttgcggttcgtttttttttcgtcgtcgggttatttcgggataggcgttttattttcgtttttttcgcggcgggagtttaaggttttagcggttgcggcggcggagtttcgtgttagtgtcgggttttgaattttcgcgcgatattgggatttatttttaatttttaattttcgcgtttcggtttcgggttttcggcgatcggcggtcgcgattacggtggattcggggttcggtgaagtttttggttgtgtttcgggtggtcgagtaaagggcgttacggtgaggagacggacggtcggcgtttacggtttggaggggttgttttaggttgtaggattgagattcgagttgttcgttcgggttttatattttcggtgttttttgttttgaagtttt

SEQ ID NO: 11946 - DNA, 522 bp, Artificial Sequence
  chemically treated genomic DNA (Homo sapiens) CpG-island No: 11946
aaaacttcaaaacaaaaaacaccgaaaatataaaacccgaacgaacaactcgaatctcaatcctacaacctaaaacaacccctccaaaccgtaaacgccgaccgtccgtctcctcaccgtaacgccctttactcgaccacccgaaacacaaccaaaaacttcaccgaaccccgaatccaccgtaatcgcgaccgccgatcgccgaaaacccgaaaccgaaacgcgaaaattaaaaattaaaaataaatcccaatatcgcgcgaaaattcaaaacccgacactaacacgaaactccgccgccgcaaccgctaaaaccttaaactcccgccgcgaaaaaaacgaaaataaaacgcctatcccgaaataacccgacgacgaaaaaaaaacgaaccgcaaacgacgaacccgaaaaaccttaaacgaacgaacgaaaaacgaataaaaccgaaatcgacaaaataaaaaccccacgaaacccgcgcctaatcgaaaaaaaaataaaaaattcccccgcgaactcaa

SEQ ID NO: 11947 - DNA, 522 bp, Artificial Sequence
  chemically treated genomic DNA (Homo sapiens) CpG-island No: 11947
ggagttttagagtaagaaatatcgaaggtgtaaagttcgagcgagtagttcgagttttagttttgtagtttaaggtagtttttttaagtcgtgggcgtcggtcgttcgtttttttatcgtggcgttttttattcggttattcggggtatagttaggggttttatcgagtttcgggtttatcgtggtcgcggtcgtcggtcgtcgggagttcggagtcgggacgcgagggttgggggttggggatgggttttagtgtcgcgcgggagtttaaagttcggtattggtacggggtttcgtcgtcgtagtcgttggagttttgggttttcgtcgcggggagagcgggggtagggcgtttgtttcggagtgattcggcggcggaggaagggcgggtcgtaggcggcgggttcgggggattttgagcgggcgggcgaggagcgggtgagatcgaggtcgatagagtgggggttttacgaggttcgcgtttggtcgggaagagagtaggagattttttcgcgagtttag

SEQ ID NO: 11948 - DNA, 522 bp, Artificial Sequence
  chemically treated genomic DNA (Homo sapiens) CpG-island No: 11948
ctaaactcgcgaaaaaatctcctactctcttcccgaccaaacgcgaacctcgtaaaacccccactctatcgacctcgatctcacccgctcctcgcccgcccgctcaaaatcccccgaacccgccgcctacgacccgcccttcctccgccgccgaatcactccgaaacaaacgccctacccccgctctccccgcgacgaaaacccaaaactccaacgactacgacgacgaaaccccgtaccaataccgaactttaaactcccgcgcgacactaaaacccatccccaacccccaaccctcgcgtcccgactccgaactcccgacgaccgacgaccgcgaccacgataaacccgaaactcgataaaacccctaactataccccgaataaccgaataaaaaacgccacgataaaaaaacgaacgaccgacgcccacgacttaaaaaaactaccttaaactacaaaactaaaactcgaactactcgctcgaactttacaccttcgatatttcttactctaaaactcc

SEQ ID NO: 11949 - DNA, 669 bp, Artificial Sequence
  chemically treated genomic DNA (Homo sapiens) CpG-island No: 11949
gttgtatacgtttgattcggttatttgtttattcgattattaagcgaaatatcgtatcgagcgagtacgtattcggatggaagtcggttttgtcgattaggatgatttggacgaagagtattaggggttttcgttagtcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgtttggttattcgtgatattgttgaagagtttggcggcgaaatggttgatcgttttttcgggttttacggtatcgtcgttttcgattcgtagcgtatcgttttttattttttttttgacgagtttttttgagcggaattttgggggtcgaaatgatcgattaagcgacgtttaattttgtattacgagatttcgattttatcgtcgttttttatgaaagggtggggtttcggaattcggtttttcgggatcgtcggttggatgaatttttttagcgcggggaatttaatggttggaagtttttcgtttatttcgggtttcgattttttcgggaggtgggttaagttggttgtttgaggtttaattattt

SEQ ID NO: 11950 - DNA, 669 bp, Artificial Sequence
  chemically treated genomic DNA (Homo sapiens) CpG-island No: 11950
aaataattaaacctcaaacaaccaacttaacccacctcccgaaaaaatcgaaacccgaaataaacgaaaaacttccaaccattaaattccccgcgctaaaaaaattcatccaaccgacgatcccgaaaaaccgaattccgaaaccccaccctttcataaaaaacgacgataaaatcgaaatctcgtaatacaaaattaaacgtcgcttaatcgatcatttcgacccccaaaattccgctcaaaaaaactcgtcaaaaaaaaaataaaaaacgatacgctacgaatcgaaaacgacgataccgtaaaacccgaaaaaacgatcaaccatttcgccgccaaactcttcaacaatatcacgaataaccaaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgactaacgaaaacccctaatactcttcgtccaaatcatcctaatcgacaaaaccgacttccatccgaatacgtactcgctcgatacgatatttcgcttaataatcgaataaacaaataaccgaatcaaacgtatacaac

SEQ ID NO: 11951 - DNA, 669 bp, Artificial Sequence
  chemically treated genomic DNA (Homo sapiens) CpG-island No: 11951
gggtggttaagttttaggtagttagtttaatttatttttcgagggggtcgaagttcggggtgggcgaaaaatttttagttattagatttttcgcgttgggaggatttatttagtcggcggtttcggaaaatcgaatttcggagttttatttttttatagaaggcggcggtggaatcgaaatttcgtgatgtaaggttgggcgtcgtttggtcggttatttcgatttttagagtttcgtttagaagaattcgttaagaagggggtagaaggcgatgcgttgcgaatcgggagcggcgatatcgtaaagttcgaggaagcggttaattatttcgtcgttaagttttttagtaatattacgggtagttaaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggttggcgagagtttttgatgtttttcgtttagattattttgatcgataagatcggtttttattcgagtacgtgttcgttcgatgcgatgtttcgtttggtggtcgaatgggtaggtagtcggattaagcgtatgtagt

SEQ ID NO: 11952 - DNA, 669 bp, Artificial Sequence
  chemically treated genomic DNA (Homo sapiens) CpG-island No: 11952
actacatacgcttaatccgactacctacccattcgaccaccaaacgaaacatcgcatcgaacgaacacgtactcgaataaaaaccgatcttatcgatcaaaataatctaaacgaaaaacatcaaaaactctcgccaaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgtttaactacccgtaatattactaaaaaacttaacgacgaaataattaaccgcttcctcgaactttacgatatcgccgctcccgattcgcaacgcatcgccttctacccccttcttaacgaattcttctaaacgaaactctaaaaatcgaaataaccgaccaaacgacgcccaaccttacatcacgaaatttcgattccaccgccgccttctataaaaaaataaaactccgaaattcgattttccgaaaccgccgactaaataaatcctcccaacgcgaaaaatctaataactaaaaatttttcgcccaccccgaacttcgaccccctcgaaaaataaattaaactaactacctaaaacttaaccaccc

SEQ ID NO: 11953 - DNA, 511 bp, Artificial Sequence
  chemically treated genomic DNA (Homo sapiens) CpG-island No: 11953
  misc_feature (68)..(68): n is either a, c, g or t
  misc_feature (83)..(84): n is either a, c, g or t
  misc_feature (103)..(103): n is either a, c, g or t
  misc_feature (252)..(253): n is either a, c, g or t
  misc_feature (323)..(324): n is either a, c, g or t
  misc_feature (349)..(349): n is either a, c, g or t
  misc_feature (385)..(385): n is either a, c, g or t
ttttttcgcgtgggcgtcgggcgggtttttttttttgttgggtgtttttggcgttcgtttcgttgcgngttttttcggcgcgnnttttttttgttgttcgcgngtggggcgtttttttttgggtcgttggtcgtttttttttttgggggggttttttttttttggttcgtggttgggtttttttcgtttgtggcgtttcgtcgtttttcggtgtgcggcgtgggcgtttcgtttttttcgttggtcgcggtnnggtcgtcggtttttttttttgttttttttttttttttgggcgggtcgggggttcgtcgttcgttggttgnngtttttttttttttttttttttttntttttttcgtttgtgtggtcgtttttttcgttcgtntttttcgggtcgtttttttttcgggggggggttttttgttttttggtgttgttcggtcgtttttcgtttgtttttcgtcgcgtcggcgcgttttttttttcgtttttcgtttttttttttttttcg

SEQ ID NO: 11954 - DNA, 511 bp, Artificial Sequence
  chemically treated genomic DNA (Homo sapiens) CpG-island No: 11954
  misc_feature (127)..(127): n is either a, c, g or t
  misc_feature (163)..(163): n is either a, c, g or t
  misc_feature (188)..(189): n is either a, c, g or t
  misc_feature (259)..(260): n is either a, c, g or t
  misc_feature (409)..(409): n is either a, c, g or t
  misc_feature (428)..(429): n is either a, c, g or t
  misc_feature (444)..(444): n is either a, c, g or t
cgaaaaaaaaaaaaaaacgaaaaacgaaaaaaaaaacgcgccgacgcgacgaaaaacaaacgaaaaacgaccgaacaacaccaaaaaacaaaaaacccccccccgaaaaaaaaacgacccgaaaaanacgaacgaaaaaaacgaccacacaaacgaaaaaaanaaaaaaaaaaaaaaaaaaaaaaacnncaaccaacgaacgacgaacccccgacccgcccaaaaaaaaaaaaaaaacaaaaaaaaaaaccgacgaccnnaccgcgaccaacgaaaaaaacgaaacgcccacgccgcacaccgaaaaacgacgaaacgccacaaacgaaaaaaacccaaccacgaaccaaaaaaaaaaaacccccccaaaaaaaaaaacgaccaacgacccaaaaaaaaacgccccacncgcgaacaacaaaaaaaanncgcgccgaaaaaacncgcaacgaaacgaacgccaaaaacacccaacaaaaaaaaaaacccgcccgacgcccacgcgaaaaaa

SEQ ID NO: 11955 - DNA, 511 bp, Artificial Sequence
  chemically treated genomic DNA (Homo sapiens) CpG-island No: 11955
  misc_feature (127)..(127): n is either a, c, g or t
  misc_feature (163)..(163): n is either a, c, g or t
  misc_feature (188)..(189): n is either a, c, g or t
  misc_feature (259)..(260): n is either a, c, g or t
  misc_feature (409)..(409): n is either a, c, g or t
  misc_feature (428)..(429): n is either a, c, g or t
  misc_feature (444)..(444): n is either a, c, g or t
cgaagagaaaaaagaagcggggggcgaaaaagggggcgcgtcgacgcggcgaggaataaacgagaaacgatcgagtaatattagaagataagagattttttttcgaagaagaggcgattcggggagnacgaacggggggggcggttatataaacgagggaggngggagaaggaggggagaaagggatnntagttagcgggcggcggattttcggttcgtttaaaagaaggaggagagtagggggagaggtcggcggttnngtcgcggttaacggggaaggcggagcgtttacgtcgtatatcggggggcggcgaagcgttataaacggagggggtttagttacggattaaagaagggggatttttttaagaggaaaaacggttagcggtttagagaagagcgttttatncgcgaataataaagagggnncgcgtcgggaaaatncgtaacggggcgagcgttaggggtatttaatagaaaggggagttcgttcggcgtttacgcgagggaa

SEQ ID NO: 11956 - DNA, 511 bp, Artificial Sequence
  chemically treated genomic DNA (Homo sapiens) CpG-island No: 11956
  misc_feature (68)..(68): n is either a, c, g or t
  misc_feature (83)..(84): n is either a, c, g or t
  misc_feature (103)..(103): n is either a, c, g or t
  misc_feature (252)..(253): n is either a, c, g or t
  misc_feature (323)..(324): n is either a, c, g or t
  misc_feature (349)..(349): n is either a, c, g or t
  misc_feature (385)..(385): n is either a, c, g or t
ttccctcgcgtaaacgccgaacgaactcccctttctattaaatacccctaacgctcgccccgttacgnattttcccgacgcgnnccctctttattattcgcgnataaaacgctcttctctaaaccgctaaccgtttttcctcttaaaaaaatcccccttctttaatccgtaactaaaccccctccgtttataacgcttcgccgccccccgatatacgacgtaaacgctccgccttccccgttaaccgcgacnnaaccgccgacctctccccctactctcctccttcttttaaacgaaccgaaaatccgccgcccgctaactannatccctttctcccctccttctcccncctccctcgtttatataaccgccccccccgttcgtnctccccgaatcgcctcttcttcgaaaaaaaatctcttatcttctaatattactcgatcgtttctcgtttattcctcgccgcgtcgacgcgccccctttttcgccccccgcttcttttttctcttcg

SEQ ID NO: 11957 - DNA, 788 bp, Artificial Sequence
  chemically treated genomic DNA (Homo sapiens) CpG-island No: 11957
tttttagtacgtttttttttagcgttttgtagtcgttattttttagtatttttttagtataagaggggtcgtcgtttggttcggttttttcgtttttagtcgcgcgggtcgggggtagtagtagtagtttcgcgtcgttttcgttttagcggtttttacggtcgtttgttcggagcgcgtagaggaggttaatacgtaggaggtagagcggcggcggcggttttgggtttcggtagagggatagtcgcgttttgatgcgttataaggtttcggagtttcgagttgtcgggtttttgtcgtttttttgcgagcgtttattgaagggtattggtcgggttttttcgcggcgtttttgaatgggttattttttttattttcgagtgatatttagcggaaaaggcggtttttggcgttcgtatcgcgggggaaagtttagttttaagaggcgttcggtagtcggcgtacgttttattaatttggggtttttttaaagttcgttgcgtttacgttttttagcgttttttgtttcgtttttcgtcgtttatttgttttcgcgttcgtttttttggaaggcgattcggattcgagtttcggaaattttttttttttatttagggcgatcgtttaaggagttttggttgtttgattattgtcgacgtttatagggcgttgcgaggttatttttcgcgtttcgttttttttcggttcgcgggattttttgttaatagttttagaaagtgaggacgggggggcggaggcgggggtagtttttaggtagtgttgttttt

SEQ ID NO: 11958 - DNA, 788 bp, Artificial Sequence
  chemically treated genomic DNA (Homo sapiens) CpG-island No: 11958
aaaaacaacactacctaaaaactacccccgcctccgcccccccgtcctcactttctaaaactattaacaaaaaatcccgcgaaccgaaaaaaaacgaaacgcgaaaaataacctcgcaacgccctataaacgtcgacaataatcaaacaaccaaaactccttaaacgatcgccctaaataaaaaaaaaaaatttccgaaactcgaatccgaatcgccttccaaaaaaacgaacgcgaaaacaaataaacgacgaaaaacgaaacaaaaaacgctaaaaaacgtaaacgcaacgaactttaaaaaaaccccaaattaataaaacgtacgccgactaccgaacgcctcttaaaactaaactttcccccgcgatacgaacgccaaaaaccgccttttccgctaaatatcactcgaaaataaaaaaaataacccattcaaaaacgccgcgaaaaaacccgaccaatacccttcaataaacgctcgcaaaaaaacgacaaaaacccgacaactcgaaactccgaaaccttataacgcatcaaaacgcgactatccctctaccgaaacccaaaaccgccgccgccgctctacctcctacgtattaacctcctctacgcgctccgaacaaacgaccgtaaaaaccgctaaaacgaaaacgacgcgaaactactactactacccccgacccgcgcgactaaaaacgaaaaaaccgaaccaaacgacgacccctcttatactaaaaaaatactaaaaaataacgactacaaaacgctaaaaaaaaacgtactaaaaa

SEQ ID NO: 11959 - DNA, 788 bp, Artificial Sequence
  chemically treated genomic DNA (Homo sapiens) CpG-island No: 11959
agaggtagtattgtttggaggttgttttcgttttcgttttttcgtttttattttttgaggttgttagtagagagtttcgcgggtcggggagaagcgggacgcgggggatggtttcgtagcgttttgtgagcgtcggtagtagttaggtagttagggttttttgggcgatcgttttgggtagaggagaggagttttcggggttcgggttcgggtcgttttttaggggaacgagcgcggaagtaagtgggcggcgagaggcggagtaagagacgttggagggcgtggacgtagcgggttttggaaaggttttaagttaatgaggcgtgcgtcggttgtcgagcgttttttggagttgggttttttttcgcggtgcgggcgttaggagtcgtttttttcgttgggtgttattcgggggtggggaagatggtttatttaaaagcgtcgcgagggggttcggttagtgttttttagtgagcgttcgtaagaggacggtagaggttcggtagttcggagtttcgggattttgtggcgtattaggacgcggttgtttttttgtcgggatttagagtcgtcgtcgtcgttttgttttttgcgtgttagttttttttgcgcgtttcgggtaggcggtcgtgggagtcgttggggcgaggacggcgcgaggttgttgttgttgttttcggttcgcgcggttggaaacggagaggtcgagttaagcggcggttttttttatgttgggaggatgttggagagtagcggttgtaaagcgttgaaggagggcgtgttggaga

SEQ ID NO: 11960 - DNA, 788 bp, Artificial Sequence
  chemically treated genomic DNA (Homo sapiens) CpG-island No: 11960
tctccaacacgccctccttcaacgctttacaaccgctactctccaacatcctcccaacataaaaaaaaccgccgcttaactcgacctctccgtttccaaccgcgcgaaccgaaaacaacaacaacaacctcgcgccgtcctcgccccaacgactcccacgaccgcctacccgaaacgcgcaaaaaaaactaacacgcaaaaaacaaaacgacgacgacgactctaaatcccgacaaaaaaacaaccgcgtcctaatacgccacaaaatcccgaaactccgaactaccgaacctctaccgtcctcttacgaacgctcactaaaaaacactaaccgaaccccctcgcgacgcttttaaataaaccatcttccccacccccgaataacacccaacgaaaaaaacgactcctaacgcccgcaccgcgaaaaaaaacccaactccaaaaaacgctcgacaaccgacgcacgcctcattaacttaaaacctttccaaaacccgctacgtccacgccctccaacgtctcttactccgcctctcgccgcccacttacttccgcgctcgttcccctaaaaaacgacccgaacccgaaccccgaaaactcctctcctctacccaaaacgatcgcccaaaaaaccctaactacctaactactaccgacgctcacaaaacgctacgaaaccatcccccgcgtcccgcttctccccgacccgcgaaactctctactaacaacctcaaaaaataaaaacgaaaaaacgaaaacgaaaacaacctccaaacaatactacctct

SEQ ID NO: 11961 - DNA, 1015 bp, Artificial Sequence
  chemically treated genomic DNA (Homo sapiens) CpG-island No: 11961
agcgcggcgtttgggtttcggggttgtaggagttttcggtgggggtatggaggtcgtcggggaaggaggacggtttagttgttaggtaattcggtttggattcgtttttcgttcgcgttgttgggagattataaggtcgggaggagggcggcgaaagggttttacgtgttgacgttaattgtatatgagcgcgagcggcgggtttttgggttttttttagcgttatttgttcgcggcgtcgttttttgtttttttcgttgttgttgtcgttgtcgttttgagttattgtttgcgtagtttcggtcgtttggttttttatattagtcgtcggtaacggatgggggtttggaagggaagggggaacgtggtgttggttgggcggtttgcgtagatgggagggtcggagggatggagggattgggagtcgggagtcggggtcgttggtcgttcgtggttttcggggtcgttttgtgaggtcggataggatcgcggagttcggatttcggagtttgagaggggtttcggggtcgattagcgtttttatcggggacggttgaggcgacgtaggggttggcgcggtttggaggtttaaggttttttgagttttatcgtttttttcgcgtggatcggagcgaggtcgcggtgacgttcgggtgttttgagattcggttgcgtcgcgaggatcgggaggttttcggcgtacgggtcgggtcgagtgtagagttcgtcgttttttggatatttttttgttttttttttaaaaataatattaggagggaggtcgttgggagatgaaaagaacggcggaggttgcgaatttcgacgggagggaggggttgtggagggacgagttttcgaggcggggagggggcgggggaggttgcgacgttttcgggtttttcgtttattgggggcggtcgcgcggggaggggaaattttcggcggtttcgttttatacgtggtaatgggttttatggttattggttgggtttggttggagatttttgttttcggt

SEQ ID NO: 11962 - DNA, 1015 bp, Artificial Sequence
  chemically treated genomic DNA (Homo sapiens) CpG-island No: 11962
accgaaaacaaaaatctccaaccaaacccaaccaataaccataaaacccattaccacgtataaaacgaaaccgccgaaaatttcccctccccgcgcgaccgcccccaataaacgaaaaacccgaaaacgtcgcaacctcccccgccccctccccgcctcgaaaactcgtccctccacaacccctccctcccgtcgaaattcgcaacctccgccgttcttttcatctcccaacgacctccctcctaatattatttttaaaaaaaaaacaaaaaaatatccaaaaaacgacgaactctacactcgacccgacccgtacgccgaaaacctcccgatcctcgcgacgcaaccgaatctcaaaacacccgaacgtcaccgcgacctcgctccgatccacgcgaaaaaaacgataaaactcaaaaaaccttaaacctccaaaccgcgccaacccctacgtcgcctcaaccgtccccgataaaaacgctaatcgaccccgaaacccctctcaaactccgaaatccgaactccgcgatcctatccgacctcacaaaacgaccccgaaaaccacgaacgaccaacgaccccgactcccgactcccaatccctccatccctccgaccctcccatctacgcaaaccgcccaaccaacaccacgttcccccttcccttccaaacccccatccgttaccgacgactaatataaaaaaccaaacgaccgaaactacgcaaacaataactcaaaacgacaacgacaacaacaacgaaaaaaacaaaaaacgacgccgcgaacaaataacgctaaaaaaaacccaaaaacccgccgctcgcgctcatatacaattaacgtcaacacgtaaaaccctttcgccgccctcctcccgaccttataatctcccaacaacgcgaacgaaaaacgaatccaaaccgaattacctaacaactaaaccgtcctccttccccgacgacctccatacccccaccgaaaactcctacaaccccgaaacccaaacgccgcgct

SEQ ID NO: 11963 - DNA, 1015 bp, Artificial Sequence
  chemically treated genomic DNA (Homo sapiens) CpG-island No: 11963
atcgagggtaagggtttttaattaggtttagttagtggttatgaagtttattattacgtgtggagcgaagtcgtcgggggtttttttttttcgcgcggtcgtttttaatgggcggagagttcgggagcgtcgtagtttttttcgtttttttttcgtttcggggattcgtttttttatagtttttttttttcgtcggaattcgtagttttcgtcgttttttttattttttagcggttttttttttggtattatttttgagggaaaagtaggggggtgtttaagaggcggcgggttttgtattcggttcggttcgtacgtcgggggtttttcggttttcgcggcgtagtcgagttttagggtattcgggcgttatcgcggtttcgtttcggtttacgcggaaaagacggtggagtttagagaattttaggtttttaggtcgcgttaatttttacgtcgttttagtcgttttcgataaaagcgttggtcggtttcggggttttttttaggtttcggggttcggatttcgcggttttgttcgattttataggacgatttcggaggttacgggcggttagcggtttcgattttcggtttttagtttttttattttttcggtttttttatttgcgtaggtcgtttagttaatattacgttttttttttttttttaggtttttattcgttatcggcgattagtatggggagttaggcggtcggagttgcgtaggtagtgatttagggcggtagcggtagtagtagcgggaggagtaggaggcggcgtcgcgagtagatggcgttaaaaaagatttaagagttcgtcgttcgcgtttatatataattagcgttagtacgtagggttttttcgtcgtttttttttcggttttgtagttttttagtaacgcgagcgagaggcgggtttaggtcgggttgtttagtaattgaatcgtttttttttttcggcgatttttatatttttatcgaggatttttgtagtttcgaggtttaggcgtcgcgtt

SEQ ID NO: 11964 - DNA, 1015 bp, Artificial Sequence
  chemically treated genomic DNA (Homo sapiens) CpG-island No: 11964
aacgcgacgcctaaacctcgaaactacaaaaatcctcgataaaaatataaaaatcgccgaaaaaaaaaaacgattcaattactaaacaacccgacctaaacccgcctctcgctcgcgttactaaaaaactacaaaaccgaaaaaaaaacgacgaaaaaaccctacgtactaacgctaattatatataaacgcgaacgacgaactcttaaatcttttttaacgccatctactcgcgacgccgcctcctactcctcccgctactactaccgctaccgccctaaatcactacctacgcaactccgaccgcctaactccccatactaatcgccgataacgaataaaaacctaaaaaaaaaaaaaaaacgtaatattaactaaacgacctacgcaaataaaaaaaccgaaaaaataaaaaaactaaaaaccgaaaatcgaaaccgctaaccgcccgtaacctccgaaatcgtcctataaaatcgaacaaaaccgcgaaatccgaaccccgaaacctaaaaaaaaccccgaaaccgaccaacgcttttatcgaaaacgactaaaacgacgtaaaaattaacgcgacctaaaaacctaaaattctctaaactccaccgtcttttccgcgtaaaccgaaacgaaaccgcgataacgcccgaataccctaaaactcgactacgccgcgaaaaccgaaaaacccccgacgtacgaaccgaaccgaatacaaaacccgccgcctcttaaacacccccctacttttccctcaaaaataataccaaaaaaaaaaccgctaaaaaataaaaaaaacgacgaaaactacgaattccgacgaaaaaaaaaaactataaaaaaacgaatccccgaaacgaaaaaaaaacgaaaaaaactacgacgctcccgaactctccgcccattaaaaacgaccgcgcgaaaaaaaaaaacccccgacgacttcgctccacacgtaataataaacttcataaccactaactaaacctaattaaaaacccttaccctcgat

SEQ ID NO: 11965 - DNA, 898 bp, Artificial Sequence
  chemically treated genomic DNA (Homo sapiens) CpG-island No: 11965
agcgggcgatggagatagagagatattcgacgagaggaggcggggtgggggaggcggggagagtgcgggggcggaggttggtagggggtagttggaagttggagcggttcgtgcgtttttcgcgttcgagggtgtaggaggttttgaagcggttgttgtatcgcggggtttaggcggcggttggggggttggggggcgttgtcgtcgtcgtcgtcgggggcgtcgttggtttcggtttttttgttttcgcgcgttttttttcgtcgtttatttttttgttgtcgcgcggcggcggcggtgggcggcgtcggtttttttcgttcgaggtagtcgggttcggcgtcggggcggggagggggcggggggagtacgttagttttcgagagtggggggcgatggcgaagtttcgggtggtttacgagtatacggaagtcgaggataagagtattcggttcggtttgttttttattattttcggcgtcgtgtcgttttttattttcggtttttgttggttgagtttcgcgttgtaggatttgtaagttacggaggttaattgtacggtgttgtcggtgtagtagatcggcgaggtgttcgagtgtatttttatttgtggcgtcgattgtaggggtatttcgtagtatttttgcgtttaggtttacgtgaataattttgagtttaattttagggcgttgttgtatagcgacgagtattagtttttgattaattttaaggtaagaacgtttcgcgtatttaggggtttttcgcgagggaggtttggaggtagcgtcggtgttagatttcgcgcggggagggttcggcgtgtgttcgtattgttaggaggagattaggtggcgtaggttgtgtttaaattaggaatgattatattagggagttttag

SEQ ID NO: 11966 - DNA, 898 bp, Artificial Sequence
  chemically treated genomic DNA (Homo sapiens) CpG-island No: 11966
ctaaaactccctaatataatcattcctaatttaaacacaacctacgccacctaatctcctcctaacaatacgaacacacgccgaaccctccccgcgcgaaatctaacaccgacgctacctccaaacctccctcgcgaaaaacccctaaatacgcgaaacgttcttaccttaaaattaatcaaaaactaatactcgtcgctatacaacaacgccctaaaattaaactcaaaattattcacgtaaacctaaacgcaaaaatactacgaaatacccctacaatcgacgccacaaataaaaatacactcgaacacctcgccgatctactacaccgacaacaccgtacaattaacctccgtaacttacaaatcctacaacgcgaaactcaaccaacaaaaaccgaaaataaaaaacgacacgacgccgaaaataataaaaaacaaaccgaaccgaatactcttatcctcgacttccgtatactcgtaaaccacccgaaacttcgccatcgccccccactctcgaaaactaacgtactccccccgccccctccccgccccgacgccgaacccgactacctcgaacgaaaaaaaccgacgccgcccaccgccgccgccgcgcgacaacaaaaaaataaacgacgaaaaaaaacgcgcgaaaacaaaaaaaccgaaaccaacgacgcccccgacgacgacgacgacaacgccccccaaccccccaaccgccgcctaaaccccgcgatacaacaaccgcttcaaaacctcctacaccctcgaacgcgaaaaacgcacgaaccgctccaacttccaactaccccctaccaacctccgcccccgcactctccccgcctcccccaccccgcctcctctcgtcgaatatctctctatctccatcgcccgct

SEQ ID NO: 11967 - DNA, 898 bp, Artificial Sequence
  chemically treated genomic DNA (Homo sapiens) CpG-island No: 11967
ttggggttttttgatgtagttatttttggtttgagtatagtttgcgttatttggtttttttttagtaatgcgagtatacgtcgaatttttttcgcgcggagtttaatatcgacgttgtttttaaatttttttcgcggggagtttttgggtgcgcggggcgtttttattttggggttggttaggagttggtgttcgtcgttgtgtagtagcgttttagagttggatttagagttgtttacgtagatttggacgtaggggtattgcgaggtgtttttgtagtcggcgttataggtgaaggtgtattcgaatatttcgtcgatttgttgtatcgatagtatcgtgtaattggttttcgtggtttgtagattttgtagcgcgggatttagttagtagaagtcgaagatgaagagcgatacgacgtcggagatgatgagaaataagtcgagtcggatgtttttgttttcggttttcgtgtattcgtaagttattcggagtttcgttatcgttttttattttcgggggttggcgtgtttttttcgtttttttttcgtttcggcgtcgagttcgattgtttcgggcgggaggagtcggcgtcgtttatcgtcgtcgtcgcgcgatagtaggggagtgggcggcgagggggagcgcgcgagaataaaggggtcgaggttagcgacgttttcggcggcggcggcggtagcgttttttagttttttagtcgtcgtttgggtttcgcggtgtagtagtcgttttagagttttttgtattttcgggcgcggggagcgtacggatcgttttagtttttagttgttttttgttagttttcgttttcgtatttttttcgttttttttatttcgttttttttcgtcgggtgtttttttgtttttatcgttcgtt

SEQ ID NO: 11968 - DNA, 898 bp, Artificial Sequence
  chemically treated genomic DNA (Homo sapiens) CpG-island No: 11968
aacgaacgataaaaacaaaaaaacacccgacgaaaaaaaacgaaataaaaaaaacgaaaaaaatacgaaaacgaaaactaacaaaaaacaactaaaaactaaaacgatccgtacgctccccgcgcccgaaaatacaaaaaactctaaaacgactactacaccgcgaaacccaaacgacgactaaaaaactaaaaaacgctaccgccgccgccgccgaaaacgtcgctaacctcgacccctttattctcgcgcgctccccctcgccgcccactcccctactatcgcgcgacgacgacgataaacgacgccgactcctcccgcccgaaacaatcgaactcgacgccgaaacgaaaaaaaaacgaaaaaaacacgccaacccccgaaaataaaaaacgataacgaaactccgaataacttacgaatacacgaaaaccgaaaacaaaaacatccgactcgacttatttctcatcatctccgacgtcgtatcgctcttcatcttcgacttctactaactaaatcccgcgctacaaaatctacaaaccacgaaaaccaattacacgatactatcgatacaacaaatcgacgaaatattcgaatacaccttcacctataacgccgactacaaaaacacctcgcaatacccctacgtccaaatctacgtaaacaactctaaatccaactctaaaacgctactacacaacgacgaacaccaactcctaaccaaccccaaaataaaaacgccccgcgcacccaaaaactccccgcgaaaaaaatttaaaaacaacgtcgatattaaactccgcgcgaaaaaaattcgacgtatactcgcattactaaaaaaaaaccaaataacgcaaactatactcaaaccaaaaataactacatcaaaaaaccccaa

SEQ ID NO: 11969 - DNA, 505 bp, Artificial Sequence
  chemically treated genomic DNA (Homo sapiens) CpG-island No: 11969
  misc_feature (457)..(457): n is either a, c, g or t
  misc_feature (471)..(471): n is either a, c, g or t
  misc_feature (495)..(495): n is either a, c, g or t
gggtggtgttaagcggatgtgagtggggtcgagcggggtagggtggagtcgagcggagtcgggtggagtcgagcggagtcgagcgagtgagaagtcggaggtcgagagggtcgggtcgatttgaagaggtggggattgttgagggttggtttgtcggttttggaaattttgttatattgttatttttggatttcgtcgttttcgttttaacggaaaattggggtttttggatttttttgattcgagttgtaattatcgacgagaattttttttattggcggtttcggcgtcggtattttataaaatgagagcggggagggcggtcgaagacgagtgtgcggagttttaggtttttcgttcgggttcgtttttcgtatattcgggtaggatcggatgtggtgtttttcgttgaagtttttcggttttagtttattttggagcgggtgggggttttggngaatgttattttanagattttgtttttggggaacggtnttggcgtttt

SEQ ID NO: 11970 - DNA, 505 bp, Artificial Sequence
  chemically treated genomic DNA (Homo sapiens) CpG-island No: 11970
  misc_feature (11)..(11): n is either a, c, g or t
  misc_feature (35)..(35): n is either a, c, g or t
  misc_feature (49)..(49): n is either a, c, g or t
aaaacgccaanaccgttccccaaaaacaaaatctntaaaataacattcnccaaaacccccacccgctccaaaataaactaaaaccgaaaaacttcaacgaaaaacaccacatccgatcctacccgaatatacgaaaaacgaacccgaacgaaaaacctaaaactccgcacactcgtcttcgaccgccctccccgctctcattttataaaataccgacgccgaaaccgccaataaaaaaaattctcgtcgataattacaactcgaatcaaaaaaatccaaaaaccccaattttccgttaaaacgaaaacgacgaaatccaaaaataacaatataacaaaatttccaaaaccgacaaaccaaccctcaacaatccccacctcttcaaatcgacccgaccctctcgacctccgacttctcactcgctcgactccgctcgactccacccgactccgctcgactccaccctaccccgctcgaccccactcacatccgcttaacaccaccc

SEQ ID NO: 11971 - DNA, 505 bp, Artificial Sequence
  chemically treated genomic DNA (Homo sapiens) CpG-island No: 11971
  misc_feature (11)..(11): n is either a, c, g or t
  misc_feature (35)..(35): n is either a, c, g or t
  misc_feature (49)..(49): n is either a, c, g or t
aaggcgttagnatcgttttttaaaagtaaagtttntaaagtgatatttnttagaatttttattcgttttaaggtgaattggagtcgagggattttaacggaagatattatattcgattttattcgaatatacgaaaagcggattcgagcggggggtttaaggtttcgtatattcgttttcggtcgtttttttcgtttttattttataaaatgtcgacgtcgaggtcgttagtgaaaaagattttcgtcggtggttataattcgggttaggggaatttaggagttttagtttttcgttgggacggaaacggcggaatttaaaagtgatagtatgataggatttttagagtcgatagattagtttttagtaatttttatttttttaagtcggttcggttttttcggttttcggttttttattcgttcggtttcgttcggttttattcggtttcgttcggttttattttgtttcgttcggttttatttatattcgtttggtattattt

SEQ ID NO: 11972 - DNA, 505 bp, Artificial Sequence
  chemically treated genomic DNA (Homo sapiens) CpG-island No: 11972
  misc_feature (457)..(457): n is either a, c, g or t
  misc_feature (471)..(471): n is either a, c, g or t
  misc_feature (495)..(495): n is either a, c, g or t
aaataataccaaacgaatataaataaaaccgaacgaaacaaaataaaaccgaacgaaaccgaataaaaccgaacgaaaccgaacgaataaaaaaccgaaaaccgaaaaaaccgaaccgacttaaaaaaataaaaattactaaaaactaatctatcgactctaaaaatcctatcatactatcacttttaaattccgccgtttccgtcccaacgaaaaactaaaactcctaaattcccctaacccgaattataaccaccgacgaaaatctttttcactaacgacctcgacgtcgacattttataaaataaaaacgaaaaaaacgaccgaaaacgaatatacgaaaccttaaaccccccgctcgaatccgcttttcgtatattcgaataaaatcgaatataatatcttccgttaaaatccctcgactccaattcaccttaaaacgaataaaaattctaanaaatatcactttanaaactttacttttaaaaaacgatnctaacgcctt

SEQ ID NO: 11973 - DNA, 1252 bp, Artificial Sequence
  chemically treated genomic DNA (Homo sapiens) CpG-island No: 11973
gtttttgttttttatcgttttaggcggattttagaggattttattcgttttatttttggcggtattttgtatcgcgtattttaaagcgtggatattattgttggtaattagtgttttttcgttgtgtttgttggggatttttttcgtgcgtttcggcgtgttggtatcggtatacgcgtttgcgtttgattcggcgcgcggtatgtttattttcgtttttatggtgttggtgattggcggttcgatgttgttgtttgtcgcgcgtggatataaagttcgtttacgcgtaaataatgcgttgtggtcgcgggaatttttgttgttagcgaataatgttttgttggtcgttgcgatgttggtggtgttgttggggacgttgttgtcgttggtgtataagtaattgggattgggtagtatttcgattggcgaatcgttttttaatattatgtttatttggttgatggtgtcgtttgcgttattgtttggtgtcggttttttggtgcgttgggggcgggatcgtcgcgtaagattcgtaatttattgtttatcgtttttatttatacgttggtgttgtcgttgttgttgtcgtggttgttcgatagtaaatttttggcgatgacggtgtttcgtttggtaatggtttgttggattttcgggttttcgtaattgcgtaagttttcgttaattattttaacgcggttagataaatagttttgtacgtaattcggggttaaagtttacggtttaatttttcgggttcggtatttgaatatattgtttcggaatttgcgtttttaggttattaagatatttagtcgtttgaaggttttgaatttttttcgcgtttaaaattttttcggtcgatataaacggttcgtattaatttttaatggatttcgattcgtattttcgttttttttatacgtgatatatttttaataggaaggtgtttatttgttttcggtaattttgaacgtttttatagtttcgcgagcggtttaaaagttcgttatatttttataaaattttttaattcgcgagattcgtttcgtgtttttcgcggtaaaatttcgttattatattttttgttcggtcgttttcgtaattcgtaacgcgttatttgatattttcgttaaacgttttttattttattcgtttttttttcggttggcggcgttgagtaagtcggaggagtaatataatggtagttgttaaatgtaaatcgatattttcgggtcgtcgttacgtatta

SEQ ID NO: 11974 - DNA, 1252 bp, Artificial Sequence
  chemically treated genomic DNA (Homo sapiens) CpG-island No: 11974
taatacgtaacgacgacccgaaaatatcgatttacatttaacaactaccattatattactcctccgacttactcaacgccgccaaccgaaaaaaaaacgaataaaataaaaaacgtttaacgaaaatatcaaataacgcgttacgaattacgaaaacgaccgaacaaaaaatataataacgaaattttaccgcgaaaaacacgaaacgaatctcgcgaattaaaaaattttataaaaatataacgaacttttaaaccgctcgcgaaactataaaaacgttcaaaattaccgaaaacaaataaacaccttcctattaaaaatatatcacgtataaaaaaaacgaaaatacgaatcgaaatccattaaaaattaatacgaaccgtttatatcgaccgaaaaaattttaaacgcgaaaaaaattcaaaaccttcaaacgactaaatatcttaataacctaaaaacgcaaattccgaaacaatatattcaaataccgaacccgaaaaattaaaccgtaaactttaaccccgaattacgtacaaaactatttatctaaccgcgttaaaataattaacgaaaacttacgcaattacgaaaacccgaaaatccaacaaaccattaccaaacgaaacaccgtcatcgccaaaaatttactatcgaacaaccacgacaacaacaacgacaacaccaacgtataaataaaaacgataaacaataaattacgaatcttacgcgacgatcccgcccccaacgcaccaaaaaaccgacaccaaacaataacgcaaacgacaccatcaaccaaataaacataatattaaaaaacgattcgccaatcgaaatactacccaatcccaattacttatacaccaacgacaacaacgtccccaacaacaccaccaacatcgcaacgaccaacaaaacattattcgctaacaacaaaaattcccgcgaccacaacgcattatttacgcgtaaacgaactttatatccacgcgcgacaaacaacaacatcgaaccgccaatcaccaacaccataaaaacgaaaataaacataccgcgcgccgaatcaaacgcaaacgcgtataccgataccaacacgccgaaacgcacgaaaaaaatccccaacaaacacaacgaaaaaacactaattaccaacaataatatccacgctttaaaatacgcgatacaaaataccgccaaaaataaaacgaataaaatcctctaaaatccgcctaaaacgataaaaaacaaaaac

SEQ ID NO: 11975 - DNA, 1252 bp, Artificial Sequence
  chemically treated genomic DNA (Homo sapiens) CpG-island No: 11975
taatacgtggcgacgattcggagatgtcggtttatatttaataattgttattgtattattttttcgatttatttagcgtcgttaatcgaaaggagagcgggtgaagtgggagacgtttgacgggggtgttaaatggcgcgttgcgggttgcgagagcgatcgggtagggggtgtaatgacgaggttttgtcgcgagagatacgggacgggtttcgcgggttagggagttttgtggagatgtgacgggtttttgagtcgttcgcgagattgtgggaacgtttagagttgtcggggataaatgggtatttttttgttgggagtgtgttacgtgtgaagagggcggaagtgcggatcggagtttattgggaattagtgcgggtcgtttgtgtcggtcggggagattttgaacgcggggagaatttaaagtttttaaacggttgagtattttggtggtttgaaagcgtagatttcggaataatgtgtttaggtgtcgggttcgaaaggttgagtcgtggattttggtttcgagttacgtgtaaggttgtttgtttggtcgcgttgaaatagttagcgggagtttgcgtaattgcgaggattcggaaatttagtaggttattgttaggcggagtatcgttatcgttagaagtttgttgtcgaatagttacggtaatagtagcgatagtattagcgtatagatgaaggcggtaagtaataaattgcggattttacgcggcgatttcgtttttagcgtattagaggatcgatattaagtagtagcgtaaacggtattattagttaggtaaatatggtgttgaagaacggttcgttaatcgaaatattgtttagttttagttgtttatgtattaacggtagtagcgtttttagtaatattattagtatcgtagcgattagtaaaatattgttcgttaatagtaaagattttcgcgattatagcgtattgtttacgcgtgagcgaattttgtgtttacgcgcggtaaatagtagtatcgaatcgttaattattagtattatagaggcgaggataaatatatcgcgcgtcggattagacgtaaacgcgtgtatcgatattagtacgtcggaacgtacgaggaaagtttttaatagatataacgagaaggtattgattgttagtagtaatgtttacgttttgaagtgcgcgatgtagagtgtcgttagggatagaacgagtgggattttttagagttcgtttggagcgatggagggtaggggt

SEQ ID NO: 11976 - DNA, 1252 bp, Artificial Sequence
  chemically treated genomic DNA (Homo sapiens) CpG-island No: 11976
acccctaccctccatcgctccaaacgaactctaaaaaatcccactcgttctatccctaacgacactctacatcgcgcacttcaaaacgtaaacattactactaacaatcaataccttctcgttatatctattaaaaactttcctcgtacgttccgacgtactaatatcgatacacgcgtttacgtctaatccgacgcgcgatatatttatcctcgcctctataatactaataattaacgattcgatactactatttaccgcgcgtaaacacaaaattcgctcacgcgtaaacaatacgctataatcgcgaaaatctttactattaacgaacaatattttactaatcgctacgatactaataatattactaaaaacgctactaccgttaatacataaacaactaaaactaaacaatatttcgattaacgaaccgttcttcaacaccatatttacctaactaataataccgtttacgctactacttaatatcgatcctctaatacgctaaaaacgaaatcgccgcgtaaaatccgcaatttattacttaccgccttcatctatacgctaatactatcgctactattaccgtaactattcgacaacaaacttctaacgataacgatactccgcctaacaataacctactaaatttccgaatcctcgcaattacgcaaactcccgctaactatttcaacgcgaccaaacaaacaaccttacacgtaactcgaaaccaaaatccacgactcaacctttcgaacccgacacctaaacacattattccgaaatctacgctttcaaaccaccaaaatactcaaccgtttaaaaactttaaattctccccgcgttcaaaatctccccgaccgacacaaacgacccgcactaattcccaataaactccgatccgcacttccgccctcttcacacgtaacacactcccaacaaaaaaatacccatttatccccgacaactctaaacgttcccacaatctcgcgaacgactcaaaaacccgtcacatctccacaaaactccctaacccgcgaaacccgtcccgtatctctcgcgacaaaacctcgtcattacaccccctacccgatcgctctcgcaacccgcaacgcgccatttaacacccccgtcaaacgtctcccacttcacccgctctcctttcgattaacgacgctaaataaatcgaaaaaataatacaataacaattattaaatataaaccgacatctccgaatcgtcgccacgtatta

SEQ ID NO: 11977 - DNA, 531 bp, Artificial Sequence
  chemically treated genomic DNA (Homo sapiens) CpG-island No: 11977
  misc_feature (164)..(164): n is either a, c, g or t
ttggcggtgtttgtcgtcggtagcgttatcgttgcgtttttcgattttatttggggaattattttgggtcgggcgttataaggttttggagtaattgtcgtcgtcgttatggcgttgtttttcgattttacgcgcgaataaaatcgtattaaagcgatggcgtntatcggcgtgagttttggtattatttttgtttatgcgatggtgtttggttcgattatcgatgtaaaatagtaggatgcgatatattatttggagtatcgtttttgggatgttttttttcggatcgcgcgttttagcggtagtaattttaattagttttagatcgtcgaaggagaatataattatcgttagcggataaaattagtttattttagtcggtggcgaagaaattatcgtagcgttagaggttgtcgatattggttttttcgtcgtcgtgattagaaaatagtagttataggttaaagtcgattatatcgatgattgttagtattttaattaacgtaaattagaattcggtttcgttatata

SEQ ID NO: 11978 - DNA, 531 bp, Artificial Sequence
  chemically treated genomic DNA (Homo sapiens) CpG-island No: 11978
  misc_feature (368)..(368): n is either a, c, g or t
tatataacgaaaccgaattctaatttacgttaattaaaatactaacaatcatcgatataatcgactttaacctataactactattttctaatcacgacgacgaaaaaaccaatatcgacaacctctaacgctacgataatttcttcgccaccgactaaaataaactaattttatccgctaacgataattatattctccttcgacgatctaaaactaattaaaattactaccgctaaaacgcgcgatccgaaaaaaaacatcccaaaaacgatactccaaataatatatcgcatcctactattttacatcgataatcgaaccaaacaccatcgcataaacaaaaataataccaaaactcacgccgatanacgccatcgctttaatacgattttattcgcgcgtaaaatcgaaaaacaacgccataacgacgacgacaattactccaaaaccttataacgcccgacccaaaataattccccaaataaaatcgaaaaacgcaacgataacgctaccgacgacaaacaccgccaa

SEQ ID NO: 11979 - DNA, 531 bp, Artificial Sequence
  chemically treated genomic DNA (Homo sapiens) CpG-island No: 11979
  misc_feature (368)..(368): n is either a, c, g or t
tatatggcgaaatcgagttttggtttgcgttgattaaagtgttggtaattatcggtatgatcggttttggtttgtggttgttgttttttggttacggcggcgagaaagttagtatcgataatttttggcgttacggtggttttttcgttatcggttggaatgggttgattttgttcgttggcggtaattatgttttttttcggcggtttggagttgattgggattattgtcgttgaagcgcgcgattcggaaaaaagtattttaaaagcggtattttaggtggtgtatcgtattttgttgttttatatcggtgatcgggttaagtattatcgtatgggtaaaggtaatgttaaagtttacgtcgatanacgttatcgttttggtgcggttttgttcgcgcgtgagatcggaaagtagcgttataacggcggcggtaattgttttagagttttgtagcgttcggtttagaataattttttagatggagtcggaaagcgtagcgataacgttatcggcggtaaatatcgttag

SEQ ID NO: 11980 - DNA, 531 bp, Artificial Sequence
  chemically treated genomic DNA (Homo sapiens) CpG-island No: 11980
  misc_feature (164)..(164): n is either a, c, g or t
ctaacgatatttaccgccgataacgttatcgctacgctttccgactccatctaaaaaattattctaaaccgaacgctacaaaactctaaaacaattaccgccgccgttataacgctactttccgatctcacgcgcgaacaaaaccgcaccaaaacgataacgtntatcgacgtaaactttaacattacctttacccatacgataatacttaacccgatcaccgatataaaacaacaaaatacgatacaccacctaaaataccgcttttaaaatacttttttccgaatcgcgcgcttcaacgacaataatcccaatcaactccaaaccgccgaaaaaaaacataattaccgccaacgaacaaaatcaacccattccaaccgataacgaaaaaaccaccgtaacgccaaaaattatcgatactaactttctcgccgccgtaaccaaaaaacaacaaccacaaaccaaaaccgatcataccgataattaccaacactttaatcaacgcaaaccaaaactcgatttcgccatata

SEQ ID NO: 11981 - DNA, 960 bp, Artificial Sequence
  chemically treated genomic DNA (Homo sapiens) CpG-island No: 11981
cgtgcgtttttgatgatgcgggtggcgttgtgttcgttttagttattgtcgcgcgtgtcggagtagagtagcgcggtgttaaaatcgttgttcgttgtgtcgtttattattaggttgtgcgtttttttcgggttgttttgtgaagaggttgggttgagttgattttttacgttcgtttcgatattaaagttttgcggaatggtacgggtaataaagtttattacgtcgtttacgttttgcggttcgtaacgtatcgtattattatcgcgtattacgttaatggtatttatgttgtcgagcgaaacgggagttagtgaaagttgcggttgatcgtaagggcgaaggggacggggatgtcgtttattaggacggtcgagcggttggcgaggcgcgggtttaggtttcggatgttaaagtttatcgttaggtcgtggttgtcggtgtcgttgtttttcggcgcgttgacgttagggatgcggttaagtattttacgtatggtggttgcgtcggttttggcgaaatttttacggcggattacgttacgcgcgttagtatgtttaaatacgtcgtttttacgcgtattatttagttagtcgtcgattacggttagggtatttttttttggtgcgggcgcgggttttagcgtttagttgttattttttagcggttttatttgtagttcgttgtcgtttagtagttgttgtaggtcgttttcgacgtcgtaatcgtcgtgtaggtcgttgttttgtttgtcgcgcgttaggttggcgttaatcgagagggtaaattcgttgtgtgcggtatattgattgagcgttttatcgagcgatttcggtgcgatattaatttgtgtagtaaaagcggaaaacgagagatcggttagcggtagtaggtttagatagatatatttttacggtaagagttgaaagatgtaggatttttatttgaattaggttgtgt

SEQ ID NO: 11982 - DNA, 960 bp, Artificial Sequence
  chemically treated genomic DNA (Homo sapiens) CpG-island No: 11982
acacaacctaattcaaataaaaatcctacatctttcaactcttaccgtaaaaatatatctatctaaacctactaccgctaaccgatctctcgttttccgcttttactacacaaattaatatcgcaccgaaatcgctcgataaaacgctcaatcaatataccgcacacaacgaatttaccctctcgattaacgccaacctaacgcgcgacaaacaaaacaacgacctacacgacgattacgacgtcgaaaacgacctacaacaactactaaacgacaacgaactacaaataaaaccgctaaaaaataacaactaaacgctaaaacccgcgcccgcaccaaaaaaaaataccctaaccgtaatcgacgactaactaaataatacgcgtaaaaacgacgtatttaaacatactaacgcgcgtaacgtaatccgccgtaaaaatttcgccaaaaccgacgcaaccaccatacgtaaaatacttaaccgcatccctaacgtcaacgcgccgaaaaacaacgacaccgacaaccacgacctaacgataaactttaacatccgaaacctaaacccgcgcctcgccaaccgctcgaccgtcctaataaacgacatccccgtccccttcgcccttacgatcaaccgcaactttcactaactcccgtttcgctcgacaacataaataccattaacgtaatacgcgataataatacgatacgttacgaaccgcaaaacgtaaacgacgtaataaactttattacccgtaccattccgcaaaactttaatatcgaaacgaacgtaaaaaatcaactcaacccaacctcttcacaaaacaacccgaaaaaaacgcacaacctaataataaacgacacaacgaacaacgattttaacaccgcgctactctactccgacacgcgcgacaataactaaaacgaacacaacgccacccgcatcatcaaaaacgcacg

SEQ ID NO: 11983 - DNA, 960 bp, Artificial Sequence
  chemically treated genomic DNA (Homo sapiens) CpG-island No: 11983
gtatagtttagtttaagtagaaattttgtattttttagtttttatcgtagagatatgtttgtttgagtttgttgtcgttggtcggtttttcgtttttcgtttttgttgtataggttaatatcgtatcgggatcgttcgataaagcgtttaattagtatgtcgtatatagcggatttattttttcggttgacgttagtttgacgcgcggtaagtagagtaacggtttgtacggcgattacgacgtcgagagcggtttgtaataattgttggacggtagcggattgtaggtaaaatcgttgggaaataatagttggacgttggagttcgcgttcgtattaaaagaagatgttttgatcgtggtcggcgattggttgggtgatgcgcgtgaaaacgacgtatttgaatatgttggcgcgcgtgacgtgattcgtcgtgaggatttcgttaaaatcggcgtaattattatgcgtgaggtatttaatcgtatttttggcgttagcgcgtcggaaaataacggtatcggtagttacgatttggcgatgaattttggtattcggggtttgaattcgcgtttcgttagtcgttcgatcgttttgatggacggtattttcgtttttttcgtttttacggttagtcgtagtttttattggttttcgtttcgttcggtaatatggatgttattgacgtggtacgcggtggtggtgcggtgcgttacggatcgtagagcgtgggcggcgtggtgaattttgttattcgtgttatttcgtaggattttggtatcgaggcgggcgtggaaggttagtttagtttaatttttttataaaataattcgaaagagacgtataatttgatggtgggcggtatagcggataacggttttggtatcgcgttgttttatttcggtacgcgcggtagtgattggagcgagtatagcgttattcgtattattagggacgtacg

SEQ ID NO: 11984 - DNA, 960 bp, Artificial Sequence
  chemically treated genomic DNA (Homo sapiens) CpG-island No: 11984
cgtacgtccctaataatacgaataacgctatactcgctccaatcactaccgcgcgtaccgaaataaaacaacgcgataccaaaaccgttatccgctataccgcccaccatcaaattatacgtctctttcgaattattttataaaaaaattaaactaaactaaccttccacgcccgcctcgataccaaaatcctacgaaataacacgaataacaaaattcaccacgccgcccacgctctacgatccgtaacgcaccgcaccaccaccgcgtaccacgtcaataacatccatattaccgaacgaaacgaaaaccaataaaaactacgactaaccgtaaaaacgaaaaaaacgaaaataccgtccatcaaaacgatcgaacgactaacgaaacgcgaattcaaaccccgaataccaaaattcatcgccaaatcgtaactaccgataccgttattttccgacgcgctaacgccaaaaatacgattaaatacctcacgcataataattacgccgattttaacgaaatcctcacgacgaatcacgtcacgcgcgccaacatattcaaatacgtcgttttcacgcgcatcacccaaccaatcgccgaccacgatcaaaacatcttcttttaatacgaacgcgaactccaacgtccaactattatttcccaacgattttacctacaatccgctaccgtccaacaattattacaaaccgctctcgacgtcgtaatcgccgtacaaaccgttactctacttaccgcgcgtcaaactaacgtcaaccgaaaaaataaatccgctatatacgacatactaattaaacgctttatcgaacgatcccgatacgatattaacctatacaacaaaaacgaaaaacgaaaaaccgaccaacgacaacaaactcaaacaaacatatctctacgataaaaactaaaaaatacaaaatttctacttaaactaaactatac

SEQ ID NO: 11985 - DNA, 513 bp, Artificial Sequence
  chemically treated genomic DNA (Homo sapiens) CpG-island No: 11985
  misc_feature (40)..(40): n is either a, c, g or t
  misc_feature (303)..(303): n is either a, c, g or t
  misc_feature (473)..(474): n is either a, c, g or t
  misc_feature (486)..(486): n is either a, c, g or t
cggtcgggggggcggtttcgtcgtcgtttcggtcgtcggncggttcgcgtcggcgggcgcgtagcgcggcggcggcgggcgcgcggggggcgggttttcggcgcgggcgggcggttcgcgcgggtttcgtcggcgtttcggcgcggcggtcgggcgcgtcgggcggcggtttttttcgcgacgcggcgcgcgtcggcggcgcgcgcggcgcggttcgtttcgcgggcggcgcgtcgttcgggtttcgagtcgggttcggcggggcgcgtcgtcggcgagcgcggggggcggggggggcggggngcggtcgtcggggcggcgggcgcggcggggcggggcgggcgttcgcggttcgggcggggcgcgggggggggaggtttacgttattaaaagggcgcgttcggtcgagggggggcggcgggggcgggcgcgggggggtcgcggttttttttttttcgcgggtcggggggggnnaacggggcgaanaaagagttttttttttttaggaggggg

SEQ ID NO: 11986 - DNA, 513 bp, Artificial Sequence
  chemically treated genomic DNA (Homo sapiens) CpG-island No: 11986
  misc_feature (28)..(28): n is either a, c, g or t
  misc_feature (40)..(41): n is either a, c, g or t
  misc_feature (211)..(211): n is either a, c, g or t
  misc_feature (474)..(474): n is either a, c, g or t
ccccctcctaaaaaaaaaaaactctttnttcgccccgttnnccccccccgacccgcgaaaaaaaaaaaaccgcgacccccccgcgcccgcccccgccgccccccctcgaccgaacgcgcccttttaataacgtaaacctcccccccccgcgccccgcccgaaccgcgaacgcccgccccgccccgccgcgcccgccgccccgacgaccgcnccccgccccccccgccccccgcgctcgccgacgacgcgccccgccgaacccgactcgaaacccgaacgacgcgccgcccgcgaaacgaaccgcgccgcgcgcgccgccgacgcgcgccgcgtcgcgaaaaaaaccgccgcccgacgcgcccgaccgccgcgccgaaacgccgacgaaacccgcgcgaaccgcccgcccgcgccgaaaacccgccccccgcgcgcccgccgccgccgcgctacgcgcccgccgacgcgaaccgnccgacgaccgaaacgacgacgaaaccgcccccccgaccg

SEQ ID NO: 11987 - DNA, 513 bp, Artificial Sequence
  chemically treated genomic DNA (Homo sapiens) CpG-island No: 11987
  misc_feature (28)..(28): n is either a, c, g or t
  misc_feature (40)..(41): n is either a, c, g or t
  misc_feature (211)..(211): n is either a, c, g or t
  misc_feature (474)..(474): n is either a, c, g or t
tttttttttggggggggggggttttttnttcgtttcgttnntttttttcggttcgcgggggggggggggtcgcggttttttcgcgttcgttttcgtcgttttttttcggtcgggcgcgtttttttggtggcgtgggtttttttttttcgcgtttcgttcgggtcgcgggcgttcgtttcgtttcgtcgcgttcgtcgtttcggcggtcgtntttcgtttttttcgtttttcgcgttcgtcggcggcgcgtttcgtcgggttcggttcggggttcgggcggcgcgtcgttcgcggggcgggtcgcgtcgcgcgcgtcgtcggcgcgcgtcgcgtcgcggggggggtcgtcgttcggcgcgttcggtcgtcgcgtcggggcgtcggcggggttcgcgcgggtcgttcgttcgcgtcgggggttcgtttttcgcgcgttcgtcgtcgtcgcgttgcgcgttcgtcggcgcgggtcgntcggcggtcggggcggcggcggggtcgttttttcggtcg

SEQ ID NO: 11988 - DNA, 513 bp, Artificial Sequence
  chemically treated genomic DNA (Homo sapiens) CpG-island No: 11988
  misc_feature (40)..(40): n is either a, c, g or t
  misc_feature (303)..(303): n is either a, c, g or t
  misc_feature (473)..(474): n is either a, c, g or t
  misc_feature (486)..(486): n is either a, c, g or t
cgaccgaaaaaacgaccccgccgccgccccgaccgccgancgacccgcgccgacgaacgcgcaacgcgacgacgacgaacgcgcgaaaaacgaacccccgacgcgaacgaacgacccgcgcgaaccccgccgacgccccgacgcgacgaccgaacgcgccgaacgacgaccccccccgcgacgcgacgcgcgccgacgacgcgcgcgacgcgacccgccccgcgaacgacgcgccgcccgaaccccgaaccgaacccgacgaaacgcgccgccgacgaacgcgaaaaacgaaaaaaacgaaanacgaccgccgaaacgacgaacgcgacgaaacgaaacgaacgcccgcgacccgaacgaaacgcgaaaaaaaaaaacccacgccaccaaaaaaacgcgcccgaccgaaaaaaaacgacgaaaacgaacgcgaaaaaaccgcgacccccccccccccgcgaaccgaaaaaaannaacgaaacgaanaaaaaaccccccccccccaaaaaaaaa

SEQ ID NO: 11989 - DNA, 665 bp, Artificial Sequence
  chemically treated genomic DNA (Homo sapiens) CpG-island No: 11989
aagttcggaggagcggcggaggagaacgcggttgggaggtcggcggttagggtttcgaagcggtcggtttcgggttgcggtaggagtacgacggcggcggtttgggtttggcgtcggtttttttttttatcgttcgcgcgttaatttattagttcgttaattcgttttttttacgttcgtttttttcggtttagcgattttttagtttagttttttgtagattgcggttgttaagtgtcggggagtcgagttttattcgcgagcggtagttaatcgtcgcgttttttcgaggcgttttaggatttcgtcgtcgggggcggttaggtaggtgtttgagtcgaaggcgagtcggcggggcggggcggggcggggaggggcggggaggggcgggtttaaagttggggcggggaggggcggggcggatttaaagtttgggcggggcggattaaaatttgggcggggcgggcgggggtcgggtttggagggatcggttaggggttcgggggagtagtagaacgggtgcggtaatagcgtgagattggtggtagggacgtagatttttagttggtcggtgaattttatgttttaaaatagtacgaataggattgtcgtttgtaaatggagaagtttgcgtattaggattgattttttatattttttttcga

SEQ ID NO: 11990 - DNA, 665 bp, Artificial Sequence
  chemically treated genomic DNA (Homo sapiens) CpG-island No: 11990
tcgaaaaaaaatataaaaaatcaatcctaatacgcaaacttctccatttacaaacgacaatcctattcgtactattttaaaacataaaattcaccgaccaactaaaaatctacgtccctaccaccaatctcacgctattaccgcacccgttctactactcccccgaacccctaaccgatccctccaaacccgacccccgcccgccccgcccaaattttaatccgccccgcccaaactttaaatccgccccgcccctccccgccccaactttaaacccgcccctccccgcccctccccgccccgccccgccccgccgactcgccttcgactcaaacacctacctaaccgcccccgacgacgaaatcctaaaacgcctcgaaaaaacgcgacgattaactaccgctcgcgaataaaactcgactccccgacacttaacaaccgcaatctacaaaaaactaaactaaaaaatcgctaaaccgaaaaaaacgaacgtaaaaaaaacgaattaacgaactaataaattaacgcgcgaacgataaaaaaaaaaaccgacgccaaacccaaaccgccgccgtcgtactcctaccgcaacccgaaaccgaccgcttcgaaaccctaaccgccgacctcccaaccgcgttctcctccgccgctcctccgaactt

SEQ ID NO: 11991 - DNA, 665 bp, Artificial Sequence
  chemically treated genomic DNA (Homo sapiens) CpG-island No: 11991
tcggggaggagtatgaagagttaattttaatgcgtaggtttttttatttgtaggcgataattttgttcgtgttattttgggatatggggtttatcggttagttaagggtttacgtttttgttattagttttacgttattgtcgtattcgttttgttattttttcgggtttttagtcggtttttttaagttcgattttcgttcgtttcgtttaggttttggttcgtttcgtttaggttttgggttcgtttcgttttttttcgttttagttttgggttcgttttttttcgttttttttcgtttcgtttcgtttcgtcgattcgttttcggtttaggtatttgtttggtcgttttcggcggcggggttttgaggcgtttcggggaagcgcggcgattggttgtcgttcgcgggtagagttcggtttttcggtatttgataatcgtagtttgtaagaggttgagttgaggagtcgttgggtcgggaggggcggacgtgagaaggacggattgacgaattgatggattgacgcgcgggcggtaggagggaggatcgacgttaaatttagatcgtcgtcgtcgtgtttttgtcgtagttcggagtcggtcgtttcggggttttggtcgtcggttttttagtcgcgttttttttcgtcgttttttcgggttt

SEQ ID NO: 11992 - DNA, 665 bp, Artificial Sequence
  chemically treated genomic DNA (Homo sapiens) CpG-island No: 11992
aaacccgaaaaaacgacgaaaaaaaacgcgactaaaaaaccgacgaccaaaaccccgaaacgaccgactccgaactacgacaaaaacacgacgacgacgatctaaatttaacgtcgatcctccctcctaccgcccgcgcgtcaatccatcaattcgtcaatccgtccttctcacgtccgcccctcccgacccaacgactcctcaactcaacctcttacaaactacgattatcaaataccgaaaaaccgaactctacccgcgaacgacaaccaatcgccgcgcttccccgaaacgcctcaaaaccccgccgccgaaaacgaccaaacaaatacctaaaccgaaaacgaatcgacgaaacgaaacgaaacgaaaaaaaacgaaaaaaaacgaacccaaaactaaaacgaaaaaaaacgaaacgaacccaaaacctaaacgaaacgaaccaaaacctaaacgaaacgaacgaaaatcgaacttaaaaaaaccgactaaaaacccgaaaaaataacaaaacgaatacgacaataacgtaaaactaataacaaaaacgtaaacccttaactaaccgataaaccccatatcccaaaataacacgaacaaaattatcgcctacaaataaaaaaacctacgcattaaaattaactcttcatactcctccccga

SEQ ID NO: 11993 - DNA, 746 bp, Artificial Sequence
  chemically treated genomic DNA (Homo sapiens) CpG-island No: 11993
cgtattttgaggaatatttttttttttaggattcgttcgtttgtgttcggtggttttttttagaattttttaaggcgcgggagggggcggagagtttaaaagtcgcgggggggagcggattttcgttgttttagggagggagagcggtttgggttttggatgttgtgtgcggagttgtggcgtcgcgtgtgaggcgcgtgtagggtgagtgtgagtggacgcgtgagtgtgtgagtgtgcgcgtttggagcgtgttaggcgagtgcgtgcgtttatttttgcgttttttttttcgtttatattttgattttatttgatcggatcgtgattttagtttcgtcgggtcgattcgaaatgaaaagttttttttttgcgaagttttttcggggcgttgtgtagcgaggttttttaggcggcggttacgttgtggttttcgaggtttcggagttggttttgcggggttcggcgtttagaagtgatgaattgattagatagacgaggtcgggtttgttttcggttattgattatcgaggcgattttgatttgggtacggttatcgggttgcgggttgtcggtggcgtaggggcgagtacgtgaacggcggcggcgggcgaggatgttgagcgcggtggttaagggtaaatgagtcgttgtttttttttttggagttggaaggtcgcggaggtttttttcgtcgttgatatattttttttttatttttttatttttttttgtttttttttttt

SEQ ID NO: 11994 - DNA, 746 bp, Artificial Sequence
  chemically treated genomic DNA (Homo sapiens) CpG-island No: 11994
aaaaaaaaaaaacaaaaaaaaataaaaaaataaaaaaaaaatatatcaacgacgaaaaaaacctccgcgaccttccaactccaaaaaaaaaaacaacgactcatttacccttaaccaccgcgctcaacatcctcgcccgccgccgccgttcacgtactcgcccctacgccaccgacaacccgcaacccgataaccgtacccaaatcaaaatcgcctcgataatcaataaccgaaaacaaacccgacctcgtctatctaatcaattcatcacttctaaacgccgaaccccgcaaaaccaactccgaaacctcgaaaaccacaacgtaaccgccgcctaaaaaacctcgctacacaacgccccgaaaaaacttcgcaaaaaaaaaacttttcatttcgaatcgacccgacgaaactaaaatcacgatccgatcaaataaaatcaaaatataaacgaaaaaaaaaacgcaaaaataaacgcacgcactcgcctaacacgctccaaacgcgcacactcacacactcacgcgtccactcacactcaccctacacgcgcctcacacgcgacgccacaactccgcacacaacatccaaaacccaaaccgctctccctccctaaaacaacgaaaatccgctcccccccgcgacttttaaactctccgccccctcccgcgccttaaaaaattctaaaaaaaaccaccgaacacaaacgaacgaatcctaaaaaaaaaaatattcctcaaaatacg

SEQ ID NO: 11995 - DNA, 746 bp, Artificial Sequence
  chemically treated genomic DNA (Homo sapiens) CpG-island No: 11995
aaaaaagaaaaataaggagaaatgggaaagtgggaggaaagtatattagcggcgaaaaaggttttcgcgattttttagttttagggggaggggtagcggtttatttatttttggttatcgcgtttagtattttcgttcgtcgtcgtcgtttacgtgttcgtttttacgttatcggtagttcgtagttcggtggtcgtgtttagattagaatcgtttcgataattagtggtcggggataagttcggtttcgtttatttgattaatttattatttttgagcgtcgggtttcgtagggttagtttcgggatttcggggattatagcgtggtcgtcgtttaaggggtttcgttgtatagcgtttcgagggggtttcgtaggaggagagttttttatttcgggtcggttcggcggggttggggttacgattcgattaaataagattaaagtgtaagcgggaggaggggcgtaggggtgggcgtacgtattcgtttaatacgttttaagcgcgtatatttatatatttacgcgtttatttatatttattttgtacgcgttttatacgcgacgttatagtttcgtatataatatttaggatttaggtcgttttttttttttaaaatagcggaagttcgttttttttcgcgatttttaagtttttcgttttttttcgcgttttggaggattttgggagaaattatcgagtataggcggacgagttttgaggaagggggtgttttttagagtgcg

SEQ ID NO: 11996 - DNA, 746 bp, Artificial Sequence
  chemically treated genomic DNA (Homo sapiens) CpG-island No: 11996
cgcactctaaaaaacacccccttcctcaaaactcgtccgcctatactcgataatttctcccaaaatcctccaaaacgcgaaaaaaaacgaaaaacttaaaaatcgcgaaaaaaaacgaacttccgctattttaaaaaaaaaaaacgacctaaatcctaaatattatatacgaaactataacgtcgcgtataaaacgcgtacaaaataaatataaataaacgcgtaaatatataaatatacgcgcttaaaacgtattaaacgaatacgtacgcccacccctacgcccctcctcccgcttacactttaatcttatttaatcgaatcgtaaccccaaccccgccgaaccgacccgaaataaaaaactctcctcctacgaaaccccctcgaaacgctatacaacgaaaccccttaaacgacgaccacgctataatccccgaaatcccgaaactaaccctacgaaacccgacgctcaaaaataataaattaatcaaataaacgaaaccgaacttatccccgaccactaattatcgaaacgattctaatctaaacacgaccaccgaactacgaactaccgataacgtaaaaacgaacacgtaaacgacgacgacgaacgaaaatactaaacgcgataaccaaaaataaataaaccgctacccctccccctaaaactaaaaaatcgcgaaaacctttttcgccgctaatatactttcctcccactttcccatttctccttatttttctttttt

SEQ ID NO: 11997 - DNA, 654 bp, Artificial Sequence
  chemically treated genomic DNA (Homo sapiens) CpG-island No: 11997
aagggtcggtcgggtcgttcgggaggaggggcggtcgcgggtttataggttttaagtgtcgtttcgagggttcgggttcgggttcgttcgttttttgggttcgtttttttttagttttttcggatatagttaattcggggcgtcgcgttttcgtttcgtcgttcgtatagcggttcgtatttgtattatgatggttattcggagcgagtttttggggatgttttcgttgtattttttgtaagaggcgcgttcgtttttggcgtattcgattcgatagagtttattcgaagatttcgttatttttttttagttgtcgttaaagtttcggaagttcgacgttacgatttagaaatacgttgtcgtttcgtcgtttcgcgtgcgtttatttagtcgtaggcgtttgagcggttagagtcgttatcgaatacgtcgtatcggttatcgtcgttttttgatagattgttgatgtttggtcgcgggaacgtttacggaattcgcgtttacggggcggggtcggcggcgcgcgcgttttttgtcggtcggggggcggagtttttcgggcgtttgtcgggtggagttttgcgggtcgttgttttgggggtcgaggcggggtttgggttgagttagtagttttttggaggattcggcgttatt

SEQ ID NO: 11998 - DNA, 654 bp, Artificial Sequence
  chemically treated genomic DNA (Homo sapiens) CpG-island No: 11998
aataacgccgaatcctccaaaaaactactaactcaacccaaaccccgcctcgacccccaaaacaacgacccgcaaaactccacccgacaaacgcccgaaaaactccgccccccgaccgacaaaaaacgcgcgcgccgccgaccccgccccgtaaacgcgaattccgtaaacgttcccgcgaccaaacatcaacaatctatcaaaaaacgacgataaccgatacgacgtattcgataacgactctaaccgctcaaacgcctacgactaaataaacgcacgcgaaacgacgaaacgacaacgtatttctaaatcgtaacgtcgaacttccgaaactttaacgacaactaaaaaaaaataacgaaatcttcgaataaactctatcgaatcgaatacgccaaaaacgaacgcgcctcttacaaaaaatacaacgaaaacatccccaaaaactcgctccgaataaccatcataatacaaatacgaaccgctatacgaacgacgaaacgaaaacgcgacgccccgaattaactatatccgaaaaaactaaaaaaaaacgaacccaaaaaacgaacgaacccgaacccgaaccctcgaaacgacacttaaaacctataaacccgcgaccgcccctcctcccgaacgacccgaccgaccctt

SEQ ID NO: 11999 - DNA, 654 bp, Artificial Sequence
  chemically treated genomic DNA (Homo sapiens) CpG-island No: 11999
ggtggcgtcgggttttttaaagagttattagtttagtttaagtttcgtttcggtttttagggtagcggttcgtagagttttattcggtaggcgttcgggaaatttcgtttttcggtcggtagggggcgcgcgcgtcgtcggtttcgtttcgtggacgcgggtttcgtgggcgttttcgcggttaggtattagtaatttattagggaacggcggtggtcggtgcggcgtgttcggtggcggttttggtcgtttaggcgtttgcggttgggtgagcgtacgcgaggcggcgaggcggtagcgtgtttttaggtcgtggcgtcgggttttcggagttttggcggtagttaggggaggatggcggagttttcggataagttttatcgagtcgagtacgttaagagcgggcgcgttttttgtaagaaatgtagcgagagtatttttaaggattcgtttcggatggttattatggtgtaggtgcgggtcgttgtgcgggcggcggggcggggacgcggcgtttcgggttaattgtgttcgggaaggttgggggagggcgggtttagggagcgagcgggttcgggttcgggttttcggagcggtatttggggtttatgggttcgcggtcgttttttttttcgagcggttcggtcgattttt

SEQ ID NO: 12000 - DNA, 654 bp, Artificial Sequence
  chemically treated genomic DNA (Homo sapiens) CpG-island No: 12000
aaaaatcgaccgaaccgctcgaaaaaaaaaacgaccgcgaacccataaaccccaaataccgctccgaaaacccgaacccgaacccgctcgctccctaaacccgccctcccccaaccttcccgaacacaattaacccgaaacgccgcgtccccgccccgccgcccgcacaacgacccgcacctacaccataataaccatccgaaacgaatccttaaaaatactctcgctacatttcttacaaaaaacgcgcccgctcttaacgtactcgactcgataaaacttatccgaaaactccgccatcctcccctaactaccgccaaaactccgaaaacccgacgccacgacctaaaaacacgctaccgcctcgccgcctcgcgtacgctcacccaaccgcaaacgcctaaacgaccaaaaccgccaccgaacacgccgcaccgaccaccgccgttccctaataaattactaatacctaaccgcgaaaacgcccacgaaacccgcgtccacgaaacgaaaccgacgacgcgcgcgccccctaccgaccgaaaaacgaaatttcccgaacgcctaccgaataaaactctacgaaccgctaccctaaaaaccgaaacgaaacttaaactaaactaataactctttaaaaaacccgacgccacc

SEQ ID NO: 12001 - DNA, 634 bp, Artificial Sequence
  chemically treated genomic DNA (Homo sapiens) CpG-island No: 12001
cgtaggcgcggtacgcggtttttgttttggtttgggtttcgcggtagtcgcgttttcgtttcggcgcgggcggtagcgttcgggttggttgcggcgggcgtattcgtttagtatttttgagtcggtttggtcgtcgtcgcgggttcgacggcgggtttagtttgggtcgcgggcgcggtagcgagggtaattcgggttcgtcgcgtcggcggcgcgttgggcgtagtttcggtaaagcgagtggtcgtacggtagggtcgttgttttttcggggggttttaggtattcggcgtagttcgattttttcggtcgcggcggtagcggcggttgtagtaacggcggcgataatattaatagcgaaggtttagaagtcgggtttggggttttagttttagttgtcgtcgtttcgttatagcggtttcgtcggtttcgtcgatttagagcggttgttgtcgtcgcggaagaggttcgagtattcggatttgtagtcgttattttgtttttcgtttgaagggagagtcggttgcgagggagaagagtggagggcggggtagtacgcgcggtgggtagtgttatttatatatttatgaggggcgaggtttttgtgagtttaaagagggttttttttagattt

SEQ ID NO: 12002 - DNA, 634 bp, Artificial Sequence
  chemically treated genomic DNA (Homo sapiens) CpG-island No: 12002
aaatctaaaaaaaaccctctttaaactcacaaaaacctcgcccctcataaatatataaataacactacccaccgcgcgtactaccccgccctccactcttctccctcgcaaccgactctcccttcaaacgaaaaacaaaataacgactacaaatccgaatactcgaacctcttccgcgacgacaacaaccgctctaaatcgacgaaaccgacgaaaccgctataacgaaacgacgacaactaaaactaaaaccccaaacccgacttctaaaccttcgctattaatattatcgccgccgttactacaaccgccgctaccgccgcgaccgaaaaaatcgaactacgccgaatacctaaaaccccccgaaaaaacaacgaccctaccgtacgaccactcgctttaccgaaactacgcccaacgcgccgccgacgcgacgaacccgaattaccctcgctaccgcgcccgcgacccaaactaaacccgccgtcgaacccgcgacgacgaccaaaccgactcaaaaatactaaacgaatacgcccgccgcaaccaacccgaacgctaccgcccgcgccgaaacgaaaacgcgactaccgcgaaacccaaaccaaaacaaaaaccgcgtaccgcgcctacg

SEQ ID NO: 12003 - DNA, 634 bp, Artificial Sequence
  chemically treated genomic DNA (Homo sapiens) CpG-island No: 12003
aggtttgaggagaattttttttgggtttatagaagtttcgttttttatgaatatgtagatagtattgtttatcgcgcgtattgtttcgttttttatttttttttttcgtaatcgattttttttttaaacgggaaataagatggcggttgtaggttcgagtattcgggtttttttcgcggcggtagtagtcgttttgagtcggcggggtcggcggggtcgttgtgacgagacggcggtagttaagattggggttttaggttcggtttttggattttcgttgttggtgttgtcgtcgtcgttgttgtagtcgtcgttgtcgtcgcggtcggaggaatcgggttgcgtcgggtgtttggagtttttcggagaagtagcggttttgtcgtgcggttattcgttttgtcgaggttgcgtttaacgcgtcgtcgacgcggcgggttcgggttgttttcgttgtcgcgttcgcggtttaggttgggttcgtcgtcgggttcgcgacgacggttaggtcgatttagaggtgttgggcgagtgcgttcgtcgtagttaattcgagcgttgtcgttcgcgtcgggacgggggcgcggttgtcgcggggtttaggttagagtaggagtcgcgtgtcgcgtttgcg

SEQ ID NO: 12004 - DNA, 634 bp, Artificial Sequence
  chemically treated genomic DNA (Homo sapiens) CpG-island No: 12004
cgcaaacgcgacacgcgactcctactctaacctaaaccccgcgacaaccgcgcccccgtcccgacgcgaacgacaacgctcgaattaactacgacgaacgcactcgcccaacacctctaaatcgacctaaccgtcgtcgcgaacccgacgacgaacccaacctaaaccgcgaacgcgacaacgaaaacaacccgaacccgccgcgtcgacgacgcgttaaacgcaacctcgacaaaacgaataaccgcacgacaaaaccgctacttctccgaaaaactccaaacacccgacgcaacccgattcctccgaccgcgacgacaacgacgactacaacaacgacgacgacaacaccaacaacgaaaatccaaaaaccgaacctaaaaccccaatcttaactaccgccgtctcgtcacaacgaccccgccgaccccgccgactcaaaacgactactaccgccgcgaaaaaaacccgaatactcgaacctacaaccgccatcttatttcccgtttaaaaaaaaaatcgattacgaaaaaaaaaaataaaaaacgaaacaatacgcgcgataaacaatactatctacatattcataaaaaacgaaacttctataaacccaaaaaaaattctcctcaaacct

SEQ ID NO: 12005 - DNA, 511 bp, Artificial Sequence
  chemically treated genomic DNA (Homo sapiens) CpG-island No: 12005
ttttttttcgtagttttttcgtttttattcggcgtcgcgtttggagcgttcgtttcggagattcgtataagagaggaggggaaaaagtgggtttgtttttcgggtggttaatttatcgagttcgcggtgttttagaggaggcgttagcgttaggttagcgttaggtcgggttgtttgtttttcgcggtaaagtataaatgcgttcgagcgcggcgtttgaagtttttggcgagtatagtcggttcgcgtttagttttttttcgcggtcgtcgcgtcgtcgtcgttgttgggatcgtcgtttcgtcgggttttaggttttcgcgggtcgatttcgagtttatcgagtagggggcgttcggtcgtttttatttcgcgcgttcgtaatattcgttggtgtcgcgcgtttcgttcggcgttgtgcgttcgggagatatcgggtttttttttgtttttttttttttttttttttattttttttttttttttgatcgttttttttttttggtggatt

SEQ ID NO: 12006 - DNA, 511 bp, Artificial Sequence
  chemically treated genomic DNA (Homo sapiens) CpG-island No: 12006
aatccaccaaaaaaaaaaaacgatcaaaaaaaaaaaaaaaataaaaaaaaaaaaaaaaaaaaacaaaaaaaaacccgatatctcccgaacgcacaacgccgaacgaaacgcgcgacaccaacgaatattacgaacgcgcgaaataaaaacgaccgaacgccccctactcgataaactcgaaatcgacccgcgaaaacctaaaacccgacgaaacgacgatcccaacaacgacgacgacgcgacgaccgcgaaaaaaaactaaacgcgaaccgactatactcgccaaaaacttcaaacgccgcgctcgaacgcatttatactttaccgcgaaaaacaaacaacccgacctaacgctaacctaacgctaacgcctcctctaaaacaccgcgaactcgataaattaaccacccgaaaaacaaacccactttttcccctcctctcttatacgaatctccgaaacgaacgctccaaacgcgacgccgaataaaaacgaaaaaactacgaaaaaaaa

SEQ ID NO: 12007 - DNA, 511 bp, Artificial Sequence
  chemically treated genomic DNA (Homo sapiens) CpG-island No: 12007
ggtttattagaagggagaggcgattaaaaaaagggggaaggtgagaggaagaggaggaaaaagtagggagaggttcggtgtttttcgagcgtatagcgtcgggcgaggcgcgcggtattagcgggtgttgcgggcgcgcgggatagaggcggtcgggcgttttttgttcggtgggttcggggtcggttcgcgggggtttggggttcggcggggcggcggttttagtagcggcggcggcgcggcggtcgcggagggaggttgagcgcgggtcggttgtgttcgttaagggttttaggcgtcgcgttcgggcgtatttgtattttgtcgcgggaagtaggtagttcggtttggcgttggtttagcgttggcgttttttttggggtatcgcgggttcggtggattggttattcgagaaataggtttatttttttttttttttttttgtgcgggttttcgggacggacgttttaggcgcggcgtcgagtggaggcgagggggttgcggaggggga

SEQ ID NO: 12008 - DNA, 511 bp, Artificial Sequence
  chemically treated genomic DNA (Homo sapiens) CpG-island No: 12008
tccccctccgcaaccccctcgcctccactcgacgccgcgcctaaaacgtccgtcccgaaaacccgcacaaaaaaaaaaaaaaaaaaataaacctatttctcgaataaccaatccaccgaacccgcgataccccaaaaaaaacgccaacgctaaaccaacgccaaaccgaactacctacttcccgcgacaaaatacaaatacgcccgaacgcgacgcctaaaacccttaacgaacacaaccgacccgcgctcaacctccctccgcgaccgccgcgccgccgccgctactaaaaccgccgccccgccgaaccccaaacccccgcgaaccgaccccgaacccaccgaacaaaaaacgcccgaccgcctctatcccgcgcgcccgcaacacccgctaataccgcgcgcctcgcccgacgctatacgctcgaaaaacaccgaacctctccctactttttcctcctcttcctctcaccttccccctttttttaatcgcctctcccttctaataaacc

SEQ ID NO: 12009 - DNA, 780 bp, Artificial Sequence
  chemically treated genomic DNA (Homo sapiens) CpG-island No: 12009
gttttcgcggttgcggcggttattgcggttggttgttgtttttttttcgcgttgttgttgttgttgttgttgtcgtcgtcgggtttcgggggtgacggttgttgtaatcgtttttgtttcgttttatatcgatattttgtttgttaattaaagggcgggggggagcgagggagcgtcggagagggatggagattaagcgagggatttgtaggggagcgggttggtggagaggcgtcgtgcgcgtagtcgttttagtcgggtttcggtttcggcgcgttagggattcgtcggaggaggcggaggaggagcgcgtagattcgcgtatttggtcggggggcgggatttttaggggttgcggagttcgcgtggtaaagtgaaattattatcgggagtgcgtgcgagcgagtaagcgagcgatcggcgggcgggggcgcggagatagcgcgcgtatcgggtttagtttgttttcgggggcggcgggggaggtcgggagtgtgttcgagtttggaggttgggcgagggggcggggagagggatttggtggcggggagcgggtgggggttattatttttgtatcgttttcgcgagatcgggtcggagtgttgtttagtaggtgcgtttcggttgggagtaggtgtgcgtttaattttaaaattttcggtgcgcgtcggagaggcgtcggcgtgaatttgggtatatttcgtttgtttttagttcgggggtggtgtgtgtgtgtgtgtgtgtttgttttttttgttcgtttgttttttgggtgtgtgt

SEQ ID NO: 12010 - DNA, 780 bp, Artificial Sequence
  chemically treated genomic DNA (Homo sapiens) CpG-island No: 12010
acacacacccaaaaaacaaacgaacaaaaaaaacaaacacacacacacacacacaccacccccgaactaaaaacaaacgaaatatacccaaattcacgccgacgcctctccgacgcgcaccgaaaattttaaaattaaacgcacacctactcccaaccgaaacgcacctactaaacaacactccgacccgatctcgcgaaaacgatacaaaaataataacccccacccgctccccgccaccaaatccctctccccgccccctcgcccaacctccaaactcgaacacactcccgacctcccccgccgcccccgaaaacaaactaaacccgatacgcgcgctatctccgcgcccccgcccgccgatcgctcgcttactcgctcgcacgcactcccgataataatttcactttaccacgcgaactccgcaacccctaaaaatcccgccccccgaccaaatacgcgaatctacgcgctcctcctccgcctcctccgacgaatccctaacgcgccgaaaccgaaacccgactaaaacgactacgcgcacgacgcctctccaccaacccgctcccctacaaatccctcgcttaatctccatccctctccgacgctccctcgctcccccccgccctttaattaacaaacaaaatatcgatataaaacgaaacaaaaacgattacaacaaccgtcacccccgaaacccgacgacgacaacaacaacaacaacaacaacgcgaaaaaaaaacaacaaccaaccgcaataaccgccgcaaccgcgaaaac

SEQ ID NO: 12011 - DNA, 780 bp, Artificial Sequence
  chemically treated genomic DNA (Homo sapiens) CpG-island No: 12011
atatatatttaaaggataaacgaataaaaaaggtaaatatatatatatatatatattattttcgagttaaagatagacgggatgtgtttaggtttacgtcgacgttttttcggcgcgtatcgagggttttaaagttgggcgtatatttgtttttagtcggagcgtatttgttgagtagtatttcggttcggtttcgcgagagcggtgtaggagtagtggtttttattcgtttttcgttattaaattttttttttcgttttttcgtttagtttttaggttcgggtatattttcggtttttttcgtcgttttcgggagtaggttgggttcgatgcgcgcgttgttttcgcgttttcgttcgtcgatcgttcgtttgttcgttcgtacgtattttcggtagtaattttattttgttacgcgagtttcgtagtttttagaaatttcgtttttcggttaggtgcgcgagtttgcgcgtttttttttcgtttttttcgacgggtttttggcgcgtcggggtcggggttcggttggggcggttgcgcgtacggcgtttttttattaattcgtttttttgtaggtttttcgtttggtttttattttttttcggcgttttttcgttttttttcgttttttgattgataggtaagatgtcggtgtggagcgaggtaggagcgattgtagtaatcgttattttcggagttcggcggcggtagtagtagtagtagtagtagcgcggggaggagatagtagttagtcgtagtagtcgtcgtagtcgcgggagt

SEQ ID NO: 12012 - DNA, 780 bp, Artificial Sequence
  chemically treated genomic DNA (Homo sapiens) CpG-island No: 12012
actcccgcgactacgacgactactacgactaactactatctcctccccgcgctactactactactactactaccgccgccgaactccgaaaataacgattactacaatcgctcctacctcgctccacaccgacatcttacctatcaatcaaaaaacgaaaaaaaacgaaaaaacgccgaaaaaaaataaaaaccaaacgaaaaacctacaaaaaaacgaattaataaaaaaacgccgtacgcgcaaccgccccaaccgaaccccgaccccgacgcgccaaaaacccgtcgaaaaaaacgaaaaaaaaacgcgcaaactcgcgcacctaaccgaaaaacgaaatttctaaaaactacgaaactcgcgtaacaaaataaaattactaccgaaaatacgtacgaacgaacaaacgaacgatcgacgaacgaaaacgcgaaaacaacgcgcgcatcgaacccaacctactcccgaaaacgacgaaaaaaaccgaaaatatacccgaacctaaaaactaaacgaaaaaacgaaaaaaaaaatttaataacgaaaaacgaataaaaaccactactcctacaccgctctcgcgaaaccgaaccgaaatactactcaacaaatacgctccgactaaaaacaaatatacgcccaactttaaaaccctcgatacgcgccgaaaaaacgtcgacgtaaacctaaacacatcccgtctatctttaactcgaaaataatatatatatatatatatatttaccttttttattcgtttatcctttaaatatatat

SEQ ID NO: 12013 - DNA, 778 bp, Artificial Sequence
  chemically treated genomic DNA (Homo sapiens) CpG-island No: 12013
gttcgttttcgggggcggttcgagttttagatatcggagatttttcgggatttcggggttggatcggttatagggttcgggttgcggggtcggttcgcgtttgtttggttttcgggttttttagttcgcgtcgggagtatttacgtatttgtgtacgagcgttcgtacgaggttgtagtttatggttttttcggtcgttttcgtttcgtcgtttagcgttttcgcgttcggttcggcgcgtttatgggtttcggggtattagtgcggtcgcgtttttcgtttcggttacggtttcggcgcgtcgggcggtgtagggggcggtcgcggttttttcgcgtttatgttcggttcggtcggcgaatgttgggttcgcggtttcgcgcgtcggtagttgttttattggcggtaaggttgttgttcggggtcgcgcgcgcgcgttttggcgtttttttttttttcgtcggttcgttcgttcggttgggttcggttggagtatttcggtcgcggcggagtttgcgttttgtttttttcgagttttttttttttttgttcgtcgttttttggagttttcgggtttcgttggtttttgtttttgtttcgggcgcgtacgttatcggcgtaagtgagtatgcgtttcgcggtcgtagttttcgtcggtttcgcgtttatattcgcgttcgtattcgcgcgtcggttttgttttttcgcgttttcgttcgggttttagattttgggggtagagggtagagggtagaggttagaggtcgcggggaggaat

SEQ ID NO: 12014 - DNA, 778 bp, Artificial Sequence
  chemically treated genomic DNA (Homo sapiens) CpG-island No: 12014
attcctccccgcgacctctaacctctaccctctaccctctacccccaaaatctaaaacccgaacgaaaacgcgaaaaaacaaaaccgacgcgcgaatacgaacgcgaatataaacgcgaaaccgacgaaaactacgaccgcgaaacgcatactcacttacgccgataacgtacgcgcccgaaacaaaaacaaaaaccaacgaaacccgaaaactccaaaaaacgacgaacaaaaaaaaaaaaaactcgaaaaaaacaaaacgcaaactccgccgcgaccgaaatactccaaccgaacccaaccgaacgaacgaaccgacgaaaaaaaaaaaaacgccaaaacgcgcgcgcgcgaccccgaacaacaaccttaccgccaataaaacaactaccgacgcgcgaaaccgcgaacccaacattcgccgaccgaaccgaacataaacgcgaaaaaaccgcgaccgccccctacaccgcccgacgcgccgaaaccgtaaccgaaacgaaaaacgcgaccgcactaataccccgaaacccataaacgcgccgaaccgaacgcgaaaacgctaaacgacgaaacgaaaacgaccgaaaaaaccataaactacaacctcgtacgaacgctcgtacacaaatacgtaaatactcccgacgcgaactaaaaaacccgaaaaccaaacaaacgcgaaccgaccccgcaacccgaaccctataaccgatccaaccccgaaatcccgaaaaatctccgatatctaaaactcgaaccgcccccgaaaacgaac

SEQ ID NO: 12015 - DNA, 778 bp, Artificial Sequence
  chemically treated genomic DNA (Homo sapiens) CpG-island No: 12015
gttttttttcgcggtttttgatttttgttttttgttttttgtttttagggtttggggttcgggcggaggcgcgagggggtagggtcggcgcgcgggtgcgagcgcgggtgtgggcgcggggtcggcgggggttgcggtcgcggggcgtatgtttatttgcgtcggtgacgtgcgcgttcggagtaggggtaggagttagcggggttcggaggttttagagggcggcgggtaggggaggaggagattcgggaggagtagagcgtaggtttcgtcgcggtcggggtgttttagtcgagtttaatcgagcgggcggatcgacggggagagagaaggcgttagagcgcgcgcgcgcggtttcgagtagtagttttgtcgttagtggagtagttgtcgacgcgcggggtcgcggatttagtattcgtcggtcgggtcgggtatgagcgcggaggggtcgcggtcgttttttgtatcgttcggcgcgtcgaggtcgtgatcggagcggggggcgcggtcgtattagtatttcggagtttatgggcgcgtcgagtcgggcgcgggggcgttgaacggcggagcgggagcggtcggaggagttatggattgtagtttcgtgcggacgttcgtgtatagatacgtgagtgttttcggcgcgggttgggggattcggggattagatagacgcgggtcggtttcgtagttcggattttgtggtcggtttagtttcggggtttcgggaggttttcgatgtttgggattcggatcgttttcggggacgagt

SEQ ID NO: 12016 - DNA, 778 bp, Artificial Sequence
  chemically treated genomic DNA (Homo sapiens) CpG-island No: 12016
actcgtccccgaaaacgatccgaatcccaaacatcgaaaacctcccgaaaccccgaaactaaaccgaccacaaaatccgaactacgaaaccgacccgcgtctatctaatccccgaatcccccaacccgcgccgaaaacactcacgtatctatacacgaacgtccgcacgaaactacaatccataactcctccgaccgctcccgctccgccgttcaacgcccccgcgcccgactcgacgcgcccataaactccgaaatactaatacgaccgcgccccccgctccgatcacgacctcgacgcgccgaacgatacaaaaaacgaccgcgacccctccgcgctcatacccgacccgaccgacgaatactaaatccgcgaccccgcgcgtcgacaactactccactaacgacaaaactactactcgaaaccgcgcgcgcgcgctctaacgccttctctctccccgtcgatccgcccgctcgattaaactcgactaaaacaccccgaccgcgacgaaacctacgctctactcctcccgaatctcctcctcccctacccgccgccctctaaaacctccgaaccccgctaactcctacccctactccgaacgcgcacgtcaccgacgcaaataaacatacgccccgcgaccgcaacccccgccgaccccgcgcccacacccgcgctcgcacccgcgcgccgaccctaccccctcgcgcctccgcccgaaccccaaaccctaaaaacaaaaaacaaaaaacaaaaatcaaaaaccgcgaaaaaaaac

SEQ ID NO: 12017 - DNA, 644 bp, Artificial Sequence
  chemically treated genomic DNA (Homo sapiens) CpG-island No: 12017
gttacgattgtagtcggttcggcgggggtttcgtcgttcgttttagtttggatttttgtaaaatgggggtaatagcgtcgatttggggggttcgtttcggggatgaacggtcgtttagagcgattcgggattttacgttattagtaggttggtacgattagtaggttacggttcgttaggcggtcggggttgcgattgatttggcgttttcgtttagttttttatgcgtgttgtaatttattgttatgatttttacggagtttttgaatattacgtttttttggtttagatattgtagggtgcggcggatggggaagcggttttttatgggtatggcggtaacggtggcggggtcgattttacgggtcgcgagtcgagtagcgacgagaaaggattagttagtattcgcgcggattttacgcggtttttttttagagttaggttttatttttcgcgtagacgtataggagacgtttttcggcgggtagcgtacgaagcggagtattttgggatttgtaggcggttttcgattcggcgcggcgagaatcggtgtgtgtagtttcgttttaggacgttttttttttggaaggtttaggttgtcgcgttttgtaaattagttatttttttatttatttacgggaaaa

SEQ ID NO: 12018 - DNA, 644 bp, Artificial Sequence
  chemically treated genomic DNA (Homo sapiens) CpG-island No: 12018
ttttcccgtaaataaataaaaaaataactaatttacaaaacgcgacaacctaaaccttccaaaaaaaaaacgtcctaaaacgaaactacacacaccgattctcgccgcgccgaatcgaaaaccgcctacaaatcccaaaatactccgcttcgtacgctacccgccgaaaaacgtctcctatacgtctacgcgaaaaataaaacctaactctaaaaaaaaaccgcgtaaaatccgcgcgaatactaactaatcctttctcgtcgctactcgactcgcgacccgtaaaatcgaccccgccaccgttaccgccatacccataaaaaaccgcttccccatccgccgcaccctacaatatctaaaccaaaaaaacgtaatattcaaaaactccgtaaaaatcataacaataaattacaacacgcataaaaaactaaacgaaaacgccaaatcaatcgcaaccccgaccgcctaacgaaccgtaacctactaatcgtaccaacctactaataacgtaaaatcccgaatcgctctaaacgaccgttcatccccgaaacgaaccccccaaatcgacgctattacccccattttacaaaaatccaaactaaaacgaacgacgaaacccccgccgaaccgactacaatcgtaac

SEQ ID NO: 12019 - DNA, 644 bp, Artificial Sequence
  chemically treated genomic DNA (Homo sapiens) CpG-island No: 12019
ttttttcgtgggtggatggggaaatgattaatttataggacgcgataatttaaattttttaaggggaaggcgttttaaagcgaagttgtatatatcggttttcgtcgcgtcgggtcgaaggtcgtttataagttttagagtgtttcgtttcgtgcgttgttcgtcgggaagcgttttttgtgcgtttgcgcgggaagtggaatttggttttggggagaagtcgcgtgagattcgcgcgggtgttagttagttttttttcgtcgttgttcggttcgcggttcgtggggtcggtttcgttatcgttgtcgttatgtttatgaagggtcgtttttttattcgtcgtattttgtaatatttgagttaggggaacgtggtgtttaaggatttcgtgaaggttatgatagtgaattataatacgtatggggagttgggcgagggcgttaggttagtcgtagtttcggtcgtttggcgagtcgtaatttgttagtcgtgttagtttgttggtaacgtgaggtttcgagtcgttttgggcggtcgtttattttcggggcgggttttttaggtcggcgttgttatttttattttatagaggtttagattgaggcggacggcggggttttcgtcgggtcggttgtagtcgtgat

SEQ ID NO: 12020 - DNA, 644 bp, Artificial Sequence
  chemically treated genomic DNA (Homo sapiens) CpG-island No: 12020
atcacgactacaaccgacccgacgaaaaccccgccgtccgcctcaatctaaacctctataaaataaaaataacaacgccgacctaaaaaacccgccccgaaaataaacgaccgcccaaaacgactcgaaacctcacgttaccaacaaactaacacgactaacaaattacgactcgccaaacgaccgaaactacgactaacctaacgccctcgcccaactccccatacgtattataattcactatcataaccttcacgaaatccttaaacaccacgttcccctaactcaaatattacaaaatacgacgaataaaaaaacgacccttcataaacataacgacaacgataacgaaaccgaccccacgaaccgcgaaccgaacaacgacgaaaaaaaactaactaacacccgcgcgaatctcacgcgacttctccccaaaaccaaattccacttcccgcgcaaacgcacaaaaaacgcttcccgacgaacaacgcacgaaacgaaacactctaaaacttataaacgaccttcgacccgacgcgacgaaaaccgatatatacaacttcgctttaaaacgccttccccttaaaaaatttaaattatcgcgtcctataaattaatcatttccccatccacccacgaaaaaa

SEQ ID NO: 12021 - DNA, 579 bp, Artificial Sequence
  chemically treated genomic DNA (Homo sapiens) CpG-island No: 12021
gtttttttttttttttttttttttttttgttcgtttttttttttttttttttcgttttcgttttttgttttttttgttttttcgttgttttttttttttttttttttttttttttttttttttttttttcgcgtttcgtttttttttttttttttttcgttttttttttttttttttttcggttgttgtgcgtttttttttttcgtgggttttacgttgtcgtatttgtttttttttcgttcgtttttcgtttttttttttcgtttttttttttttttgttgtttttcggtgtcgtcgtttttttttttttcgagttttgttttcgtcgtttcgttcgttttgtgttttttttttttatttggtgttgtgttatttttgtggttttcgggtcgcgcgtgttcgcgtttttttttttttcgggttttttatttttttttcgtttgtttacgtttttttttgttttttcgttttcgttttatattatttgttcgttcgttttcgtgtttgtgtatttttttttttttttttttttttgcgttttttcgtcgtcgttttttttattatattatatttttatt

SEQ ID NO: 12022 - DNA, 579 bp, Artificial Sequence
  chemically treated genomic DNA (Homo sapiens) CpG-island No: 12022
aataaaaatataatataataaaaaaaacgacgacgaaaaaacgcaaaaaaaaaaaaaaaaaaaaaaatacacaaacacgaaaacgaacgaacaaataatataaaacgaaaacgaaaaaacaaaaaaaaacgtaaacaaacgaaaaaaaaataaaaaacccgaaaaaaaaaaaaacgcgaacacgcgcgacccgaaaaccacaaaaataacacaacaccaaataaaaaaaaaaaacacaaaacgaacgaaacgacgaaaacaaaactcgaaaaaaaaaaaaacgacgacaccgaaaaacaacaaaaaaaaaaaaaaacgaaaaaaaaaaacgaaaaacgaacgaaaaaaaaacaaatacgacaacgtaaaacccacgaaaaaaaaaaacgcacaacaaccgaaaaaaaaaaaaaaaaaaaacgaaaaaaaaaaaaaaaaaaacgaaacgcgaaaaaaaaaaaaaaaaaaaaaaaaaaaaaaaaaaaaaaaaaacaacgaaaaaacaaaaaaaacaaaaaacgaaaacgaaaaaaaaaaaaaaaaaaacgaacaaaaaaaaaaaaaaaaaaaaaaaaaaac

SEQ ID NO: 12023 - DNA, 579 bp, Artificial Sequence
  chemically treated genomic DNA (Homo sapiens) CpG-island No: 12023
ggtagaagtataatatggtggggggggcggcggcggggagacgtaaaaagagggggaaaagaaggaatatataagtacgggggcgaacgagtaagtaatgtgaggcgggggcggggggataaaaggaagcgtgggtaaacgaaaaagaaataaaggattcgagagagggagaggcgcgggtacgcgcgattcgagggttataaaggtgatataatattaagtgggggggagaaatataaggcgggcggggcggcgggggtaaaattcgaaaaagaggaaggcggcgatatcggggaataataaagggggggggggacggggaaagggggcgggaaacgggcggaaaggagataagtgcgatagcgtggagtttacggggaaagggagcgtataataatcgaggggggagaaaaggggggacgggaaaaaaaggggaggaagcggggcgcggggagggaaagggggaaaaaaaaaggggaaaaagggggggaatagcggggaggtaaaagggataaaaaacgggagcgggggagaggaaagggaaggcggatagggggaaagggaaaggggggggggggt

SEQ ID NO: 12024 - DNA, 579 bp, Artificial Sequence
  chemically treated genomic DNA (Homo sapiens) CpG-island No: 12024
acccccccccccctttccctttccccctatccgccttccctttcctctcccccgctcccgttttttatcccttttacctccccgctattccccccctttttcccctttttttttccccctttccctccccgcgccccgcttcctcccctttttttcccgtccccccttttctcccccctcgattattatacgctccctttccccgtaaactccacgctatcgcacttatctcctttccgcccgtttcccgccccctttccccgtccccccccccctttattattccccgatatcgccgccttcctctttttcgaattttacccccgccgccccgcccgccttatatttctcccccccacttaatattatatcacctttataaccctcgaatcgcgcgtacccgcgcctctccctctctcgaatcctttatttctttttcgtttacccacgcttccttttatccccccgcccccgcctcacattacttactcgttcgcccccgtacttatatattccttcttttccccctctttttacgtctccccgccgccgccccccccaccatattatacttctacc

SEQ ID NO: 12025 - DNA, 1170 bp, Artificial Sequence
  chemically treated genomic DNA (Homo sapiens) CpG-island No: 12025
  misc_feature (414)..(414): n is either a, c, g or t
  misc_feature (670)..(670): n is either a, c, g or t
tttttttttagcgttttgtagtcgttattttttagtatttttttagtataagaggggtcgtcgtttggttcggttttttcgtttttagtcgcgcgggtcgggggtagtagtagtagtttcgcgtcgttttcgttttagcggtttttacggtcgtttgttcggagcgcgtagaggaggttaatacgtaggaggtagagcggcggcggcggttttgggtttcggtagagggatagtcgcgttttgatgcgttataaggtttcggagtttcgagttgtcgggtttttgtcgtttttttgcgagcgtttattgaagggtattggtcgggttttttcgcggcgtttttgaatgggttattttttttattttcgagtgatatttagcggaaaaggcggtttttggcgttcgtatcgcggnggaaagtttagttttaagaggcgttcggtagtcggcgtacgttttattaatttggggtttttttaaagttcgttgcgtttacgttttttagcgttttttgtttcgtttttcgtcgttatttgtttcgcgttcgttttttggaaggcgattcgattcgagtttcgggaatttttttttttttatttagggcgatcgtttaaggagttttggttgtttgattattgtcgacgtttatagggcgttgcgaggttatttntcgcgtttcgttttttttcggttcgcgggattttttgttaatagttttagaaagtgaggacgggggcgcggaggcgggggtagtttttaggtagtgttgtttttcggtttttgggaattagttcgggggattcgcgttgggtttcgagagttcgtagaattagcgtcgtgttttgggcgagttgggaggtcggggtcgagtttcgcgagtttcgcgagtgtgttttttttagaacgtttaggtaaataattgagcgtatagaggtcgagaggatatcgtgtttttttacgtatattcgtttacggttattaagtagttttttttggaaagagggcgattgttaaagtaatagtgcgattgtcgggtttgttacgggtggagagaggcggatttacgttaggtcgtatttcgtttgtttttttcgatttcgatcgtaggcgttaattcgtttttttttttttttttgattcgtacggtttgtaacgttttttataatagta

SEQ ID NO: 12026 - DNA, 1170 bp, Artificial Sequence
  chemically treated genomic DNA (Homo sapiens) CpG-island No: 12026
  misc_feature (501)..(501): n is either a, c, g or t
  misc_feature (757)..(757): n is either a, c, g or t
tactattataaaaaacgttacaaaccgtacgaatcaaaaaaaaaaaaaaaaacgaattaacgcctacgatcgaaatcgaaaaaaacaaacgaaatacgacctaacgtaaatccgcctctctccacccgtaacaaacccgacaatcgcactattactttaacaatcgccctctttccaaaaaaaactacttaataaccgtaaacgaatatacgtaaaaaaacacgatatcctctcgacctctatacgctcaattatttacctaaacgttctaaaaaaaacacactcgcgaaactcgcgaaactcgaccccgacctcccaactcgcccaaaacacgacgctaattctacgaactctcgaaacccaacgcgaatcccccgaactaattcccaaaaaccgaaaaacaacactacctaaaaactacccccgcctccgcgcccccgtcctcactttctaaaactattaacaaaaaatcccgcgaaccgaaaaaaaacgaaacgcganaaataacctcgcaacgccctataaacgtcgacaataatcaaacaaccaaaactccttaaacgatcgccctaaataaaaaaaaaaaaattcccgaaactcgaatcgaatcgccttccaaaaaacgaacgcgaaacaaataacgacgaaaaacgaaacaaaaaacgctaaaaaacgtaaacgcaacgaactttaaaaaaaccccaaattaataaaacgtacgccgactaccgaacgcctcttaaaactaaactttccnccgcgatacgaacgccaaaaaccgccttttccgctaaatatcactcgaaaataaaaaaaataacccattcaaaaacgccgcgaaaaaacccgaccaatacccttcaataaacgctcgcaaaaaaacgacaaaaacccgacaactcgaaactccgaaaccttataacgcatcaaaacgcgactatccctctaccgaaacccaaaaccgccgccgccgctctacctcctacgtattaacctcctctacgcgctccgaacaaacgaccgtaaaaaccgctaaaacgaaaacgacgcgaaactactactactacccccgacccgcgcgactaaaaacgaaaaaaccgaaccaaacgacgacccctcttatactaaaaaaatactaaaaaataacgactacaaaacgctaaaaaaaaa

SEQ ID NO: 12027 - DNA, 1170 bp, Artificial Sequence
  chemically treated genomic DNA (Homo sapiens) CpG-island No: 12027
  misc_feature (501)..(501): n is either a, c, g or t
  misc_feature (757)..(757): n is either a, c, g or t
tattgttataagagacgttgtaaatcgtacgggttaagaagaaaaaaaaagacgggttagcgtttgcggtcggggtcgagaaaagtaggcgagatgcgatttgacgtgggttcgtttttttttattcgtggtaagttcgatagtcgtattattgttttaataatcgttttttttttaagaagagttatttagtgatcgtgagcgaatatgcgtgggaagatacgatgttttttcggtttttgtgcgtttagttgtttatttaggcgttttgggggaggtatattcgcgggattcgcgggattcggtttcggttttttagttcgtttaggatacgacgttggttttgcgggttttcggagtttagcgcgaatttttcgggttaatttttaagaatcgagaggtagtattgtttggaggttgttttcgttttcgcgttttcgtttttattttttgaggttgttagtagagagtttcgcgggtcggggagaagcgggacgcggnggatggtttcgtagcgttttgtgagcgtcggtagtagttaggtagttagggttttttgggcgatcgttttgggtagaggagagggagttttcggggttcgggtcgggtcgttttttaggggacgagcgcgaagtaagtggcggcgagaggcggagtaagagacgttggagggcgtggacgtagcgggttttggaaaggttttaagttaatgaggcgtgcgtcggttgtcgagcgttttttggagttgggttttttntcgcggtgcgggcgttaggagtcgtttttttcgttgggtgttattcgggggtggggaagatggtttatttaaaagcgtcgcgagggggttcggttagtgttttttagtgagcgttcgtaagaggacggtagaggttcggtagttcggagtttcgggattttgtggcgtattaggacgcggttgtttttttgtcgggatttagagtcgtcgtcgtcgttttgttttttgcgtgttagttttttttgcgcgtttcgggtaggcggtcgtgggagtcgttgagacgaggacggcgcgaggttgttgttgttgttttcggttcgcgcggttggaaacggagaggtcgagttaagcggcggttttttttatgttgggaggatgttggagagtagcggttgtaaagcgttgaaggaggg

SEQ ID NO: 12028 - DNA, 1170 bp, Artificial Sequence
  chemically treated genomic DNA (Homo sapiens) CpG-island No: 12028
  misc_feature (414)..(414): n is either a, c, g or t
  misc_feature (670)..(670): n is either a, c, g or t
ccctccttcaacgctttacaaccgctactctccaacatcctcccaacataaaaaaaaccgccgcttaactcgacctctccgtttccaaccgcgcgaaccgaaaacaacaacaacaacctcgcgccgtcctcgtctcaacgactcccacgaccgcctacccgaaacgcgcaaaaaaaactaacacgcaaaaaacaaaacgacgacgacgactctaaatcccgacaaaaaaacaaccgcgtcctaatacgccacaaaatcccgaaactccgaactaccgaacctctaccgtcctcttacgaacgctcactaaaaaacactaaccgaaccccctcgcgacgcttttaaataaaccatcttccccacccccgaataacacccaacgaaaaaaacgactcctaacgcccgcaccgcganaaaaaacccaactccaaaaaacgctcgacaaccgacgcacgcctcattaacttaaaacctttccaaaacccgctacgtccacgccctccaacgtctcttactccgcctctcgccgccacttacttcgcgctcgtcccctaaaaaacgacccgacccgaaccccgaaaactccctctcctctacccaaaacgatcgcccaaaaaaccctaactacctaactactaccgacgctcacaaaacgctacgaaaccatccnccgcgtcccgcttctccccgacccgcgaaactctctactaacaacctcaaaaaataaaaacgaaaacgcgaaaacgaaaacaacctccaaacaatactacctctcgattcttaaaaattaacccgaaaaattcgcgctaaactccgaaaacccgcaaaaccaacgtcgtatcctaaacgaactaaaaaaccgaaaccgaatcccgcgaatcccgcgaatatacctcccccaaaacgcctaaataaacaactaaacgcacaaaaaccgaaaaaacatcgtatcttcccacgcatattcgctcacgatcactaaataactcttcttaaaaaaaaaacgattattaaaacaataatacgactatcgaacttaccacgaataaaaaaaaacgaacccacgtcaaatcgcatctcgcctacttttctcgaccccgaccgcaaacgctaacccgtctttttttttcttcttaacccgtacgatttacaacgtctcttataacaata

SEQ ID NO: 12029 - DNA, 687 bp, Artificial Sequence
  chemically treated genomic DNA (Homo sapiens) CpG-island No: 12029
  misc_feature (654)..(654): n is either a, c, g or t
gaggcgtaggcgttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagtcgtggtgttggggttcgatcgtgaaacggtgttgtgcggtgtgaaagcgttgtttgtcggttatgagggttttgggtttgtgatcggatttgtgggggttgggggtcgtaatcgggtntgtgtttttttcggttagggtggttaatggttt

SEQ ID NO: 12030 - DNA, 687 bp, Artificial Sequence
  chemically treated genomic DNA (Homo sapiens) CpG-island No: 12030
  misc_feature (34)..(34): n is either a, c, g or t
aaaccattaaccaccctaaccgaaaaaaacacanacccgattacgacccccaacccccacaaatccgatcacaaacccaaaaccctcataaccgacaaacaacgctttcacaccgcacaacaccgtttcacgatcgaaccccaacaccacgactcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaacgcctacgcctc

SEQ ID NO: 12031 - DNA, 687 bp, Artificial Sequence
  chemically treated genomic DNA (Homo sapiens) CpG-island No: 12031
  misc_feature (34)..(34): n is either a, c, g or t
aggttattgattattttggtcgggaaaaatatanattcgattgcggtttttagtttttatagattcggttataaatttaaaatttttatgatcggtagatagcgtttttatatcgtataatatcgttttacggtcggattttagtattacggttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattagcgtttgcgtttt

SEQ ID NO: 12032 - DNA, 687 bp, Artificial Sequence
  chemically treated genomic DNA (Homo sapiens) CpG-island No: 12032
  misc_feature (654)..(654): n is either a, c, g or t
aaaacgcaaacgctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaaccgtaatactaaaatccgaccgtaaaacgatattatacgatataaaaacgctatctaccgatcataaaaattttaaatttataaccgaatctataaaaactaaaaaccgcaatcgaatntatatttttcccgaccaaaataatcaataacct

SEQ ID NO: 12033 - DNA, 603 bp, Artificial Sequence
  chemically treated genomic DNA (Homo sapiens) CpG-island No: 12033
  misc_feature (297)..(297): n is either a, c, g or t
  misc_feature (372)..(372): n is either a, c, g or t
tttgtcgttttttatttattattttttgcgtcgcgtttttcgcgttttttcgcggtcgtcggttttttgtaggtttttttggtagagattcgggttcgttcgttttttcggcgtcgcgttcgggggttcgttttttttcgttcggcgcgtgcgtgttttttttttcgcgtgcggtattgtttcgtcgtttatattttttttacgtttttttttttttttatttttttttttttttatttatttgtggtttcgtttttgtcggtcgtcgaatcgtttttcgtcgttgttttatttttnatttttattcgttattattataacgcgttcgcgcgtatttttttgcgttgtttgttttgttttttttcgtttatnttttttcgttatttcgtttatttagattcgcgttgtttttaaatagtcgaaacgtatcgttacgtttttttttttttatttttttcgtgatatagtatttcgataaagtatattttttaaattgtttcgcgtttttaattcgaatttgtatttttcgcgatcgcgtttttttttgcgtttgttcgtttgttttattttttatgttttatttaggtaaatcgatatatataa

SEQ ID NO: 12034 - DNA, 603 bp, Artificial Sequence
  chemically treated genomic DNA (Homo sapiens) CpG-island No: 12034
  misc_feature (232)..(232): n is either a, c, g or t
  misc_feature (307)..(307): n is either a, c, g or t
ttatatatatcgatttacctaaataaaacataaaaaataaaacaaacgaacaaacgcaaaaaaaaacgcgatcgcgaaaaatacaaattcgaattaaaaacgcgaaacaatttaaaaaatatactttatcgaaatactatatcacgaaaaaaataaaaaaaaaaaaacgtaacgatacgtttcgactatttaaaaacaacgcgaatctaaataaacgaaataacgaaaaaanataaacgaaaaaaaacaaaacaaacaacgcaaaaaaatacgcgcgaacgcgttataataataacgaataaaaatnaaaaataaaacaacgacgaaaaacgattcgacgaccgacaaaaacgaaaccacaaataaataaaaaaaaaaaaaaataaaaaaaaaaaaaaacgtaaaaaaaatataaacgacgaaacaataccgcacgcgaaaaaaaaaacacgcacgcgccgaacgaaaaaaaacgaacccccgaacgcgacgccgaaaaaacgaacgaacccgaatctctaccaaaaaaacctacaaaaaaccgacgaccgcgaaaaaacgcgaaaaacgcgacgcaaaaaataataaataaaaaacgacaaa

SEQ ID NO: 12035 - DNA, 603 bp, Artificial Sequence
  chemically treated genomic DNA (Homo sapiens) CpG-island No: 12035
  misc_feature (232)..(232): n is either a, c, g or t
  misc_feature (307)..(307): n is either a, c, g or t
ttgtgtatatcggtttgtttgggtggggtatagggggtagagtaagcgagtagacgtagaaggggacgcggtcgcgggaagtgtaggttcgggttagaggcgcggggtaatttaagaagtgtgttttgtcggggtgttgtattacgaaagaaataggaaggagagagcgtggcggtacgtttcggttgtttgggggtagcgcgggtttgggtgaacgggatagcgaggaaangtgagcgagaggaggtagggtaggtagcgtaagagagtgcgcgcgaacgcgttataatgataacgggtagagatnaaggataggatagcgacgagggacggttcggcggtcggtagagacgaagttataggtgggtaaaaaaggggggaggtggggaggagggggggcgtgggggagatgtggacgacggggtagtatcgtacgcggaggaagggatacgtacgcgtcgggcgggggggggcgggttttcgagcgcggcgtcggggaggcgggcgggttcgggtttttattaggagggtttataaagggtcggcgatcgcggggaggcgcggaggacgcggcgtaggaagtgatgaatggagggcggtagg

SEQ ID NO: 12036 - DNA, 603 bp, Artificial Sequence
  chemically treated genomic DNA (Homo sapiens) CpG-island No: 12036
  misc_feature (297)..(297): n is either a, c, g or t
  misc_feature (372)..(372): n is either a, c, g or t
cctaccgccctccattcatcacttcctacgccgcgtcctccgcgcctccccgcgatcgccgaccctttataaaccctcctaataaaaacccgaacccgcccgcctccccgacgccgcgctcgaaaacccgcccccccccgcccgacgcgtacgtatcccttcctccgcgtacgatactaccccgtcgtccacatctcccccacgccccccctcctccccacctccccccttttttacccacctataacttcgtctctaccgaccgccgaaccgtccctcgtcgctatcctatccttnatctctacccgttatcattataacgcgttcgcgcgcactctcttacgctacctaccctacctcctctcgctcacntttcctcgctatcccgttcacccaaacccgcgctacccccaaacaaccgaaacgtaccgccacgctctctccttcctatttctttcgtaatacaacaccccgacaaaacacacttcttaaattaccccgcgcctctaacccgaacctacacttcccgcgaccgcgtccccttctacgtctactcgcttactctaccccctataccccacccaaacaaaccgatatacacaa

SEQ ID NO: 12037 - DNA, 675 bp, Artificial Sequence
  chemically treated genomic DNA (Homo sapiens) CpG-island No: 12037
  misc_feature (28)..(28): n is either a, c, g or t
  misc_feature (39)..(39): n is either a, c, g or t
  misc_feature (352)..(352): n is either a, c, g or t
  misc_feature (403)..(403): n is either a, c, g or t
  misc_feature (436)..(436): n is either a, c, g or t
  misc_feature (636)..(636): n is either a, c, g or t
cggggtttcgcggacgtaacggtgggtnacgatgcggtnaattcgtcgttcggttggtgcgtttgggtcgggtgtcgtacgtcgagttattggggttgtaggatcgttggttgcggcggttgtaggtcgagttaggtattgaggtttcgtcggggattgaggcgggcgcgtttttgttttgcgagttcgcggggttcgtgtatacggtcgggttgcgcggcggtttgacgttcgaggaaattgcgcggttacgggttttgggcgtcgaggtgcgcgttataggtcgcggtggtttggttattttttacggttcgggttagttgttttgttattcggtattcgatttgcggtngtttcggtttgcgtttgcgtatgtacgtagcgtcgttggaggcgtgcgttngtgcgtttgtgcgagttttagggtttgtaggancgttcgcgcgcggttttcgttttatattggcgtttggttagacgatcgtaagatttgcgcgatcggtgagcgtcgcggcgtagggcggtatttgagagtcgaggtcggagtttgaggtttgggggcggggtttgacggggttggattaatggaggtaaggttcggaaggaggcgtatttagcgcgggttttgaattatangttattcgttgcgtttgagtttttaaatttttttttaga

SEQ ID NO: 12038 - DNA, 675 bp, Artificial Sequence
  chemically treated genomic DNA (Homo sapiens) CpG-island No: 12038
  misc_feature (40)..(40): n is either a, c, g or t
  misc_feature (240)..(240): n is either a, c, g or t
  misc_feature (273)..(273): n is either a, c, g or t
  misc_feature (324)..(324): n is either a, c, g or t
  misc_feature (637)..(637): n is either a, c, g or t
  misc_feature (648)..(648): n is either a, c, g or t
tctaaaaaaaaatttaaaaactcaaacgcaacgaataacntataattcaaaacccgcgctaaatacgcctccttccgaaccttacctccattaatccaaccccgtcaaaccccgcccccaaacctcaaactccgacctcgactctcaaataccgccctacgccgcgacgctcaccgatcgcgcaaatcttacgatcgtctaaccaaacgccaatataaaacgaaaaccgcgcgcgaacgntcctacaaaccctaaaactcgcacaaacgcacnaacgcacgcctccaacgacgctacgtacatacgcaaacgcaaaccgaaacnaccgcaaatcgaataccgaataacaaaacaactaacccgaaccgtaaaaaataaccaaaccaccgcgacctataacgcgcacctcgacgcccaaaacccgtaaccgcgcaatttcctcgaacgtcaaaccgccgcgcaacccgaccgtatacacgaaccccgcgaactcgcaaaacaaaaacgcgcccgcctcaatccccgacgaaacctcaatacctaactcgacctacaaccgccgcaaccaacgatcctacaaccccaataactcgacgtacgacacccgacccaaacgcaccaaccgaacgacgaattnaccgcatcgtnacccaccgttacgtccgcgaaaccccg

SEQ ID NO: 12039 - DNA, 675 bp, Artificial Sequence
  chemically treated genomic DNA (Homo sapiens) CpG-island No: 12039
  misc_feature (40)..(40): n is either a, c, g or t
  misc_feature (240)..(240): n is either a, c, g or t
  misc_feature (273)..(273): n is either a, c, g or t
  misc_feature (324)..(324): n is either a, c, g or t
  misc_feature (637)..(637): n is either a, c, g or t
  misc_feature (648)..(648): n is either a, c, g or t
tttgaaaaggggtttaaaaatttaaacgtagcgggtagtntgtgatttaaaattcgcgttagatacgttttttttcgggttttatttttattggtttagtttcgttagatttcgtttttaggttttaagtttcgatttcggtttttaggtatcgttttgcgtcgcggcgtttatcgatcgcgtagattttgcgatcgtttagttagacgttagtgtagggcgggggtcgcgcgcgggcgnttttgtaggttttggagttcgtataggcgtatnggcgtacgtttttagcgacgttacgtgtatgcgtaagcgtaggtcgagatngtcgtaggtcgagtatcgggtggtaaagtagttggttcgggtcgtggaaggtggttaggttatcgcggtttgtgacgcgtatttcggcgtttaaggttcgtagtcgcgtagttttttcgggcgttaggtcgtcgcgtagttcggtcgtatatacgggtttcgcgggttcgtagagtaggagcgcgttcgttttagttttcgacggggttttaatgtttggttcggtttgtagtcgtcgtagttagcggttttgtagttttagtagttcggcgtacggtattcgatttaggcgtattagtcgaacggcgggttngtcgtatcgtngtttatcgttgcgttcgcggggtttcg

SEQ ID NO: 12040 - DNA, 675 bp, Artificial Sequence
  chemically treated genomic DNA (Homo sapiens) CpG-island No: 12040
  misc_feature (28)..(28): n is either a, c, g or t
  misc_feature (39)..(39): n is either a, c, g or t
  misc_feature (352)..(352): n is either a, c, g or t
  misc_feature (403)..(403): n is either a, c, g or t
  misc_feature (436)..(436): n is either a, c, g or t
  misc_feature (636)..(636): n is either a, c, g or t
cgaaaccccgcgaacgcaacgataaacnacgatacgacnaacccgccgttcgactaatacgcctaaatcgaataccgtacgccgaactactaaaactacaaaaccgctaactacgacgactacaaaccgaaccaaacattaaaaccccgtcgaaaactaaaacgaacgcgctcctactctacgaacccgcgaaacccgtatatacgaccgaactacgcgacgacctaacgcccgaaaaaactacgcgactacgaaccttaaacgccgaaatacgcgtcacaaaccgcgataacctaaccaccttccacgacccgaaccaactactttaccacccgatactcgacctacgacnatctcgacctacgcttacgcatacacgtaacgtcgctaaaaacgtacgccnatacgcctatacgaactccaaaacctacaaaancgcccgcgcgcgacccccgccctacactaacgtctaactaaacgatcgcaaaatctacgcgatcgataaacgccgcgacgcaaaacgatacctaaaaaccgaaatcgaaacttaaaacctaaaaacgaaatctaacgaaactaaaccaataaaaataaaacccgaaaaaaaacgtatctaacgcgaattttaaatcacanactacccgctacgtttaaatttttaaaccccttttcaaa

SEQ ID NO: 12041 - DNA, 917 bp, Artificial Sequence
  chemically treated genomic DNA (Homo sapiens) CpG-island No: 12041
aaaacgcgcgggcgttttagtttttcgttttgcggtattttatttgttttcgaggattatcgttaagaagaggtttcgtcgtgttattgatattttatttcgttttttttcgcgaggtgttttcgagttttcgaggacgcggaacgtcggggtttttcgtcgggtaagtattagtatttagatttcgtacgtagttttgtatttttacgttttttagggaacgtcggttcgttcgttttcgggatttttcgttttttaagttaaggttttttaagtttagtgttcgcgcgttattttttttttcgattttgcggcgggatttttattttcgtattttttcgcggggttggttaagtttttagattttttgcgttgtagtcggttcggaaagttatttttaggttattttttcgcgcgcgcgcggcggcggttacggtggcggcggttgcgattcgaacgggtttttttatgtatcgcgtagggtagaggagggagcggcgtttcgtacgtcggggttggggcgttgggtagggcgggcgggcgtggggtttcgggttttttcgtatttagtcgcgcgagtcgggttttcgggtttaggggaggggagttgaggggcggagttatcggggcgcgttttcgcggttgcgttttttttcgtcggggagcgcgggtacgtaattcggagggtgttgggtcggttcggagtacgcgagtagcgggaggagggatcggggaatgattgacggaggcgggtcgtagaggtcgttgtgtttcgtcggttcgtattcggtcggagtgtgcgcgcgtagtttgttagattagcggcgggggtacgggtcgtattaagtgacggaggggggtacgttttgggtaggatttttttttcgttattgatttgtttattttgtaagagagat

SEQ ID NO: 12042 - DNA, 917 bp, Artificial Sequence
  chemically treated genomic DNA (Homo sapiens) CpG-island No: 12042
atctctcttacaaaataaacaaatcaataacgaaaaaaaaatcctacccaaaacgtacccccctccgtcacttaatacgacccgtacccccgccgctaatctaacaaactacgcgcgcacactccgaccgaatacgaaccgacgaaacacaacgacctctacgacccgcctccgtcaatcattccccgatccctcctcccgctactcgcgtactccgaaccgacccaacaccctccgaattacgtacccgcgctccccgacgaaaaaaaacgcaaccgcgaaaacgcgccccgataactccgcccctcaactcccctcccctaaacccgaaaacccgactcgcgcgactaaatacgaaaaaacccgaaaccccacgcccgcccgccctacccaacgccccaaccccgacgtacgaaacgccgctccctcctctaccctacgcgatacataaaaaaacccgttcgaatcgcaaccgccgccaccgtaaccgccgccgcgcgcgcgcgaaaaaataacctaaaaataactttccgaaccgactacaacgcaaaaaatctaaaaacttaaccaaccccgcgaaaaaatacgaaaataaaaatcccgccgcaaaatcgaaaaaaaaaataacgcgcgaacactaaacttaaaaaaccttaacttaaaaaacgaaaaatcccgaaaacgaacgaaccgacgttccctaaaaaacgtaaaaatacaaaactacgtacgaaatctaaatactaatacttacccgacgaaaaaccccgacgttccgcgtcctcgaaaactcgaaaacacctcgcgaaaaaaaacgaaataaaatatcaataacacgacgaaacctcttcttaacgataatcctcgaaaacaaataaaataccgcaaaacgaaaaactaaaacgcccgcgcgtttt

SEQ ID NO: 12043 - DNA, 917 bp, Artificial Sequence
  chemically treated genomic DNA (Homo sapiens) CpG-island No: 12043
attttttttgtagagtaggtaggttaatgacgaggagagggttttgtttagagcgtgttttttttcgttatttggtacggttcgtgttttcgtcgttgatttggtaggttgcgcgcgtatatttcggtcgggtgcgggtcggcggggtatagcggtttttacggttcgttttcgttagttatttttcggttttttttttcgttgttcgcgtgtttcgggtcggtttagtatttttcgagttacgtgttcgcgtttttcggcggggaggagcgtagtcgcgggggcgcgtttcggtgatttcgttttttagttttttttttttgagttcgggagttcggttcgcgcggttaggtgcgaggagattcgggattttacgttcgttcgttttgtttagcgttttagtttcggcgtgcgaggcgtcgtttttttttttgttttgcgcggtgtatggaggggttcgttcggatcgtagtcgtcgttatcgtagtcgtcgtcgcgcgcgcgcggggggatgatttgggggtggtttttcgagtcggttgtagcgtaggaggtttggaggtttagttagtttcgcggagaggtgcgggggtgggggtttcgtcgtagggtcggagggaggggtggcgcgcgggtattgggtttggggggttttggtttaggggacgggaggtttcggggacgggcgggtcggcgttttttggagggcgtgggggtgtagggttgcgtgcggggtttggatgttgatgtttgttcggcggggagtttcggcgtttcgcgttttcgggggttcggaggtatttcgcgggaggaggcggggtgaggtgttagtgatacgacgaaatttttttttgacgatggttttcgggggtaggtgagatgtcgtagagcggggagttagggcgttcgcgcgtttt

SEQ ID NO: 12044 - DNA, 917 bp, Artificial Sequence
  chemically treated genomic DNA (Homo sapiens) CpG-island No: 12044
aaaacgcgcgaacgccctaactccccgctctacgacatctcacctacccccgaaaaccatcgtcaaaaaaaaatttcgtcgtatcactaacacctcaccccgcctcctcccgcgaaatacctccgaacccccgaaaacgcgaaacgccgaaactccccgccgaacaaacatcaacatccaaaccccgcacgcaaccctacacccccacgccctccaaaaaacgccgacccgcccgtccccgaaacctcccgtcccctaaaccaaaaccccccaaacccaatacccgcgcgccacccctccctccgaccctacgacgaaacccccacccccgcacctctccgcgaaactaactaaacctccaaacctcctacgctacaaccgactcgaaaaaccacccccaaatcatccccccgcgcgcgcgcgacgacgactacgataacgacgactacgatccgaacgaacccctccatacaccgcgcaaaacaaaaaaaaaaacgacgcctcgcacgccgaaactaaaacgctaaacaaaacgaacgaacgtaaaatcccgaatctcctcgcacctaaccgcgcgaaccgaactcccgaactcaaaaaaaaaaaactaaaaaacgaaatcaccgaaacgcgcccccgcgactacgctcctccccgccgaaaaacgcgaacacgtaactcgaaaaatactaaaccgacccgaaacacgcgaacaacgaaaaaaaaaaccgaaaaataactaacgaaaacgaaccgtaaaaaccgctataccccgccgacccgcacccgaccgaaatatacgcgcgcaacctaccaaatcaacgacgaaaacacgaaccgtaccaaataacgaaaaaaaacacgctctaaacaaaaccctctcctcgtcattaacctacctactctacaaaaaaaat

SEQ ID NO: 12045 - DNA, 585 bp, Artificial Sequence
  chemically treated genomic DNA (Homo sapiens) CpG-island No: 12045
ggtgtaggaatgtggagtataggtagtatttcggtatcgtggtgaggttaatcggtataggaacgtggagtataggtagtattttagtatcgtggtgaggttaatcggtgtaggaacgtggagtataggtagtattcgggtatcgcggtgaggttaattggtgtaggaatacggagtagaagtagtattcgggtatcgcggtgaggttaataggtataggaacgtggagtagaggtagaattcgggtatcgcggtgaggttaatcggtgtaggaacgtggagtagaattagtatttgggtatcgcggtgaggttaatcggtgtaggaacgtggagtagaggtagtatttgggtattatagtgaggttaatcggtgtaggaacgtggagtagaattagtatttgggtatcgcggtgaggttaatcggtgtaggaacgtggagtagaggtagtatttgggtattatagtgaggttaattggtgcgggaacgtggagtagaagtagtattcgggtatcgtaggaggttaatcggtgtaggaatttgtagtggtcgttttttttgtatagtttttagagtcggtgttta

SEQ ID NO: 12046 - DNA, 585 bp, Artificial Sequence
  chemically treated genomic DNA (Homo sapiens) CpG-island No: 12046
taaacaccgactctaaaaactatacaaaaaaaacgaccactacaaattcctacaccgattaacctcctacgatacccgaatactacttctactccacgttcccgcaccaattaacctcactataatacccaaatactacctctactccacgttcctacaccgattaacctcaccgcgatacccaaatactaattctactccacgttcctacaccgattaacctcactataatacccaaatactacctctactccacgttcctacaccgattaacctcaccgcgatacccaaatactaattctactccacgttcctacaccgattaacctcaccgcgatacccgaattctacctctactccacgttcctatacctattaacctcaccgcgatacccgaatactacttctactccgtattcctacaccaattaacctcaccgcgatacccgaatactacctatactccacgttcctacaccgattaacctcaccacgatactaaaatactacctatactccacgttcctataccgattaacctcaccacgataccgaaatactacctatactccacattcctacacc

SEQ ID NO: 12047 - DNA, 585 bp, Artificial Sequence
  chemically treated genomic DNA (Homo sapiens) CpG-island No: 12047
taagtatcggttttgggggttgtgtaagaagggcgattattgtaagtttttgtatcggttgattttttgcgatgttcgaatgttatttttattttacgttttcgtattagttgattttattgtgatgtttaaatgttgtttttattttacgtttttatatcggttgattttatcgcgatgtttaagtgttaattttattttacgtttttgtatcggttgattttattgtgatgtttaaatgttgtttttattttacgtttttatatcggttgattttatcgcgatgtttaagtgttaattttattttacgtttttgtatcggttgattttatcgcgatgttcgaattttatttttattttacgtttttgtatttgttgattttatcgcgatgttcgaatgttatttttatttcgtgtttttgtattagttgattttatcgcgatgttcgaatgttatttgtattttacgtttttatatcggttgattttattacgatgttggaatgttatttgtattttacgtttttgtatcggttgattttattacgatgtcggaatgttatttgtattttatatttttgtatt

SEQ ID NO: 12048 - DNA, 585 bp, Artificial Sequence
  chemically treated genomic DNA (Homo sapiens) CpG-island No: 12048
aatacaaaaatataaaatacaaataacattccgacatcgtaataaaatcaaccgatacaaaaacgtaaaatacaaataacattccaacatcgtaataaaatcaaccgatataaaaacgtaaaatacaaataacattcgaacatcgcgataaaatcaactaatacaaaaacacgaaataaaaataacattcgaacatcgcgataaaatcaacaaatacaaaaacgtaaaataaaaataaaattcgaacatcgcgataaaatcaaccgatacaaaaacgtaaaataaaattaacacttaaacatcgcgataaaatcaaccgatataaaaacgtaaaataaaaacaacatttaaacatcacaataaaatcaaccgatacaaaaacgtaaaataaaattaacacttaaacatcgcgataaaatcaaccgatataaaaacgtaaaataaaaacaacatttaaacatcacaataaaatcaactaatacgaaaacgtaaaataaaaataacattcgaacatcgcaaaaaatcaaccgatacaaaaacttacaataatcgcccttcttacacaacccccaaaaccgatactta

SEQ ID NO: 12049 - DNA, 754 bp, Artificial Sequence
  chemically treated genomic DNA (Homo sapiens) CpG-island No: 12049
ggtgagatcggtttgcgggggcgcgggtttttttttagtagttttacgttcgtttggttcggcgtttgaggggtagcgacgtagtttacgtcgtttttagagtttgtcgggaggggcgttacgtgatttcgggtgcggttttcgcgttgaagttttggagcgaattcgaattttttttttaggttcgttttttgcggttcgtagcgggtaggttggtttggatgtcggcgatagagagattggggcggcgttcggggttttagagagttaagacggcgtttatcggatagaggtagagtacggtttttattaacgttagtaagaaggtaacggcgaagatcgcgaagtttaatatggttttgtcgtttagggagttacgtttcggatcggtcgttttagtagtagcgttttagtttggtttaatttaaggtatagcgtgtgggcgggggtatttcgcgggattcggaaattaacgggtcgttgggggcgtgatcgaggtttgcggtcggcgttagaggaaagagtaatggatcgtcgaggagtcggggcgcgggtttttgagcgtagtaggtcgaggttgaggtcgtttagcgttagtttttatcgtaaggcggggatttcggtgtatacgattttagatagaatatgttcgcgatttcggatcgggttgttggcgaaagtagagtttagttttttgagaaaagttaggagttagtagtgttttgttcgtttaatagttttcgtaatggattta

SEQ ID NO: 12050 - DNA, 754 bp, Artificial Sequence
  chemically treated genomic DNA (Homo sapiens) CpG-island No: 12050
taaatccattacgaaaactattaaacgaacaaaacactactaactcctaacttttctcaaaaaactaaactctactttcgccaacaacccgatccgaaatcgcgaacatattctatctaaaatcgtatacaccgaaatccccgccttacgataaaaactaacgctaaacgacctcaacctcgacctactacgctcaaaaacccgcgccccgactcctcgacgatccattactctttcctctaacgccgaccgcaaacctcgatcacgcccccaacgacccgttaatttccgaatcccgcgaaatacccccgcccacacgctataccttaaattaaaccaaactaaaacgctactactaaaacgaccgatccgaaacgtaactccctaaacgacaaaaccatattaaacttcgcgatcttcgccgttaccttcttactaacgttaataaaaaccgtactctacctctatccgataaacgccgtcttaactctctaaaaccccgaacgccgccccaatctctctatcgccgacatccaaaccaacctacccgctacgaaccgcaaaaaacgaacctaaaaaaaaaattcgaattcgctccaaaacttcaacgcgaaaaccgcacccgaaatcacgtaacgcccctcccgacaaactctaaaaacgacgtaaactacgtcgctacccctcaaacgccgaaccaaacgaacgtaaaactactaaaaaaaaacccgcgcccccgcaaaccgatctcacc

SEQ ID NO: 12051 - DNA, 754 bp, Artificial Sequence
  chemically treated genomic DNA (Homo sapiens) CpG-island No: 12051
tgaatttattgcgaaaattgttgggcggatagagtattattaatttttaattttttttagaaagttgggttttgttttcgttagtaattcggttcgaagtcgcgggtatattttgtttgaaatcgtgtgtatcgaaattttcgttttgcggtggaggttggcgttaggcggttttagtttcggtttgttgcgtttaggaattcgcgtttcggtttttcggcgatttattgtttttttttttggcgtcggtcgtaggtttcggttacgtttttagcggttcgttggttttcgggtttcgcggggtgttttcgtttatacgttatgttttaaattgggttaggttgaggcgttgttgttggagcggtcgattcgagacgtggttttttgggcggtagaattatgttggatttcgcgattttcgtcgttatttttttgttggcgttggtgggagtcgtgttttatttttattcggtgagcgtcgttttggttttttggggtttcgggcgtcgttttagtttttttgtcgtcggtatttaggttaatttgttcgttgcgggtcgtagggggcgggtttgagaggagggttcgggttcgttttagagttttagcgcggggatcgtattcggagttacgtgacgtttttttcggtaagttttgagagcgacgtgggttgcgtcgttattttttaggcgtcgggttaggcgggcgtagagttgttgaggaaaagttcgcgttttcgtaggtcggttttatt

SEQ ID NO: 12052 - DNA, 754 bp, Artificial Sequence
  chemically treated genomic DNA (Homo sapiens) CpG-island No: 12052
aataaaaccgacctacgaaaacgcgaacttttcctcaacaactctacgcccgcctaacccgacgcctaaaaaataacgacgcaacccacgtcgctctcaaaacttaccgaaaaaaacgtcacgtaactccgaatacgatccccgcgctaaaactctaaaacgaacccgaaccctcctctcaaacccgccccctacgacccgcaacgaacaaattaacctaaataccgacgacaaaaaaactaaaacgacgcccgaaaccccaaaaaaccaaaacgacgctcaccgaataaaaataaaacacgactcccaccaacgccaacaaaaaaataacgacgaaaatcgcgaaatccaacataattctaccgcccaaaaaaccacgtctcgaatcgaccgctccaacaacaacgcctcaacctaacccaatttaaaacataacgtataaacgaaaacaccccgcgaaacccgaaaaccaacgaaccgctaaaaacgtaaccgaaacctacgaccgacgccaaaaaaaaaaacaataaatcgccgaaaaaccgaaacgcgaattcctaaacgcaacaaaccgaaactaaaaccgcctaacgccaacctccaccgcaaaacgaaaatttcgatacacacgatttcaaacaaaatatacccgcgacttcgaaccgaattactaacgaaaacaaaacccaactttctaaaaaaaattaaaaattaataatactctatccgcccaacaattttcgcaataaattca

SEQ ID NO: 12053 - DNA, 534 bp, Artificial Sequence
  chemically treated genomic DNA (Homo sapiens) CpG-island No: 12053
gtcgtgtcggtcgtcgtcgtcgttttaggttcgcgggttgttgatagagatacgcgtcgtggtgcgtatcgagtttttttaggacggttatagtttgtgttcgggtcgggagttgggtaggtgaggacgggcggggttcggcggaattttttcggacgcgcggggcgggacgtgggcgtcgataagtgtcggcgcgcggcggcgaggttgaagtggcgttgttgttgtcgataacgcgcgttgtgatttggtataaatttgggtgtcgacggtaagtagggtagtcgagtcgtattagcgttttttttacgcgtcgcgtttagtaagcgagtggtggtaattcgatggcggtttcggaggcgcggatattttttttagttttttcgttttttgtggcgtttcgaatggttatttaacgagagaaggtgcgggtcgcgttttgttttttatttcgagtagcgggtttgaaaattagaggtttgtggagtcgattttgtattttttttttaatttttgcgatttttttggtttgtt

SEQ ID NO: 12054 - DNA, 534 bp, Artificial Sequence
  chemically treated genomic DNA (Homo sapiens) CpG-island No: 12054
aacaaaccaaaaaaatcgcaaaaattaaaaaaaaaatacaaaatcgactccacaaacctctaattttcaaacccgctactcgaaataaaaaacaaaacgcgacccgcaccttctctcgttaaataaccattcgaaacgccacaaaaaacgaaaaaactaaaaaaaatatccgcgcctccgaaaccgccatcgaattaccaccactcgcttactaaacgcgacgcgtaaaaaaaacgctaatacgactcgactaccctacttaccgtcgacacccaaatttataccaaatcacaacgcgcgttatcgacaacaacaacgccacttcaacctcgccgccgcgcgccgacacttatcgacgcccacgtcccgccccgcgcgtccgaaaaaattccgccgaaccccgcccgtcctcacctacccaactcccgacccgaacacaaactataaccgtcctaaaaaaactcgatacgcaccacgacgcgtatctctatcaacaacccgcgaacctaaaacgacgacgacgaccgacacgac

SEQ ID NO: 12055 - DNA, 534 bp, Artificial Sequence
  chemically treated genomic DNA (Homo sapiens) CpG-island No: 12055
ggtagattaagaaagtcgtaagagttgaaggaaaaatgtaaagtcggttttatagatttttggtttttagattcgttgttcggggtgaaaggtagagcgcggttcgtattttttttcgttaaatagttattcgaaacgttatagagaacgaaagggttgaggaaagtgttcgcgttttcgggatcgttatcgagttattattattcgtttgttgggcgcggcgcgtggagggggcgttggtgcgattcggttgttttatttgtcgtcggtatttaagtttgtgttaagttataacgcgcgttatcggtagtagtaacgttattttagtttcgtcgtcgcgcgtcggtatttatcggcgtttacgtttcgtttcgcgcgttcgggaaggtttcgtcgggtttcgttcgtttttatttgtttagttttcggttcgggtataggttgtagtcgttttggaagggttcggtgcgtattacggcgcgtatttttgttagtagttcgcgggtttggggcggcggcggcggtcggtacggt

SEQ ID NO: 12056 - DNA, 534 bp, Artificial Sequence
  chemically treated genomic DNA (Homo sapiens) CpG-island No: 12056
accgtaccgaccgccgccgccgccccaaacccgcgaactactaacaaaaatacgcgccgtaatacgcaccgaacccttccaaaacgactacaacctatacccgaaccgaaaactaaacaaataaaaacgaacgaaacccgacgaaaccttcccgaacgcgcgaaacgaaacgtaaacgccgataaataccgacgcgcgacgacgaaactaaaataacgttactactaccgataacgcgcgttataacttaacacaaacttaaataccgacgacaaataaaacaaccgaatcgcaccaacgccccctccacgcgccgcgcccaacaaacgaataataataactcgataacgatcccgaaaacgcgaacactttcctcaaccctttcgttctctataacgtttcgaataactatttaacgaaaaaaaatacgaaccgcgctctacctttcaccccgaacaacgaatctaaaaaccaaaaatctataaaaccgactttacatttttccttcaactcttacgactttcttaatctacc

SEQ ID NO: 12057 - DNA, 673 bp, Artificial Sequence
  chemically treated genomic DNA (Homo sapiens) CpG-island No: 12057
aataagaagacggcgttaggagttaagtggttaagtcggttttttttcgttttcggaatcgtttgttttagtttttcgtagggttggtatcgttcgtgttcggagcggatgtcggacggcggaatcgcgttgttttttaatagggaagtgttacgggatcgggattcgggagattcgggtttcgtttgcgagtttcggttttttttttttcgagatggggtcgcggtcggttatttaaggaggggtttcgtcgggaggggtcgggggtcggggtcgggttcgggttgcgttttttcggggtttcgggttttcggtttcggcggcgcgggtttatgatacgtcgtagagggtgttggcgttcggttttacggtttttgttcgggttgtcgggttcgggagcgaaaggttggtttttggggagtttagagaacgttgtgtcgcgagttttatatgagtcggtgtttggtagaagttcgcgtcgttcgcgtttaaatcgttcgtttcgtttattttacggtcggcgttttttaaaattcgaatttagcgatttttagtggttgattttggaacgttttttacgtagagcgattgtaggtagggttaatgagagtatgtatcgagatataaatatagcggcgatgataggaggataggggagattgatggtaaaatt

SEQ ID NO: 12058 - DNA, 673 bp, Artificial Sequence
  chemically treated genomic DNA (Homo sapiens) CpG-island No: 12058
aattttaccatcaatctcccctatcctcctatcatcgccgctatatttatatctcgatacatactctcattaaccctacctacaatcgctctacgtaaaaaacgttccaaaatcaaccactaaaaatcgctaaattcgaattttaaaaaacgccgaccgtaaaataaacgaaacgaacgatttaaacgcgaacgacgcgaacttctaccaaacaccgactcatataaaactcgcgacacaacgttctctaaactccccaaaaaccaacctttcgctcccgaacccgacaacccgaacaaaaaccgtaaaaccgaacgccaacaccctctacgacgtatcataaacccgcgccgccgaaaccgaaaacccgaaaccccgaaaaaacgcaacccgaacccgaccccgacccccgacccctcccgacgaaacccctccttaaataaccgaccgcgaccccatctcgaaaaaaaaaaaaccgaaactcgcaaacgaaacccgaatctcccgaatcccgatcccgtaacacttccctattaaaaaacaacgcgattccgccgtccgacatccgctccgaacacgaacgataccaaccctacgaaaaactaaaacaaacgattccgaaaacgaaaaaaaaccgacttaaccacttaactcctaacgccgtcttcttatt

SEQ ID NO: 12059 - DNA, 673 bp, Artificial Sequence
  chemically treated genomic DNA (Homo sapiens) CpG-island No: 12059
gattttattattagttttttttgtttttttattatcgtcgttatatttgtgtttcggtgtatatttttattggttttatttgtagtcgttttacgtaaggggcgttttagagttagttattgggagtcgttggattcgggttttaaaaaacgtcggtcgtgaagtgggcggagcgagcgatttgaacgcgagcggcgcggatttttgttaagtatcggtttatgtgaggttcgcggtatagcgttttttgggttttttagaagttagtttttcgttttcggattcggtagttcgagtaggagtcgtgggatcgggcgttagtattttttgcggcgtgttatgggttcgcgtcgtcggagtcgaaagttcgaggtttcgaggaggcgtagttcgagttcgatttcgattttcggtttttttcggcggggtttttttttaggtaatcggtcgcggttttatttcgaagaggagaaaatcgaggttcgtaggcggagttcggatttttcgagtttcgatttcgtggtatttttttgttgggggataacgcggtttcgtcgttcggtattcgtttcgggtacgggcggtgttagttttgcgaggggttggagtaggcggtttcgaaagcgggaagggatcggtttagttatttggtttttaacgtcgtttttttgtt

SEQ ID NO: 12060 - DNA, 673 bp, Artificial Sequence
  chemically treated genomic DNA (Homo sapiens) CpG-island No: 12060
aacaaaaaaacgacgttaaaaaccaaataactaaaccgatcccttcccgctttcgaaaccgcctactccaacccctcgcaaaactaacaccgcccgtacccgaaacgaataccgaacgacgaaaccgcgttatcccccaacaaaaaaataccacgaaatcgaaactcgaaaaatccgaactccgcctacgaacctcgattttctcctcttcgaaataaaaccgcgaccgattacctaaaaaaaaaccccgccgaaaaaaaccgaaaatcgaaatcgaactcgaactacgcctcctcgaaacctcgaactttcgactccgacgacgcgaacccataacacgccgcaaaaaatactaacgcccgatcccacgactcctactcgaactaccgaatccgaaaacgaaaaactaacttctaaaaaacccaaaaaacgctataccgcgaacctcacataaaccgatacttaacaaaaatccgcgccgctcgcgttcaaatcgctcgctccgcccacttcacgaccgacgttttttaaaacccgaatccaacgactcccaataactaactctaaaacgccccttacgtaaaacgactacaaataaaaccaataaaaatatacaccgaaacacaaatataacgacgataataaaaaaacaaaaaaaactaataataaaatc

SEQ ID NO: 12061 - DNA, 686 bp, Artificial Sequence
  chemically treated genomic DNA (Homo sapiens) CpG-island No: 12061
tttattgggggtttattcgttttggtaagttcgcgtcgggttttcggaagttacggtgggcggtttttttcgtaggggggtcgatttcggttttcgttcgtcggtttttcgttttttttttttcggaattcgggtttttttttttttcggtattttcgttttttgtttttgttcgtttcgattcggattcgtcgtcggatttattttcggattttcgtttttagttttgttcgttttgtttcgtttcggtttttttttttcggatttcgttttcgcgtttttttttgggatttcgggtttttagtttcgcgtttcgttcgttcgtttttgttttcgtttttcggtttttattcgtcgttgtcgttaagtttcgttttttttttcgttagttttttcgcgtttaggtgacggcgggtgatggaggattttagggcgggcgtttggagggataacgaagtttcgagcggtatttgcggagtcggcgcggggtcggttttttttttttggttgggtgtgttcgggtttcgtcgttttttttcgtgttggtttttcggaggtcgcgtttattcgcgttttgttttgtttcgtcgtttaaagttcgggttttgaattttgtttttttaggatttttattattttcggtttcgtggagttgggcgaggtagtttttttaattttattttatt

SEQ ID NO: 12062 - DNA, 686 bp, Artificial Sequence
  chemically treated genomic DNA (Homo sapiens) CpG-island No: 12062
aataaaataaaattaaaaaaactacctcgcccaactccacgaaaccgaaaataataaaaatcctaaaaaaacaaaattcaaaacccgaactttaaacgacgaaacaaaacaaaacgcgaataaacgcgacctccgaaaaaccaacacgaaaaaaaacgacgaaacccgaacacacccaaccaaaaaaaaaaaaccgaccccgcgccgactccgcaaataccgctcgaaacttcgttatccctccaaacgcccgccctaaaatcctccatcacccgccgtcacctaaacgcgaaaaaactaacgaaaaaaaaaacgaaacttaacgacaacgacgaataaaaaccgaaaaacgaaaacaaaaacgaacgaacgaaacgcgaaactaaaaacccgaaatcccaaaaaaaaacgcgaaaacgaaatccgaaaaaaaaaaaccgaaacgaaacaaaacgaacaaaactaaaaacgaaaatccgaaaataaatccgacgacgaatccgaatcgaaacgaacaaaaacaaaaaacgaaaataccgaaaaaaaaaaaaacccgaattccgaaaaaaaaaaaacgaaaaaccgacgaacgaaaaccgaaatcgacccccctacgaaaaaaaccgcccaccgtaacttccgaaaacccgacgcgaacttaccaaaacgaataaacccccaataaa

SEQ ID NO: 12063 - DNA, 686 bp, Artificial Sequence
  chemically treated genomic DNA (Homo sapiens) CpG-island No: 12063
agtaaaatggggttaaggaggttgtttcgtttagttttacggagtcggaggtgatgaaggttttggaagagtagaatttagaattcgagttttgggcggcggagtaggatagggcgcgggtgggcgcggttttcgggaggttagtacgagggggagcggcggggttcggatatatttagttagaaggaggaggtcgatttcgcgtcgatttcgtagatgtcgttcgggatttcgttgtttttttaggcgttcgttttggggttttttattattcgtcgttatttgggcgcggggaagttggcgggaggggaggcggggtttggcggtagcggcgggtgggggtcggggagcgggggtaggggcgggcggacggagcgcggggttggggattcggggttttagaagggggcgcggggacggggttcgaggagagggggtcggggcggggtagggcggatagggttgggggcggaggttcgggggtgggttcggcggcgagttcgggtcggggcggataggagtagggggcgggggtgtcggggaggaagggggttcgggtttcgggagggagggggcgggggatcggcgggcggggatcggggtcggtttttttgcggggagggtcgtttatcgtgattttcgggggttcggcgcgggtttgttagggcgggtgaatttttaatgga

SEQ ID NO: 12064 - DNA, 686 bp, Artificial Sequence
  chemically treated genomic DNA (Homo sapiens) CpG-island No: 12064
tccattaaaaattcacccgccctaacaaacccgcgccgaacccccgaaaatcacgataaacgaccctccccgcaaaaaaaccgaccccgatccccgcccgccgatcccccgccccctccctcccgaaacccgaacccccttcctccccgacacccccgccccctactcctatccgccccgacccgaactcgccgccgaacccacccccgaacctccgcccccaaccctatccgccctaccccgccccgaccccctctcctcgaaccccgtccccgcgcccccttctaaaaccccgaatccccaaccccgcgctccgtccgcccgcccctacccccgctccccgacccccacccgccgctaccgccaaaccccgcctcccctcccgccaacttccccgcgcccaaataacgacgaataataaaaaaccccaaaacgaacgcctaaaaaaacaacgaaatcccgaacgacatctacgaaatcgacgcgaaatcgacctcctccttctaactaaatatatccgaaccccgccgctccccctcgtactaacctcccgaaaaccgcgcccacccgcgccctatcctactccgccgcccaaaactcgaattctaaattctactcttccaaaaccttcatcacctccgactccgtaaaactaaacgaaacaacctccttaaccccattttact

SEQ ID NO: 12065 - DNA, 785 bp, Artificial Sequence
  chemically treated genomic DNA (Homo sapiens) CpG-island No: 12065
gagtatacggtgcgcgttattatcgagcgcgtgaggttgtcggtgaacgtgttggtgtttagtcggtcgtcgcgtaatttttacgatttgtattcggtgcgggagggttattgttataagttggttagtattatttttaagacggtggtgttggggttggcgttgcgtcgcgagggttcggcgtcgttgtattttttgttgtttacggatacgtcgcgtttcgcgttgtcgtagggtttgttggtcggggattcgcgcgtcgagcgtttggtgcgcgatagcgttttttattgtcgcgagcgtttcgatttcgacgagtattttacggtcgtgcgcgaggcgttagcggagttcgtcgaagattgcgttattcgcgtcgcgcgcgtttttgtttgttcgcgtcggcgtttcgggttcgttcgcgttttcggttacgttagtttttcgtcggcgagggcgattaggagtacgtgagtttcgattgggtagtcgcgttcgagttcgtcgcgtcgttcgtcgagattttttacgaggagttgtgggcgtattaggggttcgaggtttcgttcggttcgtttttagggttcgattttatttttttcggggtcgcgggatcgtcgcgtcgggagtcggaagcgtcgtcgtttttagttttttttaaattcgaggcggtgagtgagcgcgttgggggtcgagtttcgggtttagttagggtttaaagttcgtttttttgggtttcggtttcggagtatgtggtagacgaggtgtttttttcggcggggtgg

SEQ ID NO: 12066 - DNA, 785 bp, Artificial Sequence
  chemically treated genomic DNA (Homo sapiens) CpG-island No: 12066
ccaccccgccgaaaaaaacacctcgtctaccacatactccgaaaccgaaacccaaaaaaacgaactttaaaccctaactaaacccgaaactcgacccccaacgcgctcactcaccgcctcgaatttaaaaaaaactaaaaacgacgacgcttccgactcccgacgcgacgatcccgcgaccccgaaaaaaataaaatcgaaccctaaaaacgaaccgaacgaaacctcgaacccctaatacgcccacaactcctcgtaaaaaatctcgacgaacgacgcgacgaactcgaacgcgactacccaatcgaaactcacgtactcctaatcgccctcgccgacgaaaaactaacgtaaccgaaaacgcgaacgaacccgaaacgccgacgcgaacaaacaaaaacgcgcgcgacgcgaataacgcaatcttcgacgaactccgctaacgcctcgcgcacgaccgtaaaatactcgtcgaaatcgaaacgctcgcgacaataaaaaacgctatcgcgcaccaaacgctcgacgcgcgaatccccgaccaacaaaccctacgacaacgcgaaacgcgacgtatccgtaaacaacaaaaaatacaacgacgccgaaccctcgcgacgcaacgccaaccccaacaccaccgtcttaaaaataatactaaccaacttataacaataaccctcccgcaccgaatacaaatcgtaaaaattacgcgacgaccgactaaacaccaacacgttcaccgacaacctcacgcgctcgataataacgcgcaccgtatactc

SEQ ID NO: 12067 - DNA, 785 bp, Artificial Sequence
  chemically treated genomic DNA (Homo sapiens) CpG-island No: 12067
ttatttcgtcgaggaagatatttcgtttgttatatatttcggggtcggggtttaggagaacgggttttgggttttggttggattcgggattcggtttttagcgcgtttatttatcgtttcggatttgggagggattggaggcggcggcgttttcggttttcgacgcggcggtttcgcggtttcgaaggagatgagatcgagttttgggggcgggtcggacgaggtttcgggtttttggtgcgtttataatttttcgtaggggatttcggcgggcggcgcggcgggttcgggcgcggttgtttagtcggggtttacgtatttttggtcgttttcgtcggcgggaggttagcgtggtcgggggcgcgggcgagttcggggcgtcggcgcgggtaggtagaggcgcgcgcggcgcgggtggcgtagttttcggcgagtttcgttggcgtttcgcgtacggtcgtggagtattcgtcggggtcgaagcgttcgcggtagtaggaggcgttgtcgcgtattaggcgttcgacgcgcgggttttcggttagtaggttttgcggtagcgcgaagcgcggcgtgttcgtgagtagtaggaagtgtagcggcgtcgggttttcgcggcgtagcgttagttttagtattatcgttttggagatgatgttaattagtttgtagtaatgattttttcgtatcgggtgtaggtcgtaggggttgcgcggcggtcggttgggtattagtacgtttatcggtagttttacgcgttcgatgatggcgcgtatcgtgtgttt

SEQ ID NO: 12068 - DNA, 785 bp, Artificial Sequence
  chemically treated genomic DNA (Homo sapiens) CpG-island No: 12068
aaacacacgatacgcgccatcatcgaacgcgtaaaactaccgataaacgtactaatacccaaccgaccgccgcgcaacccctacgacctacacccgatacgaaaaaatcattactacaaactaattaacatcatctccaaaacgataatactaaaactaacgctacgccgcgaaaacccgacgccgctacacttcctactactcacgaacacgccgcgcttcgcgctaccgcaaaacctactaaccgaaaacccgcgcgtcgaacgcctaatacgcgacaacgcctcctactaccgcgaacgcttcgaccccgacgaatactccacgaccgtacgcgaaacgccaacgaaactcgccgaaaactacgccacccgcgccgcgcgcgcctctacctacccgcgccgacgccccgaactcgcccgcgcccccgaccacgctaacctcccgccgacgaaaacgaccaaaaatacgtaaaccccgactaaacaaccgcgcccgaacccgccgcgccgcccgccgaaatcccctacgaaaaattataaacgcaccaaaaacccgaaacctcgtccgacccgcccccaaaactcgatctcatctccttcgaaaccgcgaaaccgccgcgtcgaaaaccgaaaacgccgccgcctccaatccctcccaaatccgaaacgataaataaacgcgctaaaaaccgaatcccgaatccaaccaaaacccaaaacccgttctcctaaaccccgaccccgaaatatataacaaacgaaatatcttcctcgacgaaataa

SEQ ID NO: 12069 - DNA, 548 bp, Artificial Sequence
  chemically treated genomic DNA (Homo sapiens) CpG-island No: 12069
gttgattttcgtaggagtcgttaatttttcgggtattttcgagtgtttagagacgggaaggagcggtgggtttatgtttttttgggttattttcgggcgttcggtttttttttttttcgggttatttttattagcgttagtttcgtacgttttcgtaaggtcggttattttattttcggaggtcgttttttgtttcgtcgtttattttttatttgtagtagttgtttttaaggttattcgtagcgatgttggtcgcggaattattacgataacgtttttttggtttgtcggaatcgtttttttgttttcgttggcgttatttttattggggggggcgtggtcgcggcgtaggcgcgttgggtggtttagaagcgaattttgtatcgcgaagtttgagaggtaggtagttgcggcgttgggttggcggcggcgagtttacgtgtttttcgcggtcggttgaaatcgttggcgggcgttggttgagaggtgaggggtggtggtttagaggttcgatttgggaggttggggtttagagagtgagtagggga

SEQ ID NO: 12070 - DNA, 548 bp, Artificial Sequence
  chemically treated genomic DNA (Homo sapiens) CpG-island No: 12070
tcccctactcactctctaaaccccaacctcccaaatcgaacctctaaaccaccacccctcacctctcaaccaacgcccgccaacgatttcaaccgaccgcgaaaaacacgtaaactcgccgccgccaacccaacgccgcaactacctacctctcaaacttcgcgatacaaaattcgcttctaaaccacccaacgcgcctacgccgcgaccacgccccccccaataaaaataacgccaacgaaaacaaaaaaacgattccgacaaaccaaaaaaacgttatcgtaataattccgcgaccaacatcgctacgaataaccttaaaaacaactactacaaataaaaaataaacgacgaaacaaaaaacgacctccgaaaataaaataaccgaccttacgaaaacgtacgaaactaacgctaataaaaataacccgaaaaaaaaaaaaaccgaacgcccgaaaataacccaaaaaaacataaacccaccgctccttcccgtctctaaacactcgaaaatacccgaaaaattaacgactcctacgaaaatcaac

SEQ ID NO: 12071 - DNA, 548 bp, Artificial Sequence
  chemically treated genomic DNA (Homo sapiens) CpG-island No: 12071
ttttttatttattttttgagttttagttttttaggtcggatttttgggttattattttttattttttagttagcgttcgttaacggttttaatcggtcgcggggagtacgtggattcgtcgtcgttagtttagcgtcgtagttatttgttttttaggtttcgcggtgtagaattcgtttttgaattatttagcgcgtttgcgtcgcggttacgttttttttagtggaagtgacgttaacggaagtaggaaggcggtttcggtaagttaagggggcgttgtcgtgatgatttcgcggttagtatcgttgcgagtggttttgaaggtagttgttgtaggtgaagagtaggcggcggggtagagagcggttttcgagggtaaggtggtcggttttgcgaaggcgtgcggggttggcgttggtgggaatggttcggaaggaagggaggtcgggcgttcgaaggtggtttagaagggtatggatttatcgttttttttcgtttttgggtattcgaggatattcggggggttggcggtttttgcgagagttagt

SEQ ID NO: 12072 - DNA, 548 bp, Artificial Sequence
  chemically treated genomic DNA (Homo sapiens) CpG-island No: 12072
actaactctcgcaaaaaccgccaaccccccgaatatcctcgaatacccaaaaacgaaaaaaaacgataaatccatacccttctaaaccaccttcgaacgcccgacctcccttccttccgaaccattcccaccaacgccaaccccgcacgccttcgcaaaaccgaccaccttaccctcgaaaaccgctctctaccccgccgcctactcttcacctacaacaactaccttcaaaaccactcgcaacgatactaaccgcgaaatcatcacgacaacgcccccttaacttaccgaaaccgccttcctacttccgttaacgtcacttccactaaaaaaaacgtaaccgcgacgcaaacgcgctaaataattcaaaaacgaattctacaccgcgaaacctaaaaaacaaataactacgacgctaaactaacgacgacgaatccacgtactccccgcgaccgattaaaaccgttaacgaacgctaactaaaaaataaaaaataataacccaaaaatccgacctaaaaaactaaaactcaaaaaataaataaaaaa

SEQ ID NO: 12073 - DNA, 827 bp, Artificial Sequence
  chemically treated genomic DNA (Homo sapiens) CpG-island No: 12073
ttttattcgtttattttttttttttttcgagtttttttttttttttttcggttttttttttttttttaaattattcgaaatttaagacgtgtagcgtttgtaggtgcgcgcgggtcggcgcgggttttgggcgagtttgggattgtcgggtttcgtaggtattgattagttgggcgcgcgcgtgagtgacggcgcggttgttatggtagtcgttgagcgtcgtcgaggataaggttgtagggcggcgtgaatgggcggcgttacgcgttggcgttagagagtttgtttcggggtttcggtttcgtttcgtcgcggtttggttcgtcgtcgtcgtcgtcgttatcgtcgtcgttaatttattatttgttagggattattcgcggggttacggacggaatggatatagttgtgagaataaaattcgggaaagaaaggcgaacgttttttattgcgttagatgtgtagggaggattttgagacgcgtttttcgttttcgtaggtttttttcgtttttcggcgtattacgcgggggtggtaaaggcggtttggttagcgcggagttttcggttcggagttgtttttgattatcgcgaggggttcggacgcgagagtcgtcgcggggtttgttttagaggcggagtgagtgagttttggagttaggttgggggattttacgggtcggtttgtcgttgttacggggtgggggcgtttcggtggggagtcgaggggaatcgtattaatatttattagcggaagttttgtatatttttttatcgttcgcggatttagttttttttttagttggggtcgtttgaattttggaggtt

SEQ ID NO: 12074 - DNA, 827 bp, Artificial Sequence
  chemically treated genomic DNA (Homo sapiens) CpG-island No: 12074
aacctccaaaattcaaacgaccccaactaaaaaaaaaactaaatccgcgaacgataaaaaaatatacaaaacttccgctaataaatattaatacgattcccctcgactccccaccgaaacgcccccaccccgtaacaacgacaaaccgacccgtaaaatcccccaacctaactccaaaactcactcactccgcctctaaaacaaaccccgcgacgactctcgcgtccgaacccctcgcgataatcaaaaacaactccgaaccgaaaactccgcgctaaccaaaccgcctttaccacccccgcgtaatacgccgaaaaacgaaaaaaacctacgaaaacgaaaaacgcgtctcaaaatcctccctacacatctaacgcaataaaaaacgttcgcctttctttcccgaattttattctcacaactatatccattccgtccgtaaccccgcgaataatccctaacaaataataaattaacgacgacgataacgacgacgacgacgacgaaccaaaccgcgacgaaacgaaaccgaaaccccgaaacaaactctctaacgccaacgcgtaacgccgcccattcacgccgccctacaaccttatcctcgacgacgctcaacgactaccataacaaccgcgccgtcactcacgcgcgcgcccaactaatcaatacctacgaaacccgacaatcccaaactcgcccaaaacccgcgccgacccgcgcgcacctacaaacgctacacgtcttaaatttcgaataatttaaaaaaaaaaaaaaaaccgaaaaaaaaaaaaaaaaactcgaaaaaaaaaaaaaataaacgaataaaa

SEQ ID NO: 12075 - DNA, 827 bp, Artificial Sequence
  chemically treated genomic DNA (Homo sapiens) CpG-island No: 12075
ggtttttaaagtttaaacggttttagttagagggagggttagattcgcgggcggtgggaaggtgtgtagggttttcgttggtgggtgttggtgcggtttttttcgattttttatcgggacgtttttatttcgtggtagcgatagatcggttcgtaaggttttttagtttggttttaggatttatttatttcgtttttagggtaggtttcgcggcggttttcgcgttcgggtttttcgcggtaattagaagtagtttcgggtcgggagtttcgcgttggttaggtcgtttttgttattttcgcgtgatgcgtcggggggcgggaggagtttgcgggggcggggggcgcgttttaaggttttttttgtatatttggcgtaatggggagcgttcgtttttttttttcgggttttgtttttatagttgtgtttatttcgttcgtgatttcgcgagtgatttttgataggtgatgaattggcggcggcggtggcggcggcggcggcggcgggttaggtcgcggcggggcggagtcggagtttcggagtagattttttggcgttagcgcgtgacgtcgtttatttacgtcgttttgtagttttgttttcgacggcgtttagcggttgttatggtaatcgcgtcgttatttacgcgcgcgtttagttgattaatgtttgcgaggttcggtagttttaggttcgtttagagttcgcgtcggttcgcgcgtatttgtagacgttgtacgttttaagtttcgagtgatttggggaaggaaagaggatcgagaagaaaagaaaagggttcgggggggggggggggtgggcgggtgagg

SEQ ID NO: 12076 - DNA, 827 bp, Artificial Sequence
  chemically treated genomic DNA (Homo sapiens) CpG-island No: 12076
cctcacccgcccacccccccccccccccgaacccttttcttttcttctcgatcctctttccttccccaaatcactcgaaacttaaaacgtacaacgtctacaaatacgcgcgaaccgacgcgaactctaaacgaacctaaaactaccgaacctcgcaaacattaatcaactaaacgcgcgcgtaaataacgacgcgattaccataacaaccgctaaacgccgtcgaaaacaaaactacaaaacgacgtaaataaacgacgtcacgcgctaacgccaaaaaatctactccgaaactccgactccgccccgccgcgacctaacccgccgccgccgccgccgccaccgccgccgccaattcatcacctatcaaaaatcactcgcgaaatcacgaacgaaataaacacaactataaaaacaaaacccgaaaaaaaaaaacgaacgctccccattacgccaaatatacaaaaaaaaccttaaaacgcgccccccgcccccgcaaactcctcccgccccccgacgcatcacgcgaaaataacaaaaacgacctaaccaacgcgaaactcccgacccgaaactacttctaattaccgcgaaaaacccgaacgcgaaaaccgccgcgaaacctaccctaaaaacgaaataaataaatcctaaaaccaaactaaaaaaccttacgaaccgatctatcgctaccacgaaataaaaacgtcccgataaaaaatcgaaaaaaaccgcaccaacacccaccaacgaaaaccctacacaccttcccaccgcccgcgaatctaaccctccctctaactaaaaccgtttaaactttaaaaacc

SEQ ID NO: 12077 - DNA, 626 bp, Artificial Sequence
  chemically treated genomic DNA (Homo sapiens) CpG-island No: 12077
tttttcgtaaattttttttttattattcgcgttttttttttttattttttttttttttttttttttttttttttatttttcgtttcgtatttttattttacgtttttcgttcgtcgtttttcgtttttcgtttttcgttagtttcgtatttattgtattgtattttatttattattttagtatgtcgcgtttcgtttatttcgcggggattggttgcgaacgcggaagaattaagtttacgtttacgttcgcgtttattaatggaagcgttcgttcgttttgatagacgtgttatttttcgttaatggggacgaagggaagttttagcgtgtggtttcggcgagtgcggataaaagtcgtttcgtcgggttcgggttttattttgagtcgagttcggtgttaagcgtagttagtttagtaggcggtagcggcggtttgagttttagggtagttagtttttttcggtttcgttttttttcgcggttagtatgaaagtttttagtttcgtgaggttcgttaggaaaaatagttgtcggattatagtttgggtatttttcggagtaaaatttttgtggacgattcgatgagtttgttatataatatgaacgattgttattttaagttta

SEQ ID NO: 12078 - DNA, 626 bp, Artificial Sequence
  chemically treated genomic DNA (Homo sapiens) CpG-island No: 12078
taaacttaaaataacaatcgttcatattatataacaaactcatcgaatcgtccacaaaaattttactccgaaaaatacccaaactataatccgacaactatttttcctaacgaacctcacgaaactaaaaactttcatactaaccgcgaaaaaaaacgaaaccgaaaaaaactaactaccctaaaactcaaaccgccgctaccgcctactaaactaactacgcttaacaccgaactcgactcaaaataaaacccgaacccgacgaaacgacttttatccgcactcgccgaaaccacacgctaaaacttcccttcgtccccattaacgaaaaataacacgtctatcaaaacgaacgaacgcttccattaataaacgcgaacgtaaacgtaaacttaattcttccgcgttcgcaaccaatccccgcgaaataaacgaaacgcgacatactaaaataataaataaaatacaatacaataaatacgaaactaacgaaaaacgaaaaacgaaaaacgacgaacgaaaaacgtaaaataaaaatacgaaacgaaaaataaaaaaaaaaaaaaaaaaaaaaaaaaaaaataaaaaaaaaaaacgcgaataataaaaaaaaaatttacgaaaaa

SEQ ID NO: 12079 - DNA, 626 bp, Artificial Sequence
  chemically treated genomic DNA (Homo sapiens) CpG-island No: 12079
tgagtttggagtagtagtcgtttatgttgtatagtaggtttatcgggtcgtttataggggttttgtttcgggagatgtttaggttgtggttcgatagttgttttttttaacggattttacgggattgaaggtttttatgttgatcgcgagggaaggcgagatcgggaggagttggttgttttgaagtttaggtcgtcgttgtcgtttgttgagttagttgcgtttggtatcgggttcggtttagaatgaagttcgagttcggcggaacggtttttattcgtattcgtcggggttatacgttggagttttttttcgtttttattggcggaaggtggtacgtttattaagacgagcgggcgtttttattggtgggcgcgggcgtgggcgtgggtttggttttttcgcgttcgtagttaattttcgcggggtgggcggggcgcgatatgttggggtggtaaatagagtatagtatagtaagtgcggggttggcggggggcggggggcggggagcggcgggcggggggcgtggagtagggatgcgggacgagggataggaggagggaggaggaagagaagggaagatgggggaggggaacgcggatggtaagggggaggtttacgaggag

SEQ ID NO: 12080 - DNA, 626 bp, Artificial Sequence
  chemically treated genomic DNA (Homo sapiens) CpG-island No: 12080
ctcctcgtaaacctcccccttaccatccgcgttcccctcccccatcttcccttctcttcctcctccctcctcctatccctcgtcccgcatccctactccacgccccccgcccgccgctccccgccccccgccccccgccaaccccgcacttactatactatactctatttaccaccccaacatatcgcgccccgcccaccccgcgaaaattaactacgaacgcgaaaaaaccaaacccacgcccacgcccgcgcccaccaataaaaacgcccgctcgtcttaataaacgtaccaccttccgccaataaaaacgaaaaaaaactccaacgtataaccccgacgaatacgaataaaaaccgttccgccgaactcgaacttcattctaaaccgaacccgataccaaacgcaactaactcaacaaacgacaacgacgacctaaacttcaaaacaaccaactcctcccgatctcgccttccctcgcgatcaacataaaaaccttcaatcccgtaaaatccgttaaaaaaaacaactatcgaaccacaacctaaacatctcccgaaacaaaacccctataaacgacccgataaacctactatacaacataaacgactactactccaaactca

SEQ ID NO: 12081 - DNA, 886 bp, Artificial Sequence
  chemically treated genomic DNA (Homo sapiens) CpG-island No: 12081
gtttttagtttcggggcgcgaggtgggttgggaggttttggaaggcgggttttaggtggacgcgaatcgggggaggaagggattcgggcggggtagtagtttatttggggcggaataggtgttcgggcggcgttatcgaggagttcgcgcgttttttcgttttgattttcgatcgttttcgcgggcgttggcgttggaggagggcgggggtcgtggagtcgcggtcgttcggatcgttttgcggattcgcgtcggggattgggttttgtcggggttagcgcggggcggtcgtgtggttgattattatattcggagagagttttgaggcgcgtagggcgtttttttcgtcgtaggttattcgcggatttggtttttagtttcgttatttgtcgttagtcgcggtttcggcgtatttttgcgcggcggggagggaagcgcgttttggttttaattcgattttcgtttcgttttcgggagaggttagacgtcggcgcgtacgttcgttttttagttacggggattcgcgcgtagttcgttcggacggttttggggagcgttttcggacggaagtagtgcgggcgggattgtggggcggttcgggtttttcgagcgtttgtcgggtatcgttggcgacgttggtttcgggatttttggagtcgtagtcgagggtatagtttttttcggaggcgatttttcgcggcgttagttgcgtcgatttcggtcgtggagttcgggcgttatttgttggtcgatacgaggacggcggttttcgcgcggggtttggtgggttggggcgggtattgggaattcgaggagtaattcgtggggtggaggaggtttcgggagaaaacgttagggagtgcggtttttttaaatgagtgttgtt

SEQ ID NO: 12082 - DNA, 886 bp, Artificial Sequence
  chemically treated genomic DNA (Homo sapiens) CpG-island No: 12082
aacaacactcatttaaaaaaaccgcactccctaacgttttctcccgaaacctcctccaccccacgaattactcctcgaattcccaatacccgccccaacccaccaaaccccgcgcgaaaaccgccgtcctcgtatcgaccaacaaataacgcccgaactccacgaccgaaatcgacgcaactaacgccgcgaaaaatcgcctccgaaaaaaactataccctcgactacgactccaaaaatcccgaaaccaacgtcgccaacgatacccgacaaacgctcgaaaaacccgaaccgccccacaatcccgcccgcactacttccgtccgaaaacgctccccaaaaccgtccgaacgaactacgcgcgaatccccgtaactaaaaaacgaacgtacgcgccgacgtctaacctctcccgaaaacgaaacgaaaatcgaattaaaaccaaaacgcgcttccctccccgccgcgcaaaaatacgccgaaaccgcgactaacgacaaataacgaaactaaaaaccaaatccgcgaataacctacgacgaaaaaaacgccctacgcgcctcaaaactctctccgaatataataatcaaccacacgaccgccccgcgctaaccccgacaaaacccaatccccgacgcgaatccgcaaaacgatccgaacgaccgcgactccacgacccccgccctcctccaacgccaacgcccgcgaaaacgatcgaaaatcaaaacgaaaaaacgcgcgaactcctcgataacgccgcccgaacacctattccgccccaaataaactactaccccgcccgaatcccttcctcccccgattcgcgtccacctaaaacccgccttccaaaacctcccaacccacctcgcgccccgaaactaaaaac

SEQ ID NO: 12083 - DNA, 886 bp, Artificial Sequence
  chemically treated genomic DNA (Homo sapiens) CpG-island No: 12083
agtagtatttatttggaaaggtcgtattttttggcgttttttttcgggattttttttattttacggattgtttttcgggtttttagtgttcgttttagtttattaggtttcgcgcgagagtcgtcgttttcgtgtcggttagtaggtggcgttcgggttttacggtcggagtcggcgtagttggcgtcgcgggaagtcgttttcgagaggggttgtgttttcggttgcggttttaggggtttcggggttaacgtcgttagcggtgttcggtaggcgttcgaaaggttcgggtcgttttatagtttcgttcgtattgttttcgttcggggacgttttttagggtcgttcgagcggattacgcgcgggttttcgtggttggggggcgagcgtgcgcgtcggcgtttggtttttttcggaggcgaggcgggggtcgggttgggattagagcgcgttttttttttcgtcgcgtagaggtgcgtcggggtcgcggttggcgataggtggcgggattgggggttaggttcgcgggtagtttgcgacggggaagacgttttacgcgttttagggtttttttcgggtatgatgattaattatacgatcgtttcgcgttggtttcggtagagtttagttttcggcgcgggttcgtagggcgattcgggcggtcgcggttttacggttttcgtttttttttagcgttagcgttcgcgggagcgatcgggggttagggcggggagacgcgcggatttttcggtggcgtcgttcgaatatttgtttcgttttaggtgagttgttgtttcgttcggatttttttttttttcggttcgcgtttatttgggattcgttttttagagttttttagtttatttcgcgtttcgggattgaaaat

SEQ ID NO: 12084 - DNA, 886 bp, Artificial Sequence
  chemically treated genomic DNA (Homo sapiens) CpG-island No: 12084
attttcaatcccgaaacgcgaaataaactaaaaaactctaaaaaacgaatcccaaataaacgcgaaccgaaaaaaaaaaaaatccgaacgaaacaacaactcacctaaaacgaaacaaatattcgaacgacgccaccgaaaaatccgcgcgtctccccgccctaacccccgatcgctcccgcgaacgctaacgctaaaaaaaaacgaaaaccgtaaaaccgcgaccgcccgaatcgccctacgaacccgcgccgaaaactaaactctaccgaaaccaacgcgaaacgatcgtataattaatcatcatacccgaaaaaaaccctaaaacgcgtaaaacgtcttccccgtcgcaaactacccgcgaacctaacccccaatcccgccacctatcgccaaccgcgaccccgacgcacctctacgcgacgaaaaaaaaaacgcgctctaatcccaacccgacccccgcctcgcctccgaaaaaaaccaaacgccgacgcgcacgctcgccccccaaccacgaaaacccgcgcgtaatccgctcgaacgaccctaaaaaacgtccccgaacgaaaacaatacgaacgaaactataaaacgacccgaacctttcgaacgcctaccgaacaccgctaacgacgttaaccccgaaacccctaaaaccgcaaccgaaaacacaacccctctcgaaaacgacttcccgcgacgccaactacgccgactccgaccgtaaaacccgaacgccacctactaaccgacacgaaaacgacgactctcgcgcgaaacctaataaactaaaacgaacactaaaaacccgaaaaacaatccgtaaaataaaaaaaatcccgaaaaaaaacgccaaaaaatacgacctttccaaataaatactact

SEQ ID NO: 12085 - DNA, 586 bp, Artificial Sequence
  chemically treated genomic DNA (Homo sapiens) CpG-island No: 12085
atcgggaagtcgtttaagaatttttttatcgtttcgacgttggcgtcgcgtttcgcgaatcggggttcggtcgcgtttaggtttcgtagaggtttttttttcgttttagggtttcggtcgtttgcggaagtcggtggagtattgggcgggcggggtcggagggggcgcgggttataatttcgggtcggattagggggcggtgggtcgagggcgggaagttttcgggggtcggggagcgcggggttggggatcgtcggcgggatttattaggtgtcgcgttatttcggaggaggttatggtcgcgggtaggggtacggtgaagcggttgtattagtcggtttcgagcggttggtttcggcgacggcggcgggaaggcggaggtagaagtaacgggcggggtcgaggttaggttgttttcgcgacggggaagggataggggcggggcgagttggagttttcgggggcggggttggggcggatttgtggtgcgcgttgagtttttgtttgcgttaacgagttttttataggagttattttcgacgtttgaggattgagcgttatttggggtagttgaaagagagttggg

SEQ ID NO: 12086 - DNA, 586 bp, Artificial Sequence
  chemically treated genomic DNA (Homo sapiens) CpG-island No: 12086
cccaactctctttcaactaccccaaataacgctcaatcctcaaacgtcgaaaataactcctataaaaaactcgttaacgcaaacaaaaactcaacgcgcaccacaaatccgccccaaccccgcccccgaaaactccaactcgccccgcccctatcccttccccgtcgcgaaaacaacctaacctcgaccccgcccgttacttctacctccgccttcccgccgccgtcgccgaaaccaaccgctcgaaaccgactaatacaaccgcttcaccgtacccctacccgcgaccataacctcctccgaaataacgcgacacctaataaatcccgccgacgatccccaaccccgcgctccccgacccccgaaaacttcccgccctcgacccaccgccccctaatccgacccgaaattataacccgcgccccctccgaccccgcccgcccaatactccaccgacttccgcaaacgaccgaaaccctaaaacgaaaaaaaaacctctacgaaacctaaacgcgaccgaaccccgattcgcgaaacgcgacgccaacgtcgaaacgataaaaaaattcttaaacgacttcccgat

SEQ ID NO: 12087 - DNA, 586 bp, Artificial Sequence
  chemically treated genomic DNA (Homo sapiens) CpG-island No: 12087
tttagtttttttttagttgttttaaatgacgtttagtttttaggcgtcgagggtagtttttgtgaggggttcgttggcgtaggtaaaagtttagcgcgtattataggttcgttttaatttcgttttcggaggttttagttcgtttcgtttttgtttttttttcgtcgcggaggtagtttagtttcggtttcgttcgttgtttttgttttcgttttttcgtcgtcgtcgtcgggattagtcgttcggggtcggttgatatagtcgttttatcgtgtttttgttcgcgattatggtttttttcgaggtggcgcggtatttggtgagtttcgtcgacggtttttagtttcgcgtttttcggttttcggggatttttcgttttcgatttatcgttttttggttcggttcgggattgtgattcgcgtttttttcggtttcgttcgtttagtgttttatcggttttcgtaggcggtcggagttttggggcgggagaggagtttttgcggagtttgggcgcggtcggatttcggttcgcggggcgcggcgttagcgtcgggacggtgggagagtttttgaacgatttttcggt

SEQ ID NO: 12088 - DNA, 586 bp, Artificial Sequence
  chemically treated genomic DNA (Homo sapiens) CpG-island No: 12088
accgaaaaatcgttcaaaaactctcccaccgtcccgacgctaacgccgcgccccgcgaaccgaaatccgaccgcgcccaaactccgcaaaaactcctctcccgccccaaaactccgaccgcctacgaaaaccgataaaacactaaacgaacgaaaccgaaaaaaacgcgaatcacaatcccgaaccgaaccaaaaaacgataaatcgaaaacgaaaaatccccgaaaaccgaaaaacgcgaaactaaaaaccgtcgacgaaactcaccaaataccgcgccacctcgaaaaaaaccataatcgcgaacaaaaacacgataaaacgactatatcaaccgaccccgaacgactaatcccgacgacgacgacgaaaaaacgaaaacaaaaacaacgaacgaaaccgaaactaaactacctccgcgacgaaaaaaaaacaaaaacgaaacgaactaaaacctccgaaaacgaaattaaaacgaacctataatacgcgctaaacttttacctacgccaacgaacccctcacaaaaactaccctcgacgcctaaaaactaaacgtcatttaaaacaactaaaaaaaaactaaa

SEQ ID NO: 12089 - DNA, 585 bp, Artificial Sequence
  chemically treated genomic DNA (Homo sapiens) CpG-island No: 12089
  misc_feature (43)..(43): n is either a, c, g or t
  misc_feature (242)..(242): n is either a, c, g or t
  misc_feature (408)..(408): n is either a, c, g or t
cgtttcgagggagggagggaggaggttgattcgggcgtttcgnaaggattcgttcggtttcggatttcgggcggtagtcggtttcgcgtttcgttttcgtttcgggagtttcgtttagtttcgtcgcgtcgcgtcgttttatcgttcgggttggttgttttggaggttacgcgcggcgatttgttacgcgtcgcgttatcgggtcgttttcggtttgggttttcgggggttggttagggagngtggcggcggttgagcggcggagcgggggcggtaaggcgcgacgtcgtcgggtcgtttcgttttgggaggcgttcgggtttttattaagtgattagtattttttttaggggaatacggttttttagaggaaagcgagttttaattcgcgggtacggcgttaagttngtcgttattttttttttgtgttaggtgatcgtttttttatttattcggaaaaatatagttcgtttttacgtttttgtggaatagcgttcgtttttaagtatcgtgattttttttgttttatttttgttttttttattttaattattttagaatttatcgagaggataatttagtttt

SEQ ID NO: 12090 - DNA, 585 bp, Artificial Sequence
  chemically treated genomic DNA (Homo sapiens) CpG-island No: 12090
  misc_feature (178)..(178): n is either a, c, g or t
  misc_feature (344)..(344): n is either a, c, g or t
  misc_feature (543)..(543): n is either a, c, g or t
aaaactaaattatcctctcgataaattctaaaataattaaaataaaaaaaacaaaaataaaacaaaaaaaatcacgatacttaaaaacgaacgctattccacaaaaacgtaaaaacgaactatatttttccgaataaataaaaaaacgatcacctaacacaaaaaaaaaataacgacnaacttaacgccgtacccgcgaattaaaactcgctttcctctaaaaaaccgtattcccctaaaaaaaatactaatcacttaataaaaacccgaacgcctcccaaaacgaaacgacccgacgacgtcgcgccttaccgcccccgctccgccgctcaaccgccgccacnctccctaaccaacccccgaaaacccaaaccgaaaacgacccgataacgcgacgcgtaacaaatcgccgcgcgtaacctccaaaacaaccaacccgaacgataaaacgacgcgacgcgacgaaactaaacgaaactcccgaaacgaaaacgaaacgcgaaaccgactaccgcccgaaatccgaaaccgaacgaatccttncgaaacgcccgaatcaacctcctccctccctccctcgaaacg

SEQ ID NO: 12091 - DNA, 585 bp, Artificial Sequence
  chemically treated genomic DNA (Homo sapiens) CpG-island No: 12091
  misc_feature (178)..(178): n is either a, c, g or t
  misc_feature (344)..(344): n is either a, c, g or t
  misc_feature (543)..(543): n is either a, c, g or t
aggattgaattattttttcggtgggttttagagtaattggaatgggaaagataagggtagggtaaagagagttacggtgtttggaagcgggcgttattttataaggacgtgggggcggattatgttttttcgggtgggtgaggagacgattatttggtataggaagaagatgacggtnggtttggcgtcgtgttcgcgggttggagttcgtttttttttgaaggatcgtgtttttttggaagggatattggttatttgatgagggttcgggcgttttttagggcggggcggttcggcggcgtcgcgttttgtcgttttcgtttcgtcgtttagtcgtcgttatnttttttgattagttttcgggagtttaggtcgggagcggttcggtgacgcggcgcgtggtaaatcgtcgcgcgtggtttttagggtagttaattcgggcggtggggcggcgcggcgcgacgggattgggcggggttttcggggcgggggcggggcgcgaggtcggttgtcgttcggagttcggggtcgggcgggtttttncgggacgttcgggttagttttttttttttttttttcgaggcg

SEQ ID NO: 12092 - DNA, 585 bp, Artificial Sequence
  chemically treated genomic DNA (Homo sapiens) CpG-island No: 12092
  misc_feature (43)..(43): n is either a, c, g or t
  misc_feature (242)..(242): n is either a, c, g or t
  misc_feature (408)..(408): n is either a, c, g or t
cgcctcgaaaaaaaaaaaaaaaaaactaacccgaacgtcccgnaaaaacccgcccgaccccgaactccgaacgacaaccgacctcgcgccccgcccccgccccgaaaaccccgcccaatcccgtcgcgccgcgccgccccaccgcccgaattaactaccctaaaaaccacgcgcgacgatttaccacgcgccgcgtcaccgaaccgctcccgacctaaactcccgaaaactaatcaaaaaanataacgacgactaaacgacgaaacgaaaacgacaaaacgcgacgccgccgaaccgccccgccctaaaaaacgcccgaaccctcatcaaataaccaatatcccttccaaaaaaacacgatccttcaaaaaaaaacgaactccaacccgcgaacacgacgccaaaccnaccgtcatcttcttcctataccaaataatcgtctcctcacccacccgaaaaaacataatccgcccccacgtccttataaaataacgcccgcttccaaacaccgtaactctctttaccctacccttatctttcccattccaattactctaaaacccaccgaaaaaataattcaatcct

SEQ ID NO: 12093 - DNA, 754 bp, Artificial Sequence
  chemically treated genomic DNA (Homo sapiens) CpG-island No: 12093
  misc_feature (352)..(352): n is either a, c, g or t
  misc_feature (361)..(361): n is either a, c, g or t
  misc_feature (500)..(500): n is either a, c, g or t
  misc_feature (536)..(536): n is either a, c, g or t
gaggcggcggaggtagtgcgtacgcgtagtatagaacgagtttcggtttggtcgaggtttgttttttaaaaatagtttcggtgtggggattcgtgcgcggatgtttcggcgagtttcgggttgaaagaggcggtttcgggcggcgcgaagcgttggtggcgggttcgggttgcggcgtgtgcgcgttcgttagttgtttcggagatacggtgagggtcgcgggtagcggggtttagttcgcgacgtcggtagtgttggaggggggcggcgtttcgtttaggggatcgagtaggggttggggtggaggtgttggggcgggggacggcgcggtcgagagggtcgttcggggggntttcggggnatttttggacgaggtcgtgttcggtttggagggggttagggtcgcgttcgcgtattggcggggcgggtagggtgttgggaggcgggtagggtgttggaaggcggcgaggggtggtcgggtcggggtcggcgttgaggangttaggcgttcggggaggtggggtcggggtgttttngagggcgggtcgggggggttggatggggttcggttgggcgggtcgaggggagtttagtcgcgcgggttggtggcgagtagttttttcgggcgcgtatcgtttggggtcggggggcggtggtggacgtcgtttttttgaaagttgaaggagttttcgggagatttcggagaaggtgcgttttgagggttttttttttttttttttttttttaagttcgg

SEQ ID NO: 12094 - DNA, 754 bp, Artificial Sequence
  chemically treated genomic DNA (Homo sapiens) CpG-island No: 12094
  misc_feature (219)..(219): n is either a, c, g or t
  misc_feature (255)..(255): n is either a, c, g or t
  misc_feature (394)..(394): n is either a, c, g or t
  misc_feature (403)..(403): n is either a, c, g or t
ccgaacttaaaaaaaaaaaaaaaaaaaaaaaaccctcaaaacgcaccttctccgaaatctcccgaaaactccttcaactttcaaaaaaacgacgtccaccaccgccccccgaccccaaacgatacgcgcccgaaaaaactactcgccaccaacccgcgcgactaaactcccctcgacccgcccaaccgaaccccatccaacccccccgacccgccctcnaaaacaccccgaccccacctccccgaacgcctaacntcctcaacgccgaccccgacccgaccacccctcgccgccttccaacaccctacccgcctcccaacaccctacccgccccgccaatacgcgaacgcgaccctaaccccctccaaaccgaacacgacctcgtccaaaaatnccccgaaanccccccgaacgaccctctcgaccgcgccgtcccccgccccaacacctccaccccaacccctactcgatcccctaaacgaaacgccgcccccctccaacactaccgacgtcgcgaactaaaccccgctacccgcgaccctcaccgtatctccgaaacaactaacgaacgcgcacacgccgcaacccgaacccgccaccaacgcttcgcgccgcccgaaaccgcctctttcaacccgaaactcgccgaaacatccgcgcacgaatccccacaccgaaactatttttaaaaaacaaacctcgaccaaaccgaaactcgttctatactacgcgtacgcactacctccgccgcctc

SEQ ID NO: 12095 - DNA, 754 bp, Artificial Sequence
  chemically treated genomic DNA (Homo sapiens) CpG-island No: 12095
  misc_feature (219)..(219): n is either a, c, g or t
  misc_feature (255)..(255): n is either a, c, g or t
  misc_feature (394)..(394): n is either a, c, g or t
  misc_feature (403)..(403): n is either a, c, g or t
tcgggtttggagggaaaaggggaaggaaagggtttttagagcgtatttttttcggggtttttcgagaatttttttaatttttaaggaggcgacgtttattatcgtttttcggttttaagcggtgcgcgttcggggaggttgttcgttattagttcgcgcgattgagtttttttcggttcgtttagtcgagttttatttagttttttcggttcgtttttnggggtatttcggttttattttttcgggcgtttagtntttttagcgtcgatttcgattcgattatttttcgtcgttttttagtattttattcgttttttagtattttattcgtttcgttaatgcgcgaacgcgattttggttttttttaagtcggatacggtttcgtttaggggtntttcggagntttttcgggcgattttttcggtcgcgtcgtttttcgttttagtatttttattttaatttttattcggttttttaagcgagacgtcgtttttttttagtattatcggcgtcgcggattgagtttcgttgttcgcggtttttatcgtattttcggagtagttggcgggcgcgtatacgtcgtagttcgggttcgttattagcgtttcgcgtcgttcggagtcgttttttttagttcgggattcgtcgggatattcgcgtacggatttttatatcggggttatttttaggagataagtttcggttagatcggaattcgttttgtgttgcgcgtgcgtattattttcgtcgtttt

SEQ ID NO: 12096 - DNA, 754 bp, Artificial Sequence
  chemically treated genomic DNA (Homo sapiens) CpG-island No: 12096
  misc_feature (352)..(352): n is either a, c, g or t
  misc_feature (361)..(361): n is either a, c, g or t
  misc_feature (500)..(500): n is either a, c, g or t
  misc_feature (536)..(536): n is either a, c, g or t
aaaacgacgaaaataatacgcacgcgcaacacaaaacgaattccgatctaaccgaaacttatctcctaaaaataaccccgatataaaaatccgtacgcgaatatcccgacgaatcccgaactaaaaaaaacgactccgaacgacgcgaaacgctaataacgaacccgaactacgacgtatacgcgcccgccaactactccgaaaatacgataaaaaccgcgaacaacgaaactcaatccgcgacgccgataatactaaaaaaaaacgacgtctcgcttaaaaaaccgaataaaaattaaaataaaaatactaaaacgaaaaacgacgcgaccgaaaaaatcgcccgaaaaanctccgaaanacccctaaacgaaaccgtatccgacttaaaaaaaaccaaaatcgcgttcgcgcattaacgaaacgaataaaatactaaaaaacgaataaaatactaaaaaacgacgaaaaataatcgaatcgaaatcgacgctaaaaanactaaacgcccgaaaaaataaaaccgaaataccccnaaaaacgaaccgaaaaaactaaataaaactcgactaaacgaaccgaaaaaaactcaatcgcgcgaactaataacgaacaacctccccgaacgcgcaccgcttaaaaccgaaaaacgataataaacgtcgcctccttaaaaattaaaaaaattctcgaaaaaccccgaaaaaaatacgctctaaaaaccctttccttccccttttccctccaaacccga

SEQ ID NO: 12097 - DNA, 1195 bp, Artificial Sequence
  chemically treated genomic DNA (Homo sapiens) CpG-island No: 12097
  misc_feature (36)..(36): n is either a, c, g or t
  misc_feature (190)..(190): n is either a, c, g or t
  misc_feature (397)..(397): n is either a, c, g or t
  misc_feature (464)..(464): n is either a, c, g or t
  misc_feature (905)..(905): n is either a, c, g or t
  misc_feature (1060)..(1060): n is either a, c, g or t
  misc_feature (1076)..(1076): n is either a, c, g or t
gagcgtattttaggagcgggtcgcgtatcggttganagcggcgtttttaggcgggcgttgggttcgagtattttagtatcgcgttcgtaggaggttttcggtcgcgggttgcgggttacggcgagggttgtcgggcggcgcggggtaggttttggatcgagggaaaaagttagtcggggaagttcgtatnattaaagtaagtcgttttagtcgttgagaacggagaaaagtcgtggcgtcggcgaagcgtcggacgtttaggacgtatttgtgatttttgggtcgttttcgggttcgagcgttaggacgcggcggtagtttgggtacgtcgcggggagtattcgttcgcgtagtttttttttaatttgggttcgggtttcgatttcgttttttgttntcgattcgggcgtttttatttgcgatcgtttttttcgtcgttcgttttttttattcgttcgtcgttntgtcgtttgtcgttcgttttatttcgtcgtttggtacgtacgatgttttttttttgtagtacgaacgtggattcgtttattaggttcgatacgacggttacgtttaggtcgagcgatacggcggcggggttcgggttacgcgtttttttttcggtcgtcgtcgtcgtcgtcgtcgtcgttgtcgtagttgtagtttttatttcgttcgcgttcgtttttcgagtttgcgtttgcgcgtcgcgtttcgcggggcgggatggggggtgatcgggaggcgcgggcgggggaggggagggggacgggtgggggaggagtaggaagaggggcgggggcgggacgggggtgttagggatcggcgttttaggttgcggggatagtagtggcgtcggacgcggcggtagtgaggggtcggtgaggcgttgggtggggcgggggtttttnggatttcgtaaatggaaatgtaggatttttggttaagtttttagcgcggagaaatacgtatattttttgagtggtgttttttgtaatattcgggtagcggagcgcggtaggacgtatcggcgggtagcggttttcgaagagtttttagcggaggntcggtttaatttattnggagcgcgaagttcggcgcgtcgttgtagagatcgaaggagagttttggcgttgggcgtttttttttcgtttttggcgttagagttagttatatggggttttgggtttgtgattttata

SEQ ID NO: 12098 - DNA, 1195 bp, Artificial Sequence
  chemically treated genomic DNA (Homo sapiens) CpG-island No: 12098
  misc_feature (120)..(120): n is either a, c, g or t
  misc_feature (136)..(136): n is either a, c, g or t
  misc_feature (291)..(291): n is either a, c, g or t
  misc_feature (732)..(732): n is either a, c, g or t
  misc_feature (799)..(799): n is either a, c, g or t
  misc_feature (1006)..(1006): n is either a, c, g or t
  misc_feature (1160)..(1160): n is either a, c, g or t
tataaaatcacaaacccaaaaccccatataactaactctaacgccaaaaacgaaaaaaaaacgcccaacgccaaaactctccttcgatctctacaacgacgcgccgaacttcgcgctccnaataaattaaaccgancctccgctaaaaactcttcgaaaaccgctacccgccgatacgtcctaccgcgctccgctacccgaatattacaaaaaacaccactcaaaaaatatacgtatttctccgcgctaaaaacttaaccaaaaatcctacatttccatttacgaaatccnaaaaacccccgccccacccaacgcctcaccgacccctcactaccgccgcgtccgacgccactactatccccgcaacctaaaacgccgatccctaacacccccgtcccgcccccgcccctcttcctactcctcccccacccgtccccctcccctcccccgcccgcgcctcccgatcaccccccatcccgccccgcgaaacgcgacgcgcaaacgcaaactcgaaaaacgaacgcgaacgaaataaaaactacaactacgacaacgacgacgacgacgacgacgacgaccgaaaaaaaaacgcgtaacccgaaccccgccgccgtatcgctcgacctaaacgtaaccgtcgtatcgaacctaataaacgaatccacgttcgtactacaaaaaaaaaacatcgtacgtaccaaacgacgaaataaaacgaacgacaaacgacanaacgacgaacgaataaaaaaaacgaacgacgaaaaaaacgatcgcaaataaaaacgcccgaatcganaacaaaaaacgaaatcgaaacccgaacccaaattaaaaaaaaactacgcgaacgaatactccccgcgacgtacccaaactaccgccgcgtcctaacgctcgaacccgaaaacgacccaaaaatcacaaatacgtcctaaacgtccgacgcttcgccgacgccacgacttttctccgttctcaacgactaaaacgacttactttaatnatacgaacttccccgactaactttttccctcgatccaaaacctaccccgcgccgcccgacaaccctcgccgtaacccgcaacccgcgaccgaaaacctcctacgaacgcgatactaaaatactcgaacccaacgcccgcctaaaaacgccgctntcaaccgatacgcgacccgctcctaaaatacgctc

SEQ ID NO: 12099 - DNA, 1195 bp, Artificial Sequence
  chemically treated genomic DNA (Homo sapiens) CpG-island No: 12099
  misc_feature (120)..(120): n is either a, c, g or t
  misc_feature (136)..(136): n is either a, c, g or t
  misc_feature (291)..(291): n is either a, c, g or t
  misc_feature (732)..(732): n is either a, c, g or t
  misc_feature (799)..(799): n is either a, c, g or t
  misc_feature (1006)..(1006): n is either a, c, g or t
  misc_feature (1160)..(1160): n is either a, c, g or t
tatgggattataagtttagagttttatgtagttgattttagcgttaagggcggaagagaaacgtttagcgttagggttttttttcgatttttgtagcggcgcgtcgggtttcgcgttttnggtgagttgggtcggnttttcgttggaggtttttcggggatcgttgttcgtcggtgcgttttgtcgcgtttcgttgttcggatattgtagaggatattatttagaaagtatgcgtgttttttcgcgttggaaatttaattaggagttttgtatttttatttgcgaaatttngggaattttcgttttatttagcgttttatcggttttttattgtcgtcgcgttcggcgttattgttgttttcgtagtttaaggcgtcggtttttggtattttcgtttcgttttcgtttttttttttgttttttttttattcgttttttttttttttttcgttcgcgtttttcggttattttttatttcgtttcgcggggcgcggcgcgtaggcgtaggttcggagggcgggcgcgggcggaatggggattgtagttgcggtagcggcggcggcggcggcggcggcggtcggggagggggcgcgtagttcgagtttcgtcgtcgtgtcgttcggtttgggcgtggtcgtcgtgtcgagtttggtgaacgggtttacgttcgtgttatagaagaagggtatcgtgcgtgttaagcggcgaggtagggcgggcggtaggcggtanggcggcgggcgggtgggggaggcgggcggcggagaaggcggtcgtaggtgggggcgttcgggtcggnggtaggggacggggtcggggttcgggtttaggttgggggaaggttgcgcgggcgggtgtttttcgcggcgtgtttaggttgtcgtcgcgttttggcgttcgggttcgggagcggtttaggaattataggtgcgttttgagcgttcggcgtttcgtcgacgttacggttttttttcgtttttagcggttggagcggtttgttttggtngtgcgggttttttcggttgattttttttttcggtttaagatttgtttcgcgtcgttcggtagttttcgtcgtggttcgtaattcgcggtcgggagttttttgcggacgcggtgttggggtgttcgagtttagcgttcgtttggaagcgtcgttnttagtcgatgcgcggttcgtttttagggtacgttt

SEQ ID NO: 12100 - DNA, 1195 bp, Artificial Sequence
  chemically treated genomic DNA (Homo sapiens) CpG-island No: 12100
  misc_feature (36)..(36): n is either a, c, g or t
  misc_feature (190)..(190): n is either a, c, g or t
  misc_feature (397)..(397): n is either a, c, g or t
  misc_feature (464)..(464): n is either a, c, g or t
  misc_feature (905)..(905): n is either a, c, g or t
  misc_feature (1060)..(1060): n is either a, c, g or t
  misc_feature (1076)..(1076): n is either a, c, g or t
aaacgtaccctaaaaacgaaccgcgcatcgactaanaacgacgcttccaaacgaacgctaaactcgaacaccccaacaccgcgtccgcaaaaaactcccgaccgcgaattacgaaccacgacgaaaactaccgaacgacgcgaaacaaatcttaaaccgaaaaaaaaaatcaaccgaaaaaacccgcacnaccaaaacaaaccgctccaaccgctaaaaacgaaaaaaaaccgtaacgtcgacgaaacgccgaacgctcaaaacgcacctataattcctaaaccgctcccgaacccgaacgccaaaacgcgacgacaacctaaacacgccgcgaaaaacacccgcccgcgcaaccttcccccaacctaaacccgaaccccgaccccgtcccctaccnccgacccgaacgcccccacctacgaccgccttctccgccgcccgcctcccccacccgcccgccgccntaccgcctaccgcccgccctacctcgccgcttaacacgcacgatacccttcttctataacacgaacgtaaacccgttcaccaaactcgacacgacgaccacgcccaaaccgaacgacacgacgacgaaactcgaactacgcgccccctccccgaccgccgccgccgccgccgccgccgctaccgcaactacaatccccattccgcccgcgcccgccctccgaacctacgcctacgcgccgcgccccgcgaaacgaaataaaaaataaccgaaaaacgcgaacgaaaaaaaaaaaaaaaacgaataaaaaaaaaacaaaaaaaaaaacgaaaacgaaacgaaaataccaaaaaccgacgccttaaactacgaaaacaacaataacgccgaacgcgacgacaataaaaaaccgataaaacgctaaataaaacgaaaattcccnaaatttcgcaaataaaaatacaaaactcctaattaaatttccaacgcgaaaaaacacgcatactttctaaataatatcctctacaatatccgaacaacgaaacgcgacaaaacgcaccgacgaacaacgatccccgaaaaacctccaacgaaaanccgacccaactcaccnaaaacgcgaaacccgacgcgccgctacaaaaatcgaaaaaaaaccctaacgctaaacgtttctcttccgcccttaacgctaaaatcaactacataaaactctaaacttataatcccata

SEQ ID NO: 12101 - DNA, 705 bp, Artificial Sequence
  chemically treated genomic DNA (Homo sapiens) CpG-island No: 12101
  misc_feature (60)..(60): n is either a, c, g or t
  misc_feature (80)..(80): n is either a, c, g or t
  misc_feature (225)..(225): n is either a, c, g or t
  misc_feature (391)..(391): n is either a, c, g or t
  misc_feature (400)..(400): n is either a, c, g or t
ttttattgaggattataggaaaatcgttttagaatattcggaaaggaaagttgttcgaangaattttttttcgatataanggcgggttggttcgttattaagttagttttttcgcgtttgtttgaaaggaaggagtggcgattttattttagtcggtcggtcggtcgcgcggttttttttcgtcggcgtagttttgggtatcgcggtttatatttttatataggntcgtttagttttgcgttcgtacggttatcgttttcgtcgtcgtttagtgggagatgcgagtattcggggttgaagtcgttcgtatcgttttttttatggagaagcgtcgaggaaaatttgttaaggataattttcggtatcgtcgttattatcgttgtcgggattntagggtcgngcgtcggaaaatttaggcgcggttaaatgacgtaagaggtttcgcgcgtacgcgtagtgtcgtattacgtatatttcgttttcggggttttttttcgtcgggtttcggtttttttataaggttttagtcggttgagcgcggagggcggggcgcgtagagtgtggggacgggggcggggcgtaggatttaggcgggatttggcgagggacgaagttggaagcgtagttaagtagtatagtatgttgttaggtggcgttggtcgattagtttaaaattaaatttcggcgtggtttttatttaaaacg

SEQ ID NO: 12102 - DNA, 705 bp, Artificial Sequence
  chemically treated genomic DNA (Homo sapiens) CpG-island No: 12102
  misc_feature (306)..(306): n is either a, c, g or t
  misc_feature (315)..(315): n is either a, c, g or t
  misc_feature (481)..(481): n is either a, c, g or t
  misc_feature (626)..(626): n is either a, c, g or t
  misc_feature (646)..(646): n is either a, c, g or t
cgttttaaataaaaaccacgccgaaatttaattttaaactaatcgaccaacgccacctaacaacatactatactacttaactacgcttccaacttcgtccctcgccaaatcccgcctaaatcctacgccccgcccccgtccccacactctacgcgccccgccctccgcgctcaaccgactaaaaccttataaaaaaaccgaaacccgacgaaaaaaaaccccgaaaacgaaatatacgtaatacgacactacgcgtacgcgcgaaacctcttacgtcatttaaccgcgcctaaattttccgacgcncgaccctanaatcccgacaacgataataacgacgataccgaaaattatccttaacaaattttcctcgacgcttctccataaaaaaaacgatacgaacgacttcaaccccgaatactcgcatctcccactaaacgacgacgaaaacgataaccgtacgaacgcaaaactaaacgancctatataaaaatataaaccgcgatacccaaaactacgccgacgaaaaaaaaccgcgcgaccgaccgaccgactaaaataaaatcgccactccttcctttcaaacaaacgcgaaaaaactaacttaataacgaaccaacccgccnttatatcgaaaaaaaattcnttcgaacaactttcctttccgaatattctaaaacgattttcctataatcctcaataaaa

SEQ ID NO: 12103 - DNA, 705 bp, Artificial Sequence
  chemically treated genomic DNA (Homo sapiens) CpG-island No: 12103
  misc_feature (306)..(306): n is either a, c, g or t
  misc_feature (315)..(315): n is either a, c, g or t
  misc_feature (481)..(481): n is either a, c, g or t
  misc_feature (626)..(626): n is either a, c, g or t
  misc_feature (646)..(646): n is either a, c, g or t
cgttttaaataagggttacgtcggagtttgattttgaattgatcggttaacgttatttggtagtatattgtattgtttaattacgtttttagtttcgtttttcgttaggtttcgtttggattttgcgtttcgttttcgtttttatattttacgcgtttcgtttttcgcgtttagtcgattggggttttgtaaaggaatcggaattcggcgggagagagtttcgggggcggggtgtacgtggtgcggtattgcgcgtgcgcgcgaggttttttgcgttatttagtcgcgtttaggtttttcggcgtncggttttanggtttcggtagcggtggtgacggcggtgtcggaggttgtttttggtaggtttttttcggcgtttttttatggaggaggcggtgcgaacggttttagtttcgaatgttcgtattttttattggacggcgacgaaggcggtggtcgtgcgagcgtaggattgggcggntttgtgtgggggtgtgagtcgcggtgtttaaggttgcgtcggcgaggggaagtcgcgcggtcggtcggtcgattagggtgaggtcgttattttttttttttaggtaagcgcgaaggggttgatttggtggcgagttagttcgttnttgtgtcggagaagggtttnttcgggtaattttttttttcgggtgttttgaagcggtttttttgtaatttttagtgagg

SEQ ID NO: 12104 - DNA, 705 bp, Artificial Sequence
  chemically treated genomic DNA (Homo sapiens) CpG-island No: 12104
  misc_feature (60)..(60): n is either a, c, g or t
  misc_feature (80)..(80): n is either a, c, g or t
  misc_feature (225)..(225): n is either a, c, g or t
  misc_feature (391)..(391): n is either a, c, g or t
  misc_feature (400)..(400): n is either a, c, g or t
cctcactaaaaattacaaaaaaaccgcttcaaaacacccgaaaaaaaaaattacccgaanaaacccttctccgacacaanaacgaactaactcgccaccaaatcaaccccttcgcgcttacctaaaaaaaaaaaataacgacctcaccctaatcgaccgaccgaccgcgcgacttcccctcgccgacgcaaccttaaacaccgcgactcacacccccacacaaanccgcccaatcctacgctcgcacgaccaccgccttcgtcgccgtccaataaaaaatacgaacattcgaaactaaaaccgttcgcaccgcctcctccataaaaaaacgccgaaaaaaacctaccaaaaacaacctccgacaccgccgtcaccaccgctaccgaaaccntaaaaccgnacgccgaaaaacctaaacgcgactaaataacgcaaaaaacctcgcgcgcacgcgcaataccgcaccacgtacaccccgcccccgaaactctctcccgccgaattccgattcctttacaaaaccccaatcgactaaacgcgaaaaacgaaacgcgtaaaatataaaaacgaaaacgaaacgcaaaatccaaacgaaacctaacgaaaaacgaaactaaaaacgtaattaaacaatacaatatactaccaaataacgttaaccgatcaattcaaaatcaaactccgacgtaacccttatttaaaacg

SEQ ID NO: 12105 - DNA, 715 bp, Artificial Sequence
  chemically treated genomic DNA (Homo sapiens) CpG-island No: 12105
ggttcggatagcggcggtttgtggagaggggacgatgacgatgaggtcgcggttgttgaaatgtagcgtttttttgatttgttgtaaaggttgttaaacggtatcggaggttgtagtagtagtagtgatagtggtagcgtcgaaaagaggcggagaaagtttttaggaggaggcggcggtggcggtagcggtaacgataataattaggcggcgataaagagttttcggaaggcggcggcggtcgttgttcgttttaatcgattgaagaagaaggagtacgtgatggggttggagagtcgagttcggggtttggtagtcgagaattaggagttgcgggtcgagaatcgggagttgggtaaacgcgtataggtattgtaggaggagagtcgttatttacgggtagttttagttaacgagattggattggttcgtttgttgagtcggttgagcggcgtgggattgcggttgattatttcgttttttagagattcgttcgtcggtgattacgattacgttttgtcggtgggaaagtagaagtaggatttgttggaagaggacgattcggcgggaggagtttgtttttatgtggataaggataaggtgtcggtggagttttgttcggcgtgcgttcggaaggcgtcgtttttttttaaaatgtagggttaagtaatttgttttttattcgcgtttattttttttaatttttttatattat

SEQ ID NO: 12106 - DNA, 715 bp, Artificial Sequence
  chemically treated genomic DNA (Homo sapiens) CpG-island No: 12106
ataatataaaaaaattaaaaaaaataaacgcgaataaaaaacaaattacttaaccctacattttaaaaaaaaacgacgccttccgaacgcacgccgaacaaaactccaccgacaccttatccttatccacataaaaacaaactcctcccgccgaatcgtcctcttccaacaaatcctacttctactttcccaccgacaaaacgtaatcgtaatcaccgacgaacgaatctctaaaaaacgaaataatcaaccgcaatcccacgccgctcaaccgactcaacaaacgaaccaatccaatctcgttaactaaaactacccgtaaataacgactctcctcctacaatacctatacgcgtttacccaactcccgattctcgacccgcaactcctaattctcgactaccaaaccccgaactcgactctccaaccccatcacgtactccttcttcttcaatcgattaaaacgaacaacgaccgccgccgccttccgaaaactctttatcgccgcctaattattatcgttaccgctaccgccaccgccgcctcctcctaaaaactttctccgcctcttttcgacgctaccactatcactactactactacaacctccgataccgtttaacaacctttacaacaaatcaaaaaaacgctacatttcaacaaccgcgacctcatcgtcatcgtcccctctccacaaaccgccgctatccgaacc

SEQ ID NO: 12107 - DNA, 715 bp, Artificial Sequence
  chemically treated genomic DNA (Homo sapiens) CpG-island No: 12107
atggtgtaagggagttgaaaggggtaaacgcggataaagagtagattatttgattttatattttaagagaagacgacgtttttcgggcgtacgtcgagtagaattttatcgatattttatttttgtttatatggagatagatttttttcgtcgagtcgtttttttttagtaggttttgtttttgtttttttatcggtagagcgtagtcgtggttatcggcgggcgagtttttgaagagcgaggtggttagtcgtagttttacgtcgtttagtcggtttagtaagcgagttagtttagtttcgttggttaagattgttcgtaggtagcgattttttttttgtagtgtttgtacgcgtttgtttagttttcgattttcggttcgtagtttttggttttcggttgttagatttcggattcgattttttagttttattacgtatttttttttttttagtcgattaaggcgggtagcggtcgtcgtcgtttttcggggattttttgtcgtcgtttggttgttgtcgttatcgttgtcgttatcgtcgtttttttttggggatttttttcgttttttttcggcgttgttattgttattgttgttgttgtagttttcgatatcgtttaatagtttttgtagtaggttagagaagcgttgtattttagtagtcgcggttttatcgttatcgttttttttttataggtcgtcgttattcgagtt

SEQ ID NO: 12108 - DNA, 715 bp, Artificial Sequence
  chemically treated genomic DNA (Homo sapiens) CpG-island No: 12108
aactcgaataacgacgacctataaaaaaaaaacgataacgataaaaccgcgactactaaaatacaacgcttctctaacctactacaaaaactattaaacgatatcgaaaactacaacaacaacaataacaataacaacgccgaaaaaaaacgaaaaaaatccccaaaaaaaaacgacgataacgacaacgataacgacaacaaccaaacgacgacaaaaaatccccgaaaaacgacgacgaccgctacccgccttaatcgactaaaaaaaaaaaaatacgtaataaaactaaaaaatcgaatccgaaatctaacaaccgaaaaccaaaaactacgaaccgaaaatcgaaaactaaacaaacgcgtacaaacactacaaaaaaaaaatcgctacctacgaacaatcttaaccaacgaaactaaactaactcgcttactaaaccgactaaacgacgtaaaactacgactaaccacctcgctcttcaaaaactcgcccgccgataaccacgactacgctctaccgataaaaaaacaaaaacaaaacctactaaaaaaaaacgactcgacgaaaaaaatctatctccatataaacaaaaataaaatatcgataaaattctactcgacgtacgcccgaaaaacgtcgtcttctcttaaaatataaaatcaaataatctactctttatccgcgtttacccctttcaactcccttacaccat

SEQ ID NO: 12109 - DNA, 571 bp, Artificial Sequence
  chemically treated genomic DNA (Homo sapiens) CpG-island No: 12109
cgtttcgtattcgtcgtagtattgttttcgtggtaggcggggtgggcgggacggtaaattcgcggtttttgcgtttattgggttgttcggggtagcgtagtttcgtattggttaggttttcgtttcgttcggttttcgcgagtttattggtcgtaggcgttcgatcgggtcgcggtcgcgcgtttcgttcgtcgttgcgtttttattatggcggcgtttatgtagtttagcgcgttgtgggttttcgtcggggtttttcgcggttgtcgtcgtcgtttacgtcgttgttttcgtttttttgtttcgcgtcgggtcgggcgttattttttttttgttttttttttcgttgtggtaagggtttgtttagtgcgtttcggggcgcgatggttgatcgcgaataacggtcgtcgtttcgtttcgtttttttttcgtcggtcgcgggtttcgggttgggcggggcgcggagttcgcgcgttagtgttcgggaaggcggggtcggggtacggtttagtcgtttttcgggttgggggtttagtatttggatgattttttttgggtgggggtcgtcgag

SEQ ID NO: 12110 - DNA, 571 bp, Artificial Sequence
  chemically treated genomic DNA (Homo sapiens) CpG-island No: 12110
ctcgacgacccccacccaaaaaaaatcatccaaatactaaacccccaacccgaaaaacgactaaaccgtaccccgaccccgccttcccgaacactaacgcgcgaactccgcgccccgcccaacccgaaacccgcgaccgacgaaaaaaaaacgaaacgaaacgacgaccgttattcgcgatcaaccatcgcgccccgaaacgcactaaacaaacccttaccacaacgaaaaaaaaaacaaaaaaaaaataacgcccgacccgacgcgaaacaaaaaaacgaaaacaacgacgtaaacgacgacgacaaccgcgaaaaaccccgacgaaaacccacaacgcgctaaactacataaacgccgccataataaaaacgcaacgacgaacgaaacgcgcgaccgcgacccgatcgaacgcctacgaccaataaactcgcgaaaaccgaacgaaacgaaaacctaaccaatacgaaactacgctaccccgaacaacccaataaacgcaaaaaccgcgaatttaccgtcccgcccaccccgcctaccacgaaaacaatactacgacgaatacgaaacg

SEQ ID NO: 12111 - DNA, 571 bp, Artificial Sequence
  chemically treated genomic DNA (Homo sapiens) CpG-island No: 12111
ttcggcggtttttatttaggagaggttatttaggtattgggtttttagttcgaaggacgattgggtcgtgtttcgatttcgttttttcgggtattagcgcgcgggtttcgcgtttcgtttagttcgggattcgcggtcggcgggggaggggcggggcggagcggcgatcgttattcgcggttagttatcgcgtttcgaagcgtattgggtaggtttttattatagcggagagggaggtaggggggaggtggcgttcggttcgacgcggggtaggaaggcggaggtagcggcgtaggcggcggcgatagtcgcgggggatttcggcgggagtttataacgcgttgggttgtatgggcgtcgttatagtggggacgtagcggcgggcggagcgcgcggtcgcgattcggtcgggcgtttgcgattaatgggttcgcggaagtcgggcggagcgagggtttggttaatgcggagttgcgttgtttcgagtagtttaatagacgtaggagtcgcggatttgtcgtttcgtttatttcgtttattacgagagtagtgttgcggcgagtgcggggcg

SEQ ID NO: 12112 - DNA, 571 bp, Artificial Sequence
  chemically treated genomic DNA (Homo sapiens) CpG-island No: 12112
cgccccgcactcgccgcaacactactctcgtaataaacgaaataaacgaaacgacaaatccgcgactcctacgtctattaaactactcgaaacaacgcaactccgcattaaccaaaccctcgctccgcccgacttccgcgaacccattaatcgcaaacgcccgaccgaatcgcgaccgcgcgctccgcccgccgctacgtccccactataacgacgcccatacaacccaacgcgttataaactcccgccgaaatcccccgcgactatcgccgccgcctacgccgctacctccgccttcctaccccgcgtcgaaccgaacgccacctcccccctacctccctctccgctataataaaaacctacccaatacgcttcgaaacgcgataactaaccgcgaataacgatcgccgctccgccccgcccctcccccgccgaccgcgaatcccgaactaaacgaaacgcgaaacccgcgcgctaatacccgaaaaaacgaaatcgaaacacgacccaatcgtccttcgaactaaaaacccaatacctaaataacctctcctaaataaaaaccgccgaa

SEQ ID NO: 12113 - DNA, 879 bp, Artificial Sequence
  chemically treated genomic DNA (Homo sapiens) CpG-island No: 12113
  misc_feature (8)..(8): n is either a, c, g or t
  misc_feature (24)..(24): n is either a, c, g or t
  misc_feature (69)..(69): n is either a, c, g or t
  misc_feature (100)..(100): n is either a, c, g or t
  misc_feature (136)..(136): n is either a, c, g or t
  misc_feature (206)..(206): n is either a, c, g or t
  misc_feature (231)..(231): n is either a, c, g or t
  misc_feature (368)..(368): n is either a, c, g or t
agtttttngttataggtggacgtnagagtaatagatattcggttatttttaggtttttgcgttcggagnatagaagttacgcgggcgcgttcgaggtttntgggttttttgtcgagagtttagcgtggcgtcgggnttttattggttacgcgttcgttcggtgttattttggtttttcgttttttttttatttcggcgtttacganttcgggcgtaggttatatggttttncggattgttcggtttcgggttttcgtaaggcgcgtttatattacgtcgttagatttacgcggcgaggggttgggttttttcgggggttacgggtttcgaagttcgttttcgttttcgttttcggagtttatcgtttntgagatttagaacgtcgtttttggttttttgtagtagcgatacgaatttggtagtgagtagttttaggtttttttcgtgtttgttgttgtcgttttcggcgttttcgagttgcggcggcgggggcggttgcggggtttgcgtttgcggaggttgcggcggcggtcgttggttttgtttttgttttgtcggcgtttgttggttcgagttcgcgggttttgtcgtcgttatcgcgtttcggtttcgcggtggtcgggttttcgcgtattttcgttcgtcggtttcgttcgcggttatttgtcgggtcggtttcgttgcggtcgttttttcgttcgtcgagagcggtagtgcgggtcgttggttgttgtaaataataggtgtgcggcgtttacgggagtttgggtcgtttgttacgtcgggttttcgttttttttttaagttcggggaagcgtgaatgaggtttacgatcgaggggggaggggtggaaacgaggagaaggggttgcgaggggtg

SEQ ID NO: 12114 - DNA, 879 bp, Artificial Sequence
  chemically treated genomic DNA (Homo sapiens) CpG-island No: 12114
  misc_feature (512)..(512): n is either a, c, g or t
  misc_feature (649)..(649): n is either a, c, g or t
  misc_feature (674)..(674): n is either a, c, g or t
  misc_feature (744)..(744): n is either a, c, g or t
  misc_feature (780)..(780): n is either a, c, g or t
  misc_feature (811)..(811): n is either a, c, g or t
  misc_feature (856)..(856): n is either a, c, g or t
  misc_feature (872)..(872): n is either a, c, g or t
cacccctcgcaaccccttctcctcgtttccacccctcccccctcgatcgtaaacctcattcacgcttccccgaacttaaaaaaaaaacgaaaacccgacgtaacaaacgacccaaactcccgtaaacgccgcacacctattatttacaacaaccaacgacccgcactaccgctctcgacgaacgaaaaaacgaccgcaacgaaaccgacccgacaaataaccgcgaacgaaaccgacgaacgaaaatacgcgaaaacccgaccaccgcgaaaccgaaacgcgataacgacgacaaaacccgcgaactcgaaccaacaaacgccgacaaaacaaaaacaaaaccaacgaccgccgccgcaacctccgcaaacgcaaaccccgcaaccgcccccgccgccgcaactcgaaaacgccgaaaacgacaacaacaaacacgaaaaaaacctaaaactactcactaccaaattcgtatcgctactacaaaaaaccaaaaacgacgttctaaatctcanaaacgataaactccgaaaacgaaaacgaaaacgaacttcgaaacccgtaacccccgaaaaaacccaacccctcgccgcgtaaatctaacgacgtaatataaacgcgccttacgaaaacccgaaaccgaacaatccgnaaaaccatataacctacgcccgaantcgtaaacgccgaaataaaaaaaaaacgaaaaaccaaaataacaccgaacgaacgcgtaaccaataaaancccgacgccacgctaaactctcgacaaaaaacccanaaacctcgaacgcgcccgcgtaacttctatnctccgaacgcaaaaacctaaaaataaccgaatatctattactctnacgtccacctataacnaaaaact

SEQ ID NO: 12115 - DNA, 879 bp, Artificial Sequence
  chemically treated genomic DNA (Homo sapiens) CpG-island No: 12115
  misc_feature (512)..(512): n is either a, c, g or t
  misc_feature (649)..(649): n is either a, c, g or t
  misc_feature (674)..(674): n is either a, c, g or t
  misc_feature (744)..(744): n is either a, c, g or t
  misc_feature (780)..(780): n is either a, c, g or t
  misc_feature (811)..(811): n is either a, c, g or t
  misc_feature (856)..(856): n is either a, c, g or t
  misc_feature (872)..(872): n is either a, c, g or t
tatttttcgtagtttttttttttcgtttttattttttttttttcggtcgtgggttttatttacgttttttcgggtttggggagggggcggaggttcggcgtgataagcggtttagattttcgtgggcgtcgtatatttgttgtttgtagtagttagcgattcgtattatcgttttcggcgggcggggaagcggtcgtagcggagtcgattcggtaggtggtcgcgggcggggtcggcgagcgaaagtgcgcgggggttcgattatcgcggggtcgggacgcgatggcggcggtagagttcgcgagttcgggttagtaggcgtcggtagggtaggggtagggttagcggtcgtcgtcgtagttttcgtaggcgtaagtttcgtagtcgttttcgtcgtcgtagttcgggggcgtcgggggcggtagtagtaggtacgagaagagtttggggttgtttattattaagttcgtgtcgttgttgtaggaggttaaggacggcgttttggattttanaagcggtgagtttcggaggcggggacgggggcggatttcggaattcgtggttttcggggaagtttagtttttcgtcgcgtgggtttagcggcgtggtgtagacgcgttttgcggggattcgggatcgggtaattcgnaggattatgtggtttgcgttcgggntcgtggacgtcgggatgggggagggacgagggattaggatggtatcgagcggacgcgtaattaatggggnttcggcgttacgttgggttttcgataaagagtttanggatttcgagcgcgttcgcgtggtttttgtntttcgggcgtagggatttgagggtaatcgagtgtttgttgttttngcgtttatttgtggtnagaggtt

SEQ ID NO: 12116 - DNA, 879 bp, Artificial Sequence
  chemically treated genomic DNA (Homo sapiens) CpG-island No: 12116
  misc_feature (8)..(8): n is either a, c, g or t
  misc_feature (24)..(24): n is either a, c, g or t
  misc_feature (69)..(69): n is either a, c, g or t
  misc_feature (100)..(100): n is either a, c, g or t
  misc_feature (136)..(136): n is either a, c, g or t
  misc_feature (206)..(206): n is either a, c, g or t
  misc_feature (231)..(231): n is either a, c, g or t
  misc_feature (368)..(368): n is either a, c, g or t
aacctctnaccacaaataaacgcnaaaacaacaaacactcgattaccctcaaatccctacgcccgaaanacaaaaaccacgcgaacgcgctcgaaatccntaaactctttatcgaaaacccaacgtaacgccgaanccccattaattacgcgtccgctcgataccatcctaatccctcgtccctcccccatcccgacgtccacgancccgaacgcaaaccacataatcctncgaattacccgatcccgaatccccgcaaaacgcgtctacaccacgccgctaaacccacgcgacgaaaaactaaacttccccgaaaaccacgaattccgaaatccgcccccgtccccgcctccgaaactcaccgcttntaaaatccaaaacgccgtccttaacctcctacaacaacgacacgaacttaataataaacaaccccaaactcttctcgtacctactactaccgcccccgacgcccccgaactacgacgacgaaaacgactacgaaacttacgcctacgaaaactacgacgacgaccgctaaccctacccctaccctaccgacgcctactaacccgaactcgcgaactctaccgccgccatcgcgtcccgaccccgcgataatcgaacccccgcgcactttcgctcgccgaccccgcccgcgaccacctaccgaatcgactccgctacgaccgcttccccgcccgccgaaaacgataatacgaatcgctaactactacaaacaacaaatatacgacgcccacgaaaatctaaaccgcttatcacgccgaacctccgccccctccccaaacccgaaaaaacgtaaataaaacccacgaccgaaaaaaaaaaaataaaaacgaaaaaaaaaaactacgaaaaata

SEQ ID NO: 12117 - DNA, 520 bp, Artificial Sequence
  chemically treated genomic DNA (Homo sapiens) CpG-island No: 12117
  misc_feature (145)..(145): n is either a, c, g or t
  misc_feature (501)..(501): n is either a, c, g or t
ggtatttcggtaggtaagttttggaggagcggggaggtcgaaagttagattgcgtttatttatggttttggtaaagtagtgtcgcgtttttattttggtgtcgtcgttagttattcgtggtttcggttttggggagtgcgcgggntcgtttttggttgcggagcgttttttatttttgtaagtttttgtttatgaagtatatattttcgtagttgttgtcgtcgttttcgttttttattttcgtttttgtcgttattatcgtcgtcgtcgtttttatagtattggcgacggggagcggggttttaatcggtatttagcgaggggttcgtgagtttgggataagtttttcggaagcgcggaagggcggttcgagggggcggggcggggcgaggatttattttttaatcgatagtcgggaattttttcgttttgacggtgacgtaaaattggaattttcgttttaattgtgggtttttttcgtttttatagtatttgcggtgncgatttttgaatttgttgt

SEQ ID NO: 12118 - DNA, 520 bp, Artificial Sequence
  chemically treated genomic DNA (Homo sapiens) CpG-island No: 12118
  misc_feature (20)..(20): n is either a, c, g or t
  misc_feature (376)..(376): n is either a, c, g or t
acaacaaattcaaaaatcgncaccgcaaatactataaaaacgaaaaaaacccacaattaaaacgaaaattccaattttacgtcaccgtcaaaacgaaaaaattcccgactatcgattaaaaaataaatcctcgccccgccccgccccctcgaaccgcccttccgcgcttccgaaaaacttatcccaaactcacgaacccctcgctaaataccgattaaaaccccgctccccgtcgccaatactataaaaacgacgacgacgataataacgacaaaaacgaaaataaaaaacgaaaacgacgacaacaactacgaaaatatatacttcataaacaaaaacttacaaaaataaaaaacgctccgcaaccaaaaacgancccgcgcactccccaaaaccgaaaccacgaataactaacgacgacaccaaaataaaaacgcgacactactttaccaaaaccataaataaacgcaatctaactttcgacctccccgctcctccaaaacttacctaccgaaatacc

SEQ ID NO: 12119 - DNA, 520 bp, Artificial Sequence
  chemically treated genomic DNA (Homo sapiens) CpG-island No: 12119
  misc_feature (20)..(20): n is either a, c, g or t
  misc_feature (376)..(376): n is either a, c, g or t
atagtaagtttaagagtcgntatcgtagatgttgtaaaaacgaaagaagtttatagttgggacgaggattttagttttgcgttatcgttaaggcgggaaagttttcggttgtcggttggagggtgggttttcgtttcgtttcgttttttcgggtcgttttttcgcgttttcgggaggtttgttttaagtttacggatttttcgttgggtgtcggttaagatttcgtttttcgtcgttagtgttatggaggcggcggcggcggtggtggcggtagaggcggaagtggaaaacgaagacggcgatagtagttgcggggatgtatgttttatggataaaggtttgtagaggtaaagggcgtttcgtagttaggagcganttcgcgtattttttagagtcggggttacgagtggttggcggcgatattagagtggaggcgcggtattgttttattaagattataagtgaacgtagtttggttttcggttttttcgtttttttaaaatttatttgtcgaagtgtt

SEQ ID NO: 12120 - DNA, 520 bp, Artificial Sequence
  chemically treated genomic DNA (Homo sapiens) CpG-island No: 12120
  misc_feature (145)..(145): n is either a, c, g or t
  misc_feature (501)..(501): n is either a, c, g or t
aacacttcgacaaataaattttaaaaaaacgaaaaaaccgaaaaccaaactacgttcacttataatcttaataaaacaataccgcgcctccactctaatatcgccgccaaccactcgtaaccccgactctaaaaaatacgcgaantcgctcctaactacgaaacgccctttacctctacaaacctttatccataaaacatacatccccgcaactactatcgccgtcttcgttttccacttccgcctctaccgccaccaccgccgccgccgcctccataacactaacgacgaaaaacgaaatcttaaccgacacccaacgaaaaatccgtaaacttaaaacaaacctcccgaaaacgcgaaaaaacgacccgaaaaaacgaaacgaaacgaaaacccaccctccaaccgacaaccgaaaactttcccgccttaacgataacgcaaaactaaaatcctcgtcccaactataaacttctttcgtttttacaacatctacgatancgactcttaaacttactat

SEQ ID NO: 12121 - DNA, 637 bp, Artificial Sequence
  chemically treated genomic DNA (Homo sapiens) CpG-island No: 12121
cgtggggcggagtgtcgggcgtagtttatttcgtaagcgcgggtttagggtttcgacgtgttagcgtagtttcgaagagtgcgggttcggggttttcgcggcgtttttttttttttttagtttttcgggggcgatcgcgtttttcgtcgaggttcgttttcgtcgtatttttattattttcgttgggaggatttcggcgtacgttttcgttttcgtatttcggggcgacggcgtatttatttttcgtatggtgtttgggtcgttcgggcggggttcggcgatttgggcgcgagaagggttgggtcggcggcgacgttcggtcggtcgggagtttcgcgttgtttttttttgtatacgtttgcgtcgcggtcgttaagtcggcgggggcggggcggggtagcgttggtcgcggggttttcggggttttttcgggttgcggcggaggcgcggagtcggttaagggcgtattgagttcgcggagtttcggggtttcggggtttttttgtcgtcgtcgtagcgttttcgttttttcgggtcgtttcgttttttttttttttttcgagttttggttttattaggagcggagcgagttttcgatgtttgtttcgcggtttttagaattgagttggagaagttt

SEQ ID NO: 12122 - DNA, 637 bp, Artificial Sequence
  chemically treated genomic DNA (Homo sapiens) CpG-island No: 12122
aaacttctccaactcaattctaaaaaccgcgaaacaaacatcgaaaactcgctccgctcctaataaaaccaaaactcgaaaaaaaaaaaaaaaacgaaacgacccgaaaaaacgaaaacgctacgacgacgacaaaaaaaccccgaaaccccgaaactccgcgaactcaatacgcccttaaccgactccgcgcctccgccgcaacccgaaaaaaccccgaaaaccccgcgaccaacgctaccccgccccgcccccgccgacttaacgaccgcgacgcaaacgtatacaaaaaaaaacaacgcgaaactcccgaccgaccgaacgtcgccgccgacccaacccttctcgcgcccaaatcgccgaaccccgcccgaacgacccaaacaccatacgaaaaataaatacgccgtcgccccgaaatacgaaaacgaaaacgtacgccgaaatcctcccaacgaaaataataaaaatacgacgaaaacgaacctcgacgaaaaacgcgatcgcccccgaaaaactaaaaaaaaaaaaaaacgccgcgaaaaccccgaacccgcactcttcgaaactacgctaacacgtcgaaaccctaaacccgcgcttacgaaataaactacgcccgacactccgccccacg

SEQ ID NO: 12123 - DNA, 637 bp, Artificial Sequence
  chemically treated genomic DNA (Homo sapiens) CpG-island No: 12123
aagtttttttagtttagttttgggggtcgcggggtaggtatcggagattcgtttcgtttttggtggggttagaattcgaggaagaggagaggggcgaagcggttcgaggaggcggggacgttgcgacggcggtagaaaggtttcggggtttcggagtttcgcgagtttagtgcgtttttggtcggtttcgcgttttcgtcgtagttcgggagagtttcggggatttcgcggttagcgttatttcgtttcgttttcgtcggtttggcggtcgcggcgtaggcgtgtgtaggagggggtagcgcggagttttcggtcggtcgagcgtcgtcgtcggtttagtttttttcgcgtttaagtcgtcgagtttcgttcggacggtttagatattatgcggagggtgagtgcgtcgtcgtttcggggtgcgggggcgggggcgtgcgtcggggtttttttagcgggaatagtgagggtgcggcggggacggatttcggcggggagcgcggtcgttttcgggggattgaggaggggaaggggcgtcgcggggatttcgggttcgtatttttcggggttgcgttggtacgtcggagttttgggttcgcgtttgcgaggtgggttgcgttcggtatttcgttttacg

SEQ ID NO: 12124 - DNA, 637 bp, Artificial Sequence
  chemically treated genomic DNA (Homo sapiens) CpG-island No: 12124
cgtaaaacgaaataccgaacgcaacccacctcgcaaacgcgaacccaaaactccgacgtaccaacgcaaccccgaaaaatacgaacccgaaatccccgcgacgccccttcccctcctcaatcccccgaaaacgaccgcgctccccgccgaaatccgtccccgccgcaccctcactattcccgctaaaaaaaccccgacgcacgcccccgcccccgcaccccgaaacgacgacgcactcaccctccgcataatatctaaaccgtccgaacgaaactcgacgacttaaacgcgaaaaaaactaaaccgacgacgacgctcgaccgaccgaaaactccgcgctaccccctcctacacacgcctacgccgcgaccgccaaaccgacgaaaacgaaacgaaataacgctaaccgcgaaatccccgaaactctcccgaactacgacgaaaacgcgaaaccgaccaaaaacgcactaaactcgcgaaactccgaaaccccgaaacctttctaccgccgtcgcaacgtccccgcctcctcgaaccgcttcgcccctctcctcttcctcgaattctaaccccaccaaaaacgaaacgaatctccgatacctaccccgcgacccccaaaactaaactaaaaaaactt

SEQ ID NO: 12125 - DNA, 563 bp, Artificial Sequence
  chemically treated genomic DNA (Homo sapiens) CpG-island No: 12125
attcgtcgtttaatttagtcgttagtttttcgtgattttcgttttcggttttaatttttttttttgaggagagtggtttaaacggtgaaggttgcggggcgtcgtcggaagtgtcgtaaacgtcggatattcggtttttttgggcgttaagggagttgacggagagggttatcgtttagtaatagacggtgttttagtttgttgagttcgtagttttcgtggtgtgagtgagttcgggttcgtgttttttttttcgtcgtcgttatgggttgtacgttgagcgtcgaagataaggcggtagtggagcgaagtaagatgatcgatcgtaatttacgggaggacggggaaaaagcggttaaagaagtgaagttgttgttattcggtgaggggttggaggcggggattgagtggtggtcgggagagtttaggcgtttggaaggtttgaacggggtttggtcgggtcgacggaaaggattttaaagggatttggagggcgtgtcgggcgtggggcggggtgttggggtttttagttgaggttttagagggcgtgatgaggggggtgg

SEQ ID NO: 12126 - DNA, 563 bp, Artificial Sequence
  chemically treated genomic DNA (Homo sapiens) CpG-island No: 12126
ccacccccctcatcacgccctctaaaacctcaactaaaaaccccaacaccccgccccacgcccgacacgccctccaaatccctttaaaatcctttccgtcgacccgaccaaaccccgttcaaaccttccaaacgcctaaactctcccgaccaccactcaatccccgcctccaacccctcaccgaataacaacaacttcacttctttaaccgctttttccccgtcctcccgtaaattacgatcgatcatcttacttcgctccactaccgccttatcttcgacgctcaacgtacaacccataacgacgacgaaaaaaaaaacacgaacccgaactcactcacaccacgaaaactacgaactcaacaaactaaaacaccgtctattactaaacgataaccctctccgtcaactcccttaacgcccaaaaaaaccgaatatccgacgtttacgacacttccgacgacgccccgcaaccttcaccgtttaaaccactctcctcaaaaaaaaaaattaaaaccgaaaacgaaaatcacgaaaaactaacgactaaattaaacgacgaat

SEQ ID NO: 12127 - DNA, 563 bp, Artificial Sequence
  chemically treated genomic DNA (Homo sapiens) CpG-island No: 12127
ttattttttttattacgttttttggggttttagttaggaattttaatatttcgttttacgttcggtacgttttttagatttttttagggtttttttcgtcggttcgattagatttcgtttaggttttttaagcgtttaggttttttcgattattatttagttttcgtttttagttttttatcgagtagtagtagttttatttttttggtcgtttttttttcgttttttcgtaagttgcggtcgattattttgtttcgttttattgtcgttttgttttcggcgtttaacgtgtagtttatggcggcggcgggagaggggatacgggttcggatttatttatattacggaaattgcgggtttagtaggttgaggtatcgtttattgttgggcggtggtttttttcgttagtttttttagcgtttagaagaatcggatattcgacgtttacgatattttcggcgacgtttcgtagtttttatcgtttaaattattttttttagggagaggagttgagatcgaaagcggaagttacggggagttggcggttgggttgggcggcggat

SEQ ID NO: 12128 - DNA, 563 bp, Artificial Sequence
  chemically treated genomic DNA (Homo sapiens) CpG-island No: 12128
atccgccgcccaacccaaccgccaactccccgtaacttccgctttcgatctcaactcctctccctaaaaaaaataatttaaacgataaaaactacgaaacgtcgccgaaaatatcgtaaacgtcgaatatccgattcttctaaacgctaaaaaaactaacgaaaaaaaccaccgcccaacaataaacgatacctcaacctactaaacccgcaatttccgtaatataaataaatccgaacccgtatcccctctcccgccgccgccataaactacacgttaaacgccgaaaacaaaacgacaataaaacgaaacaaaataatcgaccgcaacttacgaaaaaacgaaaaaaaaacgaccaaaaaaataaaactactactactcgataaaaaactaaaaacgaaaactaaataataatcgaaaaaacctaaacgcttaaaaaacctaaacgaaatctaatcgaaccgacgaaaaaaaccctaaaaaaatctaaaaaacgtaccgaacgtaaaacgaaatattaaaattcctaactaaaaccccaaaaaacgtaataaaaaaaataa

SEQ ID NO: 12129 - DNA, 1517 bp, Artificial Sequence
  chemically treated genomic DNA (Homo sapiens) CpG-island No: 12129
gatgaagaatgttatttgcgcgtttggatagcgtagaatcgtaattagtttgttttaaaattagatgttatagtttggttttggggacgtttttttttttaaggtataagtgcgagcgttcgttgttgtgcgtggaattgcggtcgggagggagtggcggcgtgaacgtcggcggttgtagagatatatcggtcgcggtttttattattttgtaggggtttgcggtcgttatttcggtttgttttcgattagttgtgcgatttcgaatacgtcgtgagtcggtttttcggttcgggatcgaattcgaggagtgttgtttggggtcgtagtgaggttaagggaggtcgtaggtgttaagcgtttcgtttgtcgggcgagggttaattcgaggttacgcgcgaggagcggtcgtagcgattggataaaataaagataaagataaagacggttttttttttgttcgcgttttagtcgcgacggtagttttcgcggtcgttaaacgggcgtgattttcgaggcgttttcgtcggggcgttgtttgcgatcgtgggtttaggtcgttcgtcgagtttagcgttttggtcgaaatttcgatttcgatttcgatttggatttattagtcgtttcgtttttttcgcggtttcgttcgtttcggcgtttttattagtttcgggaggtttttgcgcggcggttatcgggatgagtagtaggagtagcgcggcgttatcgaggcgtaatttttagtacggcgtcggttcgcgggttatttcgggcgttatggtcggtcggtcgttttattagttagtggagcgttataatttcgattttagtataagcggttttcgttcggaatagtcgcggcgtcggaagtggatttgcgaggtggggttatgcgagtgcgtagttttaaaaagtagttcgtttcgttttttcgttattcgtttcgttttttcgttaacgggttcgtttttcggcgcggttgaggtttagtgcgtttgcgcgatagaggaaaggagtttggtagcgaggagagcggttgaggtttagtgcgtttgcgcggcgcggatgggcgaggcgtgatcgaggggcgaggcgtgatcgaggggcgaggcgtgatcgaggggcgaggcgtgatcgaggggcgaggcgtgatcgaggggcgaggcgtgatcgaggggttcgtcgcggtttttgcgtttgcgcggcggggaacggcgatcggttgaggggattaggggagcgcggtgtttcggtggcggaggttacggtggtttttattttaaagggttgcgggcgtttcggacggcggttttaagcgttgtttacgttgtttttaagtgagttttggacgaggcgcggtgggtttttatagttcgcgtcggcgttttcgttttatatcgcggcgttcggttttgggttttcgtcgatgttcgcgtgggatttttaggggatttgtttatttttgtacgttaattatattagaaacggttttagaatgggttgaaacgtgtgttgtt

SEQ ID NO: 12130 - DNA, 1517 bp, Artificial Sequence
  chemically treated genomic DNA (Homo sapiens) CpG-island No: 12130
aacaacacacgtttcaacccattctaaaaccgtttctaatataattaacgtacaaaaataaacaaatcccctaaaaatcccacgcgaacatcgacgaaaacccaaaaccgaacgccgcgatataaaacgaaaacgccgacgcgaactataaaaacccaccgcgcctcgtccaaaactcacttaaaaacaacgtaaacaacgcttaaaaccgccgtccgaaacgcccgcaaccctttaaaataaaaaccaccgtaacctccgccaccgaaacaccgcgctcccctaatcccctcaaccgatcgccgttccccgccgcgcaaacgcaaaaaccgcgacgaacccctcgatcacgcctcgcccctcgatcacgcctcgcccctcgatcacgcctcgcccctcgatcacgcctcgcccctcgatcacgcctcgcccctcgatcacgcctcgcccatccgcgccgcgcaaacgcactaaacctcaaccgctctcctcgctaccaaactcctttcctctatcgcgcaaacgcactaaacctcaaccgcgccgaaaaacgaacccgttaacgaaaaaacgaaacgaataacgaaaaaacgaaacgaactactttttaaaactacgcactcgcataaccccacctcgcaaatccacttccgacgccgcgactattccgaacgaaaaccgcttatactaaaatcgaaattataacgctccactaactaataaaacgaccgaccgaccataacgcccgaaataacccgcgaaccgacgccgtactaaaaattacgcctcgataacgccgcgctactcctactactcatcccgataaccgccgcgcaaaaacctcccgaaactaataaaaacgccgaaacgaacgaaaccgcgaaaaaaacgaaacgactaataaatccaaatcgaaatcgaaatcgaaatttcgaccaaaacgctaaactcgacgaacgacctaaacccacgatcgcaaacaacgccccgacgaaaacgcctcgaaaatcacgcccgtttaacgaccgcgaaaactaccgtcgcgactaaaacgcgaacaaaaaaaaaaccgtctttatctttatctttattttatccaatcgctacgaccgctcctcgcgcgtaacctcgaattaaccctcgcccgacaaacgaaacgcttaacacctacgacctcccttaacctcactacgaccccaaacaacactcctcgaattcgatcccgaaccgaaaaaccgactcacgacgtattcgaaatcgcacaactaatcgaaaacaaaccgaaataacgaccgcaaacccctacaaaataataaaaaccgcgaccgatatatctctacaaccgccgacgttcacgccgccactccctcccgaccgcaattccacgcacaacaacgaacgctcgcacttataccttaaaaaaaaaaacgtccccaaaaccaaactataacatctaattttaaaacaaactaattacgattctacgctatccaaacgcgcaaataacattcttcatc

SEQ ID NO: 12131 - DNA, 1517 bp, Artificial Sequence
  chemically treated genomic DNA (Homo sapiens) CpG-island No: 12131
agtagtatacgttttagtttattttggggtcgtttttagtgtggttaacgtataaaaataaataaattttttaaaagttttacgcggatatcggcgggagtttagggtcggacgtcgcggtgtggagcgagggcgtcggcgcggattatgagggtttatcgcgtttcgtttagggtttatttaagagtagcgtgagtagcgtttgggatcgtcgttcgggacgttcgtagttttttaggatggaggttatcgtgattttcgttatcgaagtatcgcgtttttttagtttttttagtcggtcgtcgtttttcgtcgcgtaggcgtaggagtcgcggcgagtttttcggttacgtttcgtttttcggttacgtttcgtttttcggttacgtttcgtttttcggttacgtttcgtttttcggttacgtttcgtttttcggttacgtttcgtttattcgcgtcgcgtaggcgtattgagttttagtcgtttttttcgttattaggttttttttttttatcgcgtaggcgtattgaattttagtcgcgtcgggaggcgagttcgttggcgagggggcggggcggatggcgagggagcggggcgagttgttttttgaggttgcgtattcgtatggttttatttcgtaggtttattttcggcgtcgcggttgtttcgggcggagatcgtttgtgttggagtcggagttgtaacgttttattgattgatagagcgatcggtcgattatggcgttcggagtggttcgcgggtcgacgtcgtattggaggttgcgtttcggtggcgtcgcgttgtttttgttgtttatttcggtggtcgtcgcgtaggagtttttcggagttggtgagggcgtcggggcgggcggggtcgcgaagggggcggggcggttggtgggtttaggtcggggtcggggtcggggtttcggttagggcgttgggttcggcgggcggtttgggtttacggtcgtaggtagcgtttcgacggaggcgtttcgagggttacgttcgtttggcggtcgcgggagttgtcgtcgcggttggggcgcgggtaggggaagagtcgtttttgtttttgtttttgttttgtttagtcgttgcggtcgtttttcgcgcgtggtttcgggttggttttcgttcggtaggcgggacgtttggtatttgcggttttttttagttttattgcgattttaaatagtatttttcgggttcgatttcgagtcgggaagtcggtttacgacgtgttcgaggtcgtatagttggtcgggggtaggtcgggatggcggtcgtaggtttttgtagggtgatgggggtcgcggtcggtgtgtttttatagtcgtcggcgtttacgtcgttattttttttcggtcgtagttttacgtatagtagcgaacgttcgtatttatgttttagaaaggaaggcgtttttaaagttaggttgtagtatttgattttgaagtaagttgattgcggttttacgttgtttagacgcgtaggtggtattttttatt

SEQ ID NO: 12132 - DNA, 1517 bp, Artificial Sequence
  chemically treated genomic DNA (Homo sapiens) CpG-island No: 12132
aataaaaaataccacctacgcgtctaaacaacgtaaaaccgcaatcaacttacttcaaaatcaaatactacaacctaactttaaaaacgccttcctttctaaaacataaatacgaacgttcgctactatacgtaaaactacgaccgaaaaaaaataacgacgtaaacgccgacgactataaaaacacaccgaccgcgacccccatcaccctacaaaaacctacgaccgccatcccgacctacccccgaccaactatacgacctcgaacacgtcgtaaaccgacttcccgactcgaaatcgaacccgaaaaatactatttaaaatcgcaataaaactaaaaaaaaccgcaaataccaaacgtcccgcctaccgaacgaaaaccaacccgaaaccacgcgcgaaaaacgaccgcaacgactaaacaaaacaaaaacaaaaacaaaaacgactcttcccctacccgcgccccaaccgcgacgacaactcccgcgaccgccaaacgaacgtaaccctcgaaacgcctccgtcgaaacgctacctacgaccgtaaacccaaaccgcccgccgaacccaacgccctaaccgaaaccccgaccccgaccccgacctaaacccaccaaccgccccgcccccttcgcgaccccgcccgccccgacgccctcaccaactccgaaaaactcctacgcgacgaccaccgaaataaacaacaaaaacaacgcgacgccaccgaaacgcaacctccaatacgacgtcgacccgcgaaccactccgaacgccataatcgaccgatcgctctatcaatcaataaaacgttacaactccgactccaacacaaacgatctccgcccgaaacaaccgcgacgccgaaaataaacctacgaaataaaaccatacgaatacgcaacctcaaaaaacaactcgccccgctccctcgccatccgccccgccccctcgccaacgaactcgcctcccgacgcgactaaaattcaatacgcctacgcgataaaaaaaaaaaacctaataacgaaaaaaacgactaaaactcaatacgcctacgcgacgcgaataaacgaaacgtaaccgaaaaacgaaacgtaaccgaaaaacgaaacgtaaccgaaaaacgaaacgtaaccgaaaaacgaaacgtaaccgaaaaacgaaacgtaaccgaaaaactcgccgcgactcctacgcctacgcgacgaaaaacgacgaccgactaaaaaaactaaaaaaacgcgatacttcgataacgaaaatcacgataacctccatcctaaaaaactacgaacgtcccgaacgacgatcccaaacgctactcacgctactcttaaataaaccctaaacgaaacgcgataaaccctcataatccgcgccgacgccctcgctccacaccgcgacgtccgaccctaaactcccgccgatatccgcgtaaaacttttaaaaaatttatttatttttatacgttaaccacactaaaaacgaccccaaaataaactaaaacgtatactact

SEQ ID NO: 12133 - DNA, 1370 bp, Artificial Sequence
  chemically treated genomic DNA (Homo sapiens) CpG-island No: 12133
aatcgcggcggtagggaggcgggtggcgtttttaatcgtttagggtgttggttcgattcgcgcggttttcgcggacgggatttcgcgggtcgtttttttcgttttgttcgcggtttttgagagggaacgttatttttagcgttttttttttttcgttttaggtttttgcggttatgggcggcggtttcggttttatttttcggcgttttaggaacgcggtttttaggaaaggagtcggggttcgggcgacgcggggaggcgggtaagggtttttagggttcgggtttttcgtaaacgtttttggttcgcgttttatagcgttttagggttttcgcgttcgtcggggtcgcgcgggattcgttttcgtgacgtatttttaatcgtttagagtcgcggttcggtttgcgcgcgttcgacgtttcggggagcgcgtttcgtgaacgcgcgtagttacgtgattttcgtgtcggttaacgggtgcgtcgggatttgggggataaagcgcggtttcgcgtatagttgcggcgggagagcggcggggtcgagagcgtgattcgttcgtttcgcgttgtttttttcgcgtcgttttttcgcgtcgttcgcgtagttatgttcgaggagaagtttaaggtaagcgcggcgatttcgtttgtacgcgcgtttatcgcgggcgtttcgggcgttttcgtcgtcgcgcgtcgtttttgcggtttttggagacggcggcgtttacggggattcgcgtttaggtttgcggcgtcgttcgcgttttcgtttttttttcgttttcgttcggtcgcgtcgtttttttttttcgttcggttgcgttcggcggcgcgtttcgtttttagttcggtttcgtttttatttcgatttcgtttcgcgtttcgtttttgataggtttcgttttttttcgttttttagagtttcgtttttaagtgggttcgtttaaggtgcgttttttttgttttcgcgaagcgcgttgtgtcgcgagtttcgtttttttcgggtttggttacgttttcgttttacgttcgttttttttttagttgggaaggcgcgcgtttagcgtttttttgagcgttcggtgtcgggtttcgcgttgttgtttttgtagagcgcggcgttttcggatttcgttttagtagtgttttcgaagcgtttttgcgtgttttttttttgagttattgttggttggggtcgttttttttttcggtatcgttttgggtgcgggattttgtgtcgagtgtacggagtcggttcgggaataagcgtttggggttatttttaaggggcgcgttttgaggggtttggtttttgtgagtagtattgtcgtttttttagggcgtttatcgcgatttcggtattta

SEQ ID NO: 12134 - DNA, 1370 bp, Artificial Sequence
  chemically treated genomic DNA (Homo sapiens) CpG-island No: 12134
taaataccgaaatcgcgataaacgccctaaaaaaacgacaatactactcacaaaaaccaaacccctcaaaacgcgccccttaaaaataaccccaaacgcttattcccgaaccgactccgtacactcgacacaaaatcccgcacccaaaacgataccgaaaaaaaaaacgaccccaaccaacaataactcaaaaaaaaaacacgcaaaaacgcttcgaaaacactactaaaacgaaatccgaaaacgccgcgctctacaaaaacaacaacgcgaaacccgacaccgaacgctcaaaaaaacgctaaacgcgcgccttcccaactaaaaaaaaaacgaacgtaaaacgaaaacgtaaccaaacccgaaaaaaacgaaactcgcgacacaacgcgcttcgcgaaaacaaaaaaaacgcaccttaaacgaacccacttaaaaacgaaactctaaaaaacgaaaaaaaacgaaacctatcaaaaacgaaacgcgaaacgaaatcgaaataaaaacgaaaccgaactaaaaacgaaacgcgccgccgaacgcaaccgaacgaaaaaaaaaaacgacgcgaccgaacgaaaacgaaaaaaaaacgaaaacgcgaacgacgccgcaaacctaaacgcgaatccccgtaaacgccgccgtctccaaaaaccgcaaaaacgacgcgcgacgacgaaaacgcccgaaacgcccgcgataaacgcgcgtacaaacgaaatcgccgcgcttaccttaaacttctcctcgaacataactacgcgaacgacgcgaaaaaacgacgcgaaaaaaacaacgcgaaacgaacgaatcacgctctcgaccccgccgctctcccgccgcaactatacgcgaaaccgcgctttatcccccaaatcccgacgcacccgttaaccgacacgaaaatcacgtaactacgcgcgttcacgaaacgcgctccccgaaacgtcgaacgcgcgcaaaccgaaccgcgactctaaacgattaaaaatacgtcacgaaaacgaatcccgcgcgaccccgacgaacgcgaaaaccctaaaacgctataaaacgcgaaccaaaaacgtttacgaaaaacccgaaccctaaaaacccttacccgcctccccgcgtcgcccgaaccccgactcctttcctaaaaaccgcgttcctaaaacgccgaaaaataaaaccgaaaccgccgcccataaccgcaaaaacctaaaacgaaaaaaaaaaaacgctaaaaataacgttccctctcaaaaaccgcgaacaaaacgaaaaaaacgacccgcgaaatcccgtccgcgaaaaccgcgcgaatcgaaccaacaccctaaacgattaaaaacgccacccgcctccctaccgccgcgatt

SEQ ID NO: 12135 - DNA, 1370 bp, Artificial Sequence
  chemically treated genomic DNA (Homo sapiens) CpG-island No: 12135
tgaatatcggggtcgcgatgggcgttttggaaggacggtagtgttgtttataggggttaggttttttagagcgcgttttttgggggtaattttagacgtttgttttcgagtcgatttcgtgtattcgatataggatttcgtatttagggcgatgtcgggggagagggcgattttaattagtaatgatttaggagaggagtacgtaaagacgtttcggggatattgttggggcgggattcgagggcgtcgcgttttgtaggagtagtagcgcggggttcgatatcgggcgtttaaggaggcgttgggcgcgcgtttttttagttggggaggagacgggcgtggagcggaggcgtggttaggttcggagggggcggagttcgcggtatagcgcgtttcgcgggggtagagggggcgtattttgggcgggtttatttaggggcggggttttagagggcggggaggggcggagtttgttaggggcgggacgcggggcggagtcggggtgggggcggagtcgggttgggggcggggcgcgtcgtcgagcgtagtcgggcgggggaggggagcggcgcggtcggacgggagcgggggaggggcgggggcgcgggcggcgtcgtaggtttgggcgcgggttttcgtgggcgtcgtcgtttttaagggtcgtaggagcggcgcgcggcggcggaggcgttcgggacgttcgcgatagacgcgcgtgtaggcggggtcgtcgcgtttattttgggttttttttcggatatggttgcgcgagcggcgcggggaggcggcgcgggggaagtagcgcggagcgggcgagttacgttttcggtttcgtcgttttttcgtcgtaattgtgcgcggggtcgcgttttattttttaaatttcggcgtattcgttggtcggtacgggggttacgtggttgcgcgcgtttacgaggcgcgtttttcggggcgtcgggcgcgcgtaggtcgggtcgcggttttgggcggttggagatgcgttacgggggcgggtttcgcgcgatttcggcgggcgcggaagttttagggcgttgtggggcgcgggttaggagcgtttacggggagttcgggttttggggatttttgttcgttttttcgcgtcgttcgggtttcgattttttttttgggggtcgcgtttttggggcgtcgggaagtgaggtcggggtcgtcgtttatggtcgtagggatttggggcggaggagggaggacgttgggggtgacgtttttttttaggagtcgcggatagagcggagaaggcggttcgcggggtttcgttcgcgggggtcgcgcgaatcgggttagtattttagacgattgggggcgttattcgtttttttgtcgtcgcggtt

SEQ ID NO: 12136 - DNA, 1370 bp, Artificial Sequence
  chemically treated genomic DNA (Homo sapiens) CpG-island No: 12136
aaccgcgacgacaaaaaaacgaataacgcccccaatcgtctaaaatactaacccgattcgcgcgacccccgcgaacgaaaccccgcgaaccgccttctccgctctatccgcgactcctaaaaaaaaacgtcacccccaacgtcctccctcctccgccccaaatccctacgaccataaacgacgaccccgacctcacttcccgacgccccaaaaacgcgacccccaaaaaaaaaatcgaaacccgaacgacgcgaaaaaacgaacaaaaatccccaaaacccgaactccccgtaaacgctcctaacccgcgccccacaacgccctaaaacttccgcgcccgccgaaatcgcgcgaaacccgcccccgtaacgcatctccaaccgcccaaaaccgcgacccgacctacgcgcgcccgacgccccgaaaaacgcgcctcgtaaacgcgcgcaaccacgtaacccccgtaccgaccaacgaatacgccgaaatttaaaaaataaaacgcgaccccgcgcacaattacgacgaaaaaacgacgaaaccgaaaacgtaactcgcccgctccgcgctacttcccccgcgccgcctccccgcgccgctcgcgcaaccatatccgaaaaaaaacccaaaataaacgcgacgaccccgcctacacgcgcgtctatcgcgaacgtcccgaacgcctccgccgccgcgcgccgctcctacgacccttaaaaacgacgacgcccacgaaaacccgcgcccaaacctacgacgccgcccgcgcccccgcccctcccccgctcccgtccgaccgcgccgctcccctcccccgcccgactacgctcgacgacgcgccccgcccccaacccgactccgcccccaccccgactccgccccgcgtcccgcccctaacaaactccgcccctccccgccctctaaaaccccgcccctaaataaacccgcccaaaatacgccccctctacccccgcgaaacgcgctataccgcgaactccgccccctccgaacctaaccacgcctccgctccacgcccgtctcctccccaactaaaaaaacgcgcgcccaacgcctccttaaacgcccgatatcgaaccccgcgctactactcctacaaaacgcgacgccctcgaatcccgccccaacaatatccccgaaacgtctttacgtactcctctcctaaatcattactaattaaaatcgccctctcccccgacatcgccctaaatacgaaatcctatatcgaatacacgaaatcgactcgaaaacaaacgtctaaaattacccccaaaaaacgcgctctaaaaaacctaacccctataaacaacactaccgtccttccaaaacgcccatcgcgaccccgatattca

SEQ ID NO: 12137 - DNA, 760 bp, Artificial Sequence
  chemically treated genomic DNA (Homo sapiens) CpG-island No: 12137
ttcgcgttcggcgttggtttcgttttcgcggttcgtatttgatttacgttttcgttcgtttttagttgtacgttgtcgcggtttcggtttttattgtcgtttagtaggtcgtttttcgagttttcgagtagcgacgaggagttagtggaggagatcgacgaggtggaaaggcggcgcggttgttgtaggtgcgaagagttcgttgtcgggaggtagtttttttttcgtttcggcggtttagggttggtcgggggtacgtcgggtttttcggttgttacggttagttgagggattatcggggtcgggggagttcgcggaagttcgttggggatttgttttttacgtcgtttggtttcgcgggttcggggttttttcgcggcggcggtcgtagcgatcgtcgtatagcgcgtttcgaagagtaggcgtagtttttcgatatttcggcgcggggttcgttttagtttcgggttgtagggtttcgcgtttttcggtcgcgttatgttcgttgggttttcgggtagggttattttttagtgtcggcgtcgtcgttgagtttattagttcgcggcgcgtcggggattggagcggttcggcgttttcggttggagacggtttcggggcggagtttgcgtcgttgtacgttcgcgtttcgtttcggtcgcgtttttcgtttattttttttatttttagagaaagcgcgggttttttagggtttttgcgagggagagaaggttttcggtgatttttcggggtggcgggg

SEQ ID NO: 12138 - DNA, 760 bp, Artificial Sequence
  chemically treated genomic DNA (Homo sapiens) CpG-island No: 12138
ccccgccaccccgaaaaatcaccgaaaaccttctctccctcgcaaaaaccctaaaaaacccgcgctttctctaaaaataaaaaaaataaacgaaaaacgcgaccgaaacgaaacgcgaacgtacaacgacgcaaactccgccccgaaaccgtctccaaccgaaaacgccgaaccgctccaatccccgacgcgccgcgaactaataaactcaacgacgacgccgacactaaaaaataaccctacccgaaaacccaacgaacataacgcgaccgaaaaacgcgaaaccctacaacccgaaactaaaacgaaccccgcgccgaaatatcgaaaaactacgcctactcttcgaaacgcgctatacgacgatcgctacgaccgccgccgcgaaaaaaccccgaacccgcgaaaccaaacgacgtaaaaaacaaatccccaacgaacttccgcgaactcccccgaccccgataatccctcaactaaccgtaacaaccgaaaaacccgacgtacccccgaccaaccctaaaccgccgaaacgaaaaaaaaactacctcccgacaacgaactcttcgcacctacaacaaccgcgccgcctttccacctcgtcgatctcctccactaactcctcgtcgctactcgaaaactcgaaaaacgacctactaaacgacaataaaaaccgaaaccgcgacaacgtacaactaaaaacgaacgaaaacgtaaatcaaatacgaaccgcgaaaacgaaaccaacgccgaacgcgaa

SEQ ID NO: 12139 - DNA, 760 bp, Artificial Sequence
  chemically treated genomic DNA (Homo sapiens) CpG-island No: 12139
tttcgttatttcgaggagttatcgagagttttttttttttcgtaggggttttgggaggttcgcgttttttttgaaagtggaaggagtgggcggggggcgcggtcgaggcggggcgcgggcgtgtagcggcgtaggtttcgtttcggggtcgtttttagtcgggggcgtcgagtcgttttagttttcggcgcgtcgcgggttggtgggtttagcggcggcgtcggtattgggaaatgattttgttcgggggtttaacgggtatggcgcggtcggggggcgcgaggttttgtagttcggggttggagcgggtttcgcgtcggagtgtcggggagttgcgtttgtttttcgaggcgcgttgtgcggcggtcgttgcggtcgtcgtcgcgggggagtttcgggttcgcggggttaagcggcgtgggggataggtttttaacgggttttcgcgggttttttcggtttcggtgattttttagttgatcgtgatagtcgaggagttcgacgtgttttcgattagttttgggtcgtcggagcgggagagggattgtttttcggtagcgggtttttcgtatttgtagtagtcgcgtcgtttttttatttcgtcggttttttttattggtttttcgtcgttgttcgaggattcggaggacgatttgttgagcgatagtgagagtcggagtcgcggtaacgtgtagttggaagcgggcgaggacgtgggttaggtacgggtcgcgggggcggggttagcgtcgggcgcggg

SEQ ID NO: 12140 - DNA, 760 bp, Artificial Sequence
  chemically treated genomic DNA (Homo sapiens) CpG-island No: 12140
cccgcgcccgacgctaaccccgcccccgcgacccgtacctaacccacgtcctcgcccgcttccaactacacgttaccgcgactccgactctcactatcgctcaacaaatcgtcctccgaatcctcgaacaacgacgaaaaaccaataaaaaaaaccgacgaaataaaaaaacgacgcgactactacaaatacgaaaaacccgctaccgaaaaacaatccctctcccgctccgacgacccaaaactaatcgaaaacacgtcgaactcctcgactatcacgatcaactaaaaaatcaccgaaaccgaaaaaacccgcgaaaacccgttaaaaacctatcccccacgccgcttaaccccgcgaacccgaaactcccccgcgacgacgaccgcaacgaccgccgcacaacgcgcctcgaaaaacaaacgcaactccccgacactccgacgcgaaacccgctccaaccccgaactacaaaacctcgcgccccccgaccgcgccatacccgttaaacccccgaacaaaatcatttcccaataccgacgccgccgctaaacccaccaacccgcgacgcgccgaaaactaaaacgactcgacgcccccgactaaaaacgaccccgaaacgaaacctacgccgctacacgcccgcgccccgcctcgaccgcgccccccgcccactccttccactttcaaaaaaaacgcgaacctcccaaaacccctacgaaaaaaaaaaaactctcgataactcctcgaaataacgaaa

SEQ ID NO: 12141 - DNA, 895 bp, Artificial Sequence
  chemically treated genomic DNA (Homo sapiens) CpG-island No: 12141
agcgggaaagttttgggggtcgttttgcgttttaagatagacgtttataattttttttacgtcgtgtaatatttaagtaggcggtttttttttcgcgttttcgcgtttataggttgggttaattatagtgtcgtattttttatattgttcgataggcggtgggcgggtcgttggtgattgttatttaataggcgtcgcggttgtttcggtggcgttattgattcggaggcggttgcggagagcggggcgttggttcgtggaggcggtagcggcggcggttttttagcggattcgaggtgcgacggatagagacgcggggcggtaggtcgggcggcgaagtcggcgagggcgaggttatgggtttgagcggtcggggttggcgaatttcgcgtgtggtcggtttcggcggcgaggttcgtttcgttgaagtacgcggggatttcgaacggcggtgtaggcgaggttagcgaggcgggcgggggattggcgcgttttttgggcggtattggagtttcggcgtttttatagcgggcgtcgatatcgtaaaagtcgttttcgaacgaagtcgcggggtcggttttttaaatttggttatgttttcggggaaagttagaaattcgtatatatgtttttttttgtcgtggagattgatggagtttttgttgcggggcggggattttagcgagagggggacgtgaagttcgtttcgtatttaggcgtgtgtgtttttgatcgacgcgtaggacgttttggaggacggcgttagtttttgatttagtgtgaggtgttcggacggtttttttaagaagcgcgtatttaagatgagatttgaagttgagcgtgaatttaaggtggggtagggggtgggtaggcgagagaacgtatagggtttgat

SEQ ID NO: 12142 - DNA, 895 bp, Artificial Sequence
  chemically treated genomic DNA (Homo sapiens) CpG-island No: 12142
atcaaaccctatacgttctctcgcctacccaccccctaccccaccttaaattcacgctcaacttcaaatctcatcttaaatacgcgcttcttaaaaaaaccgtccgaacacctcacactaaatcaaaaactaacgccgtcctccaaaacgtcctacgcgtcgatcaaaaacacacacgcctaaatacgaaacgaacttcacgtccccctctcgctaaaatccccgccccgcaacaaaaactccatcaatctccacgacaaaaaaaaacatatatacgaatttctaactttccccgaaaacataaccaaatttaaaaaaccgaccccgcgacttcgttcgaaaacgacttttacgatatcgacgcccgctataaaaacgccgaaactccaataccgcccaaaaaacgcgccaatcccccgcccgcctcgctaacctcgcctacaccgccgttcgaaatccccgcgtacttcaacgaaacgaacctcgccgccgaaaccgaccacacgcgaaattcgccaaccccgaccgctcaaacccataacctcgccctcgccgacttcgccgcccgacctaccgccccgcgtctctatccgtcgcacctcgaatccgctaaaaaaccgccgccgctaccgcctccacgaaccaacgccccgctctccgcaaccgcctccgaatcaataacgccaccgaaacaaccgcgacgcctattaaataacaatcaccaacgacccgcccaccgcctatcgaacaatataaaaaatacgacactataattaacccaacctataaacgcgaaaacgcgaaaaaaaaaccgcctacttaaatattacacgacgtaaaaaaaattataaacgtctatcttaaaacgcaaaacgacccccaaaactttcccgct

SEQ ID NO: 12143 - DNA, 895 bp, Artificial Sequence
  chemically treated genomic DNA (Homo sapiens) CpG-island No: 12143
gttaggttttgtgcgttttttcgtttgtttattttttattttattttgagtttacgtttaattttagattttattttaaatacgcgttttttagggaaatcgttcgggtattttatattaggttaggagttggcgtcgttttttagggcgttttacgcgtcggttaggggtatatacgtttgagtacggaacgaattttacgtttttttttcgttagagttttcgtttcgtagtagaggttttattagtttttacggtaagaagaagtatatgtgcgaatttttagtttttttcggggatataattaagtttgggagatcggtttcgcgatttcgttcgagaacgatttttgcggtgtcggcgttcgttatgagggcgtcggaattttagtgtcgtttaaggaacgcgttagtttttcgttcgtttcgttggtttcgtttatatcgtcgttcggagttttcgcgtgttttagcgggacgggtttcgtcgtcgggatcggttatacgcggggttcgttaatttcgatcgtttaagtttatggtttcgttttcgtcggtttcgtcgttcgatttgtcgtttcgcgtttttgttcgtcgtatttcggattcgttagaaagtcgtcgtcgttgtcgtttttacgggttagcgtttcgtttttcgtagtcgttttcgagttagtggcgttatcggagtagtcgcggcgtttgttgggtaatagttattagcggttcgtttatcgtttgtcgggtagtatgaaaagtgcggtattgtgattggtttagtttgtgggcgcgaaagcgcgggaaggaggtcgtttgtttgaatgttgtacgacgtagaagagattgtgggcgtttgttttggagcgtagagcggtttttaagattttttcgtt

SEQ ID NO: 12144 - DNA, 895 bp, Artificial Sequence
  chemically treated genomic DNA (Homo sapiens) CpG-island No: 12144
aacgaaaaaatcttaaaaaccgctctacgctccaaaacaaacgcccacaatctcttctacgtcgtacaacattcaaacaaacgacctccttcccgcgctttcgcgcccacaaactaaaccaatcacaataccgcacttttcatactacccgacaaacgataaacgaaccgctaataactattacccaacaaacgccgcgactactccgataacgccactaactcgaaaacgactacgaaaaacgaaacgctaacccgtaaaaacgacaacgacgacgactttctaacgaatccgaaatacgacgaacaaaaacgcgaaacgacaaatcgaacgacgaaaccgacgaaaacgaaaccataaacttaaacgatcgaaattaacgaaccccgcgtataaccgatcccgacgacgaaacccgtcccgctaaaacacgcgaaaactccgaacgacgatataaacgaaaccaacgaaacgaacgaaaaactaacgcgttccttaaacgacactaaaattccgacgccctcataacgaacgccgacaccgcaaaaatcgttctcgaacgaaatcgcgaaaccgatctcccaaacttaattatatccccgaaaaaaactaaaaattcgcacatatacttcttcttaccgtaaaaactaataaaacctctactacgaaacgaaaactctaacgaaaaaaaaacgtaaaattcgttccgtactcaaacgtatatacccctaaccgacgcgtaaaacgccctaaaaaacgacgccaactcctaacctaatataaaatacccgaacgatttccctaaaaaacgcgtatttaaaataaaatctaaaattaaacgtaaactcaaaataaaataaaaaataaacaaacgaaaaaacgcacaaaacctaac

SEQ ID NO: 12145 - DNA, 664 bp, Artificial Sequence
  chemically treated genomic DNA (Homo sapiens) CpG-island No: 12145
  misc_feature (230)..(230): n is either a, c, g or t
  misc_feature (237)..(237): n is either a, c, g or t
ttttcgtcggtcggtcgggttcggagtttttaagatttcgttttattcggtgcggcgggcgttgatgtatcggggtatttatatcgtgtttaatttgttgtcgaagtagcgttcggtggatatttcggaggacgagttggagggtgagtgttcgtcgggattttcgtttcggcggtttttttatttgtgcgtttaggtgaagcgcgggttaggggcgcgggggcgggggncgggggncggttcgtaggtgtcggttgttaggtgggcgttttagttagtagttgtgtttcgcggtaagatttgttcgtatttcggggcgtcgcggtgggggtcgtttaggcggagagcggtttagtttttgttcgcgtggtttttagcgttgcggaaatttgtcgggtttcgtagcggggttacggggtcgcgtagtcggcggtgacggtgcggtaacgcggcggattggggcgggggttcgcgttgagtttttagcgtcggttcggtcggagtattcgtattttgatttttttcgcggcgttcgttcgcggttttttgttcgtattgatatttcgttcgtgtcgttttaaaaatttaatttgttcgggtagtagtagtttagattcgtagggggatggtaggtcgttggttgggcgaggttagagtagagggt

SEQ ID NO: 12146 - DNA, 664 bp, Artificial Sequence
  chemically treated genomic DNA (Homo sapiens) CpG-island No: 12146
  misc_feature (428)..(428): n is either a, c, g or t
  misc_feature (435)..(435): n is either a, c, g or t
accctctactctaacctcgcccaaccaacgacctaccatccccctacgaatctaaactactactacccgaacaaattaaatttttaaaacgacacgaacgaaatatcaatacgaacaaaaaaccgcgaacgaacgccgcgaaaaaaatcaaaatacgaatactccgaccgaaccgacgctaaaaactcaacgcgaacccccgccccaatccgccgcgttaccgcaccgtcaccgccgactacgcgaccccgtaaccccgctacgaaacccgacaaatttccgcaacgctaaaaaccacgcgaacaaaaactaaaccgctctccgcctaaacgacccccaccgcgacgccccgaaatacgaacaaatcttaccgcgaaacacaactactaactaaaacgcccacctaacaaccgacacctacgaaccgncccccgncccccgcccccgcgcccctaacccgcgcttcacctaaacgcacaaataaaaaaaccgccgaaacgaaaatcccgacgaacactcaccctccaactcgtcctccgaaatatccaccgaacgctacttcgacaacaaattaaacacgatataaataccccgatacatcaacgcccgccgcaccgaataaaacgaaatcttaaaaactccgaacccgaccgaccgacgaaaa

SEQ ID NO: 12147 - DNA, 664 bp, Artificial Sequence
  chemically treated genomic DNA (Homo sapiens) CpG-island No: 12147
  misc_feature (428)..(428): n is either a, c, g or t
  misc_feature (435)..(435): n is either a, c, g or t
gttttttgttttgatttcgtttagttagcggtttgttatttttttgcgagtttgagttgttgttgttcgagtagattgaatttttaaagcgatacgagcggaatgttaatgcgagtagagagtcgcgggcgggcgtcgcggaggggattaggatgcgggtgtttcggtcgggtcggcgttgggggtttagcgcggattttcgttttagttcgtcgcgttgtcgtatcgttatcgtcgattgcgcggtttcgtgatttcgttgcggggttcggtaagttttcgtagcgttggggattacgcgggtaggggttgggtcgtttttcgtttgagcgatttttatcgcggcgtttcggggtgcggataggttttgtcgcggggtatagttgttagttggggcgtttatttggtaatcggtatttgcggatcgnttttcgnttttcgttttcgcgtttttggttcgcgttttatttgggcgtataggtaggagggtcgtcggggcggggatttcggcggatatttattttttagttcgtttttcgggatgtttatcgggcgttgtttcgatagtaggttgggtacggtgtagatgtttcggtatattaacgttcgtcgtatcgggtggaacgggattttggaggtttcgggttcggtcggtcggcgaaaa

SEQ ID NO: 12148 - DNA, 664 bp, Artificial Sequence
  chemically treated genomic DNA (Homo sapiens) CpG-island No: 12148
  misc_feature (230)..(230): n is either a, c, g or t
  misc_feature (237)..(237): n is either a, c, g or t
ttttcgccgaccgaccgaacccgaaacctccaaaatcccgttccacccgatacgacgaacgttaatataccgaaacatctacaccgtacccaacctactatcgaaacaacgcccgataaacatcccgaaaaacgaactaaaaaataaatatccgccgaaatccccgccccgacgaccctcctacctatacgcccaaataaaacgcgaaccaaaaacgcgaaaacgaaaancgaaaancgatccgcaaataccgattaccaaataaacgccccaactaacaactataccccgcgacaaaacctatccgcaccccgaaacgccgcgataaaaatcgctcaaacgaaaaacgacccaacccctacccgcgtaatccccaacgctacgaaaacttaccgaaccccgcaacgaaatcacgaaaccgcgcaatcgacgataacgatacgacaacgcgacgaactaaaacgaaaatccgcgctaaacccccaacgccgacccgaccgaaacacccgcatcctaatcccctccgcgacgcccgcccgcgactctctactcgcattaacattccgctcgtatcgctttaaaaattcaatctactcgaacaacaacaactcaaactcgcaaaaaaataacaaaccgctaactaaacgaaatcaaaacaaaaaac

SEQ ID NO: 12149 - DNA, 504 bp, Artificial Sequence
  chemically treated genomic DNA (Homo sapiens) CpG-island No: 12149
ttcgttcggtcgggtggacgagtttcggatatttacgtttattagtttgtttttaagtgtaaagagttcgtttttcgagtcgtttagaaaggcggtaggttatgttttaaaaataaataaggtaaagagagaggggtttgcgttcggggagagttttataggcgcgttagtttggaaggttcgcgaggtcgtatcgtttcggttaggataggtatttaaaaaagttaaagtatatcgattttttaaattcgatcgttgtttttagaggtcgtaaatcgttgtttggcggtgttttaggtcggggtttgtcgtcggagttattaattttcggttttttcgcggcggttagggatttcgatagtatttcgggggtgggatttcgttcgggatttaaaaggtagcgcggtttcgggcgttcgggaattttttttatacgatacggttattaatattaatagaggttcggcgttcgggtttgcgggaatttttcggtcgttgttcggt

SEQ ID NO: 12150 - DNA, 504 bp, Artificial Sequence
  chemically treated genomic DNA (Homo sapiens) CpG-island No: 12150
accgaacaacgaccgaaaaattcccgcaaacccgaacgccgaacctctattaatattaataaccgtatcgtataaaaaaaattcccgaacgcccgaaaccgcgctaccttttaaatcccgaacgaaatcccacccccgaaatactatcgaaatccctaaccgccgcgaaaaaaccgaaaattaataactccgacgacaaaccccgacctaaaacaccgccaaacaacgatttacgacctctaaaaacaacgatcgaatttaaaaaatcgatatactttaacttttttaaatacctatcctaaccgaaacgatacgacctcgcgaaccttccaaactaacgcgcctataaaactctccccgaacgcaaacccctctctctttaccttatttatttttaaaacataacctaccgcctttctaaacgactcgaaaaacgaactctttacacttaaaaacaaactaataaacgtaaatatccgaaactcgtccacccgaccgaacgaa

SEQ ID NO: 12151 - DNA, 504 bp, Artificial Sequence
  chemically treated genomic DNA (Homo sapiens) CpG-island No: 12151
gtcggatagcggtcgaggggttttcgtaggttcggacgtcggatttttgttggtattggtggtcgtgtcgtgtggaaaaagttttcgggcgttcggggtcgcgttgttttttggatttcgggcggagttttattttcgaggtgttgtcgggatttttagtcgtcgcggggaggtcgggagttggtggtttcggcggtaggtttcggtttggggtatcgttaagtagcggtttgcggtttttaggaatagcggtcggatttggggggtcggtgtgttttggtttttttagatatttgttttggtcggggcggtgcggtttcgcgggttttttaggttggcgcgtttgtggggtttttttcgagcgtaggtttttttttttttgttttatttatttttggaatataatttgtcgtttttttagacggttcgaggggcgggttttttgtatttggaagtaggttgatgggcgtgagtgttcggggttcgtttattcggtcggacggg

SEQ ID NO: 12152 - DNA, 504 bp, Artificial Sequence
  chemically treated genomic DNA (Homo sapiens) CpG-island No: 12152
cccgtccgaccgaataaacgaaccccgaacactcacgcccatcaacctacttccaaatacaaaaaacccgcccctcgaaccgtctaaaaaaacgacaaattatattccaaaaataaataaaacaaaaaaaaaaaaacctacgctcgaaaaaaaccccacaaacgcgccaacctaaaaaacccgcgaaaccgcaccgccccgaccaaaacaaatatctaaaaaaaccaaaacacaccgaccccccaaatccgaccgctattcctaaaaaccgcaaaccgctacttaacgataccccaaaccgaaacctaccgccgaaaccaccaactcccgacctccccgcgacgactaaaaatcccgacaacacctcgaaaataaaactccgcccgaaatccaaaaaacaacgcgaccccgaacgcccgaaaactttttccacacgacacgaccaccaataccaacaaaaatccgacgtccgaacctacgaaaacccctcgaccgctatccgac

SEQ ID NO: 12153 - DNA, 706 bp, Artificial Sequence
  chemically treated genomic DNA (Homo sapiens) CpG-island No: 12153
aatttcgtttttttcgtttggtacggtttttttgtatcgttgtgtttcgtttttaggtttttgttcgttaagaatgtttgtttcgggggcgcgttcgttggttaggattttgtcggtagttttcggggaatttttgaggatgcggaggtgggttcgagaattgcggtttcgatgcggggtggagttagttaggtcgcgcgttttcgtagttttgtcgtagcgcgtgttttggttttttcggatcgaaaaggtcgaagtcgtttttcgcgatcgatttcgcgtaattggttcgggtttgtatttagatggttgtgggttttatagggatggtcgggcgggttcgttcggtcgttattttagggtcgttagttttcgcgcgcggtcgtttttcgttaggaagggtggcgggttcggaaggttagagatgttttagtgtttttcgcgtcgttacgtatttagttgttcgcgggttttatatggttgcggtcggagggttcgtattaggatcgtcgtcgtttggggaagcgtttttttgtgggtagggcgcggcgggtagtgcggaagttcgaaagttatcggagttcggggtaggggcggcgcgatgtagaggcggcgttcgggggtttttagttgtttgcggttcggttatttagtcgcgattagagggggcgggggacgtaggaatttcggcgttcgggcggtgtgt

SEQ ID NO: 12154 - DNA, 706 bp, Artificial Sequence
  chemically treated genomic DNA (Homo sapiens) CpG-island No: 12154
acacaccgcccgaacgccgaaattcctacgtcccccgccccctctaatcgcgactaaataaccgaaccgcaaacaactaaaaacccccgaacgccgcctctacatcgcgccgcccctaccccgaactccgataactttcgaacttccgcactacccgccgcgccctacccacaaaaaaacgcttccccaaacgacgacgatcctaatacgaaccctccgaccgcaaccatataaaacccgcgaacaactaaatacgtaacgacgcgaaaaacactaaaacatctctaaccttccgaacccgccacccttcctaacgaaaaacgaccgcgcgcgaaaactaacgaccctaaaataacgaccgaacgaacccgcccgaccatccctataaaacccacaaccatctaaatacaaacccgaaccaattacgcgaaatcgatcgcgaaaaacgacttcgaccttttcgatccgaaaaaaccaaaacacgcgctacgacaaaactacgaaaacgcgcgacctaactaactccaccccgcatcgaaaccgcaattctcgaacccacctccgcatcctcaaaaattccccgaaaactaccgacaaaatcctaaccaacgaacgcgcccccgaaacaaacattcttaacgaacaaaaacctaaaaacgaaacacaacgatacaaaaaaaccgtaccaaacgaaaaaaacgaaatt

SEQ ID NO: 12155 - DNA, 706 bp, Artificial Sequence
  chemically treated genomic DNA (Homo sapiens) CpG-island No: 12155
gtatatcgttcggacgtcggggtttttgcgtttttcgttttttttgatcgcggttgggtagtcgagtcgtaggtagttgggggttttcgaacgtcgtttttgtatcgcgtcgtttttgtttcgggtttcggtagttttcgggttttcgtattgttcgtcgcgttttgtttatagggaagcgtttttttaggcggcggcggttttggtgcggatttttcggtcgtagttatgtgggattcgcgggtagttaggtgcgtagcggcgcgggaagtattggggtatttttggtttttcgggttcgttattttttttggcgggaggcggtcgcgcgcggggattggcgattttgaggtagcggtcgaacgggttcgttcggttatttttgtggggtttatagttatttaggtgtagattcgagttagttgcgcggggtcggtcgcgggggacggtttcggttttttcggttcggagggattagggtacgcgttgcgataggattgcggaggcgcgcggtttggttagttttatttcgtatcgaaatcgtagttttcgggtttattttcgtatttttaggggtttttcgggggttgtcgatagggttttgattagcgagcgcgttttcggggtaagtatttttggcgggtagaaatttgggagcggagtatagcggtgtaagggaatcgtgttaggcggaaagggcggaatt

SEQ ID NO: 12156 - DNA, 706 bp, Artificial Sequence
  chemically treated genomic DNA (Homo sapiens) CpG-island No: 12156
aattccgccctttccgcctaacacgattcccttacaccgctatactccgctcccaaatttctacccgccaaaaatacttaccccgaaaacgcgctcgctaatcaaaaccctatcgacaacccccgaaaaacccctaaaaatacgaaaataaacccgaaaactacgatttcgatacgaaataaaactaaccaaaccgcgcgcctccgcaatcctatcgcaacgcgtaccctaatccctccgaaccgaaaaaaccgaaaccgtcccccgcgaccgaccccgcgcaactaactcgaatctacacctaaataactataaaccccacaaaaataaccgaacgaacccgttcgaccgctacctcaaaatcgccaatccccgcgcgcgaccgcctcccgccaaaaaaaataacgaacccgaaaaaccaaaaataccccaatacttcccgcgccgctacgcacctaactacccgcgaatcccacataactacgaccgaaaaatccgcaccaaaaccgccgccgcctaaaaaaacgcttccctataaacaaaacgcgacgaacaatacgaaaacccgaaaactaccgaaacccgaaacaaaaacgacgcgatacaaaaacgacgttcgaaaacccccaactacctacgactcgactacccaaccgcgatcaaaaaaaacgaaaaacgcaaaaaccccgacgtccgaacgatatac

SEQ ID NO: 12157 - DNA, 726 bp, Artificial Sequence
  chemically treated genomic DNA (Homo sapiens) CpG-island No: 12157
  misc_feature (91)..(91): n is either a, c, g or t
  misc_feature (105)..(105): n is either a, c, g or t
agttcggaaagttttcgcgtagtaggcgtaaggcgcgttttttttttttattcgtaggcgtcgggttcgcgaacgttttatttcggttcgntttcgttcgtcgtntggtgttcgtttaaggttattgttgataaggcgtttgttttcgcggggcgaagggattaagatacgtttcggtttacgttttcgttttggttcggcgggggttttcggggtcgagcgttcgcggaagggaagttagtagggaaagtgataagagatcgagcgagaggggaagaggtttagagttcgggttcggtcgtttttgttttatttgcgtcggtttcgagagcgagatgttgtcgtcgtcgttgtcgtcgtcgttgtcgttggtgcgcgttcggttcggttcggtttcgttgcggttgcggtttttttgtcgcggttgtttcgcgttcgtttgtttcgcggtttcgtcgtcgttcgttcgttttttttttttcgtcgtcgtttttgttatcgttgtattgcgttttgttcgtttttttttttcgttttttttgtttattttttttcgcgcgttttttttcggttttttttaaattttttacggagagcgtttcgcgggatcggagcgcgcggtttcgttcgcgttttttttcgcgcgtattagtggggttgcggggaagggtatttagttttgtttcggggcgtgtttttaggtatttttattagtataggtttttg

SEQ ID NO: 12158 - DNA, 726 bp, Artificial Sequence
  chemically treated genomic DNA (Homo sapiens) CpG-island No: 12158
  misc_feature (622)..(622): n is either a, c, g or t
  misc_feature (636)..(636): n is either a, c, g or t
caaaaacctatactaataaaaatacctaaaaacacgccccgaaacaaaactaaatacccttccccgcaaccccactaatacgcgcgaaaaaaaacgcgaacgaaaccgcgcgctccgatcccgcgaaacgctctccgtaaaaaatttaaaaaaaaccgaaaaaaaacgcgcgaaaaaaaataaacaaaaaaaacgaaaaaaaaaaacgaacaaaacgcaatacaacgataacaaaaacgacgacgaaaaaaaaaaaacgaacgaacgacgacgaaaccgcgaaacaaacgaacgcgaaacaaccgcgacaaaaaaaccgcaaccgcaacgaaaccgaaccgaaccgaacgcgcaccaacgacaacgacgacgacaacgacgacgacaacatctcgctctcgaaaccgacgcaaataaaacaaaaacgaccgaacccgaactctaaacctcttcccctctcgctcgatctcttatcactttccctactaacttcccttccgcgaacgctcgaccccgaaaacccccgccgaaccaaaacgaaaacgtaaaccgaaacgtatcttaatcccttcgccccgcgaaaacaaacgccttatcaacaataaccttaaacgaacaccanacgacgaacgaaancgaaccgaaataaaacgttcgcgaacccgacgcctacgaataaaaaaaaaaaacgcgccttacgcctactacgcgaaaactttccgaact

SEQ ID NO: 12159 - DNA, 726 bp, Artificial Sequence
  chemically treated genomic DNA (Homo sapiens) CpG-island No: 12159
  misc_feature (622)..(622): n is either a, c, g or t
  misc_feature (636)..(636): n is either a, c, g or t
taggggtttgtgttgatggaggtatttggagatacgtttcggggtaagattggatattttttttcgtagttttattggtgcgcgcggaggaggacgcgggcgggatcgcgcgtttcggtttcgcggggcgtttttcgtgaggagtttggggagggtcgagggggagcgcgcggggaggagtgagtagggagggcgggagggggaggcgggtagagcgtagtgtagcggtggtagaggcggcggcggagggagggaggcgggcgggcggcggcggggtcgcggggtaggcgagcgcggggtagtcgcggtagaggagtcgtagtcgtagcggggtcgggtcgggtcgggcgcgtattagcggtagcggcggcggtagcggcggcggtagtatttcgttttcggagtcggcgtaggtgaggtaggggcggtcgggttcgggttttgggtttttttttttttcgttcggttttttgttattttttttgttggtttttttttcgcgggcgttcggtttcggagattttcgtcgggttagggcgggagcgtgagtcggagcgtgttttggttttttcgtttcgcggaggtaggcgttttgttagtagtgattttgagcgggtattangcggcgggcggggncgggtcggggtggggcgttcgcggattcggcgtttgcgggtgagggaagggggcgcgttttgcgtttgttgcgcgaaaatttttcgggtt

SEQ ID NO: 12160 - DNA, 726 bp, Artificial Sequence
  chemically treated genomic DNA (Homo sapiens) CpG-island No: 12160
  misc_feature (91)..(91): n is either a, c, g or t
  misc_feature (105)..(105): n is either a, c, g or t
aacccgaaaaattttcgcgcaacaaacgcaaaacgcgcccccttccctcacccgcaaacgccgaatccgcgaacgccccaccccgacccgnccccgcccgccgcntaatacccgctcaaaatcactactaacaaaacgcctacctccgcgaaacgaaaaaaccaaaacacgctccgactcacgctcccgccctaacccgacgaaaatctccgaaaccgaacgcccgcgaaaaaaaaaccaacaaaaaaaataacaaaaaaccgaacgaaaaaaaaaaaaacccaaaacccgaacccgaccgcccctacctcacctacgccgactccgaaaacgaaatactaccgccgccgctaccgccgccgctaccgctaatacgcgcccgacccgacccgaccccgctacgactacgactcctctaccgcgactaccccgcgctcgcctaccccgcgaccccgccgccgcccgcccgcctccctccctccgccgccgcctctaccaccgctacactacgctctacccgcctccccctcccgccctccctactcactcctccccgcgcgctccccctcgaccctccccaaactcctcacgaaaaacgccccgcgaaaccgaaacgcgcgatcccgcccgcgtcctcctccgcgcgcaccaataaaactacgaaaaaaaatatccaatcttaccccgaaacgtatctccaaatacctccatcaacacaaaccccta

SEQ ID NO: 12161 - DNA, 647 bp, Artificial Sequence
  chemically treated genomic DNA (Homo sapiens) CpG-island No: 12161
  misc_feature (148)..(148): n is either a, c, g or t
  misc_feature (211)..(211): n is either a, c, g or t
ggtcgtcgcggtgcggtagtagtagtcgggttgcgggcgtcggagtttcgttatgttgttgttcgcgttttttttcgttgttcgtcgcgttcgtcgttagttcgttggcgttttagttgtttcgtttcgggttcggttttcgtgtcgnttcggtttcgtttcgtttcgtttcgtttcggttcgggttcggttttttttcgtcgttgtcgtngttgttgtagttttagattcgggcgcgtcgtttgttttgtgcgcgtgtgcgtcgtagaaagggagggacggaattcggcggggtgcgggggaaagtgggtaatgcgaattcgcgggtgtttcgtttcggcgcggagtatatggtcgcgggttcgtttcgtagcgcgcgttttgcggggttcgggcgtttttttcggttgggacggggtcgtttagagttgttcgcggggattagcggtttatttttgttaagtgtatttttatgaatttttgggtggttgtcgttttgtcgaggcgtttgggttacggtcgagagattattttcgagggaagaggtggcggtggaggtgggaaaaaggagtcgttaagcgagaggttttggatataggatattagtggaaataatgtagtggttgttatgaaattgcgagtgtagt

SEQ ID NO: 12162 - DNA, 647 bp, Artificial Sequence
  chemically treated genomic DNA (Homo sapiens) CpG-island No: 12162
  misc_feature (437)..(437): n is either a, c, g or t
  misc_feature (500)..(500): n is either a, c, g or t
actacactcgcaatttcataacaaccactacattatttccactaatatcctatatccaaaacctctcgcttaacgactcctttttcccacctccaccgccacctcttccctcgaaaataatctctcgaccgtaacccaaacgcctcgacaaaacgacaaccacccaaaaattcataaaaatacacttaacaaaaataaaccgctaatccccgcgaacaactctaaacgaccccgtcccaaccgaaaaaaacgcccgaaccccgcaaaacgcgcgctacgaaacgaacccgcgaccatatactccgcgccgaaacgaaacacccgcgaattcgcattacccactttcccccgcaccccgccgaattccgtccctccctttctacgacgcacacgcgcacaaaacaaacgacgcgcccgaatctaaaactacaacaacnacgacaacgacgaaaaaaaaccgaacccgaaccgaaacgaaacgaaacgaaacgaaaccgaancgacacgaaaaccgaacccgaaacgaaacaactaaaacgccaacgaactaacgacgaacgcgacgaacaacgaaaaaaaacgcgaacaacaacataacgaaactccgacgcccgcaacccgactactactaccgcaccgcgacgacc

SEQ ID NO: 12163 - DNA, 647 bp, Artificial Sequence
  chemically treated genomic DNA (Homo sapiens) CpG-island No: 12163
  misc_feature (437)..(437): n is either a, c, g or t
  misc_feature (500)..(500): n is either a, c, g or t
gttgtattcgtagttttatgataattattgtattatttttattaatattttgtgtttaaggtttttcgtttggcgattttttttttttatttttatcgttattttttttttcgagggtaatttttcgatcgtggtttaagcgtttcgataaagcggtaattatttaaaagtttatgaaaatgtatttggtaaaagtgggtcgttagttttcgcggatagttttaagcgatttcgttttagtcgaggaaagcgttcgggtttcgtaaagcgcgcgttgcggggcgggttcgcggttatgtgtttcgcgtcggggcggggtattcgcgggttcgtattgtttattttttttcgtatttcgtcgggtttcgtttttttttttttgcggcgtatacgcgtatagagtaagcggcgcgttcgggtttggagttgtagtagtngcggtaacggcgggggggggtcgggttcgggtcggggcggggcggggcggggcggggtcgggncggtacgggggtcgggttcggggcgaggtagttggggcgttagcgagttagcggcgagcgcggcgagtaacggagaggagcgcgagtagtagtatggcggggtttcgacgttcgtagttcggttgttattgtcgtatcgcggcggtt

SEQ ID NO: 12164 - DNA, 647 bp, Artificial Sequence
  chemically treated genomic DNA (Homo sapiens) CpG-island No: 12164
  misc_feature (148)..(148): n is either a, c, g or t
  misc_feature (211)..(211): n is either a, c, g or t
aaccgccgcgatacgacaataacaaccgaactacgaacgtcgaaaccccgccatactactactcgcgctcctctccgttactcgccgcgctcgccgctaactcgctaacgccccaactacctcgccccgaacccgacccccgtaccgncccgaccccgccccgccccgccccgccccgacccgaacccgacccccccccgccgttaccgcnactactacaactccaaacccgaacgcgccgcttactctatacgcgtatacgccgcaaaaaaaaaaaaacgaaacccgacgaaatacgaaaaaaaataaacaatacgaacccgcgaataccccgccccgacgcgaaacacataaccgcgaacccgccccgcaacgcgcgctttacgaaacccgaacgctttcctcgactaaaacgaaatcgcttaaaactatccgcgaaaactaacgacccacttttaccaaatacattttcataaacttttaaataattaccgctttatcgaaacgcttaaaccacgatcgaaaaattaccctcgaaaaaaaaaataacgataaaaataaaaaaaaaaaatcgccaaacgaaaaaccttaaacacaaaatattaataaaaataatacaataattatcataaaactacgaatacaac

SEQ ID NO: 12165 - DNA, 892 bp, Artificial Sequence
  chemically treated genomic DNA (Homo sapiens) CpG-island No: 12165
ttcgcggcgattcggagagggcgaggtatcgggatatagattcgggtcgagaggagttttcgcgaggcgtagggtcgtggcgcgcgggcgtagggttttcggcggggttagggtggttatattcgtcgggcgttttttttcgggtcgttcgtttaagatggcgatggaggggcgggtgaggcggtagcggttttggttttcgcgtcggttttagttcgggttcgggttttcgaggtcgcgttttcgttcgcggcgtcgcgttttttcgggttattgacgttcggcgcgtttttttttcgcggcggcggtcgaagtacggggaggcggcggcggcggcggcggttcgagtttagttttatggcgcggggggacgtcggtcgcggtcgcgggtttttcgcgttgattttttgtttgttggtcgcgcgcggtaagggcgggcgttcggagaggtaggagcgattgcggagtgttggtgcgttcgcgttttggtttgtatcgggttgcggggttggtttaagtcggagtttcgagtaagtgcgggggttgcgcgtttaggtgttcgcgatgtttgcgcgggggtttgcgagttgcggtcggggggcgtttgtggggcgtgtttgttcgtagtgggtgtgtgtttttggttcgtagagtttggagtcgtgtgtgtgtgtgtgtgtgtgtgtgtgtgtgtgtgtgtgtgttgggagtgtttttgtcgtgttcgtagtgcgtgttatggtcgcggcgtggtatcggcggggcgggtagttgcggtgtcggtggttttcgcggggcgggttttgttttgtttgcgcgtgttttgggttgagagtgtgtgtaaaagaggagggaattggggttgtgtttgtatttttatttgggtcgggtg

SEQ ID NO: 12166 - DNA, 892 bp, Artificial Sequence
  chemically treated genomic DNA (Homo sapiens) CpG-island No: 12166
cacccgacccaaataaaaatacaaacacaaccccaattccctcctcttttacacacactctcaacccaaaacacgcgcaaacaaaacaaaacccgccccgcgaaaaccaccgacaccgcaactacccgccccgccgataccacgccgcgaccataacacgcactacgaacacgacaaaaacactcccaacacacacacacacacacacacacacacacacacacacacacgactccaaactctacgaaccaaaaacacacacccactacgaacaaacacgccccacaaacgccccccgaccgcaactcgcaaacccccgcgcaaacatcgcgaacacctaaacgcgcaacccccgcacttactcgaaactccgacttaaaccaaccccgcaacccgatacaaaccaaaacgcgaacgcaccaacactccgcaatcgctcctacctctccgaacgcccgcccttaccgcgcgcgaccaacaaacaaaaaatcaacgcgaaaaacccgcgaccgcgaccgacgtccccccgcgccataaaactaaactcgaaccgccgccgccgccgccgcctccccgtacttcgaccgccgccgcgaaaaaaaaacgcgccgaacgtcaataacccgaaaaaacgcgacgccgcgaacgaaaacgcgacctcgaaaacccgaacccgaactaaaaccgacgcgaaaaccaaaaccgctaccgcctcacccgcccctccatcgccatcttaaacgaacgacccgaaaaaaaacgcccgacgaatataaccaccctaaccccgccgaaaaccctacgcccgcgcgccacgaccctacgcctcgcgaaaactcctctcgacccgaatctatatcccgatacctcgccctctccgaatcgccgcgaa

SEQ ID NO: 12167 - DNA, 892 bp, Artificial Sequence
  chemically treated genomic DNA (Homo sapiens) CpG-island No: 12167
tattcgatttaaatggaggtgtagatataattttagttttttttttttttatatatatttttaatttaagatacgcgtaggtaaggtagagttcgtttcgcgaaagttatcgatatcgtagttattcgtttcgtcgatgttacgtcgcgattatggtacgtattgcggatacgataggagtatttttaatatatatatatatatatatatatatatatatatatatatacgattttagattttgcgaattaaaggtatatatttattgcggataagtacgttttataaacgtttttcggtcgtagttcgtagattttcgcgtaggtatcgcgggtatttggacgcgtagttttcgtatttgttcgggatttcggtttgagttagtttcgtagttcgatgtagattagggcgcgggcgtattagtatttcgtagtcgtttttgttttttcgggcgttcgtttttatcgcgcgcggttaataggtagaaggttaacgcgaggagttcgcggtcgcggtcggcgttttttcgcgttatggggttgggttcgggtcgtcgtcgtcgtcgtcgttttttcgtgtttcggtcgtcgtcgcggggggagagcgcgtcgggcgttagtggttcggggaggcgcggcgtcgcgggcgggggcgcggtttcgggggttcgggttcgagttggggtcggcgcgggggttagggtcgttgtcgttttattcgtttttttatcgttattttgggcgagcggttcgggagggggcgttcggcgagtgtggttattttggtttcgtcggggattttgcgttcgcgcgttacggttttgcgtttcgcgggggtttttttcggttcgggtttgtgtttcggtgtttcgtttttttcgggtcgtcgcggg

SEQ ID NO: 12168 - DNA, 892 bp, Artificial Sequence
  chemically treated genomic DNA (Homo sapiens) CpG-island No: 12168
cccgcgacgacccgaaaaaaacgaaacaccgaaacacaaacccgaaccgaaaaaaacccccgcgaaacgcaaaaccgtaacgcgcgaacgcaaaatccccgacgaaaccaaaataaccacactcgccgaacgccccctcccgaaccgctcgcccaaaataacgataaaaaaacgaataaaacgacaacgaccctaacccccgcgccgaccccaactcgaacccgaacccccgaaaccgcgcccccgcccgcgacgccgcgcctccccgaaccactaacgcccgacgcgctctccccccgcgacgacgaccgaaacacgaaaaaacgacgacgacgacgacgacccgaacccaaccccataacgcgaaaaaacgccgaccgcgaccgcgaactcctcgcgttaaccttctacctattaaccgcgcgcgataaaaacgaacgcccgaaaaaacaaaaacgactacgaaatactaatacgcccgcgccctaatctacatcgaactacgaaactaactcaaaccgaaatcccgaacaaatacgaaaactacgcgtccaaatacccgcgatacctacgcgaaaatctacgaactacgaccgaaaaacgtttataaaacgtacttatccgcaataaatatatacctttaattcgcaaaatctaaaatcgtatatatatatatatatatatatatatatatatatatatattaaaaatactcctatcgtatccgcaatacgtaccataatcgcgacgtaacatcgacgaaacgaataactacgatatcgataactttcgcgaaacgaactctaccttacctacgcgtatcttaaattaaaaatatatataaaaaaaaaaaaaactaaaattatatctacacctccatttaaatcgaata

SEQ ID NO: 12169 - DNA, 563 bp, Artificial Sequence
  chemically treated genomic DNA (Homo sapiens) CpG-island No: 12169
tttcgcgtttagcgtcgtttttcgcgtttttagcggttttcgttattatttaggcgttcgaggcgttgtcgcggacgcgggcgagtatagcgcgtttcgtgtgtcgcgcgtcgggggagtcgcggttagcgttgcgttggttgtataacggggcgtcgttgcggtttaacgggcgcgttaaggtttagggcggcggtggtagtttggttattatatagatcggtttgtaggacgtcggttattattagtgcgtggttgagaatagcgcgggaatggcgtgcgttgtcgcgtcgttggtcgtggtggtgcgcgaggggttgtttagcgtttttacgcgggttattgttacgttattgagtagtttcgttgtgttggtggtttgggagcggttcgagatgtatagcgagtagattatcggtttttttttttattattagaaggtacggggtacgtcggtttggggcgggatgtattagcgtaggttcgggcggggcgtagttagaaggggtttaggtcggatgattgaagggttgtttgatgggtatttttgcggtaaggatgga

SEQ ID NO: 12170 - DNA, 563 bp, Artificial Sequence
  chemically treated genomic DNA (Homo sapiens) CpG-island No: 12170
tccatccttaccgcaaaaatacccatcaaacaacccttcaatcatccgacctaaaccccttctaactacgccccgcccgaacctacgctaatacatcccgccccaaaccgacgtaccccgtaccttctaataataaaaaaaaaaaccgataatctactcgctatacatctcgaaccgctcccaaaccaccaacacaacgaaactactcaataacgtaacaataacccgcgtaaaaacgctaaacaacccctcgcgcaccaccacgaccaacgacgcgacaacgcacgccattcccgcgctattctcaaccacgcactaataataaccgacgtcctacaaaccgatctatataataaccaaactaccaccgccgccctaaaccttaacgcgcccgttaaaccgcaacgacgccccgttatacaaccaacgcaacgctaaccgcgactcccccgacgcgcgacacacgaaacgcgctatactcgcccgcgtccgcgacaacgcctcgaacgcctaaataataacgaaaaccgctaaaaacgcgaaaaacgacgctaaacgcgaaa

SEQ ID NO: 12171 - DNA, 563 bp, Artificial Sequence
  chemically treated genomic DNA (Homo sapiens) CpG-island No: 12171
tttatttttgtcgtagaggtatttattaggtaattttttagttattcgatttgaattttttttggttgcgtttcgttcgggtttgcgttggtgtatttcgttttaggtcgacgtatttcgtgttttttggtagtggagagagaagtcgatgatttgttcgttgtgtatttcgggtcgtttttaggttattaatatagcggagttgtttagtggcgtagtagtgattcgcgtgggggcgttgggtagtttttcgcgtattattacggttagcgacgcggtagcgtacgttattttcgcgttgtttttagttacgtattggtagtagtcggcgttttgtaggtcgatttgtgtgatgattaggttgttatcgtcgttttggattttgacgcgttcgttgggtcgtagcggcgtttcgttgtgtagttagcgtagcgttggtcgcggttttttcgacgcgcggtatacgaagcgcgttgtgttcgttcgcgttcgcgatagcgtttcgggcgtttgagtgatggcgggagtcgttaggggcgcgaggggcgacgttgagcgcggga

SEQ ID NO: 12172 - DNA, 563 bp, Artificial Sequence
  chemically treated genomic DNA (Homo sapiens) CpG-island No: 12172
tcccgcgctcaacgtcgcccctcgcgcccctaacgactcccgccatcactcaaacgcccgaaacgctatcgcgaacgcgaacgaacacaacgcgcttcgtataccgcgcgtcgaaaaaaccgcgaccaacgctacgctaactacacaacgaaacgccgctacgacccaacgaacgcgtcaaaatccaaaacgacgataacaacctaatcatcacacaaatcgacctacaaaacgccgactactaccaatacgtaactaaaaacaacgcgaaaataacgtacgctaccgcgtcgctaaccgtaataatacgcgaaaaactacccaacgcccccacgcgaatcactactacgccactaaacaactccgctatattaataacctaaaaacgacccgaaatacacaacgaacaaatcatcgacttctctctccactaccaaaaaacacgaaatacgtcgacctaaaacgaaatacaccaacgcaaacccgaacgaaacgcaaccaaaaaaaattcaaatcgaataactaaaaaattacctaataaatacctctacgacaaaaataaa

SEQ ID NO: 12173 - DNA, 605 bp, Artificial Sequence
  chemically treated genomic DNA (Homo sapiens) CpG-island No: 12173
gttagtacgtcgtaagcgtatcgcgtcgtcgattttgttggcgtattgtaggtttttcggcgcgtacgcggataaagggggtaggggttttggcgggtattcggagtcgcgatttcgcgcgtttttcgtcgttcgattcggtttttatttgtacgttatttagttttacgcgtagatatagttcgcggtgtcgttgagtttagtagatatgcggcgttaatatttgattttttatggttatattgtttagggcgcggggaggttaggttcgttgcgtttcgttgttttaggtagtgttttgttggcgcgagtagaaagtaggttttaaattttagcgtttttgagcgtttgtaattcggtatttcgagatattttacgttcgcgggtcgcgtttgcgtagtgacgcgtcgggatggcggcggcgttagtagcgggttttggcgcgagtcgggcgggggcggggcgtaggcgggataggggtaggtcggggtatagagacgtcgtagttcgtcgcggtcgtttagggaattggaattagcgggtggtttgttttttttattcgtttttagggatatgttttaaaataagttttaaaataaaaaagg

SEQ ID NO: 12174 - DNA, 605 bp, Artificial Sequence
  chemically treated genomic DNA (Homo sapiens) CpG-island No: 12174
ccttttttattttaaaacttattttaaaacatatccctaaaaacgaataaaaaaaacaaaccacccgctaattccaattccctaaacgaccgcgacgaactacgacgtctctataccccgacctacccctatcccgcctacgccccgcccccgcccgactcgcgccaaaacccgctactaacgccgccgccatcccgacgcgtcactacgcaaacgcgacccgcgaacgtaaaatatctcgaaataccgaattacaaacgctcaaaaacgctaaaatttaaaacctactttctactcgcgccaacaaaacactacctaaaacaacgaaacgcaacgaacctaacctccccgcgccctaaacaatataaccataaaaaatcaaatattaacgccgcatatctactaaactcaacgacaccgcgaactatatctacgcgtaaaactaaataacgtacaaataaaaaccgaatcgaacgacgaaaaacgcgcgaaatcgcgactccgaatacccgccaaaacccctaccccctttatccgcgtacgcgccgaaaaacctacaatacgccaacaaaatcgacgacgcgatacgcttacgacgtactaac

SEQ ID NO: 12175 - DNA, 605 bp, Artificial Sequence
  chemically treated genomic DNA (Homo sapiens) CpG-island No: 12175
ttttttttattttaaagtttattttaaagtatgtttttgaagacgagtggggagagtagattattcgttgattttaattttttaggcggtcgcggcgagttgcggcgtttttgtgtttcggtttgtttttatttcgtttgcgtttcgttttcgttcggttcgcgttaaggttcgttgttggcgtcgtcgttatttcggcgcgttattgcgtaggcgcggttcgcgagcgtggggtatttcgaggtgtcgggttgtaggcgtttaggagcgttagggtttgaggtttgttttttgttcgcgttagtagagtattatttgaggtagcgaggcgtagcgagtttagttttttcgcgttttgggtagtgtggttatggagaattaggtgttgacgtcgtatgtttattgggtttagcgatatcgcgagttatatttgcgcgtggagttgagtgacgtataggtaaaggtcgggtcgggcggcgggaagcgcgcgggatcgcggtttcgggtattcgttaggatttttgttttttttgttcgcgtgcgcgtcggagagtttgtagtgcgttaataaggtcggcgacgcggtgcgtttacggcgtgttggt

SEQ ID NO: 12176 - DNA, 605 bp, Artificial Sequence
  chemically treated genomic DNA (Homo sapiens) CpG-island No: 12176
accaacacgccgtaaacgcaccgcgtcgccgaccttattaacgcactacaaactctccgacgcgcacgcgaacaaaaaaaacaaaaatcctaacgaatacccgaaaccgcgatcccgcgcgcttcccgccgcccgacccgacctttacctatacgtcactcaactccacgcgcaaatataactcgcgatatcgctaaacccaataaacatacgacgtcaacacctaattctccataaccacactacccaaaacgcgaaaaaactaaactcgctacgcctcgctacctcaaataatactctactaacgcgaacaaaaaacaaacctcaaaccctaacgctcctaaacgcctacaacccgacacctcgaaataccccacgctcgcgaaccgcgcctacgcaataacgcgccgaaataacgacgacgccaacaacgaaccttaacgcgaaccgaacgaaaacgaaacgcaaacgaaataaaaacaaaccgaaacacaaaaacgccgcaactcgccgcgaccgcctaaaaaattaaaatcaacgaataatctactctccccactcgtcttcaaaaacatactttaaaataaactttaaaataaaaaaaa

SEQ ID NO: 12177 - DNA, 668 bp, Artificial Sequence
  chemically treated genomic DNA (Homo sapiens) CpG-island No: 12177
agagagtcggttggggtcgagttttcgtggttattatcgcggttttggttttttttttcggggttttttcgcgttttacgtagttcgtggtgtagggttcgttggttttggcggggtggaaggtttcgtgtcgtcgtcgtcgcgcgtcgtgggtagtgtgggtttgttgggggtgtaggtaggtaagtaggaagggtttgtcggggagatggtgggggagcgcgtttcgatcgtcgtggttcgttttcgtttttggtggttgttcggtaatcggtatatcgttgttttagcgttttttttttttaatatttttttaagttatagtttttttttttcgttcgtttttcgtttgtcgggcgcgtatcgcggttgtgttcggggacggaagttcgttacgcggttcgtttggtagggtttgtggtcgaggttttggggttcgcgtgtttttggcggtgattcgttggatgttgcggtgttgttcgttatcgtgcgttcgttttcgtttttcggtcgcgtagtgtttggggttcggtttgtagtttttacgttaggttagggcggtatcgttgcgttttcggattagttttttatttttatttagtacgtaggaaattttatgtaatttagtaaagttaggaagtttttaaatttcgcgtagttattgtagg

SEQ ID NO: 12178 - DNA, 668 bp, Artificial Sequence
  chemically treated genomic DNA (Homo sapiens) CpG-island No: 12178
cctacaataactacgcgaaatttaaaaacttcctaactttactaaattacataaaatttcctacgtactaaataaaaataaaaaactaatccgaaaacgcaacgataccgccctaacctaacgtaaaaactacaaaccgaaccccaaacactacgcgaccgaaaaacgaaaacgaacgcacgataacgaacaacaccgcaacatccaacgaatcaccgccaaaaacacgcgaaccccaaaacctcgaccacaaaccctaccaaacgaaccgcgtaacgaacttccgtccccgaacacaaccgcgatacgcgcccgacaaacgaaaaacgaacgaaaaaaaaaaactataacttaaaaaaatattaaaaaaaaaaaacgctaaaacaacgatataccgattaccgaacaaccaccaaaaacgaaaacgaaccacgacgatcgaaacgcgctcccccaccatctccccgacaaacccttcctacttacctacctacacccccaacaaacccacactacccacgacgcgcgacgacgacgacacgaaaccttccaccccgccaaaaccaacgaaccctacaccacgaactacgtaaaacgcgaaaaaaccccgaaaaaaaaaaccaaaaccgcgataataaccacgaaaactcgaccccaaccgactctct

SEQ ID NO: 12179 - DNA, 668 bp, Artificial Sequence
  chemically treated genomic DNA (Homo sapiens) CpG-island No: 12179
tttatagtggttgcgcggagtttagggattttttagttttgttaagttatatgggattttttacgtattaaatggaggtgggggattggttcgaggacgtagcggtgtcgttttggtttgacgtggaagttatagatcgggttttaggtattgcgcggtcgagagacggaggcgggcgtacgatggcggataatatcgtagtatttagcgagttatcgttaggggtacgcgaattttaggatttcggttataagttttgttagacgggtcgcgtggcgggttttcgttttcggatataatcgcgatgcgcgttcggtaggcggggggcgggcgggagaggaggattgtggtttggaggggtgttggggaggaggggcgttggagtagcggtgtgtcggttgtcgggtagttattaggggcggaggcgaattacggcgatcgggacgcgtttttttattattttttcggtagattttttttatttgtttgtttgtatttttaataaatttatattatttacgacgcgcgacgacgacggtacgagattttttatttcgttagggttaacgaattttgtattacgagttgcgtgaggcgcgagggagtttcggagggaggaattaggatcgcggtggtggttacgggaattcggttttagtcggtttttt

SEQ ID NO: 12180 - DNA, 668 bp, Artificial Sequence
  chemically treated genomic DNA (Homo sapiens) CpG-island No: 12180
aaaaaaccgactaaaaccgaattcccgtaaccaccaccgcgatcctaattcctccctccgaaactccctcgcgcctcacgcaactcgtaatacaaaattcgttaaccctaacgaaataaaaaatctcgtaccgtcgtcgtcgcgcgtcgtaaataatataaatttattaaaaatacaaacaaacaaataaaaaaaatctaccgaaaaaataataaaaaaacgcgtcccgatcgccgtaattcgcctccgcccctaataactacccgacaaccgacacaccgctactccaacgcccctcctccccaacacccctccaaaccacaatcctcctctcccgcccgccccccgcctaccgaacgcgcatcgcgattatatccgaaaacgaaaacccgccacgcgacccgtctaacaaaacttataaccgaaatcctaaaattcgcgtacccctaacgataactcgctaaatactacgatattatccgccatcgtacgcccgcctccgtctctcgaccgcgcaatacctaaaacccgatctataacttccacgtcaaaccaaaacgacaccgctacgtcctcgaaccaatcccccacctccatttaatacgtaaaaaatcccatataacttaacaaaactaaaaaatccctaaactccgcgcaaccactataaa

SEQ ID NO: 12181 - DNA, 937 bp, Artificial Sequence
  chemically treated genomic DNA (Homo sapiens) CpG-island No: 12181
agtgttcgcgtcggttttttcgttgattcgtagtattcgaaagtcgtagggcgcgggggtttgtggggtcgggttcgggagttgcgagattaggggtcggtgatttttcgcgggggatcgagcgaggatggggaagttagcggttttatttgcgatggattaggtttagcggtagaattttatcgtgtcgttgagtgtcgtggatattacgtttaggatattattcggtttcgagtttaggagttttatcgcggcgatgagcgggcgttggcggtaggagaaagcggagatttagagagagggttgatttcggaggcggtggcggtcgacggggcgagcggcggtcgggaatttttttaacggcggcggttcggttgcgtttttttttgttttttaaggcgtcgcggcggcggggatgcggtagaaggtagggttaagcggaaggcgtcgttaaggttttcgggagaaagacgaggaggtggagaaggtttagtcgttagtatagtgcgttgtattagtttgtagtttcgcgtagtcgtttttttaatttttttagtcggcgttacgtggtcgcgcgcgggggcggggggtcggtcgttttttttttttttttttttttttagtattgggattcgttggcgtagggatgttgcgtttaagggtgcgacgttaattgggttcgcgtaggcgcgcgtcgtcgagcgggagcgggatatttgggtttttttttggttttttttcgtataagtcgttttattagtttttttcgtttttgtttcgggtatcggtttttgcggaggagtttatcgtttttttacgggtgattttttattcgtttcggatacgttttgggaaataggatacgggaagaatgggtgttttgtgggtaaagatgaggtaggcgtggtgttttggtttttatttgatatttatttcg

SEQ ID NO: 12182 - DNA, 937 bp, Artificial Sequence
  chemically treated genomic DNA (Homo sapiens) CpG-island No: 12182
cgaaataaatatcaaataaaaaccaaaacaccacgcctacctcatctttacccacaaaacacccattcttcccgtatcctatttcccaaaacgtatccgaaacgaataaaaaatcacccgtaaaaaaacgataaactcctccgcaaaaaccgatacccgaaacaaaaacgaaaaaaactaataaaacgacttatacgaaaaaaaaccaaaaaaaaacccaaatatcccgctcccgctcgacgacgcgcgcctacgcgaacccaattaacgtcgcacccttaaacgcaacatccctacgccaacgaatcccaatactaaaaaaaaaaaaaaaaaaaaaaaacgaccgaccccccgcccccgcgcgcgaccacgtaacgccgactaaaaaaattaaaaaaacgactacgcgaaactacaaactaatacaacgcactatactaacgactaaaccttctccacctcctcgtctttctcccgaaaaccttaacgacgccttccgcttaaccctaccttctaccgcatccccgccgccgcgacgccttaaaaaacaaaaaaaaacgcaaccgaaccgccgccgttaaaaaaattcccgaccgccgctcgccccgtcgaccgccaccgcctccgaaatcaaccctctctctaaatctccgctttctcctaccgccaacgcccgctcatcgccgcgataaaactcctaaactcgaaaccgaataatatcctaaacgtaatatccacgacactcaacgacacgataaaattctaccgctaaacctaatccatcgcaaataaaaccgctaacttccccatcctcgctcgatcccccgcgaaaaatcaccgacccctaatctcgcaactcccgaacccgaccccacaaacccccgcgccctacgactttcgaatactacgaatcaacgaaaaaaccgacgcgaacact

SEQ ID NO: 12183 - DNA, 937 bp, Artificial Sequence
  chemically treated genomic DNA (Homo sapiens) CpG-island No: 12183
cgaggtgagtgttaggtaaggattaaagtattacgtttattttatttttgtttatagaatatttatttttttcgtgttttgttttttaggacgtattcggggcggataagaaattattcgtggggaggcggtgaattttttcgtaggggtcgatgttcgggataggggcggggaaggttaatgaggcgatttgtgcggggaggggttaaggaggagtttaggtgtttcgttttcgttcgacggcgcgcgtttgcgcgagtttagttggcgtcgtatttttgagcgtagtatttttacgttagcgagttttaatattagggagggagggagggaggaggggcggtcggtttttcgttttcgcgcgcggttacgtgacgtcggttgaggagattggaggggcggttgcgcgaggttgtagattggtgtagcgtattgtgttggcggttgggttttttttattttttcgtttttttttcgggaattttgacgacgtttttcgtttggttttgttttttgtcgtattttcgtcgtcgcggcgttttgaggagtaggagaagacgtagtcgggtcgtcgtcgttagaggggttttcggtcgtcgttcgtttcgtcggtcgttatcgttttcggggttagttttttttttgggttttcgtttttttttgtcgttagcgttcgtttatcgtcgcgatggggtttttggattcggagtcgggtagtgttttaaacgtagtgtttacggtatttaacgatacggtagagttttatcgttggatttggtttatcgtaggtaaagtcgttgatttttttattttcgttcggtttttcgcggggggttatcggtttttggtttcgtagttttcgggttcggttttataggttttcgcgttttgcggttttcggatgttgcggattagcggaggggtcggcgcgggtatt

SEQ ID NO: 12184 - DNA, 937 bp, Artificial Sequence
  chemically treated genomic DNA (Homo sapiens) CpG-island No: 12184
aatacccgcgccgacccctccgctaatccgcaacatccgaaaaccgcaaaacgcgaaaacctataaaaccgaacccgaaaactacgaaaccaaaaaccgataaccccccgcgaaaaaccgaacgaaaataaaaaaatcaacgactttacctacgataaaccaaatccaacgataaaactctaccgtatcgttaaataccgtaaacactacgtttaaaacactacccgactccgaatccaaaaaccccatcgcgacgataaacgaacgctaacgacaaaaaaaaacgaaaacccaaaaaaaaaactaaccccgaaaacgataacgaccgacgaaacgaacgacgaccgaaaacccctctaacgacgacgacccgactacgtcttctcctactcctcaaaacgccgcgacgacgaaaatacgacaaaaaacaaaaccaaacgaaaaacgtcgtcaaaattcccgaaaaaaaaacgaaaaaataaaaaaaacccaaccgccaacacaatacgctacaccaatctacaacctcgcgcaaccgcccctccaatctcctcaaccgacgtcacgtaaccgcgcgcgaaaacgaaaaaccgaccgcccctcctccctccctccctccctaatattaaaactcgctaacgtaaaaatactacgctcaaaaatacgacgccaactaaactcgcgcaaacgcgcgccgtcgaacgaaaacgaaacacctaaactcctccttaacccctccccgcacaaatcgcctcattaaccttccccgcccctatcccgaacatcgacccctacgaaaaaattcaccgcctccccacgaataatttcttatccgccccgaatacgtcctaaaaaacaaaacacgaaaaaaataaatattctataaacaaaaataaaataaacgtaatactttaatccttacctaacactcacctcg

SEQ ID NO: 12185 - DNA, 852 bp, Artificial Sequence
  chemically treated genomic DNA (Homo sapiens) CpG-island No: 12185
  misc_feature (148)..(148): n is either a, c, g or t
  misc_feature (435)..(435): n is either a, c, g or t
  misc_feature (499)..(499): n is either a, c, g or t
  misc_feature (619)..(619): n is either a, c, g or t
  misc_feature (808)..(808): n is either a, c, g or t
tttttttatattcgtgtttcggttcggtcgcggggagtttcgttttatcgtcgtgggttacgtggacgatacgtagttcgtgcggttcgatagcgacgtcgcgagttagaagatggagtcgcgggcgtcgtggatagagtaggagggngtcggagtattgggattaggagatacggaatatgaaggtttatttatagattgatcgagcgaatttggggattttgcgcggttattataattagagcgaggacggtgagtgatttcggttcggggcgtaggttacgattttttattttttacggacgggttaggtcgtttatagttttcgggttcgagatttatttcgaagtcgcgggatttcgagatttttgtttcgggagaggtttaggcgtttttattcggttttatttttagtttaggttaaaaatttttttngggttggtcggggcggggcggggttcgggggattgggttgatcgcggggtcggggttaggtttnttatattatttagataatgtatggttgcgacgtggggtcggacgggcgtttttttcgcgggtatcggtaggacgtttacgacggtaaggattatatcgttttgaacgaggatttgcgttntttggatcgcggcggatatggtagtttagattattaagcgtaagtgggaggcggtttatgcggcggagtagcggagagtttatttggagggtacgtgcgtggagtggtttcgtagatatttggagaacgggaaggagacgttgtagcgtacgggtattaggggttacggggcgtttttttgatcgtttnatagatttttcgggttggttttttataaggaggggagataattg

SEQ ID NO: 12186 - DNA, 852 bp, Artificial Sequence
  chemically treated genomic DNA (Homo sapiens) CpG-island No: 12186
  misc_feature (45)..(45): n is either a, c, g or t
  misc_feature (234)..(234): n is either a, c, g or t
  misc_feature (354)..(354): n is either a, c, g or t
  misc_feature (418)..(418): n is either a, c, g or t
  misc_feature (705)..(705): n is either a, c, g or t
caattatctcccctccttataaaaaaccaacccgaaaaatctatnaaacgatcaaaaaaacgccccgtaacccctaatacccgtacgctacaacgtctccttcccgttctccaaatatctacgaaaccactccacgcacgtaccctccaaataaactctccgctactccgccgcataaaccgcctcccacttacgcttaataatctaaactaccatatccgccgcgatccaaanaacgcaaatcctcgttcaaaacgatataatccttaccgtcgtaaacgtcctaccgatacccgcgaaaaaaacgcccgtccgaccccacgtcgcaaccatacattatctaaataatataanaaacctaaccccgaccccgcgatcaacccaatcccccgaaccccgccccgccccgaccaacccnaaaaaaatttttaacctaaactaaaaataaaaccgaataaaaacgcctaaacctctcccgaaacaaaaatctcgaaatcccgcgacttcgaaataaatctcgaacccgaaaactataaacgacctaacccgtccgtaaaaaataaaaaatcgtaacctacgccccgaaccgaaatcactcaccgtcctcgctctaattataataaccgcgcaaaatccccaaattcgctcgatcaatctataaataaaccttcatattccgtatctcctaatcccaatactccgacnccctcctactctatccacgacgcccgcgactccatcttctaactcgcgacgtcgctatcgaaccgcacgaactacgtatcgtccacgtaacccacgacgataaaacgaaactccccgcgaccgaaccgaaacacgaatataaaaaaa

SEQ ID NO: 12187 - DNA, 852 bp, Artificial Sequence
  chemically treated genomic DNA (Homo sapiens) CpG-island No: 12187
  misc_feature (45)..(45): n is either a, c, g or t
  misc_feature (234)..(234): n is either a, c, g or t
  misc_feature (354)..(354): n is either a, c, g or t
  misc_feature (418)..(418): n is either a, c, g or t
  misc_feature (705)..(705): n is either a, c, g or t
taattgttttttttttttgtgggaggttagttcgggagatttatnaggcgattagggaggcgtttcgtggtttttggtattcgtgcgttgtagcgtttttttttcgttttttaggtatttgcggagttattttacgtacgtgttttttaggtagatttttcgttgtttcgtcgtatggatcgttttttatttgcgtttggtgatttgagttgttatgttcgtcgcggtttaagnagcgtaggttttcgtttagggcgatgtaatttttgtcgtcgtaggcgttttgtcggtattcgcggaggaagcgttcgttcggttttacgtcgtagttatatattatttggatggtgtgangaatttggtttcgatttcgcggttagtttagtttttcgagtttcgtttcgtttcgattaatttnggggggatttttggtttaaattgaaaatgaaatcgggtaaaggcgtttgggtttttttcgggataagggtttcggagtttcgcggtttcggggtggatttcggattcggagattgtgggcgatttggttcgttcgtgggggatgaggggtcgtgatttgcgtttcgggtcggggttatttatcgttttcgttttggttgtagtagtcgcgtagggtttttaggttcgttcggttagtttgtgagtgggtttttatatttcgtgttttttggttttaatatttcggtntttttttgttttatttacggcgttcgcggttttattttttggttcgcggcgtcgttgtcgaatcgtacgaattgcgtgtcgtttacgtagtttacggcgatgaagcggggtttttcgcggtcgggtcgggatacggatgtgaagaaa

SEQ ID NO: 12188 - DNA, 852 bp, Artificial Sequence
  chemically treated genomic DNA (Homo sapiens) CpG-island No: 12188
  misc_feature (148)..(148): n is either a, c, g or t
  misc_feature (435)..(435): n is either a, c, g or t
  misc_feature (499)..(499): n is either a, c, g or t
  misc_feature (619)..(619): n is either a, c, g or t
  misc_feature (808)..(808): n is either a, c, g or t
tttcttcacatccgtatcccgacccgaccgcgaaaaaccccgcttcatcgccgtaaactacgtaaacgacacgcaattcgtacgattcgacaacgacgccgcgaaccaaaaaataaaaccgcgaacgccgtaaataaaacaaaaaaanaccgaaatattaaaaccaaaaaacacgaaatataaaaacccactcacaaactaaccgaacgaacctaaaaaccctacgcgactactacaaccaaaacgaaaacgataaataaccccgacccgaaacgcaaatcacgacccctcatcccccacgaacgaaccaaatcgcccacaatctccgaatccgaaatccaccccgaaaccgcgaaactccgaaacccttatcccgaaaaaaacccaaacgcctttacccgatttcattttcaatttaaaccaaaaatccccccnaaattaatcgaaacgaaacgaaactcgaaaaactaaactaaccgcgaaatcgaaaccaaattcntcacaccatccaaataatatataactacgacgtaaaaccgaacgaacgcttcctccgcgaataccgacaaaacgcctacgacgacaaaaattacatcgccctaaacgaaaacctacgctncttaaaccgcgacgaacataacaactcaaatcaccaaacgcaaataaaaaacgatccatacgacgaaacaacgaaaaatctacctaaaaaacacgtacgtaaaataactccgcaaatacctaaaaaacgaaaaaaaaacgctacaacgcacgaataccaaaaaccacgaaacgcctccctaatcgcctnataaatctcccgaactaacctcccacaaaaaaaaaaaacaatta

SEQ ID NO: 12189 - DNA, 770 bp, Artificial Sequence
  chemically treated genomic DNA (Homo sapiens) CpG-island No: 12189
tcggcggcgtcggtagagtcgtttagggcgtcgggtagggaggcgttgtaggacgcggcgggcgcggcggcggggggcgcgttttcggcggtcgcgcggttttcgttgattaggtcggtgagcgcgcggtattagtttttttgtttttgttcgttttcggcggttacggcgaagtattcgtttttggtgtagagggcgattaggtatttgtgtttggcgtcggcgcgtttgttgatgtttaggtagtagtcgagagcgattattcgtttcggcgcgtttgttttgtttcgttattttttttcgttttcgtagtattcgagtcgcggcggttgcggcgtcgatttttcgttcgtcgtcgtttcgtcgtcgttcgcgtcgggttcgcgtagtacgaagaagcgtttgtggttatgtttttgtttgcgtaggtagtcgtatttgcgtacgttgtggttgttgttgttgttgttgttgttaaggttggggtcgttttcgttcgtcggttcgggtcggttcgtatcgcggcgggttcgttatcgcgggcgttttagttcgcgcggttcgggttcggcgtttaggggttggggtgaggggcgtagggggcgcgggcggggacggtttttttttatttttgcgttcggtcgttcgttcgattacgcgtttttcgggtttaggcggtggggaaggttcggggaggttcgcgggggttagtatcgttcggcggcgtcgcgtttttcgcgttttggggtttttgaggatgttcggcgcgg

SEQ ID NO: 12190 - DNA, 770 bp, Artificial Sequence
  chemically treated genomic DNA (Homo sapiens) CpG-island No: 12190
ccgcgccgaacatcctcaaaaaccccaaaacgcgaaaaacgcgacgccgccgaacgatactaacccccgcgaacctccccgaaccttccccaccgcctaaacccgaaaaacgcgtaatcgaacgaacgaccgaacgcaaaaataaaaaaaaaccgtccccgcccgcgccccctacgcccctcaccccaacccctaaacgccgaacccgaaccgcgcgaactaaaacgcccgcgataacgaacccgccgcgatacgaaccgacccgaaccgacgaacgaaaacgaccccaaccttaacaacaacaacaacaacaacaaccacaacgtacgcaaatacgactacctacgcaaacaaaaacataaccacaaacgcttcttcgtactacgcgaacccgacgcgaacgacgacgaaacgacgacgaacgaaaaatcgacgccgcaaccgccgcgactcgaatactacgaaaacgaaaaaaaataacgaaacaaaacaaacgcgccgaaacgaataatcgctctcgactactacctaaacatcaacaaacgcgccgacgccaaacacaaatacctaatcgccctctacaccaaaaacgaatacttcgccgtaaccgccgaaaacgaacaaaaacaaaaaaactaataccgcgcgctcaccgacctaatcaacgaaaaccgcgcgaccgccgaaaacgcgccccccgccgccgcgcccgccgcgtcctacaacgcctccctacccgacgccctaaacgactctaccgacgccgccga

SEQ ID NO: 12191 - DNA, 770 bp, Artificial Sequence
  chemically treated genomic DNA (Homo sapiens) CpG-island No: 12191
tcgcgtcgggtatttttaggagttttagagcgcggagggcgcggcgtcgtcgagcggtgttggttttcgcgggttttttcggattttttttatcgtttgggttcgagggacgcgtgatcgggcgggcggtcgggcgtaagggtgggagggagtcgttttcgttcgcgttttttacgttttttattttaatttttgggcgtcgggttcgggtcgcgcggattgaagcgttcgcgatggcgagttcgtcgcggtacgggtcggttcgggtcggcgagcggagacggttttaattttaataataataataataataataattatagcgtgcgtaagtgcggttatttgcgtaagtagaagtatggttataagcgttttttcgtgttgcgcggattcggcgcgggcggcgacgaggcgacggcgggcggggggtcggcgtcgtaatcgtcgcggttcgagtattacgagagcgagaaaaagtggcggagtaaggtaggcgcgtcgaaacgggtgatcgttttcgattgttgtttgaatattaataagcgcgtcgacgttaagtataagtatttgatcgttttttatattaaggacgagtatttcgtcgtggtcgtcgagaacgagtaggagtaggagggttggtatcgcgcgtttatcgatttggttagcgagggtcgcgcggtcgtcggagacgcgtttttcgtcgtcgcgttcgtcgcgttttgtagcgtttttttgttcggcgttttgggcggttttgtcggcgtcgtcgg

SEQ ID NO: 12192 - DNA, 770 bp, Artificial Sequence
  chemically treated genomic DNA (Homo sapiens) CpG-island No: 12192
ccgacgacgccgacaaaaccgcccaaaacgccgaacaaaaaaacgctacaaaacgcgacgaacgcgacgacgaaaaacgcgtctccgacgaccgcgcgaccctcgctaaccaaatcgataaacgcgcgataccaaccctcctactcctactcgttctcgacgaccacgacgaaatactcgtccttaatataaaaaacgatcaaatacttatacttaacgtcgacgcgcttattaatattcaaacaacaatcgaaaacgatcacccgtttcgacgcgcctaccttactccgccactttttctcgctctcgtaatactcgaaccgcgacgattacgacgccgaccccccgcccgccgtcgcctcgtcgccgcccgcgccgaatccgcgcaacacgaaaaaacgcttataaccatacttctacttacgcaaataaccgcacttacgcacgctataattattattattattattattattaaaattaaaaccgtctccgctcgccgacccgaaccgacccgtaccgcgacgaactcgccatcgcgaacgcttcaatccgcgcgacccgaacccgacgcccaaaaattaaaataaaaaacgtaaaaaacgcgaacgaaaacgactccctcccacccttacgcccgaccgcccgcccgatcacgcgtccctcgaacccaaacgataaaaaaaatccgaaaaaacccgcgaaaaccaacaccgctcgacgacgccgcgccctccgcgctctaaaactcctaaaaatacccgacgcga

SEQ ID NO: 12193 - DNA, 534 bp, Artificial Sequence
  chemically treated genomic DNA (Homo sapiens) CpG-island No: 12193
ggcgtcgcgtgaagagtgggagagaagtattgcgggggcgggggcgggggcgggggcgggggcgggggtagtcgggagtttggagttagatcggggcggggtcgggatcggggttagggattagtggtgggaggaggttgcggcgttagatgcggatatttggatcgtcgcgtcgaggttttcggcgttcgttgttttcgcggttcgcgttatgtttttttatacggttatcgtggttattggtagttagtggttcgtcggtattgacgattatatttattttagtttcgtgggttcggcgggttgtagcgagaagtatttgttggataagtttttttataacgatttcgagcgtggcgcggtgagcgcgggcggggtacgggtggagcgcgggttgaggtgcgttcgggattcggtttggacggtagaggtttgggcgggggcgtcgagggttcgtcggggcggttcggataggattgggggtgtttaggattttgttagggagggtagaattgcggtggggcgtgttttggg

SEQ ID NO: 12194 - DNA, 534 bp, Artificial Sequence
  chemically treated genomic DNA (Homo sapiens) CpG-island No: 12194
cccaaaacacgccccaccgcaattctaccctccctaacaaaatcctaaacacccccaatcctatccgaaccgccccgacgaaccctcgacgcccccgcccaaacctctaccgtccaaaccgaatcccgaacgcacctcaacccgcgctccacccgtaccccgcccgcgctcaccgcgccacgctcgaaatcgttataaaaaaacttatccaacaaatacttctcgctacaacccgccgaacccacgaaactaaaataaatataatcgtcaataccgacgaaccactaactaccaataaccacgataaccgtataaaaaaacataacgcgaaccgcgaaaacaacgaacgccgaaaacctcgacgcgacgatccaaatatccgcatctaacgccgcaacctcctcccaccactaatccctaaccccgatcccgaccccgccccgatctaactccaaactcccgactacccccgcccccgcccccgcccccgcccccgcccccgcaatacttctctcccactcttcacgcgacgcc

SEQ ID NO: 12195 - DNA, 534 bp, Artificial Sequence
  chemically treated genomic DNA (Homo sapiens) CpG-island No: 12195
tttagggtacgttttatcgtagttttgttttttttgatagggttttggatatttttagttttgttcgggtcgtttcgacgggttttcggcgttttcgtttaggtttttgtcgtttaaatcgggtttcggacgtattttagttcgcgttttattcgtgtttcgttcgcgtttatcgcgttacgttcgaagtcgttgtagaagggtttgtttagtaggtgtttttcgttgtagttcgtcgagtttacgaggttgaggtagatgtagtcgttagtgtcggcgaattattggttgttagtggttacggtgatcgtgtaggagggtatggcgcgggtcgcgggagtagcgagcgtcgggagtttcggcgcggcggtttaggtgttcgtatttagcgtcgtagtttttttttattattggtttttggtttcggtttcggtttcgtttcggtttggttttaggttttcggttgttttcgttttcgttttcgttttcgttttcgttttcgtagtattttttttttattttttacgcggcgtt

SEQ ID NO: 12196 - DNA, 534 bp, Artificial Sequence
  chemically treated genomic DNA (Homo sapiens) CpG-island No: 12196
aacgccgcgtaaaaaataaaaaaaaaatactacgaaaacgaaaacgaaaacgaaaacgaaaacgaaaacaaccgaaaacctaaaaccaaaccgaaacgaaaccgaaaccgaaaccaaaaaccaataataaaaaaaaactacgacgctaaatacgaacacctaaaccgccgcgccgaaactcccgacgctcgctactcccgcgacccgcgccataccctcctacacgatcaccgtaaccactaacaaccaataattcgccgacactaacgactacatctacctcaacctcgtaaactcgacgaactacaacgaaaaacacctactaaacaaacccttctacaacgacttcgaacgtaacgcgataaacgcgaacgaaacacgaataaaacgcgaactaaaatacgtccgaaacccgatttaaacgacaaaaacctaaacgaaaacgccgaaaacccgtcgaaacgacccgaacaaaactaaaaatatccaaaaccctatcaaaaaaaacaaaactacgataaaacgtaccctaaa

SEQ ID NO: 12197 - DNA, 748 bp, Artificial Sequence
  chemically treated genomic DNA (Homo sapiens) CpG-island No: 12197
ggttcgtattaagcgtatttttttgggggcggggtttgcgcgagttgggcgtgtcgggggcggggtttgcgcgtttgttttcggcgtgtcgcgagaggcggggcgtgtggggaggcgcggtcgttacgcgacgtttggttgggttcgtatcggagaggcgtttcggtatttggtaggcggtttgttattcggagttcgttgcggggcggcggcggcggggatatgtacgtgtgagatgcggtagcgggcggcgcggacgcgaatagtagcggcggcggcgggcgcggttttttgggcgcggggcgcgcggtgtttgagggcgggcgcgcgggcgttgggtaattgtcggtcgcgtcgtttgcgtaggcgttggtttaggatttatacgtcgcgttgaggttcgcgggttcgttatggaggcgtttatcgtggagacgtttttcgatttttcgtttttttcggtttcggtttttgtttcggtttcgttgcgcgtttcggatgtggcgcggttgcgcgaggagtaggaaaaggtaattagtagtttcgcgtcgttttcgttttcgttcgtcgggttgtttttgtttgtgttttgggtcgtcgtttcgcgtggtttaggtttagttgttcgggttttcggagggaacggggataaatttttgttacgtgtttttgttgtttttgtttgtagttttttgatttcgtagcggagtgaggggtgtgtagttcgttcgtttgtttaggaaagggg

SEQ ID NO: 12198 - DNA, 748 bp, Artificial Sequence
  chemically treated genomic DNA (Homo sapiens) CpG-island No: 12198
cccctttcctaaacaaacgaacgaactacacacccctcactccgctacgaaatcaaaaaactacaaacaaaaacaacaaaaacacgtaacaaaaatttatccccgttccctccgaaaacccgaacaactaaacctaaaccacgcgaaacgacgacccaaaacacaaacaaaaacaacccgacgaacgaaaacgaaaacgacgcgaaactactaattaccttttcctactcctcgcgcaaccgcgccacatccgaaacgcgcaacgaaaccgaaacaaaaaccgaaaccgaaaaaaacgaaaaatcgaaaaacgtctccacgataaacgcctccataacgaacccgcgaacctcaacgcgacgtataaatcctaaaccaacgcctacgcaaacgacgcgaccgacaattacccaacgcccgcgcgcccgccctcaaacaccgcgcgccccgcgcccaaaaaaccgcgcccgccgccgccgctactattcgcgtccgcgccgcccgctaccgcatctcacacgtacatatccccgccgccgccgccccgcaacgaactccgaataacaaaccgcctaccaaataccgaaacgcctctccgatacgaacccaaccaaacgtcgcgtaacgaccgcgcctccccacacgccccgcctctcgcgacacgccgaaaacaaacgcgcaaaccccgcccccgacacgcccaactcgcgcaaaccccgcccccaaaaaaatacgcttaatacgaacc

SEQ ID NO: 12199 - DNA, 748 bp, Artificial Sequence
  chemically treated genomic DNA (Homo sapiens) CpG-island No: 12199
ttttttttttgggtaggcgaacgggttgtatattttttatttcgttgcgaagttaaagggttgtagataaagataatagaagtacgtgataaaagtttattttcgtttttttcgggggttcgggtagttgggtttaggttacgcggggcggcggtttagagtataggtaggggtagttcggcgggcggaggcggaagcggcgcggggttgttagttatttttttttgtttttcgcgtagtcgcgttatattcggggcgcgtaacggaatcggggtaggggtcggggtcgaagggggcgaggggtcggggggcgtttttacggtgggcgtttttatgacgggttcgcgggttttagcgcggcgtgtgagttttgaattagcgtttgcgtaggcggcgcggtcggtagttgtttagcgttcgcgcgttcgtttttaggtatcgcgcgtttcgcgtttaggaggtcgcgttcgtcgtcgtcgttgttgttcgcgttcgcgtcgttcgttgtcgtattttatacgtgtatgttttcgtcgtcgtcgtttcgtagcgggtttcgagtagtaggtcgtttgttaggtatcgagacgttttttcggtgcgggtttagttaggcgtcgcgtggcggtcgcgtttttttatacgtttcgtttttcgcggtacgtcggaagtaagcgcgtaggtttcgttttcgatacgtttagttcgcgtaggtttcgtttttaggggagtgcgtttgatgcgaatt

SEQ ID NO: 12200 - DNA, 748 bp, Artificial Sequence
  chemically treated genomic DNA (Homo sapiens) CpG-island No: 12200
aattcgcatcaaacgcactcccctaaaaacgaaacctacgcgaactaaacgtatcgaaaacgaaacctacgcgcttacttccgacgtaccgcgaaaaacgaaacgtataaaaaaacgcgaccgccacgcgacgcctaactaaacccgcaccgaaaaaacgtctcgatacctaacaaacgacctactactcgaaacccgctacgaaacgacgacgacgaaaacatacacgtataaaatacgacaacgaacgacgcgaacgcgaacaacaacgacgacgacgaacgcgacctcctaaacgcgaaacgcgcgatacctaaaaacgaacgcgcgaacgctaaacaactaccgaccgcgccgcctacgcaaacgctaattcaaaactcacacgccgcgctaaaacccgcgaacccgtcataaaaacgcccaccgtaaaaacgccccccgacccctcgcccccttcgaccccgacccctaccccgattccgttacgcgccccgaatataacgcgactacgcgaaaaacaaaaaaaaataactaacaaccccgcgccgcttccgcctccgcccgccgaactacccctacctatactctaaaccgccgccccgcgtaacctaaacccaactacccgaacccccgaaaaaaacgaaaataaacttttatcacgtacttctattatctttatctacaaccctttaacttcgcaacgaaataaaaaatatacaacccgttcgcctacccaaaaaaaaaa

SEQ ID NO: 12201 - DNA, 566 bp, Artificial Sequence
  chemically treated genomic DNA (Homo sapiens) CpG-island No: 12201
tcgtttatcgcgcggaggataatttttagtcggtagtttagattagcgcggtatttgttttcggagtttttatcgtttttttcgatttattttagggaaatttttaagaatacgttttataaatttacgtgcgtattatttttatttcgcgtcgcgttcgggaggaaggaacgaggtaaggagttaaagtagcgtgcgtttagttttggggtaagttcgtcgggtggggaagtcggtttcgtaggattttgggatgggaattttgtttttttttgcgattttagggcgtgaagaaggcgtttttttcgttgtcggcggagttgatcggttggttagttaatttttttttagtacgtttcgtgcgtttattttcgtttagttcggggttttttcgtcgtttttcggaaggggtttgcggtttttggttaggacgttcggaaggcgagcgggggaaggtagggttgtcgcgggaattcggtttgtgagagcgatttcgttatgtttgtgttgttaagagtatttttttttttttgttgtggtttgatgttatatggttttttcggagt

SEQ ID NO: 12202 - DNA, 566 bp, Artificial Sequence
  chemically treated genomic DNA (Homo sapiens) CpG-island No: 12202
actccgaaaaaaccatataacatcaaaccacaacaaaaaaaaaaaaatactcttaacaacacaaacataacgaaatcgctctcacaaaccgaattcccgcgacaaccctaccttcccccgctcgccttccgaacgtcctaaccaaaaaccgcaaaccccttccgaaaaacgacgaaaaaaccccgaactaaacgaaaataaacgcacgaaacgtactaaaaaaaaattaactaaccaaccgatcaactccgccgacaacgaaaaaaacgccttcttcacgccctaaaatcgcaaaaaaaaacaaaattcccatcccaaaatcctacgaaaccgacttccccacccgacgaacttaccccaaaactaaacgcacgctactttaactccttacctcgttccttcctcccgaacgcgacgcgaaataaaaataatacgcacgtaaatttataaaacgtattcttaaaaatttccctaaaataaatcgaaaaaaacgataaaaactccgaaaacaaataccgcgctaatctaaactaccgactaaaaattatcctccgcgcgataaacga

SEQ ID NO: 12203 - DNA, 566 bp, Artificial Sequence
  chemically treated genomic DNA (Homo sapiens) CpG-island No: 12203
gtttcggaggagttatgtggtattaagttatagtaaaggggaaaaagtgtttttagtaatataaatatggcgaaatcgtttttataagtcgggttttcgcgatagttttattttttttcgttcgtttttcgaacgttttggttaggaatcgtagatttttttcgggggacggcgagggggtttcgggttgagcgagggtgggcgtacggggcgtgttaaggggaaattgattagttagtcgattagtttcgtcggtagcggaggggacgttttttttacgttttgagatcgtaaaggagagtaaaatttttattttaaagttttgcgggatcggtttttttattcgacgaatttattttagggttgaacgtacgttgttttagttttttgtttcgtttttttttttcgggcgcgacgcgaggtgaaaatgatgcgtacgtagatttgtagagcgtatttttgagaatttttttgggatgaatcgggaggagcggtggagatttcggagataggtgtcgcgttggtttgggttgtcggttaaaagttgtttttcgcgcggtgggcgg

SEQ ID NO: 12204 - DNA, 566 bp, Artificial Sequence
  chemically treated genomic DNA (Homo sapiens) CpG-island No: 12204
ccgcccaccgcgcgaaaaacaacttttaaccgacaacccaaaccaacgcgacacctatctccgaaatctccaccgctcctcccgattcatcccaaaaaaattctcaaaaatacgctctacaaatctacgtacgcatcattttcacctcgcgtcgcgcccgaaaaaaaaaaacgaaacaaaaaactaaaacaacgtacgttcaaccctaaaataaattcgtcgaataaaaaaaccgatcccgcaaaactttaaaataaaaattttactctcctttacgatctcaaaacgtaaaaaaaacgtcccctccgctaccgacgaaactaatcgactaactaatcaatttccccttaacacgccccgtacgcccaccctcgctcaacccgaaaccccctcgccgtcccccgaaaaaaatctacgattcctaaccaaaacgttcgaaaaacgaacgaaaaaaaataaaactatcgcgaaaacccgacttataaaaacgatttcgccatatttatattactaaaaacactttttcccctttactataacttaataccacataactcctccgaaac

SEQ ID NO: 12205 - DNA, 803 bp, Artificial Sequence
  chemically treated genomic DNA (Homo sapiens) CpG-island No: 12205
tataggttcgggatttttcgtagcgttaggggtcgtagtttcggtcgtcggggagtgttatggtagggaggcggtagttacgtgaggggtttgcggaagcgtcggagttgaaagttgggggcgaagtgcgtagtagagtcgtgacgggggtgatacgtagtagtcgggggcggcgggtcgtcggagtcgggcgttttttacgtagggtcggcgtttttcgtcgcgggtgggtgcgtattcgtcggttttttttcgggagatcgttttcgggagcgggcgttggcggggcggggtcgtggcggtaaatagggtggtgttttttgttttttcgttttcggtttgtcggggcgcgcggtcggcggcgttcggggcggtggaggcgcggtcgcggcgtcgggtagcgggggcgcgttcgttttttgtcgttttcgcgcgcgttcgtcgtcgttcggtcggttttttttgtttttgttttgatggagttcgcgtgtagttggcgcgtgtcgagttacgtgtcgtgggcgggagggggtcggggcgcgggaggcgagggcgcggtgatacgggtcggaggggtttgcgttcgcggagggcgcgcgagggggcgtgtggttttcgatggagttttgtcgcgcgggtgtttcggcgttggttgaggggtttggcgtttttcggcgagtagtgttaggtttgtcgtcgtagcgtttcggggagtttagtttaggagagaggatttgtttgcgttgttcggtttagaattcggattttataggtggtgtgtatatttcggtggacgggtagat

SEQ ID NO: 12206 - DNA, 803 bp, Artificial Sequence
  chemically treated genomic DNA (Homo sapiens) CpG-island No: 12206
atctacccgtccaccgaaatatacacaccacctataaaatccgaattctaaaccgaacaacgcaaacaaatcctctctcctaaactaaactccccgaaacgctacgacgacaaacctaacactactcgccgaaaaacgccaaacccctcaaccaacgccgaaacacccgcgcgacaaaactccatcgaaaaccacacgccccctcgcgcgccctccgcgaacgcaaacccctccgacccgtatcaccgcgccctcgcctcccgcgccccgaccccctcccgcccacgacacgtaactcgacacgcgccaactacacgcgaactccatcaaaacaaaaacaaaaaaaaccgaccgaacgacgacgaacgcgcgcgaaaacgacaaaaaacgaacgcgcccccgctacccgacgccgcgaccgcgcctccaccgccccgaacgccgccgaccgcgcgccccgacaaaccgaaaacgaaaaaacaaaaaacaccaccctatttaccgccacgaccccgccccgccaacgcccgctcccgaaaacgatctcccgaaaaaaaaccgacgaatacgcacccacccgcgacgaaaaacgccgaccctacgtaaaaaacgcccgactccgacgacccgccgcccccgactactacgtatcacccccgtcacgactctactacgcacttcgcccccaactttcaactccgacgcttccgcaaacccctcacgtaactaccgcctccctaccataacactccccgacgaccgaaactacgacccctaacgctacgaaaaatcccgaacctata

SEQ ID NO: 12207 - DNA, 803 bp, Artificial Sequence
  chemically treated genomic DNA (Homo sapiens) CpG-island No: 12207
gtttattcgtttatcgggatgtatatattatttgtaaggttcgagttttgagtcgagtagcgtaggtaggtttttttttttggattaggtttttcgaagcgttgcgacgataaatttagtattgttcgtcgagaagcgttaagttttttagttagcgtcggggtattcgcgcggtagggttttatcgggggttatacgttttttcgcgcgtttttcgcgggcgtaggttttttcggttcgtgttatcgcgttttcgtttttcgcgtttcggttttttttcgtttacggtacgtgattcgatacgcgttagttgtacgcgggttttattaaaataaaaatagaggaggtcggtcgggcggcggcgggcgcgcgcgggggcggtagagagcgggcgcgttttcgttgttcggcgtcgcgatcgcgtttttatcgtttcgggcgtcgtcggtcgcgcgtttcggtaggtcgggggcgggagggtagagggtattattttgtttatcgttacggtttcgtttcgttagcgttcgttttcggaaacggtttttcgggagagggtcggcgagtgcgtatttattcgcggcggggaacgtcggttttgcgtgggaggcgttcggtttcggcggttcgtcgttttcggttgttgcgtgttattttcgttacgattttgttacgtatttcgtttttagtttttagtttcggcgttttcgtagattttttacgtggttgtcgtttttttgttatggtatttttcggcgatcggggttgcggtttttagcgttgcgagggatttcgagtttgtg

SEQ ID NO: 12208 - DNA, 803 bp, Artificial Sequence
  chemically treated genomic DNA (Homo sapiens) CpG-island No: 12208
cacaaactcgaaatccctcgcaacgctaaaaaccgcaaccccgatcgccgaaaaataccataacaaaaaaacgacaaccacgtaaaaaatctacgaaaacgccgaaactaaaaactaaaaacgaaatacgtaacaaaatcgtaacgaaaataacacgcaacaaccgaaaacgacgaaccgccgaaaccgaacgcctcccacgcaaaaccgacgttccccgccgcgaataaatacgcactcgccgaccctctcccgaaaaaccgtttccgaaaacgaacgctaacgaaacgaaaccgtaacgataaacaaaataataccctctaccctcccgcccccgacctaccgaaacgcgcgaccgacgacgcccgaaacgataaaaacgcgatcgcgacgccgaacaacgaaaacgcgcccgctctctaccgcccccgcgcgcgcccgccgccgcccgaccgacctcctctatttttattttaataaaacccgcgtacaactaacgcgtatcgaatcacgtaccgtaaacgaaaaaaaaccgaaacgcgaaaaacgaaaacgcgataacacgaaccgaaaaaacctacgcccgcgaaaaacgcgcgaaaaaacgtataacccccgataaaaccctaccgcgcgaataccccgacgctaactaaaaaacttaacgcttctcgacgaacaatactaaatttatcgtcgcaacgcttcgaaaaacctaatccaaaaaaaaaaacctacctacgctactcgactcaaaactcgaaccttacaaataatatatacatcccgataaacgaataaac

SEQ ID NO: 12209 - DNA, 1016 bp, Artificial Sequence
  chemically treated genomic DNA (Homo sapiens) CpG-island No: 12209
tttagcgcggcggagttgagttttttttcggtttatcggtattatttgttgtttttaagttagaaaaggcggcgtttttagagggagtcgagtagtcgttgtaggtgaaggggagtttcgggcggttaggtcgtcgttacgtgtcggtttcgttcggttcggcgtatttgtagcgtagttagggcgttaagtaaggtttttatattcggggttcgtagttattgttaacgcgttaattttttgttcgcgggttcgagggtgtcggttgttgcgcgcgggtttttgaggcgttagagattttatttggcgcgttcgcgggattaagtttatttttttcgaagtgggatttttttattttgttttttcgtatacgatcggtttttttttttcggtagggcgtggcgttcggcgttttatttcgtcgcggtttatttgattaatcgttttttttttttttttatttagcgttttttttagtcgttggggaggcgcgttgatatttgtttattggtattagagaggcgtgggcgatggtagaggattgggcgtttggggcgtcgtttaggttgattttaaacggtgttcgttcggtagttttacgcgatagttttcgttttttgttcgcgcgtcgttcggtcggattttgtagggggcgcgtaggagtcgcgtttttttaagtaacgttaaaataaggtcgagttcgaatcggtttagcgttggttgttcgcgaggtcggatgggattttcggttttatttttgaacggttgtttcgggtagttttgtttgcggcggttcgttagtttggtataggcgtcgttcggtatcgtttttttttacgtcgtttagggcgttcgcggggtagtagttacgtgattcgcggttagggattttatagtttacgggttacggtatatacgcgttacgtatatatcgaggtgacgtggaagttttttagtagttgattttaaatagtttgggttgattggtttggtaattgcgtttttattcgtttttt

SEQ ID NO: 12210 - DNA, 1016 bp, Artificial Sequence
  chemically treated genomic DNA (Homo sapiens) CpG-island No: 12210
aaaaaacgaataaaaacgcaattaccaaaccaatcaacccaaactatttaaaatcaactactaaaaaacttccacgtcacctcgatatatacgtaacgcgtatataccgtaacccgtaaactataaaatccctaaccgcgaatcacgtaactactaccccgcgaacgccctaaacgacgtaaaaaaaaacgataccgaacgacgcctataccaaactaacgaaccgccgcaaacaaaactacccgaaacaaccgttcaaaaataaaaccgaaaatcccatccgacctcgcgaacaaccaacgctaaaccgattcgaactcgaccttattttaacgttacttaaaaaaacgcgactcctacgcgccccctacaaaatccgaccgaacgacgcgcgaacaaaaaacgaaaactatcgcgtaaaactaccgaacgaacaccgtttaaaatcaacctaaacgacgccccaaacgcccaatcctctaccatcgcccacgcctctctaataccaataaacaaatatcaacgcgcctccccaacgactaaaaaaaacgctaaataaaaaaaaaaaaaaaacgattaatcaaataaaccgcgacgaaataaaacgccgaacgccacgccctaccgaaaaaaaaaaaccgatcgtatacgaaaaaacaaaataaaaaaatcccacttcgaaaaaaataaacttaatcccgcgaacgcgccaaataaaatctctaacgcctcaaaaacccgcgcgcaacaaccgacaccctcgaacccgcgaacaaaaaattaacgcgttaacaataactacgaaccccgaatataaaaaccttacttaacgccctaactacgctacaaatacgccgaaccgaacgaaaccgacacgtaacgacgacctaaccgcccgaaactccccttcacctacaacgactactcgactccctctaaaaacgccgccttttctaacttaaaaacaacaaataataccgataaaccgaaaaaaaactcaactccgccgcgctaaa

SEQ ID NO: 12211 - DNA, 1016 bp, Artificial Sequence
  chemically treated genomic DNA (Homo sapiens) CpG-island No: 12211
aaaaagcgaatgaaggcgtagttattaggttagttaatttaggttgtttaaggttaattattgggggatttttacgttatttcgatatatacgtaacgcgtgtgtgtcgtaattcgtgaattatggaatttttaatcgcgaattacgtggttgttgtttcgcggacgttttagacgacgtgagggaaggcggtgtcgggcggcgtttgtgttaggttggcgggtcgtcgtagatagagttattcggagtaatcgtttaggggtgaggtcggaagttttattcgatttcgcgggtagttagcgttaggtcgattcgaattcgattttgttttggcgttgtttaggagaacgcggtttttgcgcgttttttatagagttcggtcgggcggcgcgcgggtagggggcggggattgtcgcgtggagttgtcgggcgagtatcgtttaggattaatttggacggcgttttaggcgtttagttttttgttatcgtttacgtttttttggtgttagtgaataggtattagcgcgtttttttagcggttgggagagacgttgaatgaagaagagggaaggacggttagttaggtgagtcgcggcggggtggagcgtcgggcgttacgttttgtcgagggagaagagtcggtcgtgtgcggagggatagggtgaagggattttatttcggggaggatgggtttaatttcgcgggcgcgttaggtgggatttttagcgttttaggggttcgcgcgtaatagtcggtattttcgggttcgcggataaagggttaacgcgttggtagtgattgcgggtttcggatgtgagagttttgtttgacgttttggttgcgttgtaggtgcgtcgggtcgaacggagtcggtacgtggcggcgatttgatcgttcgaggtttttttttatttgtagcggttgttcggttttttttgggaacgtcgttttttttaatttaagggtaataggtggtgtcggtggatcgagagagagtttagtttcgtcgcgttggg

SEQ ID NO: 12212 - DNA, 1016 bp, Artificial Sequence
  chemically treated genomic DNA (Homo sapiens) CpG-island No: 12212
cccaacgcgacgaaactaaactctctctcgatccaccgacaccacctattacccttaaattaaaaaaaacgacgttcccaaaaaaaaccgaacaaccgctacaaataaaaaaaaacctcgaacgatcaaatcgccgccacgtaccgactccgttcgacccgacgcacctacaacgcaaccaaaacgtcaaacaaaactctcacatccgaaacccgcaatcactaccaacgcgttaaccctttatccgcgaacccgaaaataccgactattacgcgcgaacccctaaaacgctaaaaatcccacctaacgcgcccgcgaaattaaacccatcctccccgaaataaaatcccttcaccctatccctccgcacacgaccgactcttctccctcgacaaaacgtaacgcccgacgctccaccccgccgcgactcacctaactaaccgtccttccctcttcttcattcaacgtctctcccaaccgctaaaaaaacgcgctaatacctattcactaacaccaaaaaaacgtaaacgataacaaaaaactaaacgcctaaaacgccgtccaaattaatcctaaacgatactcgcccgacaactccacgcgacaatccccgccccctacccgcgcgccgcccgaccgaactctataaaaaacgcgcaaaaaccgcgttctcctaaacaacgccaaaacaaaatcgaattcgaatcgacctaacgctaactacccgcgaaatcgaataaaacttccgacctcacccctaaacgattactccgaataactctatctacgacgacccgccaacctaacacaaacgccgcccgacaccgccttccctcacgtcgtctaaaacgtccgcgaaacaacaaccacgtaattcgcgattaaaaattccataattcacgaattacgacacacacgcgttacgtatatatcgaaataacgtaaaaatcccccaataattaaccttaaacaacctaaattaactaacctaataactacgccttcattcgcttttt

SEQ ID NO: 12213 - DNA, 631 bp, Artificial Sequence
  chemically treated genomic DNA (Homo sapiens) CpG-island No: 12213
ggacggagtggaagaagaggggtcgagatttgtttgggggcgtttaggtggagcgtacggggttcggggtttttttacggtttggttttagcgcgcggatgttaaagtggaaggagtttttgtaggtgtagggcgtgggtaggtcgatgttgttttgtttggatagttcggtttttcggggtcgtacgttgtttagttgggtatcgtttattatcgtttggttgtgggagatgagttgggcgatgcgtttttttagtcgttttttttttagttttaggtcggtttttcgcgtttcgggttcggtttttgcgatttttggtttcgggttcgggtcgttttttttttcggattcggcgttgtgtttcgaaaggttgtgtagggggttgtagggcgtatgcggttgtttcgcgttgtcggagcgcgataggtatttcgagtcggtgtttttatattttcgtagtcggttttcgggggttttggtattttagggtttttcggttgtcgtcgtttgttgtcgttgtagggcgtacggtttttcggcggtcggcgatttttgttttggtaatttacgttagggttgtgtgttggtcgttgggagtttaggtgacgttatgggggtagagttttaagg

SEQ ID NO: 12214 - DNA, 631 bp, Artificial Sequence
  chemically treated genomic DNA (Homo sapiens) CpG-island No: 12214
ccttaaaactctacccccataacgtcacctaaactcccaacgaccaacacacaaccctaacgtaaattaccaaaacaaaaatcgccgaccgccgaaaaaccgtacgccctacaacgacaacaaacgacgacaaccgaaaaaccctaaaataccaaaacccccgaaaaccgactacgaaaatataaaaacaccgactcgaaatacctatcgcgctccgacaacgcgaaacaaccgcatacgccctacaaccccctacacaacctttcgaaacacaacgccgaatccgaaaaaaaaaacgacccgaacccgaaaccaaaaatcgcaaaaaccgaacccgaaacgcgaaaaaccgacctaaaactaaaaaaaaaacgactaaaaaaacgcatcgcccaactcatctcccacaaccaaacgataataaacgatacccaactaaacaacgtacgaccccgaaaaaccgaactatccaaacaaaacaacatcgacctacccacgccctacacctacaaaaactccttccactttaacatccgcgcgctaaaaccaaaccgtaaaaaaaccccgaaccccgtacgctccacctaaacgcccccaaacaaatctcgacccctcttcttccactccgtcc

SEQ ID NO: 12215 - DNA, 631 bp, Artificial Sequence
  chemically treated genomic DNA (Homo sapiens) CpG-island No: 12215
ttttgggattttgtttttatggcgttatttgggtttttagcggttagtatataattttggcgtaagttgttagagtagaagtcgtcgatcgtcgggaagtcgtgcgttttgtagcggtagtaggcgacggtagtcgagaagttttgggatgttaaggttttcgagggtcggttgcggaagtgtgagagtatcgattcggggtatttgtcgcgtttcgatagcgcggagtagtcgtatgcgttttgtagttttttgtatagtttttcggagtatagcgtcgagttcgagggggagggcggttcgggttcggggttaggggtcgtaggggtcgagttcggggcgcgagaagtcggtttggagttggagaagaagcggttggaggagcgtatcgtttagtttattttttataattaggcggtggtggacgatgtttagttggataacgtgcggtttcggaagatcgggttgtttaaatagggtagtatcgatttgtttacgttttatatttataaggattttttttattttgatattcgcgcgttggagttaggtcgtaggagggtttcgggtttcgtgcgttttatttggacgtttttagataagtttcggtttttttttttttatttcgttt

SEQ ID NO: 12216 - DNA, 631 bp, Artificial Sequence
  chemically treated genomic DNA (Homo sapiens) CpG-island No: 12216
aaacgaaataaaaaaaaaaaaaccgaaacttatctaaaaacgtccaaataaaacgcacgaaacccgaaaccctcctacgacctaactccaacgcgcgaatatcaaaataaaaaaaatccttataaatataaaacgtaaacaaatcgatactaccctatttaaacaacccgatcttccgaaaccgcacgttatccaactaaacatcgtccaccaccgcctaattataaaaaataaactaaacgatacgctcctccaaccgcttcttctccaactccaaaccgacttctcgcgccccgaactcgacccctacgacccctaaccccgaacccgaaccgccctccccctcgaactcgacgctatactccgaaaaactatacaaaaaactacaaaacgcatacgactactccgcgctatcgaaacgcgacaaataccccgaatcgatactctcacacttccgcaaccgaccctcgaaaaccttaacatcccaaaacttctcgactaccgtcgcctactaccgctacaaaacgcacgacttcccgacgatcgacgacttctactctaacaacttacgccaaaattatatactaaccgctaaaaacccaaataacgccataaaaacaaaatcccaaaa

SEQ ID NO: 12217 - DNA, 666 bp, Artificial Sequence
  chemically treated genomic DNA (Homo sapiens) CpG-island No: 12217
ggggcgcggggtagtagtggtaattgtgcgagtcgataggagttcgcgtttcggggagggcgggtcggcggttgaggtatataagaggatgaaggtaggtcggaggggtgtttcggtcgtttttcgaatttttgttttttttatttgttacgaatattacgaagatcgcgtcgttttttttggtcgtcgcgatggcggtcggaatggcgttttggaattatagtatcgtttttttcgggtttaggcgttcgttcggtgtgtagttttcgtagtttcgaagtcggtttcgtttttcgttttcgttcggttttgcggttttcgtaattttggttggttcggtttttattttcggtttcgtataagcgcgtacgttcgttagcggtattcggagacgcgcgttagcgcgcgcgagaatattttacgttatagtcgtaattcgtcggtgttcgtgttttaggattttttttcgttggcgagtcgatggtgcgggcgcgcgttcgttaggttttcggtcgcgtagtttaggaagtggaggaaagcggtaagagggatgattaatcgttaagatacgtcggcggcgtttgtagtgaggtatgatgggaattgtagtttatttaggtttattcgtttttatattgtggagtatgtaattgtgggttttgaggt

SEQ ID NO: 12218 - DNA, 666 bp, Artificial Sequence
  chemically treated genomic DNA (Homo sapiens) CpG-island No: 12218
acctcaaaacccacaattacatactccacaatataaaaacgaataaacctaaataaactacaattcccatcatacctcactacaaacgccgccgacgtatcttaacgattaatcatccctcttaccgctttcctccacttcctaaactacgcgaccgaaaacctaacgaacgcgcgcccgcaccatcgactcgccaacgaaaaaaaatcctaaaacacgaacaccgacgaattacgactataacgtaaaatattctcgcgcgcgctaacgcgcgtctccgaataccgctaacgaacgtacgcgcttatacgaaaccgaaaataaaaaccgaaccaaccaaaattacgaaaaccgcaaaaccgaacgaaaacgaaaaacgaaaccgacttcgaaactacgaaaactacacaccgaacgaacgcctaaacccgaaaaaaacgatactataattccaaaacgccattccgaccgccatcgcgacgaccaaaaaaaacgacgcgatcttcgtaatattcgtaacaaataaaaaaaacaaaaattcgaaaaacgaccgaaacacccctccgacctaccttcatcctcttatatacctcaaccgccgacccgccctccccgaaacgcgaactcctatcgactcgcacaattaccactactaccccgcgcccc

SEQ ID NO: 12219 - DNA, 666 bp, Artificial Sequence
  chemically treated genomic DNA (Homo sapiens) CpG-island No: 12219
gttttagaatttatagttatatgttttataatatggaggcgaataagtttaagtggattataatttttattatgttttattgtaggcgtcgtcgacgtgttttagcggttagttattttttttatcgtttttttttattttttggattgcgcgatcggaggtttagcgggcgcgcgttcgtattatcgattcgttaacgagagaaggttttggggtacggatatcgacgggttgcgattgtgacgtgaggtgttttcgcgcgcgttagcgcgcgttttcgggtgtcgttgacgggcgtgcgcgtttgtgcggagtcggaggtgggggtcgaattagttaaggttgcgggggtcgtagagtcggacgaagacggagggcggagtcggtttcgggattgcggagattatatatcgagcgagcgtttgggttcgaagggagcgatgttgtggttttagggcgttatttcggtcgttatcgcgacggttaaaaggagcggcgcggttttcgtggtgttcgtggtaggtgaaggaggtaggggttcgagaggcggtcgggatattttttcggtttatttttatttttttgtatattttagtcgtcggttcgtttttttcgagacgcgggtttttgtcggttcgtataattgttattattatttcgcgtttt

SEQ ID NO: 12220 - DNA, 666 bp, Artificial Sequence
  chemically treated genomic DNA (Homo sapiens) CpG-island No: 12220
aaaacgcgaaataataataacaattatacgaaccgacaaaaacccgcgtctcgaaaaaaacgaaccgacgactaaaatatacaaaaaaataaaaataaaccgaaaaaatatcccgaccgcctctcgaacccctacctccttcacctaccacgaacaccacgaaaaccgcgccgctccttttaaccgtcgcgataacgaccgaaataacgccctaaaaccacaacatcgctcccttcgaacccaaacgctcgctcgatatataatctccgcaatcccgaaaccgactccgccctccgtcttcgtccgactctacgacccccgcaaccttaactaattcgacccccacctccgactccgcacaaacgcgcacgcccgtcaacgacacccgaaaacgcgcgctaacgcgcgcgaaaacacctcacgtcacaatcgcaacccgtcgatatccgtaccccaaaaccttctctcgttaacgaatcgataatacgaacgcgcgcccgctaaacctccgatcgcgcaatccaaaaaataaaaaaaaacgataaaaaaaataactaaccgctaaaacacgtcgacgacgcctacaataaaacataataaaaattataatccacttaaacttattcgcctccatattataaaacatataactataaattctaaaac

SEQ ID NO: 12221 - DNA, 553 bp, Artificial Sequence
  chemically treated genomic DNA (Homo sapiens) CpG-island No: 12221
taagcggcgtgaagagcgatggcgcgtttcgtagagttcgtaagtcggttttttagttttcgcgtgtatttgaaggagtcggggatcgaggtttatgtgttcgaagtttagtgttttagagttttttatggcgttgtttagtagcgtagtacgtacgcgttgtaggaaaaacgttatcgacgcgagcgggagtaaagtaataattaatcggtttcggagacgaagttatttttcggaagtgttggtttttaggttttcggtattcggacggagttttgcgattgcgtagtttttaggattgggtttagtaggaggcggtggagcggtcgtgttggggtcgacggggtattttggattatagagtcgttttattggttttttcggcgttttcggacgtcgttgacgtatttgattttcgcgatttgtaggagaagtttcggtcggggcgagggtcgaggtcgtgacgggtatgatcgtttttttgtttggttagggttagtgtttcgtcgggtatattattttatgaatggagttattgagatagattgggttg

SEQ ID NO: 12222 - DNA, 553 bp, Artificial Sequence
  chemically treated genomic DNA (Homo sapiens) CpG-island No: 12222
caacccaatctatctcaataactccattcataaaataatatacccgacgaaacactaaccctaaccaaacaaaaaaacgatcatacccgtcacgacctcgaccctcgccccgaccgaaacttctcctacaaatcgcgaaaatcaaatacgtcaacgacgtccgaaaacgccgaaaaaaccaataaaacgactctataatccaaaataccccgtcgaccccaacacgaccgctccaccgcctcctactaaacccaatcctaaaaactacgcaatcgcaaaactccgtccgaataccgaaaacctaaaaaccaacacttccgaaaaataacttcgtctccgaaaccgattaattattactttactcccgctcgcgtcgataacgtttttcctacaacgcgtacgtactacgctactaaacaacgccataaaaaactctaaaacactaaacttcgaacacataaacctcgatccccgactccttcaaatacacgcgaaaactaaaaaaccgacttacgaactctacgaaacgcgccatcgctcttcacgccgctta

SEQ ID NO: 12223 - DNA, 553 bp, Artificial Sequence
  chemically treated genomic DNA (Homo sapiens) CpG-island No: 12223
tagtttagtttattttagtggttttatttatagggtgatgtgttcggcgggatattaattttaattaagtagagagacggttatgttcgttacgatttcggttttcgtttcggtcgaggttttttttgtaggtcgcgagaattaggtgcgttagcggcgttcgggaacgtcggaagagttagtggagcggttttgtagtttaaagtatttcgtcgattttagtacggtcgttttatcgttttttattagatttagttttagggattgcgtagtcgtagagtttcgttcgagtatcggaagtttaggagttagtattttcgggaagtgatttcgttttcgaagtcgattggttgttgttttgttttcgttcgcgtcggtggcgttttttttgtagcgcgtgcgtgttgcgttattgagtagcgttatggaggattttgaagtattgggtttcgaatatatgggtttcgattttcggtttttttaggtatacgcgagggttggggagtcggtttacgggttttgcggggcgcgttatcgttttttacgtcgttta

SEQ ID NO: 12224 - DNA, 553 bp, Artificial Sequence
  chemically treated genomic DNA (Homo sapiens) CpG-island No: 12224
taaacgacgtaaaaaacgataacgcgccccgcaaaacccgtaaaccgactccccaaccctcgcgtatacctaaaaaaaccgaaaatcgaaacccatatattcgaaacccaatacttcaaaatcctccataacgctactcaataacgcaacacgcacgcgctacaaaaaaaacgccaccgacgcgaacgaaaacaaaacaacaaccaatcgacttcgaaaacgaaatcacttcccgaaaatactaactcctaaacttccgatactcgaacgaaactctacgactacgcaatccctaaaactaaatctaataaaaaacgataaaacgaccgtactaaaatcgacgaaatactttaaactacaaaaccgctccactaactcttccgacgttcccgaacgccgctaacgcacctaattctcgcgacctacaaaaaaaacctcgaccgaaacgaaaaccgaaatcgtaacgaacataaccgtctctctacttaattaaaattaatatcccgccgaacacatcaccctataaataaaaccactaaaataaactaaacta

SEQ ID NO: 12225 - DNA, 606 bp, Artificial Sequence
  chemically treated genomic DNA (Homo sapiens) CpG-island No: 12225
atgattatggtttcgtcggggattttttcgatgaaatagcgtttttcggtttcgtcgatgtggaagtagagtttttggcgtttgtgcgatagcgcgagaagtagtagggtttgtcgttttatcgttcgtagaggtttagtttcgatatttgttatcgcgttttagtttttaagcgtttgcgtatatttgcgtatcgttttggtttgcgcgttattttagcgattttgagagttaggggaagaggacgtttgcgtagtgatatgtattcgtcgttttttgtaattttattcgtatcgaatattgtcgcgtttcgtttttttatatagttcggcgttcgtttattttcgtaacgagagtagagggcgtatgcgtaatgacgttcgtttttaatttttcgttttttatttcgtagtttattttcggtatttcgtaggggaggtacgtttgcgtagttacgttcgttttcggttttagttagcgatttgggtttcggagtattaaggagacggtggacggaatttgattaggtttggtggttacgatggtttgaagcgtgttttttgggtttttagttcgggtttataagtgttttttgtgttaaatata

SEQ ID NO: 12226 - DNA, 606 bp, Artificial Sequence
  chemically treated genomic DNA (Homo sapiens) CpG-island No: 12226
tatatttaacacaaaaaacacttataaacccgaactaaaaacccaaaaaacacgcttcaaaccatcgtaaccaccaaacctaatcaaattccgtccaccgtctccttaatactccgaaacccaaatcgctaactaaaaccgaaaacgaacgtaactacgcaaacgtacctcccctacgaaataccgaaaataaactacgaaataaaaaacgaaaaattaaaaacgaacgtcattacgcatacgccctctactctcgttacgaaaataaacgaacgccgaactatataaaaaaacgaaacgcgacaatattcgatacgaataaaattacaaaaaacgacgaatacatatcactacgcaaacgtcctcttcccctaactctcaaaatcgctaaaataacgcgcaaaccaaaacgatacgcaaatatacgcaaacgcttaaaaactaaaacgcgataacaaatatcgaaactaaacctctacgaacgataaaacgacaaaccctactacttctcgcgctatcgcacaaacgccaaaaactctacttccacatcgacgaaaccgaaaaacgctatttcatcgaaaaaatccccgacgaaaccataatcat

SEQ ID NO: 12227 - DNA, 606 bp, Artificial Sequence
  chemically treated genomic DNA (Homo sapiens) CpG-island No: 12227
tgtatttagtatagaaaatatttgtgagttcgagttgagaatttaaaaggtacgttttaggttatcgtagttattaagtttggttagatttcgtttatcgtttttttggtgtttcgagatttaaatcgttgattggggtcgagggcgggcgtgattgcgtaggcgtgttttttttgcgagatgtcggaggtaagttgcggggtaaggggcgagaaattaagggcgaacgttattgcgtatgcgttttttattttcgttgcgggggtaggcgggcgtcgggttgtgtgagggggcggggcgcggtagtgttcggtacggatggagttgtaggagacggcgagtatatattattgcgtaggcgttttttttttttaatttttagggtcgttagggtggcgcgtaggttagagcgatgcgtaaatgtgcgtaggcgtttaggggttgaggcgcgatggtaggtgtcggggttgggtttttgcgggcgatggggcggtaggttttgttgtttttcgcgttgtcgtataggcgttaggggttttatttttatatcggcgagatcgagaagcgttgttttatcgaggaaattttcgacgagattatggttat

SEQ ID NO: 12228 - DNA, 606 bp, Artificial Sequence
  chemically treated genomic DNA (Homo sapiens) CpG-island No: 12228
ataaccataatctcgtcgaaaatttcctcgataaaacaacgcttctcgatctcgccgatataaaaataaaacccctaacgcctatacgacaacgcgaaaaacaacaaaacctaccgccccatcgcccgcaaaaacccaaccccgacacctaccatcgcgcctcaacccctaaacgcctacgcacatttacgcatcgctctaacctacgcgccaccctaacgaccctaaaaattaaaaaaaaaaaacgcctacgcaataatatatactcgccgtctcctacaactccatccgtaccgaacactaccgcgccccgccccctcacacaacccgacgcccgcctacccccgcaacgaaaataaaaaacgcatacgcaataacgttcgcccttaatttctcgccccttaccccgcaacttacctccgacatctcgcaaaaaaaacacgcctacgcaatcacgcccgccctcgaccccaatcaacgatttaaatctcgaaacaccaaaaaaacgataaacgaaatctaaccaaacttaataactacgataacctaaaacgtaccttttaaattctcaactcgaactcacaaatattttctatactaaataca

SEQ ID NO: 12229 - DNA, 926 bp, Artificial Sequence
  chemically treated genomic DNA (Homo sapiens) CpG-island No: 12229
ttcgatatatttggggtcgcgcgattttcgattttcgtttttttttcgcgtttagagggtttgttcgtttttcgaggtcgcgtttggtttagtcgaggtttcgtagtttttaacgttcgagtcgttatcgtttcgaaaagtcgcgcgagatttgcgagattttcgttttttttttattacgttttgtttttttcgtttttcgcgttcggtttgttagttttagtttcggtcgcgagggtggagttttgtgtttcggaggcgtgggtgacgtaggcgtagcgcgggttgcgcgcgttattgtttattttcggttgttttatttttgttcgttttttttcggttttttatttaagagtttcgttttcgtttcgtttttttcgaagttttcgtcgcgcgttcgcgatttaggtcgttttgaaatttagttcgttcgagcgcgagtttaacgtcgcggtcgtattaaggtgggggaggggaggagtttggggggtttcgttggggcgggagaggaatcggggtttacgggggcgggcgcggagaaattcggggcgagtggaggtgttggagtcgcgtttttaggtttaggatggtgggggtcgcggagggttggttttggcgggagggaagcgggcgagttgttcgcgagggacggttttttttttcgttcgtttttttgtattatttttatcgttttttttcggtttttaggtttttttagatcgtgttatgggtgatagtgatgacgagtacgatcgaaggcgtagggataagtttagaagagagcgtagcgattacgatcgttttcgcgagagagatgaaagacgtcgaggggacgattggaatgataggtgagtcgtttttaattttattttgttttcgttttatgtcgttttattttattcgcgtcgtttttttttttttttttt

SEQ ID NO: 12230 - DNA, 926 bp, Artificial Sequence
  chemically treated genomic DNA (Homo sapiens) CpG-island No: 12230
aaaaaaaaaaaaaaaaaacgacgcgaataaaataaaacgacataaaacgaaaacaaaataaaattaaaaacgactcacctatcattccaatcgtcccctcgacgtctttcatctctctcgcgaaaacgatcgtaatcgctacgctctcttctaaacttatccctacgccttcgatcgtactcgtcatcactatcacccataacacgatctaaaaaaacctaaaaaccgaaaaaaaacgataaaaataatacaaaaaaacgaacgaaaaaaaaaaccgtccctcgcgaacaactcgcccgcttccctcccgccaaaaccaaccctccgcgacccccaccatcctaaacctaaaaacgcgactccaacacctccactcgccccgaatttctccgcgcccgcccccgtaaaccccgattcctctcccgccccaacgaaaccccccaaactcctcccctcccccaccttaatacgaccgcgacgttaaactcgcgctcgaacgaactaaatttcaaaacgacctaaatcgcgaacgcgcgacgaaaacttcgaaaaaaacgaaacgaaaacgaaactcttaaataaaaaaccgaaaaaaaacgaacaaaaataaaacaaccgaaaataaacaataacgcgcgcaacccgcgctacgcctacgtcacccacgcctccgaaacacaaaactccaccctcgcgaccgaaactaaaactaacaaaccgaacgcgaaaaacgaaaaaaacaaaacgtaataaaaaaaaaacgaaaatctcgcaaatctcgcgcgacttttcgaaacgataacgactcgaacgttaaaaactacgaaacctcgactaaaccaaacgcgacctcgaaaaacgaacaaaccctctaaacgcgaaaaaaaaacgaaaatcgaaaatcgcgcgaccccaaatatatcgaa

SEQ ID NO: 12231 - DNA, 926 bp, Artificial Sequence
  chemically treated genomic DNA (Homo sapiens) CpG-island No: 12231
aagggggagaaagaaaagcgacgcgggtggagtgaaacggtatgaaacggggataagatgaagttaaaaacggtttatttgttattttaatcgttttttcgacgttttttatttttttcgcgggaacggtcgtagtcgttgcgtttttttttgaatttgtttttgcgttttcgatcgtattcgttattattgttatttatggtacggtttgagggggtttggggatcggggagaggcggtaggagtggtgtaaaaggacgagcggaggaagggatcgtttttcgcgggtagttcgttcgtttttttttcgttaaggttagtttttcgcggtttttattattttaggtttgagaacgcggttttaatatttttattcgtttcgagttttttcgcgttcgttttcgtggatttcggtttttttttcgttttagcggggttttttaggtttttttttttttttattttggtgcggtcgcggcgttggattcgcgttcggacgggttagattttagggcgatttgggtcgcgggcgcgcgacgaggatttcgaggagggcgagacggagacggagtttttgagtagagggtcgaagagaggcgaataaaagtgggataatcggggatgggtagtagcgcgcgtagttcgcgttgcgtttgcgttatttacgttttcgaggtataaagttttattttcgcggtcggaattggaattaataaatcgagcgcgaagggcggggagagtagggcgtgatgggaaaggggcggggatttcgtaagtttcgcgcggtttttcgagacgataacggttcgagcgttaggaattacgggatttcggttgggttaagcgcggtttcgggaggcgaataagttttttgggcgcgaagggagagcggaagtcgaggatcgcgcgattttagatgtgtcggg

SEQ ID NO: 12232 - DNA, 926 bp, Artificial Sequence
  chemically treated genomic DNA (Homo sapiens) CpG-island No: 12232
cccgacacatctaaaatcgcgcgatcctcgacttccgctctcccttcgcgcccaaaaaacttattcgcctcccgaaaccgcgcttaacccaaccgaaatcccgtaattcctaacgctcgaaccgttatcgtctcgaaaaaccgcgcgaaacttacgaaatccccgcccctttcccatcacgccctactctccccgcccttcgcgctcgatttattaattccaattccgaccgcgaaaataaaactttatacctcgaaaacgtaaataacgcaaacgcaacgcgaactacgcgcgctactacccatccccgattatcccacttttattcgcctctcttcgaccctctactcaaaaactccgtctccgtctcgccctcctcgaaatcctcgtcgcgcgcccgcgacccaaatcgccctaaaatctaacccgtccgaacgcgaatccaacgccgcgaccgcaccaaaataaaaaaaaaaaaaaacctaaaaaaccccgctaaaacgaaaaaaaaaccgaaatccacgaaaacgaacgcgaaaaaactcgaaacgaataaaaatattaaaaccgcgttctcaaacctaaaataataaaaaccgcgaaaaactaaccttaacgaaaaaaaaacgaacgaactacccgcgaaaaacgatcccttcctccgctcgtccttttacaccactcctaccgcctctccccgatccccaaaccccctcaaaccgtaccataaataacaataataacgaatacgatcgaaaacgcaaaaacaaattcaaaaaaaaacgcaacgactacgaccgttcccgcgaaaaaaataaaaaacgtcgaaaaaacgattaaaataacaaataaaccgtttttaacttcatcttatccccgtttcataccgtttcactccacccgcgtcgcttttctttctccccctt

SEQ ID NO: 12233 - DNA, 821 bp, Artificial Sequence
  chemically treated genomic DNA (Homo sapiens) CpG-island No: 12233
gatttagtttcgggagtttcggaagtcggggggtttgtcgtttatgttttttagggtcgtttgtacggcggttagtttaggtacgttcgcgggttggttttttggttacgagtatagcgtttgtagagtgcggtagtcgtagttttagtcgcggtcgtttaggtcgtcgtagtcgtagtggtagtagaggtagtggttcgagagtagcgttaggcggatagggtcgcggttcggcggggataggtttacgtggacgttttttagcggttttagggcggtgggcgggagcggaggttttaggttaggtatagcgtttttttagcggcgcggagcgattttaggttttaatattttttttcggtttcgggttttgggttagttgtcgtaggatcggcgcgtagattggggacgcgtttttcgggtttcgttgattatcgtaggtcgtaataggtagttatcgatcggtatcgatcgaggagtttttataatgtttcgtcgcgtttcgtttcgtttcgttttttttttttttttttttttttttttttttttttttttttttttcgtcgtgttagttagtttgtttgcgggttttattacgtaggcgcgagtttcgttcggtagggtagggttaggggttggtttttgttttgcgttcgtttcggagttcgtttgttttttgttttttagtttcgtttttgtatagattcggttttcgtgatttcggcgttttgtttttatttttggttttttagtcgcgtatattttcgtggttgtaatagtttattggtagtttagaggggcgaaggtatcgcgggggaggg

SEQ ID NO: 12234 - DNA, 821 bp, Artificial Sequence
  chemically treated genomic DNA (Homo sapiens) CpG-island No: 12234
ccctcccccgcgataccttcgcccctctaaactaccaataaactattacaaccacgaaaatatacgcgactaaaaaaccaaaaataaaaacaaaacgccgaaatcacgaaaaccgaatctatacaaaaacgaaactaaaaaacaaaaaacaaacgaactccgaaacgaacgcaaaacaaaaaccaacccctaaccctaccctaccgaacgaaactcgcgcctacgtaataaaacccgcaaacaaactaactaacacgacgaaaaaaaaaaaaaaaaaaaaaaaaaaaaaaaaaaaaaaaaaaaaaacgaaacgaaacgaaacgcgacgaaacattataaaaactcctcgatcgataccgatcgataactacctattacgacctacgataatcaacgaaacccgaaaaacgcgtccccaatctacgcgccgatcctacgacaactaacccaaaacccgaaaccgaaaaaaaatattaaaacctaaaatcgctccgcgccgctaaaaaaacgctatacctaacctaaaacctccgctcccgcccaccgccctaaaaccgctaaaaaacgtccacgtaaacctatccccgccgaaccgcgaccctatccgcctaacgctactctcgaaccactacctctactaccactacgactacgacgacctaaacgaccgcgactaaaactacgactaccgcactctacaaacgctatactcgtaaccaaaaaaccaacccgcgaacgtacctaaactaaccgccgtacaaacgaccctaaaaaacataaacgacaaaccccccgacttccgaaactcccgaaactaaatc

SEQ ID NO: 12235 - DNA, 821 bp, Artificial Sequence
  chemically treated genomic DNA (Homo sapiens) CpG-island No: 12235
ttttttttcgcggtgttttcgtttttttgggttgttaataaattgttatagttacgggagtgtgcgcgattagggagttaggggtagaggtagaacgtcggaattacgggggtcgagtttatgtaggagcggggttggagggtaagaaataggcgagtttcgaggcgggcgtaaggtaaaggttaatttttagttttgttttgtcgggcggagttcgcgtttgcgtaatgaggttcgtaggtaggttagttggtacggcggaggggaggagaggggaggggaggggaggggaggggaggggaggggcggggcggggcggggcgcggcggagtattgtgggagtttttcggtcggtgtcggtcggtggttgtttattgcggtttgcggtgattaacgaggttcggggagcgcgtttttagtttgcgcgtcggttttgcggtagttggtttaagattcggagtcgaaaggaagtgttggagtttgaggtcgtttcgcgtcgttaggaggacgttgtgtttggtttgggattttcgttttcgtttatcgttttggagtcgttgagggacgtttacgtgggtttgttttcgtcgagtcgcggttttgttcgtttggcgttgttttcgggttattatttttattattattacggttgcgacggtttggacgatcgcggttggggttgcggttatcgtattttgtagacgttgtgttcgtggttagagggttagttcgcgggcgtatttggattggtcgtcgtataggcggttttggaggatatgggcgataagtttttcggttttcggggttttcgggattggatt

SEQ ID NO: 12236 - DNA, 821 bp, Artificial Sequence
  chemically treated genomic DNA (Homo sapiens) CpG-island No: 12236
aatccaatcccgaaaaccccgaaaaccgaaaaacttatcgcccatatcctccaaaaccgcctatacgacgaccaatccaaatacgcccgcgaactaaccctctaaccacgaacacaacgtctacaaaatacgataaccgcaaccccaaccgcgatcgtccaaaccgtcgcaaccgtaataataataaaaataataacccgaaaacaacgccaaacgaacaaaaccgcgactcgacgaaaacaaacccacgtaaacgtccctcaacgactccaaaacgataaacgaaaacgaaaatcccaaaccaaacacaacgtcctcctaacgacgcgaaacgacctcaaactccaacacttcctttcgactccgaatcttaaaccaactaccgcaaaaccgacgcgcaaactaaaaacgcgctccccgaacctcgttaatcaccgcaaaccgcaataaacaaccaccgaccgacaccgaccgaaaaactcccacaatactccgccgcgccccgccccgccccgcccctcccctcccctcccctcccctcccctcccctctcctcccctccgccgtaccaactaacctacctacgaacctcattacgcaaacgcgaactccgcccgacaaaacaaaactaaaaattaacctttaccttacgcccgcctcgaaactcgcctatttcttaccctccaaccccgctcctacataaactcgacccccgtaattccgacgttctacctctacccctaactccctaatcgcgcacactcccgtaactataacaatttattaacaacccaaaaaaacgaaaacaccgcgaaaaaaaa

SEQ ID NO: 12237 - DNA, 532 bp, Artificial Sequence
  chemically treated genomic DNA (Homo sapiens) CpG-island No: 12237
gagcgatcggggaaggggtgttcgggggttttcgcgggaatcggagcgtagaggcggcggtcgttttcgcgggttcgggtttttgcgtgggcgtcggtgagtgtgaggcggtcggggaagagtttcggacgagtgcggggtagcggagggcggcgcggggtaggttcggggaagcgggagtcgtttcgttaggggggtttggatttttcggggagcgtacggtgtttcggattcgggttttaaggagagtttcgggcggggagggagatttatttgaggcggtcgagtcgggtcgggtcgggtcgcgtcgggagttggaggcggtcgatgtttttcggcgtaggttgagtcgattttgatagtcgcgtttttttttttcgtatatattttttcgggttttatagcgttttcgttcgttttcgtttattgttttcgttttcgttttttttcgttttttcgggtggttatttttttttttttttttttttttggagtcgagattcggagatttcggggtttagacgtattttag

SEQ ID NO: 12238 - DNA, 532 bp, Artificial Sequence
  chemically treated genomic DNA (Homo sapiens) CpG-island No: 12238
ctaaaatacgtctaaaccccgaaatctccgaatctcgactccaaaaaaaaaaaaaaaaaaaaaaataaccacccgaaaaaacgaaaaaaaacgaaaacgaaaacaataaacgaaaacgaacgaaaacgctataaaacccgaaaaaatatatacgaaaaaaaaaaacgcgactatcaaaatcgactcaacctacgccgaaaaacatcgaccgcctccaactcccgacgcgacccgacccgacccgactcgaccgcctcaaataaatctccctccccgcccgaaactctccttaaaacccgaatccgaaacaccgtacgctccccgaaaaatccaaacccccctaacgaaacgactcccgcttccccgaacctaccccgcgccgccctccgctaccccgcactcgtccgaaactcttccccgaccgcctcacactcaccgacgcccacgcaaaaacccgaacccgcgaaaacgaccgccgcctctacgctccgattcccgcgaaaacccccgaacaccccttccccgatcgctc

SEQ ID NO: 12239 - DNA, 532 bp, Artificial Sequence
  chemically treated genomic DNA (Homo sapiens) CpG-island No: 12239
ttggagtgcgtttgggtttcggggttttcgggtttcggttttaagggagggagagagaggggaggtggttattcgggagagcggggaggggcgggggcggagatagtgggcgggggcgggcgggggcgttgtgaggttcggaggagtgtgtgcggggggaggaggcgcggttgttagagtcggtttagtttgcgtcggggaatatcggtcgtttttagttttcggcgcggttcggttcggttcggttcggtcgttttaggtgagttttttttttcgttcgggattttttttaaggttcgggttcggggtatcgtgcgtttttcgaggggtttaggtttttttaacgggacggttttcgttttttcgggtttgtttcgcgtcgtttttcgttgtttcgtattcgttcggaattttttttcggtcgttttatatttatcgacgtttacgtaggagttcgagttcgcgggaacggtcgtcgtttttgcgtttcgattttcgcggggattttcgagtatttttttttcgatcgttt

SEQ ID NO: 12240 - DNA, 532 bp, Artificial Sequence
  chemically treated genomic DNA (Homo sapiens) CpG-island No: 12240
aaacgatcgaaaaaaaaatactcgaaaatccccgcgaaaatcgaaacgcaaaaacgacgaccgttcccgcgaactcgaactcctacgtaaacgtcgataaatataaaacgaccgaaaaaaaattccgaacgaatacgaaacaacgaaaaacgacgcgaaacaaacccgaaaaaacgaaaaccgtcccgttaaaaaaacctaaacccctcgaaaaacgcacgataccccgaacccgaaccttaaaaaaaatcccgaacgaaaaaaaaaactcacctaaaacgaccgaaccgaaccgaaccgaaccgcgccgaaaactaaaaacgaccgatattccccgacgcaaactaaaccgactctaacaaccgcgcctcctccccccgcacacactcctccgaacctcacaacgcccccgcccgcccccgcccactatctccgcccccgcccctccccgctctcccgaataaccacctcccctctctctccctcccttaaaaccgaaacccgaaaaccccgaaacccaaacgcactccaa

SEQ ID NO: 12241 - DNA, 521 bp, Artificial Sequence
  chemically treated genomic DNA (Homo sapiens) CpG-island No: 12241
cgtttttcgttatttttatacgttttttttagtggggtggttgtttatcgtatttcggagttcggattggggttcggtttttgcggcgacgattgtttgtatttaagtgaaggaggtttcgagattcgcggtttacgttttgtcggagacgtttgtttgtagggttgtattgtattttcgggcgtacgtggagttggagtagcgtaggttggggaagagtagagagggtcgggttttttcgggcgcgttatggggcggggtcgaggacggggattaatagcgcgcgcgtgttggtgggggtggggataggttttaggtttggtatttcggtagtcgtagttgtttttttcggttttcgtgtatttttcgttcgagcggagtttttcggttcgcggggatcgttttcgagcgttgcgttttgcgggtgggtgagtgagcgtttcgcggttttcgagttgtggggtgtatttggtcggggagaaggatattttggtttttttgtattttaacgggcgtaaagg

SEQ ID NO: 12242 - DNA, 521 bp, Artificial Sequence
  chemically treated genomic DNA (Homo sapiens) CpG-island No: 12242
cctttacgcccgttaaaatacaaaaaaaccaaaatatccttctccccgaccaaatacaccccacaactcgaaaaccgcgaaacgctcactcacccacccgcaaaacgcaacgctcgaaaacgatccccgcgaaccgaaaaactccgctcgaacgaaaaatacacgaaaaccgaaaaaaacaactacgactaccgaaataccaaacctaaaacctatccccacccccaccaacacgcgcgcgctattaatccccgtcctcgaccccgccccataacgcgcccgaaaaaacccgaccctctctactcttccccaacctacgctactccaactccacgtacgcccgaaaatacaatacaaccctacaaacaaacgtctccgacaaaacgtaaaccgcgaatctcgaaacctccttcacttaaatacaaacaatcgtcgccgcaaaaaccgaaccccaatccgaactccgaaatacgataaacaaccaccccactaaaaaaaacgtataaaaataacgaaaaacg

SEQ ID NO: 12243 - DNA, 521 bp, Artificial Sequence
  chemically treated genomic DNA (Homo sapiens) CpG-island No: 12243
tttttgcgttcgttggggtgtaagggagttaagatattttttttttcggttaggtgtattttatagttcgggggtcgcgaggcgtttatttatttattcgtaggacgtagcgttcgggggcgattttcgcgagtcggggggtttcgttcgggcggagagtgtacgggggtcggaaaagatagttgcggttatcgggatgttaggtttggagtttgtttttatttttattagtacgcgcgcgttattggttttcgttttcggtttcgttttatggcgcgttcggagaagttcgattttttttgtttttttttagtttgcgttgttttagttttacgtgcgttcggggatgtaatgtagttttgtagataagcgttttcggtaggacgtgggtcgcgggtttcggagttttttttatttaggtataaataatcgtcgtcgtaggggtcggattttagttcgagtttcgaggtgcggtgagtagttattttattaaagggggcgtgtgaggatggcggaaagcg

SEQ ID NO: 12244 - DNA, 521 bp, Artificial Sequence
  chemically treated genomic DNA (Homo sapiens) CpG-island No: 12244
cgctttccgccatcctcacacgccccctttaataaaataactactcaccgcacctcgaaactcgaactaaaatccgacccctacgacgacgattatttatacctaaataaaaaaaactccgaaacccgcgacccacgtcctaccgaaaacgcttatctacaaaactacattacatccccgaacgcacgtaaaactaaaacaacgcaaactaaaaaaaaacaaaaaaaatcgaacttctccgaacgcgccataaaacgaaaccgaaaacgaaaaccaataacgcgcgcgtactaataaaaataaaaacaaactccaaacctaacatcccgataaccgcaactatcttttccgacccccgtacactctccgcccgaacgaaaccccccgactcgcgaaaatcgcccccgaacgctacgtcctacgaataaataaataaacgcctcgcgacccccgaactataaaatacacctaaccgaaaaaaaaaatatcttaactcccttacaccccaacgaacgcaaaaa

SEQ ID NO: 12245 - DNA, 774 bp, Artificial Sequence
  chemically treated genomic DNA (Homo sapiens) CpG-island No: 12245
tttttcggagcggcggaaaggtaagtacgagggtcgtattcggtttgtttgtatatagttaagtcgtaagcggggttttagaattagttgaattttaatattaacggacgaaggttagtgggtttcggcggcgaagtttgcgggttgttttagaagtttcgaagtttagaacgaggacggcgcgggaagggaaaggcgtaggcgcgggatatattggaggggtttaggagtagagacggcgtaggcgttgggtttgtcggggtttgcggggacgttcgggcgcggttagttcgggcggcgttgaggcgataaattaattcgttagcgaatattgcgggaattcggttgttgttttttatcgttgtatcgtatcgttttttcgtaattttttggtttgggttgggcggtgagtttattcggtggtttagtcgagattcgttgagttcggttttaggaaagtagtttatttcgtagcgtcgtttgtcgggtcgttcggttattttcgcgggtttcgtttttggttagttttttcgcgtttagtagggttgcggtcgtttgcgtaggcgtcgtggaggtttcgtttatatttttttattgcgtaggcgtcgtcgttttttattattatttttttttttttttttattttcggttcgcgttcgtttcggtattgggtcgcgtagtcgttttgttatttggtcggttaagaaagtagtcggttagtcggtgcgtatgttttaggttttgggttggagtcgggtaaggcgggttttttta

SEQ ID NO: 12246 - DNA, 774 bp, Artificial Sequence
  chemically treated genomic DNA (Homo sapiens) CpG-island No: 12246
taaaaaaacccgccttacccgactccaacccaaaacctaaaacatacgcaccgactaaccgactactttcttaaccgaccaaataacaaaacgactacgcgacccaataccgaaacgaacgcgaaccgaaaataaaaaaaaaaaaaaaaataataataaaaaacgacgacgcctacgcaataaaaaaatataaacgaaacctccacgacgcctacgcaaacgaccgcaaccctactaaacgcgaaaaaactaaccaaaaacgaaacccgcgaaaataaccgaacgacccgacaaacgacgctacgaaataaactactttcctaaaaccgaactcaacgaatctcgactaaaccaccgaataaactcaccgcccaacccaaaccaaaaaattacgaaaaaacgatacgatacaacgataaaaaacaacaaccgaattcccgcaatattcgctaacgaattaatttatcgcctcaacgccgcccgaactaaccgcgcccgaacgtccccgcaaaccccgacaaacccaacgcctacgccgtctctactcctaaacccctccaatatatcccgcgcctacgcctttcccttcccgcgccgtcctcgttctaaacttcgaaacttctaaaacaacccgcaaacttcgccgccgaaacccactaaccttcgtccgttaatattaaaattcaactaattctaaaaccccgcttacgacttaactatatacaaacaaaccgaatacgaccctcgtacttacctttccgccgctccgaaaaa

SEQ ID NO: 12247 - DNA, 774 bp, Artificial Sequence
  chemically treated genomic DNA (Homo sapiens) CpG-island No: 12247
tgaagggattcgttttgttcggttttagtttaagatttgaggtatgcgtatcggttggtcggttatttttttgatcggttaagtggtagagcggttgcgcgatttagtgtcgagacggacgcgagtcggagatgggggaaggggagggggtggtggtgggggacggcggcgtttgcgtagtgaaggaatgtaggcggggtttttacgacgtttgcgtagacggtcgtagttttgttgggcgcgaaggggttggttaagggcggggttcgcgaggatggtcgggcggttcggtaagcggcgttgcggggtaggttgtttttttgaggtcggatttaacgggtttcggttgagttatcgggtgagtttatcgtttagtttaaattaggagattgcgagggagcgatgcgatgtagcgatgaagagtagtagtcgggttttcgtagtgttcgttggcgagttggtttatcgttttagcgtcgttcgggttgatcgcgttcgggcgttttcgtagatttcggtaggtttagcgtttgcgtcgtttttgtttttgggtttttttagtgtgtttcgcgtttgcgttttttttttttcgcgtcgttttcgttttgggtttcggggtttttggaataattcgtaggtttcgtcgtcgagatttattggttttcgttcgttggtgttggggtttagttggttttgggatttcgtttgcggtttgattgtgtgtagataggtcgggtgcgattttcgtgtttgttttttcgtcgtttcgggaga

SEQ ID NO: 12248 - DNA, 774 bp, Artificial Sequence
  chemically treated genomic DNA (Homo sapiens) CpG-island No: 12248
tctcccgaaacgacgaaaaaacaaacacgaaaatcgcacccgacctatctacacacaatcaaaccgcaaacgaaatcccaaaaccaactaaaccccaacaccaacgaacgaaaaccaataaatctcgacgacgaaacctacgaattattccaaaaaccccgaaacccaaaacgaaaacgacgcgaaaaaaaaaaaacgcaaacgcgaaacacactaaaaaaacccaaaaacaaaaacgacgcaaacgctaaacctaccgaaatctacgaaaacgcccgaacgcgatcaacccgaacgacgctaaaacgataaaccaactcgccaacgaacactacgaaaacccgactactactcttcatcgctacatcgcatcgctccctcgcaatctcctaatttaaactaaacgataaactcacccgataactcaaccgaaacccgttaaatccgacctcaaaaaaacaacctaccccgcaacgccgcttaccgaaccgcccgaccatcctcgcgaaccccgcccttaaccaaccccttcgcgcccaacaaaactacgaccgtctacgcaaacgtcgtaaaaaccccgcctacattccttcactacgcaaacgccgccgtcccccaccaccaccccctccccttcccccatctccgactcgcgtccgtctcgacactaaatcgcgcaaccgctctaccacttaaccgatcaaaaaaataaccgaccaaccgatacgcatacctcaaatcttaaactaaaaccgaacaaaacgaatcccttca

SEQ ID NO: 12249 - DNA, 517 bp, Artificial Sequence
  chemically treated genomic DNA (Homo sapiens) CpG-island No: 12249
ttgcgcgtggggttgcggtttcgttttatttcgagtcgaatcgtgcggtgcggcgttcgtgcgtttttaggtttgcgttggtcggggcgtttgtttttattggatagtttcggttcggttttgtttttttatcgtcgcgtcgacgattttaagtagtcggagtagtcggttttagggttcgttttaggacgcgtttattggttggggcgggtgttcgagttgtgttaattttcgtcggcgggggaggggagtagaggcgggttttttgtgcgttttgttttgtttcgtttcgtttcgtttcgtatttcgtatattcgatcgcgcgtcgtttcggggagcggaggtgtgcgtattcgcggggggcgcggcgttttttgttaggtgtcgatgttcgtttgttcgcgttttttagtttattcgagttgattgtgattgagaatatagttcgttcgcgtttcgtgttttaggaagatagattttagcggggaagttgagtttgggtatggagaagaatttt

SEQ ID NO: 12250 - DNA, 517 bp, Artificial Sequence
  chemically treated genomic DNA (Homo sapiens) CpG-island No: 12250
aaaattcttctccatacccaaactcaacttccccgctaaaatctatcttcctaaaacacgaaacgcgaacgaactatattctcaatcacaatcaactcgaataaactaaaaaacgcgaacaaacgaacatcgacacctaacaaaaaacgccgcgccccccgcgaatacgcacacctccgctccccgaaacgacgcgcgatcgaatatacgaaatacgaaacgaaacgaaacgaaacaaaacaaaacgcacaaaaaacccgcctctactcccctcccccgccgacgaaaattaacacaactcgaacacccgccccaaccaataaacgcgtcctaaaacgaaccctaaaaccgactactccgactacttaaaatcgtcgacgcgacgataaaaaaacaaaaccgaaccgaaactatccaataaaaacaaacgccccgaccaacgcaaacctaaaaacgcacgaacgccgcaccgcacgattcgactcgaaataaaacgaaaccgcaaccccacgcgcaa

SEQ ID NO: 12251 - DNA, 517 bp, Artificial Sequence
  chemically treated genomic DNA (Homo sapiens) CpG-island No: 12251
ggggtttttttttatatttagatttagttttttcgttggagtttgtttttttggaatacggaacgcgggcgggttgtgtttttagttataattagttcggatgagttggggggcgcgggtaagcgggtatcggtatttggtagaaagcgtcgcgtttttcgcgggtgcgtatattttcgtttttcggggcggcgcgcggtcgggtgtgcggggtacggggcggggcggagcggagtagagtaaagcgtataggaggttcgtttttgtttttttttttcgtcggcgaagattgatatagttcgagtattcgttttaattaatgagcgcgttttggggcgggttttgggatcggttgtttcggttatttagagtcgtcggcgcggcggtgggaaagtagagtcgagtcgggattgtttagtgggagtaggcgtttcggttagcgtagatttggaggcgtacgggcgtcgtatcgtacgattcggttcggggtagagcggagtcgtagttttacgcgtag

SEQ ID NO: 12252 - DNA, 517 bp, Artificial Sequence
  chemically treated genomic DNA (Homo sapiens) CpG-island No: 12252
ctacgcgtaaaactacgactccgctctaccccgaaccgaatcgtacgatacgacgcccgtacgcctccaaatctacgctaaccgaaacgcctactcccactaaacaatcccgactcgactctactttcccaccgccgcgccgacgactctaaataaccgaaacaaccgatcccaaaacccgccccaaaacgcgctcattaattaaaacgaatactcgaactatatcaatcttcgccgacgaaaaaaaaaaacaaaaacgaacctcctatacgctttactctactccgctccgccccgccccgtaccccgcacacccgaccgcgcgccgccccgaaaaacgaaaatatacgcacccgcgaaaaacgcgacgctttctaccaaataccgatacccgcttacccgcgccccccaactcatccgaactaattataactaaaaacacaacccgcccgcgttccgtattccaaaaaaacaaactccaacgaaaaaactaaatctaaatataaaaaaaaacccc

SEQ ID NO: 12253 - DNA, 812 bp, Artificial Sequence
  chemically treated genomic DNA (Homo sapiens) CpG-island No: 12253
tttggatatatggttattatagttttttttcgacgttttggatatacggttattatttcgttttcgacgttttggatatacggttattatttcgttttcgacgttttggatatacggttattatttcgttttcgacgttttggatatacggttattatttcgttttcgacgttttggatatacggttattatttcgttttcgacgttttggatatacggttattatttcgtttttgacgttttggatatacggttatttggatatacggttattatttcgtttttgacgttttggatatacggttattatttcgtttttgacgttttggatatacggttattatttcgtttttgacgttttggatatacggttattatttcgtttttgacgttttggatatacggttattatttcgtttttgacgttttggatatacggttattattttgtttttgacgttttggatatatggttatttggatatacggttattatttcgtttttgacgttttggatatacggttattatttcgtttttgacgttttggatatacggttattatttcgtttttgacgttttggatatacggttattatttcgtttttgacgttttggatatacggttattatttcgtttttgacgttttggatatacggttattattttgtttttgatattttggatatacggttattatttcgtttttgacgttttggatatacggttattattttgtttttgacgttttggatatacggttatttggatatacggttattatttcgtttttgacgttttggatatagggt

SEQ ID NO: 12254 - DNA, 812 bp, Artificial Sequence
  chemically treated genomic DNA (Homo sapiens) CpG-island No: 12254
accctatatccaaaacgtcaaaaacgaaataataaccgtatatccaaataaccgtatatccaaaacgtcaaaaacaaaataataaccgtatatccaaaacgtcaaaaacgaaataataaccgtatatccaaaatatcaaaaacaaaataataaccgtatatccaaaacgtcaaaaacgaaataataaccgtatatccaaaacgtcaaaaacgaaataataaccgtatatccaaaacgtcaaaaacgaaataataaccgtatatccaaaacgtcaaaaacgaaataataaccgtatatccaaaacgtcaaaaacgaaataataaccgtatatccaaataaccatatatccaaaacgtcaaaaacaaaataataaccgtatatccaaaacgtcaaaaacgaaataataaccgtatatccaaaacgtcaaaaacgaaataataaccgtatatccaaaacgtcaaaaacgaaataataaccgtatatccaaaacgtcaaaaacgaaataataaccgtatatccaaaacgtcaaaaacgaaataataaccgtatatccaaataaccgtatatccaaaacgtcaaaaacgaaataataaccgtatatccaaaacgtcgaaaacgaaataataaccgtatatccaaaacgtcgaaaacgaaataataaccgtatatccaaaacgtcgaaaacgaaataataaccgtatatccaaaacgtcgaaaacgaaataataaccgtatatccaaaacgtcgaaaacgaaataataaccgtatatccaaaacgtcgaaaaaaaactataataaccatatatccaaa

SEQ ID NO: 12255 - DNA, 812 bp, Artificial Sequence
  chemically treated genomic DNA (Homo sapiens) CpG-island No: 12255
gttttgtatttagagcgttaggggcggggtggtggtcgtgtatttaggtggtcgtgtatttagggcgttagggatagggtggtggtcgtgtatttagggcgttaggggcggggtggtggtcgtgtatttagggtgttagggatagggtggtggtcgtgtatttagggcgttagggacggggtggtggtcgtgtatttagggcgttagggacggggtggtggtcgtgtatttagggcgttagggacggggtggtggtcgtgtatttagggcgttaggggcggggtggtggtcgtgtatttagggcgttaggggcggggtggtggtcgtgtatttaggtggttatgtatttagggcgttagggatagggtggtggtcgtgtatttagggcgttaggggcggggtggtggtcgtgtatttagggcgttagggacggggtggtggtcgtgtatttagggcgttagggacggggtggtggtcgtgtatttagggcgttaggggcggggtggtggtcgtgtatttagggcgttaggggcggggtggtggtcgtgtatttaggtggtcgtgtatttagggcgttagggacggggtggtggtcgtgtatttagggcgtcggggacggggtggtggtcgtgtatttagggcgtcgggggcggggtggtggtcgtgtatttagggcgtcgggggcggggtggtggtcgtgtatttagggcgtcgggggcggggtggtggtcgtgtatttagggcgtcgggggcggggtggtggtcgtgtatttagggcgtcgggggggggttgtggtggttatgtatttagg

SEQ ID NO: 12256 - DNA, 812 bp, Artificial Sequence
  chemically treated genomic DNA (Homo sapiens) CpG-island No: 12256
cctaaatacataaccaccacaacccccccccgacgccctaaatacacgaccaccaccccgcccccgacgccctaaatacacgaccaccaccccgcccccgacgccctaaatacacgaccaccaccccgcccccgacgccctaaatacacgaccaccaccccgcccccgacgccctaaatacacgaccaccaccccgtccccgacgccctaaatacacgaccaccaccccgtccctaacgccctaaatacacgaccacctaaatacacgaccaccaccccgcccctaacgccctaaatacacgaccaccaccccgcccctaacgccctaaatacacgaccaccaccccgtccctaacgccctaaatacacgaccaccaccccgtccctaacgccctaaatacacgaccaccaccccgcccctaacgccctaaatacacgaccaccaccctatccctaacgccctaaatacataaccacctaaatacacgaccaccaccccgcccctaacgccctaaatacacgaccaccaccccgcccctaacgccctaaatacacgaccaccaccccgtccctaacgccctaaatacacgaccaccaccccgtccctaacgccctaaatacacgaccaccaccccgtccctaacgccctaaatacacgaccaccaccctatccctaacaccctaaatacacgaccaccaccccgcccctaacgccctaaatacacgaccaccaccctatccctaacgccctaaatacacgaccacctaaatacacgaccaccaccccgcccctaacgctctaaatacaaaac

SEQ ID NO: 12257 - DNA, 639 bp, Artificial Sequence
  chemically treated genomic DNA (Homo sapiens) CpG-island No: 12257
attttcgtcgttttcgttatcggttttatcgttagttttttcgttatcgttgttatttcggtcgttaggggtcgcggatagtgaggggtaggtattaagtttttcggttttggtaggtgtcgggggcgtaggtagttgtaaattcgcgggtcggcgttgtttatcgttgtgcgcggtatcggggtgtttcgggggtgcgtagttagtaggtggcgtaggcggtgacgtagttgtttaggtgcgagtggcgggggtataggggtgggtaggggcgcgggtgtagaggtgttcgcgggtgtagaggagcgcgtgcgataatttgcgtgtattcgtcgataattgtttatgcgaagtatcgacgtagttatgagtatttgcggggttttattttgtgttataacgagcgaatcgttgtataggagttcgattagttgtcgtatcgtttgtataggtattatcgaaggtatacggattttagaggggtcgagtagtagtttgttttggaaggagggcgagtcgattgttagttcgtagcggtgcgtacgtagcgaagttttatgaatgtatatagttacgtcgtagaagtgtttatttagtttttgtttattgagggttttaagtagagagcgtgagaagttt

SEQ ID NO: 12258 - DNA, 639 bp, Artificial Sequence
  chemically treated genomic DNA (Homo sapiens) CpG-island No: 12258
aaacttctcacgctctctacttaaaaccctcaataaacaaaaactaaataaacacttctacgacgtaactatatacattcataaaacttcgctacgtacgcaccgctacgaactaacaatcgactcgccctccttccaaaacaaactactactcgacccctctaaaatccgtataccttcgataatacctatacaaacgatacgacaactaatcgaactcctatacaacgattcgctcgttataacacaaaataaaaccccgcaaatactcataactacgtcgatacttcgcataaacaattatcgacgaatacacgcaaattatcgcacgcgctcctctacacccgcgaacacctctacacccgcgcccctacccacccctatacccccgccactcgcacctaaacaactacgtcaccgcctacgccacctactaactacgcacccccgaaacaccccgataccgcgcacaacgataaacaacgccgacccgcgaatttacaactacctacgcccccgacacctaccaaaaccgaaaaacttaatacctacccctcactatccgcgacccctaacgaccgaaataacaacgataacgaaaaaactaacgataaaaccgataacgaaaacgacgaaaat

SEQ ID NO: 12259 - DNA, 639 bp, Artificial Sequence
  chemically treated genomic DNA (Homo sapiens) CpG-island No: 12259
gaattttttacgttttttgtttgagatttttaatgggtagaagttgggtgggtatttttgcgacgtgattgtgtgtatttatgaagtttcgttgcgtgcgtatcgttgcgggttggtaatcggttcgttttttttttaagataagttgttgttcggtttttttgagattcgtgtgttttcggtggtgtttgtgtagacggtgcgatagttagtcgagtttttgtatagcggttcgttcgttgtggtatagagtgaagtttcgtaggtatttatggttgcgtcggtgtttcgtatagatagttatcgacgaatgtacgtagattatcgtacgcgtttttttgtattcgcgagtatttttgtattcgcgtttttgtttatttttgtgttttcgttattcgtatttgagtagttgcgttatcgtttgcgttatttgttggttgcgtattttcggggtatttcggtgtcgcgtatagcggtaagtagcgtcggttcgcgagtttgtagttgtttgcgttttcgatatttgttaaagtcgaggggtttggtgtttattttttattgttcgcggtttttgacgatcgaggtgataacgatgacgaggaaattgacgatgagatcgatggcgaggacggcgaaggt

SEQ ID NO: 12260 - DNA, 639 bp, Artificial Sequence
  chemically treated genomic DNA (Homo sapiens) CpG-island No: 12260
accttcgccgtcctcgccatcgatctcatcgtcaatttcctcgtcatcgttatcacctcgatcgtcaaaaaccgcgaacaataaaaaataaacaccaaacccctcgactttaacaaatatcgaaaacgcaaacaactacaaactcgcgaaccgacgctacttaccgctatacgcgacaccgaaataccccgaaaatacgcaaccaacaaataacgcaaacgataacgcaactactcaaatacgaataacgaaaacacaaaaataaacaaaaacgcgaatacaaaaatactcgcgaatacaaaaaaacgcgtacgataatctacgtacattcgtcgataactatctatacgaaacaccgacgcaaccataaatacctacgaaacttcactctataccacaacgaacgaaccgctatacaaaaactcgactaactatcgcaccgtctacacaaacaccaccgaaaacacacgaatctcaaaaaaaccgaacaacaacttatcttaaaaaaaaaacgaaccgattaccaacccgcaacgatacgcacgcaacgaaacttcataaatacacacaatcacgtcgcaaaaatacccacccaacttctacccattaaaaatctcaaacaaaaaacgtaaaaaattc

SEQ ID NO: 12261 - DNA, 914 bp, Artificial Sequence
  chemically treated genomic DNA (Homo sapiens) CpG-island No: 12261
gattcgcgtgtggttttacggtatttagggtatcgtcgagtatacggttcgggaagttttaatgaaacggaataaatcgcgagattaggggaggtaggaggtttattttacgttttgttttcgcggagtataagtttcgtttgcgtttcgagttttcgggttcgtaaagttgggttttaaagagttttaacgtcggaattaaggagtacggaatgtcgggaataagtttttttcgtgcgcgatgacgataaggtcgaggcgcgaagggtgggatcgtaggagtcgtgtagtcgcggattaatgagcgggcgtcggacgatttgtggtttaatggcggcggcgcgcgggtacgttgggggtcggttagacgggtcgatttttttagaagattcggatagtttttttcggttacgtcgcgtcggttttgggtatttagtatcgtttttttttttttcgttggagtagttatggcggcggtgaagattttgaattttaaggtcgaggtggttcgagcgtaggcggcgttggcggttaatattagcgtagcgcggggtttgtaggacgtgttaaggattaatttggggtttaagggtattatgaagatgtaaggcggggttgaatcggagggtcgggcgggtatcgcgcgtcgtcgcgtttttggcgggttcgggatcgcggattggagttcgtcgtttcggggttgcgtagtcgtttttttcggcgtttttcggggtcggttttgtgttttttttaagttttatcgtttcggttattttttttcgtatcgatgtagttttcgcggagaataaagcggttttagagcgcggcgtttttcgttttttggggtttttaggtattttgaggattcggtataatttttgcggggacggggtgggtattatatttgtttttta

SEQ ID NO: 12262 - DNA, 914 bp, Artificial Sequence
  chemically treated genomic DNA (Homo sapiens) CpG-island No: 12262
taaaaaacaaatataatacccaccccgtccccgcaaaaattataccgaatcctcaaaatacctaaaaaccccaaaaaacgaaaaacgccgcgctctaaaaccgctttattctccgcgaaaactacatcgatacgaaaaaaaataaccgaaacgataaaacttaaaaaaaacacaaaaccgaccccgaaaaacgccgaaaaaaacgactacgcaaccccgaaacgacgaactccaatccgcgatcccgaacccgccaaaaacgcgacgacgcgcgatacccgcccgaccctccgattcaaccccgccttacatcttcataatacccttaaaccccaaattaatccttaacacgtcctacaaaccccgcgctacgctaatattaaccgccaacgccgcctacgctcgaaccacctcgaccttaaaattcaaaatcttcaccgccgccataactactccaacgaaaaaaaaaaaaacgatactaaatacccaaaaccgacgcgacgtaaccgaaaaaaactatccgaatcttctaaaaaaatcgacccgtctaaccgacccccaacgtacccgcgcgccgccgccattaaaccacaaatcgtccgacgcccgctcattaatccgcgactacacgactcctacgatcccacccttcgcgcctcgaccttatcgtcatcgcgcacgaaaaaaacttattcccgacattccgtactccttaattccgacgttaaaactctttaaaacccaactttacgaacccgaaaactcgaaacgcaaacgaaacttatactccgcgaaaacaaaacgtaaaataaacctcctacctcccctaatctcgcgatttattccgtttcattaaaacttcccgaaccgtatactcgacgataccctaaataccgtaaaaccacacgcgaatc

SEQ ID NO: 12263 - DNA, 914 bp, Artificial Sequence
  chemically treated genomic DNA (Homo sapiens) CpG-island No: 12263
tggaggataggtgtagtgtttatttcgttttcgtagagattgtgtcgagtttttagggtgtttggaagttttagagggcggggaacgtcgcgttttagagtcgttttgtttttcgcggagattgtatcgatgcgggaagaaatggtcgggacggtggggtttaggagggatataggatcgatttcggaggacgtcgagaaggacggttgcgtagtttcgaggcggcgggttttagttcgcggtttcgggttcgttaggagcgcggcggcgcgcggtgttcgttcggtttttcggtttagtttcgttttatatttttatggtgtttttgggttttaggttggtttttagtacgttttgtagatttcgcgttgcgttgatgttgatcgttagcgtcgtttgcgttcgggttatttcggttttggggtttagggtttttatcgtcgttatagttgttttagcggaggaaaaggaaacgatgttgagtgtttagagtcggcgcggcgtggtcgggaggaattattcgggttttttggaaaagtcggttcgtttggtcggtttttagcgtgttcgcgcgtcgtcgttattgggttataggtcgttcggcgttcgtttattggttcgcggttgtacggtttttgcggttttatttttcgcgtttcggttttgtcgttatcgcgtacgggaggagtttgttttcggtatttcgtgttttttggtttcggcgttggagttttttggggtttagttttgcggattcgggagttcgggacgtaggcggggtttgtgtttcgcgggggtagggcgtagggtgggttttttattttttttgatttcgcggtttgtttcgttttattggagtttttcggatcgtgtgttcgacggtgttttaggtgtcgtggggttatacgcgagtt

SEQ ID NO: 12264 - DNA, 914 bp, Artificial Sequence
  chemically treated genomic DNA (Homo sapiens) CpG-island No: 12264
aactcgcgtataaccccacgacacctaaaacaccgtcgaacacacgatccgaaaaactccaataaaacgaaacaaaccgcgaaatcaaaaaaaataaaaaacccaccctacgccctacccccgcgaaacacaaaccccgcctacgtcccgaactcccgaatccgcaaaactaaaccccaaaaaactccaacgccgaaaccaaaaaacacgaaataccgaaaacaaactcctcccgtacgcgataacgacaaaaccgaaacgcgaaaaataaaaccgcaaaaaccgtacaaccgcgaaccaataaacgaacgccgaacgacctataacccaataacgacgacgcgcgaacacgctaaaaaccgaccaaacgaaccgacttttccaaaaaacccgaataattcctcccgaccacgccgcgccgactctaaacactcaacatcgtttccttttcctccgctaaaacaactataacgacgataaaaaccctaaaccccaaaaccgaaataacccgaacgcaaacgacgctaacgatcaacatcaacgcaacgcgaaatctacaaaacgtactaaaaaccaacctaaaacccaaaaacaccataaaaatataaaacgaaactaaaccgaaaaaccgaacgaacaccgcgcgccgccgcgctcctaacgaacccgaaaccgcgaactaaaacccgccgcctcgaaactacgcaaccgtccttctcgacgtcctccgaaatcgatcctatatccctcctaaaccccaccgtcccgaccatttcttcccgcatcgatacaatctccgcgaaaaacaaaacgactctaaaacgcgacgttccccgccctctaaaacttccaaacaccctaaaaactcgacacaatctctacgaaaacgaaataaacactacacctatcctcca

SEQ ID NO: 12265 - DNA, 853 bp, Artificial Sequence
  chemically treated genomic DNA (Homo sapiens) CpG-island No: 12265
  misc_feature (57)..(57): n is either a, c, g or t
  misc_feature (77)..(77): n is either a, c, g or t
  misc_feature (721)..(721): n is either a, c, g or t
gattgtacgtttcgtttacgttagtttggggttcgggattttttgattcgacggggnaattacggtgcgtttttttnaattatatcgtacgttacggattaaggcgatttagtttcgtttatttttatcgttttattattagtttggcgttaggattttacgatttttaattcggttttttttttttattcgggttagattcggttttcgattggtgttcgcgggcgtgattttcgttttcgtttttttcgttattgttaagatggcgtcggtcgcggtggtcgcggaggttagagtcggagaaagaggcggaggtagtggcggtcgcgaggggagggggagtttcgtttgattgagacggtaggtttgggcgggcgggcgggggtgtcgcgaagggcggagcgtcgggttggggatgagttaagcgggtttagagcgtcgcggtatttagtttttcgtgtttcgttatcgcgcgtgcgggatttcggcgtcgtttttcgagttcgattcgttgttcgtacgggagttagttgggtggtgagtgcgggggcggcgattcgggtagcggtggtaggtggagttgttacggttcggagaggtgatagtcgggggcgcgggagcggggcgggtgggttcggggaggaggaaaggatggtttagattttcgttcgagagtttttgagattcgggaggtgtttcgcggttcggttcgtttttggantggcgcggcggtgttgagagtagtattcgcgtttttgcgtcggacgcgtggggggtttttgtgtttttattttagattttttattttaggttggtttggggttgttgttatttgggagtgggggcggggagg

SEQ ID NO: 12266 - DNA, 853 bp, Artificial Sequence
  chemically treated genomic DNA (Homo sapiens) CpG-island No: 12266
  misc_feature (133)..(133): n is either a, c, g or t
  misc_feature (777)..(777): n is either a, c, g or t
  misc_feature (797)..(797): n is either a, c, g or t
cctccccgcccccactcccaaataacaacaaccccaaaccaacctaaaataaaaaatctaaaataaaaacacaaaaaccccccacgcgtccgacgcaaaaacgcgaatactactctcaacaccgccgcgccantccaaaaacgaaccgaaccgcgaaacacctcccgaatctcaaaaactctcgaacgaaaatctaaaccatcctttcctcctccccgaacccacccgccccgctcccgcgcccccgactatcacctctccgaaccgtaacaactccacctaccaccgctacccgaatcgccgcccccgcactcaccacccaactaactcccgtacgaacaacgaatcgaactcgaaaaacgacgccgaaatcccgcacgcgcgataacgaaacacgaaaaactaaataccgcgacgctctaaacccgcttaactcatccccaacccgacgctccgcccttcgcgacacccccgcccgcccgcccaaacctaccgtctcaatcaaacgaaactccccctcccctcgcgaccgccactacctccgcctctttctccgactctaacctccgcgaccaccgcgaccgacgccatcttaacaataacgaaaaaaacgaaaacgaaaatcacgcccgcgaacaccaatcgaaaaccgaatctaacccgaataaaaaaaaaaaaccgaattaaaaatcgtaaaatcctaacgccaaactaataataaaacgataaaaataaacgaaactaaatcgccttaatccgtaacgtacgatataattnaaaaaaacgcaccgtaattnccccgtcgaatcaaaaaatcccgaaccccaaactaacgtaaacgaaacgtacaatc

SEQ ID NO: 12267 - DNA, 853 bp, Artificial Sequence
  chemically treated genomic DNA (Homo sapiens) CpG-island No: 12267
  misc_feature (133)..(133): n is either a, c, g or t
  misc_feature (777)..(777): n is either a, c, g or t
  misc_feature (797)..(797): n is either a, c, g or t
ttttttcgtttttatttttaaataataatagttttaggttagtttggaatagaaaatttggaatgaaaatataggagttttttacgcgttcgacgtagaggcgcgggtgttatttttagtatcgtcgcgttantttaggggcggatcgagtcgcggagtatttttcggattttaggagttttcgggcggagatttgggttatttttttttttttttcgaatttattcgtttcgttttcgcgttttcggttgttattttttcgggtcgtgatagttttatttgttatcgttgttcgggtcgtcgttttcgtatttattatttagttggttttcgtgcgagtagcggatcgagttcggagagcggcgtcggaatttcgtacgcgcggtagcggaatacgaggggttgaatgtcgcggcgttttgagttcgtttagtttatttttagttcggcgtttcgtttttcgcggtattttcgttcgttcgtttaggtttgtcgttttagttagacgggatttttttttttttcgcggtcgttattgttttcgttttttttttcgattttagttttcgcggttatcgcgatcggcgttattttggtaatgacggaaggggcgggggcgggaattacgttcgcgagtattaatcgaaggtcggatttggttcgagtgggaggagagggtcgagttgagggtcgtggggttttagcgttaaattgataatggggcggtgaaggtgggcgggattaagtcgttttagttcgtgacgtgcggtgtagttnggggaaacgtatcgtggttntttcgtcgggttaggagatttcgagttttaggttggcgtgggcgaagcgtataatt

SEQ ID NO: 12268 - DNA, 853 bp, Artificial Sequence
  chemically treated genomic DNA (Homo sapiens) CpG-island No: 12268
  misc_feature (57)..(57): n is either a, c, g or t
  misc_feature (77)..(77): n is either a, c, g or t
  misc_feature (721)..(721): n is either a, c, g or t
aattatacgcttcgcccacgccaacctaaaactcgaaatctcctaacccgacgaaanaaccacgatacgtttccccnaactacaccgcacgtcacgaactaaaacgacttaatcccgcccaccttcaccgccccattatcaatttaacgctaaaaccccacgaccctcaactcgaccctctcctcccactcgaaccaaatccgaccttcgattaatactcgcgaacgtaattcccgcccccgccccttccgtcattaccaaaataacgccgatcgcgataaccgcgaaaactaaaatcgaaaaaaaaaacgaaaacaataacgaccgcgaaaaaaaaaaaaatcccgtctaactaaaacgacaaacctaaacgaacgaacgaaaataccgcgaaaaacgaaacgccgaactaaaaataaactaaacgaactcaaaacgccgcgacattcaacccctcgtattccgctaccgcgcgtacgaaattccgacgccgctctccgaactcgatccgctactcgcacgaaaaccaactaaataataaatacgaaaacgacgacccgaacaacgataacaaataaaactatcacgacccgaaaaaataacaaccgaaaacgcgaaaacgaaacgaataaattcgaaaaaaaaaaaaaaataacccaaatctccgcccgaaaactcctaaaatccgaaaaatactccgcgactcgatccgcccctaaantaacgcgacgatactaaaaataacacccgcgcctctacgtcgaacgcgtaaaaaactcctatattttcattccaaattttctattccaaactaacctaaaactattattatttaaaaataaaaacgaaaaaa

SEQ ID NO: 12269 - DNA, 577 bp, Artificial Sequence
  chemically treated genomic DNA (Homo sapiens) CpG-island No: 12269
tttttttttattttcgtaatagtttattttgcgtatgcgttttaatcgatggtattgttgcgtaggcgtaatgtttgcgttcggtttatttgcgtaggcgtagtgtttgacgtttagattcggcgtaggcgtattcgtttcgtttttatttttgtttttttagtttaggagttcggttggttttgggtgggtttagatagtcgcggcggttgcggcgtcgatagtgatagtgagtgcgtgagattcggagagaaatggcgatggcgatgtcggatagtggggcgagtcgtttgcgtcggtagttggagttagggggttttgaggcgcggttgtacgtgaagtagttttcgtagtagtcggatggggatcgggatttttaggagtatcggtagcgtatttaggcgttggcggaggagacggcgtagaatttgaagcgtaacgtttattagaattatcggtagtttatagagacggttcgcgagattttttatttggagagcgagatgtattagtttagttatttgttgatcgagtagaaaagtagtttggagagtatttcgtttacgttgttgtttgt

SEQ ID NO: 12270 - DNA, 577 bp, Artificial Sequence
  chemically treated genomic DNA (Homo sapiens) CpG-island No: 12270
acaaacaacaacgtaaacgaaatactctccaaactacttttctactcgatcaacaaataactaaactaatacatctcgctctccaaataaaaaatctcgcgaaccgtctctataaactaccgataattctaataaacgttacgcttcaaattctacgccgtctcctccgccaacgcctaaatacgctaccgatactcctaaaaatcccgatccccatccgactactacgaaaactacttcacgtacaaccgcgcctcaaaaccccctaactccaactaccgacgcaaacgactcgccccactatccgacatcgccatcgccatttctctccgaatctcacgcactcactatcactatcgacgccgcaaccgccgcgactatctaaacccacccaaaaccaaccgaactcctaaactaaaaaaacaaaaataaaaacgaaacgaatacgcctacgccgaatctaaacgtcaaacactacgcctacgcaaataaaccgaacgcaaacattacgcctacgcaacaataccatcgattaaaacgcatacgcaaaataaactattacgaaaataaaaaaaaa

SEQ ID NO: 12271 - DNA, 577 bp, Artificial Sequence
  chemically treated genomic DNA (Homo sapiens) CpG-island No: 12271
gtaggtagtaacgtaagcgggatgttttttaggttgtttttttgttcggttagtaaatggttgagttggtatatttcgttttttaggtaggagatttcgcgggtcgtttttatgaattgtcggtagttttggtagacgttgcgttttaggttttgcgtcgtttttttcgttagcgtttggatgcgttgtcggtgtttttggaggtttcggtttttattcgattgttgcgagagttgttttacgtatagtcgcgttttaaaattttttgattttagttgtcgacgtaggcggttcgttttattgttcgatatcgttatcgttattttttttcgggttttacgtatttattgttattatcggcgtcgtagtcgtcgcggttgtttagatttatttaaggttaatcgagtttttgggttgaggaagtaggaatgggaacgagacgagtacgtttgcgtcgggtttgagcgttagatattgcgtttgcgtaagtgggtcgagcgtagatattgcgtttgcgtagtaatgttatcggttaaagcgtatgcgtaagatgagttattgcggaagtgaggggagg

SEQ ID NO: 12272 - DNA, 577 bp, Artificial Sequence
  chemically treated genomic DNA (Homo sapiens) CpG-island No: 12272
cctcccctcacttccgcaataactcatcttacgcatacgctttaaccgataacattactacgcaaacgcaatatctacgctcgacccacttacgcaaacgcaatatctaacgctcaaacccgacgcaaacgtactcgtctcgttcccattcctacttcctcaacccaaaaactcgattaaccttaaataaatctaaacaaccgcgacgactacgacgccgataataacaataaatacgtaaaacccgaaaaaaaataacgataacgatatcgaacaataaaacgaaccgcctacgtcgacaactaaaatcaaaaaattttaaaacgcgactatacgtaaaacaactctcgcaacaatcgaataaaaaccgaaacctccaaaaacaccgacaacgcatccaaacgctaacgaaaaaaacgacgcaaaacctaaaacgcaacgtctaccaaaactaccgacaattcataaaaacgacccgcgaaatctcctacctaaaaaacgaaatataccaactcaaccatttactaaccgaacaaaaaaacaacctaaaaaacatcccgcttacgttactacctac

SEQ ID NO: 12273 - DNA, 795 bp, Artificial Sequence
  chemically treated genomic DNA (Homo sapiens) CpG-island No: 12273
  misc_feature (16)..(16): n is either a, c, g or t
  misc_feature (48)..(48): n is either a, c, g or t
  misc_feature (139)..(139): n is either a, c, g or t
  misc_feature (227)..(227): n is either a, c, g or t
  misc_feature (231)..(231): n is either a, c, g or t
  misc_feature (240)..(240): n is either a, c, g or t
  misc_feature (254)..(254): n is either a, c, g or t
  misc_feature (265)..(265): n is either a, c, g or t
  misc_feature (271)..(271): n is either a, c, g or t
  misc_feature (278)..(278): n is either a, c, g or t
  misc_feature (291)..(291): n is either a, c, g or t
  misc_feature (306)..(306): n is either a, c, g or t
  misc_feature (389)..(389): n is either a, c, g or t
  misc_feature (444)..(444): n is either a, c, g or t
  misc_feature (470)..(470): n is either a, c, g or t
  misc_feature (566)..(566): n is either a, c, g or t
tcgttttttttttcgngcgtgggaagtttttttaaaagtggaggggangcgagtgtcgcgttttgttaatttcgattgcgtttgggtttttttcgcgtcgggtttcggagtcgttttttttgattttgcgattacggtncggggattttgcgcgcgttcgggaatgtagagtttttagcgtcgcgtagggttcgtttcgatttcggtcggttttgggtaattcgttntcgncggttagtnttttattttaagantgtggttcggntttttnatttttngcgggggggaaantgtcgggcgattttntatattgatttttttgcgtatttagcgtaaattacgaatttagagttggagttgttcgtagatttcgcgtagttagatttcgncgtttttatttcgtttcgtttcgtttcgttcggggtattaattttcggtcgaggnaggggtcgcgtggcgtcgcggggggncggttcgcgtacgtttttcgtagggaggatttagggatagttagggtttcgggagagttcgcgcgtatcgttcggtttcgcggcgttagttatggncgttcgtgcgtggtttcgttagggatggggcgacgcggttagagtcgtacgcgatcgaaattcgtattttggagtcgtagagcgcgcggttttgttgtttagcggttttttggtaagtgacgtggggaagaaacgtagggcgtaggagagatagttggaaaggtgtgcggtgtagttggtttaggattgagggtttggaggtcgggtgttggaagattttgagcgaggt

SEQ ID NO: 12274 - DNA, 795 bp, Artificial Sequence
  chemically treated genomic DNA (Homo sapiens) CpG-island No: 12274
  misc_feature (230)..(230): n is either a, c, g or t
  misc_feature (326)..(326): n is either a, c, g or t
  misc_feature (352)..(352): n is either a, c, g or t
  misc_feature (407)..(407): n is either a, c, g or t
  misc_feature (490)..(490): n is either a, c, g or t
  misc_feature (505)..(505): n is either a, c, g or t
  misc_feature (518)..(518): n is either a, c, g or t
  misc_feature (525)..(525): n is either a, c, g or t
  misc_feature (531)..(531): n is either a, c, g or t
  misc_feature (542)..(542): n is either a, c, g or t
  misc_feature (556)..(556): n is either a, c, g or t
  misc_feature (565)..(565): n is either a, c, g or t
  misc_feature (569)..(569): n is either a, c, g or t
  misc_feature (657)..(657): n is either a, c, g or t
  misc_feature (748)..(748): n is either a, c, g or t
  misc_feature (780)..(780): n is either a, c, g or t
acctcgctcaaaatcttccaacacccgacctccaaaccctcaatcctaaaccaactacaccgcacacctttccaactatctctcctacgccctacgtttcttccccacgtcacttaccaaaaaaccgctaaacaacaaaaccgcgcgctctacgactccaaaatacgaatttcgatcgcgtacgactctaaccgcgtcgccccatccctaacgaaaccacgcacgaacgnccataactaacgccgcgaaaccgaacgatacgcgcgaactctcccgaaaccctaactatccctaaatcctccctacgaaaaacgtacgcgaaccgnccccccgcgacgccacgcgacccctncctcgaccgaaaattaataccccgaacgaaacgaaacgaaacgaaataaaaacgncgaaatctaactacgcgaaatctacgaacaactccaactctaaattcgtaatttacgctaaatacgcaaaaaaatcaatatanaaaatcgcccgacantttcccccccgcnaaaaatnaaaaanccgaaccacantcttaaaataaaanactaaccgncganaacgaattacccaaaaccgaccgaaatcgaaacgaaccctacgcgacgctaaaaactctacattcccgaacgcgcgcaaaatccccgnaccgtaatcgcaaaatcaaaaaaaacgactccgaaacccgacgcgaaaaaaacccaaacgcaatcgaaattaacaaaacgcgacactcgcntcccctccacttttaaaaaaacttcccacgcncgaaaaaaaaaacga

SEQ ID NO: 12275 - DNA, 795 bp, Artificial Sequence
  chemically treated genomic DNA (Homo sapiens) CpG-island No: 12275
  misc_feature (230)..(230): n is either a, c, g or t
  misc_feature (326)..(326): n is either a, c, g or t
  misc_feature (352)..(352): n is either a, c, g or t
  misc_feature (407)..(407): n is either a, c, g or t
  misc_feature (490)..(490): n is either a, c, g or t
  misc_feature (505)..(505): n is either a, c, g or t
  misc_feature (518)..(518): n is either a, c, g or t
  misc_feature (525)..(525): n is either a, c, g or t
  misc_feature (531)..(531): n is either a, c, g or t
  misc_feature (542)..(542): n is either a, c, g or t
  misc_feature (556)..(556): n is either a, c, g or t
  misc_feature (565)..(565): n is either a, c, g or t
  misc_feature (569)..(569): n is either a, c, g or t
  misc_feature (657)..(657): n is either a, c, g or t
  misc_feature (748)..(748): n is either a, c, g or t
  misc_feature (780)..(780): n is either a, c, g or t
gtttcgtttaaggttttttaatattcgatttttagatttttaattttgggttagttatatcgtatatttttttagttgttttttttgcgttttgcgttttttttttacgttatttgttagggagtcgttaaatagtaagatcgcgcgttttgcggttttagagtgcggatttcggtcgcgtgcggttttgatcgcgtcgttttatttttggcggggttacgtacggacgnttatggttggcgtcgcggagtcgggcgatgcgcgcggattttttcggggttttgattgtttttgagttttttttgcggggggcgtgcgcgggtcgntttttcgcggcgttacgcggtttttntttcggtcggggattggtgtttcgggcggggcggggcggggcgggataaaggcgncggggtttggttgcgcggggtttgcgggtagttttaattttgggttcgtagtttgcgttgggtgcgtaggaaggttagtgtgnggggtcgttcgatantttttttttcgtnggaggtngggagntcgagttatanttttggagtggggnattggtcgncggnagcgggttgtttagggtcggtcgaggtcggggcgagttttgcgcggcgttggagattttgtattttcgggcgcgcgtagggttttcgngtcgtggtcgtagagttaggaggggcggtttcggagttcggcgcggggagggtttaggcgtagtcggggttggtagggcgcgatattcgtnttttttttatttttgaaagggttttttacgtncgagaagaggggcgg

SEQ ID NO: 12276 - DNA, 795 bp, Artificial Sequence
  chemically treated genomic DNA (Homo sapiens) CpG-island No: 12276
  misc_feature (16)..(16): n is either a, c, g or t
  misc_feature (48)..(48): n is either a, c, g or t
  misc_feature (139)..(139): n is either a, c, g or t
  misc_feature (227)..(227): n is either a, c, g or t
  misc_feature (231)..(231): n is either a, c, g or t
  misc_feature (240)..(240): n is either a, c, g or t
  misc_feature (254)..(254): n is either a, c, g or t
  misc_feature (265)..(265): n is either a, c, g or t
  misc_feature (271)..(271): n is either a, c, g or t
  misc_feature (278)..(278): n is either a, c, g or t
  misc_feature (291)..(291): n is either a, c, g or t
  misc_feature (306)..(306): n is either a, c, g or t
  misc_feature (389)..(389): n is either a, c, g or t
  misc_feature (444)..(444): n is either a, c, g or t
  misc_feature (470)..(470): n is either a, c, g or t
  misc_feature (566)..(566): n is either a, c, g or t
ccgcccctcttctcgnacgtaaaaaaccctttcaaaaataaaaaaaanacgaatatcgcgccctaccaaccccgactacgcctaaaccctccccgcgccgaactccgaaaccgcccctcctaactctacgaccacgacncgaaaaccctacgcgcgcccgaaaatacaaaatctccaacgccgcgcaaaactcgccccgacctcgaccgaccctaaacaacccgctnccgncgaccaatnccccactccaaaantataactcganctcccnacctccnacgaaaaaaaaantatcgaacgaccccncacactaaccttcctacgcacccaacgcaaactacgaacccaaaattaaaactacccgcaaaccccgcgcaaccaaaccccgncgcctttatcccgccccgccccgccccgcccgaaacaccaatccccgaccgaaanaaaaaccgcgtaacgccgcgaaaaancgacccgcgcacgccccccgcaaaaaaaactcaaaaacaatcaaaaccccgaaaaaatccgcgcgcatcgcccgactccgcgacgccaaccataancgtccgtacgtaaccccgccaaaaataaaacgacgcgatcaaaaccgcacgcgaccgaaatccgcactctaaaaccgcaaaacgcgcgatcttactatttaacgactccctaacaaataacgtaaaaaaaaaacgcaaaacgcaaaaaaaacaactaaaaaaatatacgatataactaacccaaaattaaaaatctaaaaatcgaatattaaaaaaccttaaacgaaac

SEQ ID NO: 12277 - DNA, 526 bp, Artificial Sequence
  chemically treated genomic DNA (Homo sapiens) CpG-island No: 12277
  misc_feature (400)..(400): n is either a, c, g or t
  misc_feature (496)..(496): n is either a, c, g or t
tgcgtcgtttttgtttttattttcgtttttattttcgttttttgcgcggtttcgacgttgttttgttttttttgtttagtttttagtttttttttttacgtattggtagtttttttcggcgttgtagattttttcgttaagtcgcgttcggttttagttgcgttttcgaggtcggtttcgcggattcgcgtcgtagttttttggagcgttcggggtcgcgcggcgtcgttttaggtacggaggcggtaggtttaggcgcgtttcggatattaggcgcgggaggcggtcggtagtaacgcgagttaagaagcgagcgggagggacgttttagtttcgtttggcgtttttttttcgttatatcggtagtttttttcgttttttttttttatcggggcggggncggtcgcggtgtacggattcgtgttaaagatcgcgtcgttagttttcgtttgtaggtggagaacgttaggttttattattttgttgtttatttaancgtaggggttgtatttaggaaaattttgtt

SEQ ID NO: 12278 - DNA, 526 bp, Artificial Sequence
  chemically treated genomic DNA (Homo sapiens) CpG-island No: 12278
  misc_feature (31)..(31): n is either a, c, g or t
  misc_feature (127)..(127): n is either a, c, g or t
aacaaaattttcctaaatacaacccctacgnttaaataaacaacaaaataataaaacctaacgttctccacctacaaacgaaaactaacgacgcgatctttaacacgaatccgtacaccgcgaccgnccccgccccgataaaaaaaaaaaacgaaaaaaactaccgatataacgaaaaaaaaacgccaaacgaaactaaaacgtccctcccgctcgcttcttaactcgcgttactaccgaccgcctcccgcgcctaatatccgaaacgcgcctaaacctaccgcctccgtacctaaaacgacgccgcgcgaccccgaacgctccaaaaaactacgacgcgaatccgcgaaaccgacctcgaaaacgcaactaaaaccgaacgcgacttaacgaaaaaatctacaacgccgaaaaaaactaccaatacgtaaaaaaaaaaactaaaaactaaacaaaaaaaacaaaacaacgtcgaaaccgcgcaaaaaacgaaaataaaaacgaaaataaaaacaaaaacgacgca

SEQ ID NO: 12279 - DNA, 526 bp, Artificial Sequence
  chemically treated genomic DNA (Homo sapiens) CpG-island No: 12279
  misc_feature (31)..(31): n is either a, c, g or t
  misc_feature (127)..(127): n is either a, c, g or t
gataggatttttttgggtgtagtttttgcgnttgggtgaatagtagagtgataaagtttggcgttttttatttgtaggcggaggttgacggcgcggtttttggtacgagttcgtgtatcgcggtcgntttcgtttcggtgggagagagggacggaggaagttgtcggtataacgggaggagagcgttaggcggagttggggcgtttttttcgttcgttttttgattcgcgttgttgtcggtcgtttttcgcgtttagtgttcgggacgcgtttgaatttgtcgttttcgtgtttggggcggcgtcgcgcggtttcgagcgttttagaaagttgcggcgcgagttcgcggggtcgatttcggagacgtagttggggtcgggcgcggtttggcgggagggtttgtagcgtcgagggaggttgttagtgcgtgaggaagagagttagagattggataggggagatagagtagcgtcggagtcgcgtaggggacgggagtgagagcgggagtgagagtaggaacgacgta

SEQ ID NO: 12280 - DNA, 526 bp, Artificial Sequence
  chemically treated genomic DNA (Homo sapiens) CpG-island No: 12280
  misc_feature (400)..(400): n is either a, c, g or t
  misc_feature (496)..(496): n is either a, c, g or t
tacgtcgttcctactctcactcccgctctcactcccgtcccctacgcgactccgacgctactctatctcccctatccaatctctaactctcttcctcacgcactaacaacctccctcgacgctacaaaccctcccgccaaaccgcgcccgaccccaactacgtctccgaaatcgaccccgcgaactcgcgccgcaactttctaaaacgctcgaaaccgcgcgacgccgccccaaacacgaaaacgacaaattcaaacgcgtcccgaacactaaacgcgaaaaacgaccgacaacaacgcgaatcaaaaaacgaacgaaaaaaacgccccaactccgcctaacgctctcctcccgttataccgacaacttcctccgtccctctctcccaccgaaacgaaancgaccgcgatacacgaactcgtaccaaaaaccgcgccgtcaacctccgcctacaaataaaaaacgccaaactttatcactctactattcacccaancgcaaaaactacacccaaaaaaatcctatc

SEQ ID NO: 12281 - DNA, 640 bp, Artificial Sequence
  chemically treated genomic DNA (Homo sapiens) CpG-island No: 12281
  misc_feature (47)..(47): n is either a, c, g or t
  misc_feature (106)..(106): n is either a, c, g or t
  misc_feature (135)..(135): n is either a, c, g or t
  misc_feature (155)..(155): n is either a, c, g or t
  misc_feature (164)..(164): n is either a, c, g or t
  misc_feature (273)..(273): n is either a, c, g or t
  misc_feature (636)..(636): n is either a, c, g or t
cgggttgtcgtagtagagaagagtattgattggttgaggtagaaaangtgtttttgtttcggcgttttcggttttggttgggattattcgcggcggtcgggttcgntggggcgtttggagtgagggttttggttnttcgtcggcgaggtgagttngtatcgttngcgcgggtcgacgacggggtcgggcgtagttttaggttcggtgttttagtgtttagtcgcgttgtggagcggcggttgtagcggttttaggtcgggcgaggtagttttnggaaagggtttgcggtgaataggttggggtttcgggaagggatcgttgggtggcgggttttcgcgaaatgtcgcgtttaagtttttcgcgtatggaatggttgggagaggtttgatggtgggcgtcgggatcgtttttagcgaggcgtttagattgcgcggagaggagcggtatcgttttcgtttttatagagttggcgttcgagattaatttaggttgttgaagttttttagggagtttcgacgttaattttaagattcggcgggaaaacggattttcgaatttagttttaggtttcgtttgttttttaggaagggttttagggaattgcgaatttttttttatatcggggtggttgcgtantgat

SEQ ID NO: 12282 - DNA, 640 bp, Artificial Sequence
  chemically treated genomic DNA (Homo sapiens) CpG-island No: 12282
  misc_feature (5)..(5): n is either a, c, g or t
  misc_feature (368)..(368): n is either a, c, g or t
  misc_feature (477)..(477): n is either a, c, g or t
  misc_feature (486)..(486): n is either a, c, g or t
  misc_feature (506)..(506): n is either a, c, g or t
  misc_feature (535)..(535): n is either a, c, g or t
  misc_feature (594)..(594): n is either a, c, g or t
atcantacgcaaccaccccgatataaaaaaaaattcgcaattccctaaaacccttcctaaaaaacaaacgaaacctaaaactaaattcgaaaatccgttttcccgccgaatcttaaaattaacgtcgaaactccctaaaaaacttcaacaacctaaattaatctcgaacgccaactctataaaaacgaaaacgataccgctcctctccgcgcaatctaaacgcctcgctaaaaacgatcccgacgcccaccatcaaacctctcccaaccattccatacgcgaaaaacttaaacgcgacatttcgcgaaaacccgccacccaacgatcccttcccgaaaccccaacctattcaccgcaaaccctttccnaaaactacctcgcccgacctaaaaccgctacaaccgccgctccacaacgcgactaaacactaaaacaccgaacctaaaactacgcccgaccccgtcgtcgacccgcgcnaacgatacnaactcacctcgccgacgaanaaccaaaaccctcactccaaacgccccancgaacccgaccgccgcgaataatcccaaccaaaaccgaaaacgccgaaacaaaaacacnttttctacctcaaccaatcaatactcttctctactacgacaacccg

SEQ ID NO: 12283 - DNA, 640 bp, Artificial Sequence
  chemically treated genomic DNA (Homo sapiens) CpG-island No: 12283
  misc_feature (5)..(5): n is either a, c, g or t
  misc_feature (368)..(368): n is either a, c, g or t
  misc_feature (477)..(477): n is either a, c, g or t
  misc_feature (486)..(486): n is either a, c, g or t
  misc_feature (506)..(506): n is either a, c, g or t
  misc_feature (535)..(535): n is either a, c, g or t
  misc_feature (594)..(594): n is either a, c, g or t
gttantgcgtagttatttcgatgtaggagagggttcgtaattttttgaagttttttttggaagataggcgaagtttagggttgggttcggggattcgttttttcgtcgaattttgggattagcgtcggggttttttggggaattttaataatttgaattgatttcggacgttaattttgtaggagcggggacggtgtcgttttttttcgcgtagtttaggcgtttcgttgagggcggtttcggcgtttattattagattttttttagttattttatgcgcggagagtttggacgcggtatttcgcggggattcgttatttagcggttttttttcggagttttagtttgtttatcgtaggttttttttnggggttgtttcgttcggtttagggtcgttgtagtcgtcgttttatagcgcgattgaatattggggtatcgaatttggggttgcgttcggtttcgtcgtcggttcgcgtnagcggtgtnggtttatttcgtcggcgggnaattagaatttttattttaggcgttttancgagttcggtcgtcgcggatgattttagttaaaatcgaaagcgtcgaggtaggggtatnttttttgttttagttaattagtgtttttttttgttacggtagttcg

SEQ ID NO: 12284 - DNA, 640 bp, Artificial Sequence
  chemically treated genomic DNA (Homo sapiens) CpG-island No: 12284
  misc_feature (47)..(47): n is either a, c, g or t
  misc_feature (106)..(106): n is either a, c, g or t
  misc_feature (135)..(135): n is either a, c, g or t
  misc_feature (155)..(155): n is either a, c, g or t
  misc_feature (164)..(164): n is either a, c, g or t
  misc_feature (273)..(273): n is either a, c, g or t
  misc_feature (636)..(636): n is either a, c, g or t
cgaactaccgtaacaaaaaaaaacactaattaactaaaacaaaaaanatacccctacctcgacgctttcgattttaactaaaatcatccgcgacgaccgaactcgntaaaacgcctaaaataaaaattctaattncccgccgacgaaataaaccnacaccgctnacgcgaaccgacgacgaaaccgaacgcaaccccaaattcgataccccaatattcaatcgcgctataaaacgacgactacaacgaccctaaaccgaacgaaacaaccccnaaaaaaaacctacgataaacaaactaaaactccgaaaaaaaaccgctaaataacgaatccccgcgaaataccgcgtccaaactctccgcgcataaaataactaaaaaaaatctaataataaacgccgaaaccgccctcaacgaaacgcctaaactacgcgaaaaaaaacgacaccgtccccgctcctacaaaattaacgtccgaaatcaattcaaattattaaaattccccaaaaaaccccgacgctaatcccaaaattcgacgaaaaaacgaatccccgaacccaaccctaaacttcgcctatcttccaaaaaaaacttcaaaaaattacgaaccctctcctacatcgaaataactacgcantaac

SEQ ID NO: 12285 - DNA, 887 bp, Artificial Sequence
  chemically treated genomic DNA (Homo sapiens) CpG-island No: 12285
  misc_feature (305)..(305): n is either a, c, g or t
  misc_feature (466)..(466): n is either a, c, g or t
cgttttttaagtcgtaagttatttttgcgttcgagagaggcgggttcggataaagtcgggacgttttttggtatataaagttttatttgtttttttcgttcgtacggtttttgtcgtttggcggttttttttttttacggcgggcgcgggcggggagatggtcgtcggcgtttttcggcgtaaacgggcgttgcgcgcgtagtcgtcgttacgttgatttttcgttttagttggttgttgttcggagttttagtagcgggcgaaggcggaggtttagaagggtaggagatcgtcgcgataggagnttcgagggttcgtatggttttttttcgtcggcgggtgttgtgcgttacggagttcgttaaaggcgtttcgggttcggagcggttttgagtcgcgtcgtttgttgagatcgatcgtttgttgagtcgtttcgtggagttgcgggtaggaattcgaggagtanggaggtggcggcggcggtagtgtttgttttttttagagggcgatgtggtcggtcggcgcgggtattaagttgttttgttttcgagattttgcgtttcggagggcggttttttttgggaattttacggttttgtttttttatatcgtgttcgtcggtcgtagcgttcgggtttttattagcgttaattttgaaggtacgtttttcgttcgggtttgttcgttcgtttttttgttcgttagcgttgcgggagttggagagtgtgtgttcgttttatagttcggtgcgttttgcgttttttttttttagttaaagtcgtggtcgttttgagcgcgtgggaatttaatttgaattatttttttttttttttcgttggtcggttttgtttgtatatttttattaggatatttattttttatttcgg

SEQ ID NO: 12286 - DNA, 887 bp, Artificial Sequence
  chemically treated genomic DNA (Homo sapiens) CpG-island No: 12286
  misc_feature (422)..(422): n is either a, c, g or t
  misc_feature (583)..(583): n is either a, c, g or t
ccgaaataaaaaataaatatcctaataaaaatatacaaacaaaaccgaccaacgaaaaaaaaaaaaaaataattcaaattaaattcccacgcgctcaaaacgaccacgactttaactaaaaaaaaaaaacgcaaaacgcaccgaactataaaacgaacacacactctccaactcccgcaacgctaacgaacaaaaaaacgaacgaacaaacccgaacgaaaaacgtaccttcaaaattaacgctaataaaaacccgaacgctacgaccgacgaacacgatataaaaaaacaaaaccgtaaaattcccaaaaaaaaccgccctccgaaacgcaaaatctcgaaaacaaaacaacttaatacccgcgccgaccgaccacatcgccctctaaaaaaaacaaacactaccgccgccgccacctccntactcctcgaattcctacccgcaactccacgaaacgactcaacaaacgatcgatctcaacaaacgacgcgactcaaaaccgctccgaacccgaaacgcctttaacgaactccgtaacgcacaacacccgccgacgaaaaaaaaccatacgaaccctcgaanctcctatcgcgacgatctcctacccttctaaacctccgccttcgcccgctactaaaactccgaacaacaaccaactaaaacgaaaaatcaacgtaacgacgactacgcgcgcaacgcccgtttacgccgaaaaacgccgacgaccatctccccgcccgcgcccgccgtaaaaaaaaaaaaccgccaaacgacaaaaaccgtacgaacgaaaaaaacaaataaaactttatataccaaaaaacgtcccgactttatccgaacccgcctctctcgaacgcaaaaataacttacgacttaaaaaacg

SEQ ID NO: 12287 - DNA, 887 bp, Artificial Sequence
  chemically treated genomic DNA (Homo sapiens) CpG-island No: 12287
  misc_feature (422)..(422): n is either a, c, g or t
  misc_feature (583)..(583): n is either a, c, g or t
tcggggtggagaatgggtgttttaatagaagtgtgtaggtaaaatcggttagcgaggggagaaaaaaagtgatttaaattaaatttttacgcgtttagggcggttacggttttagttggaggaagggagcgtagggcgtatcgggttgtggggcggatatatattttttagttttcgtagcgttgacggatagaaggacggacgggtaaattcgagcgagggacgtatttttagggttggcgttgatgaagattcggacgttgcggtcggcgggtacgatgtgagagggtagggtcgtgaggtttttagagaaagtcgtttttcggagcgtagagtttcggggatagggtagtttggtgttcgcgtcggtcggttatatcgttttttgggaggaatagatattgtcgtcgtcgttatttttntgtttttcgggtttttgttcgtagttttacggaacggtttagtaggcggtcgattttagtaggcggcgcggtttagagtcgtttcgagttcgaagcgtttttggcgagtttcgtggcgtatagtattcgtcggcgaggagaagttatacggattttcgggntttttgtcgcggcggttttttgtttttttgggttttcgttttcgttcgttgttagggtttcgagtagtagttagttggagcgggaggttagcgtggcggcggttacgcgcgtagcgttcgtttgcgtcgggaagcgtcggcggttattttttcgttcgcgttcgtcgtgggaggagggggtcgttaggcggtagggatcgtgcgagcgaggagagtagatgaaattttatgtattagaaggcgtttcgattttattcgagttcgtttttttcgggcgtagaaataatttgcggtttagaggacg

SEQ ID NO: 12288 - DNA, 887 bp, Artificial Sequence
  chemically treated genomic DNA (Homo sapiens) CpG-island No: 12288
  misc_feature (305)..(305): n is either a, c, g or t
  misc_feature (466)..(466): n is either a, c, g or t
cgtcctctaaaccgcaaattatttctacgcccgaaaaaaacgaactcgaataaaatcgaaacgccttctaatacataaaatttcatctactctcctcgctcgcacgatccctaccgcctaacgaccccctcctcccacgacgaacgcgaacgaaaaaataaccgccgacgcttcccgacgcaaacgaacgctacgcgcgtaaccgccgccacgctaacctcccgctccaactaactactactcgaaaccctaacaacgaacgaaaacgaaaacccaaaaaaacaaaaaaccgccgcgacaaaaancccgaaaatccgtataacttctcctcgccgacgaatactatacgccacgaaactcgccaaaaacgcttcgaactcgaaacgactctaaaccgcgccgcctactaaaatcgaccgcctactaaaccgttccgtaaaactacgaacaaaaacccgaaaaacanaaaaataacgacgacgacaatatctattcctcccaaaaaacgatataaccgaccgacgcgaacaccaaactaccctatccccgaaactctacgctccgaaaaacgactttctctaaaaacctcacgaccctaccctctcacatcgtacccgccgaccgcaacgtccgaatcttcatcaacgccaaccctaaaaatacgtccctcgctcgaatttacccgtccgtccttctatccgtcaacgctacgaaaactaaaaaatatatatccgccccacaacccgatacgccctacgctcccttcctccaactaaaaccgtaaccgccctaaacgcgtaaaaatttaatttaaatcactttttttctcccctcgctaaccgattttacctacacacttctattaaaacacccattctccaccccga

SEQ ID NO: 12289 - DNA, 564 bp, Artificial Sequence
  chemically treated genomic DNA (Homo sapiens) CpG-island No: 12289
  misc_feature (239)..(239): n is either a, c, g or t
  misc_feature (303)..(303): n is either a, c, g or t
  misc_feature (316)..(316): n is either a, c, g or t
  misc_feature (400)..(400): n is either a, c, g or t
  misc_feature (523)..(523): n is either a, c, g or t
  misc_feature (529)..(529): n is either a, c, g or t
tatttattcgcgtttcgggtattcgtttttggggcgttttcgtttgggacgtttttcgcgacgtagtggtcgcgcggacgggtagcgatagcgcgtatagcgttagggatagcgcgtaaagtagcgcgggcgcggggcggtgcggagttatggtggcgatagcggtaggggatttagtcggtagtcgcggtttcgggtcgtcgattttaagtagtcgttcgtttatttcgtttaagttnggggatcgttttttagggagggcgcggggcggggatttgtttcggattttggagatatttgggntttttattcggantcgattcgatagggcgcggtagtttttgtattttagtttcggggcggagatttagtattaggtttgatatacggcgggcgttangttgtgtgtatattaaatgggcgtaagtacgagcggcggcgagtttagttgagttttttgcgacgtacgcgagttttttcgttttttcgtatttaatatttttagtaaaaaaataacgggaanttaatnattatagaaagtttagtatcgagttattagtatat

SEQ ID NO: 12290 - DNA, 564 bp, Artificial Sequence
  chemically treated genomic DNA (Homo sapiens) CpG-island No: 12290
  misc_feature (36)..(36): n is either a, c, g or t
  misc_feature (42)..(42): n is either a, c, g or t
  misc_feature (165)..(165): n is either a, c, g or t
  misc_feature (249)..(249): n is either a, c, g or t
  misc_feature (262)..(262): n is either a, c, g or t
  misc_feature (326)..(326): n is either a, c, g or t
atatactaataactcgatactaaactttctataatnattaanttcccgttatttttttactaaaaatattaaatacgaaaaaacgaaaaaactcgcgtacgtcgcaaaaaactcaactaaactcgccgccgctcgtacttacgcccatttaatatacacacaacntaacgcccgccgtatatcaaacctaatactaaatctccgccccgaaactaaaatacaaaaactaccgcgccctatcgaatcgantccgaataaaaancccaaatatctccaaaatccgaaacaaatccccgccccgcgccctccctaaaaaacgatccccnaacttaaacgaaataaacgaacgactacttaaaatcgacgacccgaaaccgcgactaccgactaaatcccctaccgctatcgccaccataactccgcaccgccccgcgcccgcgctactttacgcgctatccctaacgctatacgcgctatcgctacccgtccgcgcgaccactacgtcgcgaaaaacgtcccaaacgaaaacgccccaaaaacgaatacccgaaacgcgaataaata

SEQ ID NO: 12291 - DNA, 564 bp, Artificial Sequence
  chemically treated genomic DNA (Homo sapiens) CpG-island No: 12291
  misc_feature (36)..(36): n is either a, c, g or t
  misc_feature (42)..(42): n is either a, c, g or t
  misc_feature (165)..(165): n is either a, c, g or t
  misc_feature (249)..(249): n is either a, c, g or t
  misc_feature (262)..(262): n is either a, c, g or t
  misc_feature (326)..(326): n is either a, c, g or t
atgtgttgatggttcggtgttaagttttttataatngttagnttttcgttatttttttgttggaggtgttaggtgcggagaggcgagggggttcgcgtgcgtcgtaggaggtttagttgggttcgtcgtcgttcgtgtttgcgtttatttagtgtgtatatagtntagcgttcgtcgtatgttaggtttggtgttgggttttcgtttcggagttggggtgtaggggttgtcgcgttttgtcgggtcganttcgggtgggaantttagatgtttttaagattcgagatagattttcgtttcgcgttttttttggggggcggtttttnggtttgggcgggatgggcgggcggttatttaaggtcggcgattcgaggtcgcggttgtcgattgggttttttgtcgttgtcgttattatggtttcgtatcgtttcgcgttcgcgttgttttgcgcgttgtttttggcgttgtgcgcgttgtcgttgttcgttcgcgcggttattgcgtcgcggggggcgttttaggcgggggcgttttaggggcgggtgttcgaggcgcgggtgagtg

SEQ ID NO: 12292 - DNA, 564 bp, Artificial Sequence
  chemically treated genomic DNA (Homo sapiens) CpG-island No: 12292
  misc_feature (239)..(239): n is either a, c, g or t
  misc_feature (303)..(303): n is either a, c, g or t
  misc_feature (316)..(316): n is either a, c, g or t
  misc_feature (400)..(400): n is either a, c, g or t
  misc_feature (523)..(523): n is either a, c, g or t
  misc_feature (529)..(529): n is either a, c, g or t
cactcacccgcgcctcgaacacccgcccctaaaacgcccccgcctaaaacgccccccgcgacgcaataaccgcgcgaacgaacaacgacaacgcgcacaacgccaaaaacaacgcgcaaaacaacgcgaacgcgaaacgatacgaaaccataataacgacaacgacaaaaaacccaatcgacaaccgcgacctcgaatcgccgaccttaaataaccgcccgcccatcccgcccaaaccnaaaaaccgccccccaaaaaaaacgcgaaacgaaaatctatctcgaatcttaaaaacatctaaanttcccacccgaantcgacccgacaaaacgcgacaacccctacaccccaactccgaaacgaaaacccaacaccaaacctaacatacgacgaacgctanactatatacacactaaataaacgcaaacacgaacgacgacgaacccaactaaacctcctacgacgcacgcgaaccccctcgcctctccgcacctaacacctccaacaaaaaaataacgaaaanctaacnattataaaaaacttaacaccgaaccatcaacacat

SEQ ID NO: 12293 - DNA, 1398 bp, Artificial Sequence
  chemically treated genomic DNA (Homo sapiens) CpG-island No: 12293
taggtcgcgtttagtcgagggggttttcgggcgcggtgcgtattgttcgtttttttattgttttttttcgcgttttcgttttcgcggggtcgttgggcgttcggggaggcgagggtgtcgaggtcggaaaatgagcgttgttcgaagggtggttcggagttgtaggtaacgcggtttagagtttaggtcggagcgggtttcgtatatcgtttttttttcgtagcgattcgcgggttgcgtttagggattgcgtcgggcgttcgggttgtagggacgcgggcgcgggggaggcgcggttagttttgttttgggggacggtcgcgtttttcgttggttttgtagttacgtttcggcggttgtttttgggagcggcgggaggcggtttcggtgagttaggtcggcgcggtagatgtttgggaagatggagaagtttttgtagatcgcgttttattttttggttatcgttttgggttcggtagaggcgtcggcgggggaaaggttaggggtagttcggttcgcgttttcggtttagtttcgttagttcgttcggtattatatcggttacgagattttcgtcgattttaaagtcgagaatatgtagtatttttggaataagaaggttacggtcgcggtggtcgagattttttttttgggttggatcgacgagtaggttttgttgatttagggtaaggaggaatatttggaggcgttgcgcgaaggttggacgcgtcgggttttgcggtcgttttcgggtttttatattcgttgtttgggtgagtgcgatcgtcgcgcgttcgtttcgtttttttttatcggatcgcgttcgtgtcgtgcggtcgcgggtgtttcgttttgttttagttcgtcgcgggtatcgtcgaggtttttttgggtgttcgcgtttttgtcgggggaggagtcgggggttttttgcgagcgtgggattggggaattttttggtatcgaaaggagggagtcgttttattttcggtgcgtcgttttcgtttgttcgcgggagttttttcggtggcgggcggtgtttgaggtcggttaggtgggcgtcgcggttcggcgggcggttcggagggcgcggcgttcggggcgcgtgagtgtttttttttcggtattgtttcgcggttggagtgcgcgggtcgggcggaggtgggcggggaggatttcggggttcgggtcgcgcggggtttttagttggagcggcggtttaggtgcgttcgggacgtttttttttgggcggcgattgcgggggacgcgtcgggaagttagggttgaggttgagtgttgcgcgtacgtattttttaacgaggtaaggttgtagagttcgttttaaatgttttatttgtagtatattttttaagtcgttttgtgtgtttgagggaagga

SEQ ID NO: 12294 - DNA, 1398 bp, Artificial Sequence
  chemically treated genomic DNA (Homo sapiens) CpG-island No: 12294
tccttccctcaaacacacaaaacgacttaaaaaatatactacaaataaaacatttaaaacgaactctacaaccttacctcgttaaaaaatacgtacgcgcaacactcaacctcaaccctaacttcccgacgcgtcccccgcaatcgccgcccaaaaaaaaacgtcccgaacgcacctaaaccgccgctccaactaaaaaccccgcgcgacccgaaccccgaaatcctccccgcccacctccgcccgacccgcgcactccaaccgcgaaacaataccgaaaaaaaaacactcacgcgccccgaacgccgcgccctccgaaccgcccgccgaaccgcgacgcccacctaaccgacctcaaacaccgcccgccaccgaaaaaactcccgcgaacaaacgaaaacgacgcaccgaaaataaaacgactccctcctttcgataccaaaaaattccccaatcccacgctcgcaaaaaacccccgactcctcccccgacaaaaacgcgaacacccaaaaaaacctcgacgatacccgcgacgaactaaaacaaaacgaaacacccgcgaccgcacgacacgaacgcgatccgataaaaaaaaacgaaacgaacgcgcgacgatcgcactcacccaaacaacgaatataaaaacccgaaaacgaccgcaaaacccgacgcgtccaaccttcgcgcaacgcctccaaatattcctccttaccctaaatcaacaaaacctactcgtcgatccaacccaaaaaaaaaatctcgaccaccgcgaccgtaaccttcttattccaaaaatactacatattctcgactttaaaatcgacgaaaatctcgtaaccgatataataccgaacgaactaacgaaactaaaccgaaaacgcgaaccgaactacccctaacctttcccccgccgacgcctctaccgaacccaaaacgataaccaaaaaataaaacgcgatctacaaaaacttctccatcttcccaaacatctaccgcgccgacctaactcaccgaaaccgcctcccgccgctcccaaaaacaaccgccgaaacgtaactacaaaaccaacgaaaaacgcgaccgtcccccaaaacaaaactaaccgcgcctcccccgcgcccgcgtccctacaacccgaacgcccgacgcaatccctaaacgcaacccgcgaatcgctacgaaaaaaaaacgatatacgaaacccgctccgacctaaactctaaaccgcgttacctacaactccgaaccacccttcgaacaacgctcattttccgacctcgacaccctcgcctccccgaacgcccaacgaccccgcgaaaacgaaaacgcgaaaaaaaacaataaaaaaacgaacaatacgcaccgcgcccgaaaaccccctcgactaaacgcgaccta

SEQ ID NO: 12295 - DNA, 1398 bp, Artificial Sequence
  chemically treated genomic DNA (Homo sapiens) CpG-island No: 12295
ttttttttttagatatataaaacgatttgagagatgtgttgtaggtgagatatttaagacgaattttgtagttttgtttcgttgagaaatgcgtgcgcgtaatatttagttttaattttagtttttcggcgcgtttttcgtagtcgtcgtttagggaagggcgtttcgggcgtatttgagtcgtcgttttagttgggagtttcgcgcgattcgagtttcggaatttttttcgtttattttcgttcggttcgcgtattttagtcgcggagtagtgtcgggagggggatatttacgcgtttcgagcgtcgcgtttttcgagtcgttcgtcgagtcgcggcgtttatttggtcggttttaggtatcgttcgttatcggggaggttttcgcgggtaggcgggggcggcgtatcgggaatgggacggtttttttttttcggtgttaggaagttttttaattttacgttcgtagagggttttcggtttttttttcggtagggacgcgggtatttaggggagtttcggcggtgttcgcggcgggttggggtagggcggggtattcgcgatcgtacggtacggacgcgattcggtgggaagggacgggacgggcgcgcggcggtcgtatttatttaggtagcggatgtggaagttcgagggcggtcgtagggttcggcgcgtttagttttcgcgtagcgtttttagatgtttttttttgttttggattagtaggatttgttcgtcgatttagtttaggaagaaggtttcggttatcgcggtcgtgatttttttgttttagaagtgttgtatgttttcggttttgaagtcggcgaagatttcgtagtcgatgtggtgtcgggcgagttggcggggttgggtcgggggcgcgggtcgggttgtttttggtttttttttcgtcggcgtttttgtcgggtttaggacgatggttagggagtgaggcgcgatttgtagaaatttttttatttttttaggtatttgtcgcgtcgatttggtttatcgaggtcgtttttcgtcgtttttaggaatagtcgtcgggacgtggttgtaagattagcggggagcgcgatcgttttttagggtagggttggtcgcgtttttttcgcgttcgcgtttttgtagttcgggcgttcggcgtagtttttgggcgtagttcgcgggtcgttgcggggaagggacggtgtgcggggttcgtttcggtttgagttttggatcgcgttatttgtagtttcgggttatttttcgggtagcgtttatttttcggtttcggtattttcgttttttcgggcgtttagcggtttcgcgggggcggagacgcgggaggaggtagtgagggggcgggtagtgcgtatcgcgttcgggaattttttcggttggacgcggtttg

SEQ ID NO: 12296 - DNA, 1398 bp, Artificial Sequence
  chemically treated genomic DNA (Homo sapiens) CpG-island No: 12296
caaaccgcgtccaaccgaaaaaattcccgaacgcgatacgcactacccgccccctcactacctcctcccgcgtctccgcccccgcgaaaccgctaaacgcccgaaaaaacgaaaataccgaaaccgaaaaataaacgctacccgaaaaataacccgaaactacaaataacgcgatccaaaactcaaaccgaaacgaaccccgcacaccgtcccttccccgcaacgacccgcgaactacgcccaaaaactacgccgaacgcccgaactacaaaaacgcgaacgcgaaaaaaacgcgaccaaccctaccctaaaaaacgatcgcgctccccgctaatcttacaaccacgtcccgacgactattcctaaaaacgacgaaaaacgacctcgataaaccaaatcgacgcgacaaatacctaaaaaaataaaaaaatttctacaaatcgcgcctcactccctaaccatcgtcctaaacccgacaaaaacgccgacgaaaaaaaaaccaaaaacaacccgacccgcgcccccgacccaaccccgccaactcgcccgacaccacatcgactacgaaatcttcgccgacttcaaaaccgaaaacatacaacacttctaaaacaaaaaaatcacgaccgcgataaccgaaaccttcttcctaaactaaatcgacgaacaaatcctactaatccaaaacaaaaaaaaacatctaaaaacgctacgcgaaaactaaacgcgccgaaccctacgaccgccctcgaacttccacatccgctacctaaataaatacgaccgccgcgcgcccgtcccgtcccttcccaccgaatcgcgtccgtaccgtacgatcgcgaataccccgccctaccccaacccgccgcgaacaccgccgaaactcccctaaatacccgcgtccctaccgaaaaaaaaaccgaaaaccctctacgaacgtaaaattaaaaaacttcctaacaccgaaaaaaaaaaaccgtcccattcccgatacgccgcccccgcctacccgcgaaaacctccccgataacgaacgatacctaaaaccgaccaaataaacgccgcgactcgacgaacgactcgaaaaacgcgacgctcgaaacgcgtaaatatccccctcccgacactactccgcgactaaaatacgcgaaccgaacgaaaataaacgaaaaaaattccgaaactcgaatcgcgcgaaactcccaactaaaacgacgactcaaatacgcccgaaacgcccttccctaaacgacgactacgaaaaacgcgccgaaaaactaaaattaaaactaaatattacgcgcacgcatttctcaacgaaacaaaactacaaaattcgtcttaaatatctcacctacaacacatctctcaaatcgttttatatatctaaaaaaaaaa

SEQ ID NO: 12297 - DNA, 680 bp, Artificial Sequence
  chemically treated genomic DNA (Homo sapiens) CpG-island No: 12297
ggtcgcggcgtatcgagtacgtttcgcggtttcggttcgggggtagaaacgcggttattaattaatttgatgttatgtagtttcgcgaagtttggggcgcgaaggtcgcggggaaacgtttgtgtaggcggtagtttttttcgttgcgggattttatgcggttcgaggttcggttcgagaaattcgagttaggttaggttcgtcgtaaggttgtgtttcgggttttttttatggtggggagggcgatttgtcgtttcgattttcggggttttatcgtcggggcgtagcgcgtttttttattcgtttacggcgggtacgattcgggcggattttgcgtatatttttttagttttttttcgtcggcgtttatatcgttagcggcgggttcggttttttttacgtttttttatatttttacggcgaaggtttcgattttatatacgttttataatgtattatattttatttgtaattcgttcggtttatagtttttagatttttggggggaaaggtacgttaggaggtttttcggtcgggaggaggcggggagggggcgggcggggtgggggcgtcgagatttgtagcgtgaaggtaatgggagcgtagataatggttcgatttagcgtaggagtgtttggttaattgggagttacggtataaaagatttaaataaatgaggt

SEQ ID NO: 12298 - DNA, 680 bp, Artificial Sequence
  chemically treated genomic DNA (Homo sapiens) CpG-island No: 12298
acctcatttatttaaatcttttataccgtaactcccaattaaccaaacactcctacgctaaatcgaaccattatctacgctcccattaccttcacgctacaaatctcgacgcccccaccccgcccgccccctccccgcctcctcccgaccgaaaaacctcctaacgtacctttccccccaaaaatctaaaaactataaaccgaacgaattacaaataaaatataatacattataaaacgtatataaaatcgaaaccttcgccgtaaaaatataaaaaaacgtaaaaaaaaccgaacccgccgctaacgatataaacgccgacgaaaaaaaactaaaaaaatatacgcaaaatccgcccgaatcgtacccgccgtaaacgaataaaaaaacgcgctacgccccgacgataaaaccccgaaaatcgaaacgacaaatcgccctccccaccataaaaaaaacccgaaacacaaccttacgacgaacctaacctaactcgaatttctcgaaccgaacctcgaaccgcataaaatcccgcaacgaaaaaaactaccgcctacacaaacgtttccccgcgaccttcgcgccccaaacttcgcgaaactacataacatcaaattaattaataaccgcgtttctacccccgaaccgaaaccgcgaaacgtactcgatacgccgcgacc

SEQ ID NO: 12299 - DNA, 680 bp, Artificial Sequence
  chemically treated genomic DNA (Homo sapiens) CpG-island No: 12299
gttttatttgtttgggttttttgtgtcgtggtttttagttggttaagtatttttgcgttgaatcgggttattgtttgcgtttttattgtttttacgttgtaagtttcggcgtttttatttcgttcgtttttttttcgttttttttcggtcggggagttttttaacgtgtttttttttttaggaatttggaagttataagtcgggcggattgtaaatgaagtgtaatgtattgtgggacgtgtgtaaaatcggagttttcgtcgtgggggtgtgggggggcgtggggagggtcggattcgtcgttggcggtgtagacgtcgacgaggaggggttgggaaaatgtgcgtagagttcgttcgggtcgtgttcgtcgtagacggatgaaggagcgcgttgcgtttcggcgatgaggtttcgaggatcggggcggtaggtcgttttttttattatgaagaagattcggagtataattttgcggcgagtttggtttagttcggatttttcggatcgggtttcggatcgtatgaggtttcgtagcgagaaggattatcgtttgtataagcgttttttcgcggttttcgcgttttaggtttcgcggggttatatgatattaggttggttggtgatcgcgtttttgttttcgggtcggggtcgcgggacgtgttcggtacgtcgcggtt

SEQ ID NO: 12300 - DNA, 680 bp, Artificial Sequence
  chemically treated genomic DNA (Homo sapiens) CpG-island No: 12300
aaccgcgacgtaccgaacacgtcccgcgaccccgacccgaaaacaaaaacgcgatcaccaaccaacctaatatcatataaccccgcgaaacctaaaacgcgaaaaccgcgaaaaaacgcttatacaaacgataatccttctcgctacgaaacctcatacgatccgaaacccgatccgaaaaatccgaactaaaccaaactcgccgcaaaattatactccgaatcttcttcataataaaaaaaacgacctaccgccccgatcctcgaaacctcatcgccgaaacgcaacgcgctccttcatccgtctacgacgaacacgacccgaacgaactctacgcacattttcccaacccctcctcgtcgacgtctacaccgccaacgacgaatccgaccctccccacgcccccccacacccccacgacgaaaactccgattttacacacgtcccacaatacattacacttcatttacaatccgcccgacttataacttccaaattcctaaaaaaaaaaacacgttaaaaaactccccgaccgaaaaaaaacgaaaaaaaaacgaacgaaataaaaacgccgaaacttacaacgtaaaaacaataaaaacgcaaacaataacccgattcaacgcaaaaatacttaaccaactaaaaaccacgacacaaaaaacccaaacaaataaaac

SEQ ID NO: 12301 - DNA, 611 bp, Artificial Sequence
  chemically treated genomic DNA (Homo sapiens) CpG-island No: 12301
tcgggatcgggcgtgcgggaggtcggaggggcggcggtagatttttcgcgtcgggtagtttagcgcgaggcgtggggatgatagtgttcgagtcgtgttttcgcgggtttattagtcgtacggttcgtagttttcggcgttggttggttttgttttcgttgtagttttcgggagatagtttttattatagaggttcgagcggggggcgcgtgtgtataggattcgagtaggttttgtagatagtagttgcggcgggcgggtttttgcggaatttaggaagagttcgcgtcgttttcgcgattgtagcgtttcgttaattttttttttgtcgaggtttcgggcgttgtgcgtgcgcgcgggtggatggttgggtgggtgcgtcgatacgtatgtgttttttatatatgtatgtttttatttattggtcgaggcggcgtcggagttatggttgttaaggacgtcgagtttgcgatcgattttcgcgcggcggtagcgttgtttcggcgcgagcgcgcggaacggttattgaagggtaggaagtaggatagtcgtttagttttatgttaattattaggttgttttaagttagaacgcggtttttattaggtttt

SEQ ID NO: 12302 - DNA, 611 bp, Artificial Sequence
  chemically treated genomic DNA (Homo sapiens) CpG-island No: 12302
aaaacctaataaaaaccgcgttctaacttaaaacaacctaataattaacataaaactaaacgactatcctacttcctacccttcaataaccgttccgcgcgctcgcgccgaaacaacgctaccgccgcgcgaaaatcgatcgcaaactcgacgtccttaacaaccataactccgacgccgcctcgaccaataaataaaaacatacatatataaaaaacacatacgtatcgacgcacccacccaaccatccacccgcgcgcacgcacaacgcccgaaacctcgacaaaaaaaaaattaacgaaacgctacaatcgcgaaaacgacgcgaactcttcctaaattccgcaaaaacccgcccgccgcaactactatctacaaaacctactcgaatcctatacacacgcgccccccgctcgaacctctataataaaaactatctcccgaaaactacaacgaaaacaaaaccaaccaacgccgaaaactacgaaccgtacgactaataaacccgcgaaaacacgactcgaacactatcatccccacgcctcgcgctaaactacccgacgcgaaaaatctaccgccgcccctccgacctcccgcacgcccgatcccga

SEQ ID NO: 12303 - DNA, 611 bp, Artificial Sequence
  chemically treated genomic DNA (Homo sapiens) CpG-island No: 12303
gaagtttgatgggaatcgcgttttaatttaaggtagtttggtgattagtatgagattgggcggttgttttgttttttgttttttaatagtcgtttcgcgcgttcgcgtcggagtagcgttgtcgtcgcgcgggggtcgatcgtaggttcggcgtttttggtagttatggtttcggcgtcgtttcggttagtaagtaggagtatgtatgtgtagggggtatatgcgtgtcggcgtatttatttagttatttattcgcgcgtacgtatagcgttcggagtttcggtaaggggaagattgacgaggcgttgtagtcgcggggacgacgcgggttttttttggatttcgtaggagttcgttcgtcgtagttgttgtttgtagagtttgttcggattttgtgtatacgcgtttttcgttcgagtttttgtgatgaagattgtttttcggggattgtagcggaggtagagttagttagcgtcggggattgcgggtcgtgcggttgataggttcgcggggatacgattcggatattgttatttttacgtttcgcgttgagttgttcggcgcggagggtttgtcgtcgttttttcggtttttcgtacgttcgatttcgg

SEQ ID NO: 12304 - DNA, 611 bp, Artificial Sequence
  chemically treated genomic DNA (Homo sapiens) CpG-island No: 12304
ccgaaatcgaacgtacgaaaaaccgaaaaaacgacgacaaaccctccgcgccgaacaactcaacgcgaaacgtaaaaataacaatatccgaatcgtatccccgcgaacctatcaaccgcacgacccgcaatccccgacgctaactaactctacctccgctacaatccccgaaaaacaatcttcatcacaaaaactcgaacgaaaaacgcgtatacacaaaatccgaacaaactctacaaacaacaactacgacgaacgaactcctacgaaatccaaaaaaaacccgcgtcgtccccgcgactacaacgcctcgtcaatcttccccttaccgaaactccgaacgctatacgtacgcgcgaataaataactaaataaatacgccgacacgcatataccccctacacatacatactcctacttactaaccgaaacgacgccgaaaccataactaccaaaaacgccgaacctacgatcgacccccgcgcgacgacaacgctactccgacgcgaacgcgcgaaacgactattaaaaaacaaaaaacaaaacaaccgcccaatctcatactaatcaccaaactaccttaaattaaaacgcgattcccatcaaacttc

SEQ ID NO: 12305 - DNA, 791 bp, Artificial Sequence
  chemically treated genomic DNA (Homo sapiens) CpG-island No: 12305
cgaggtcgaggagagggtagcgcgttcgtggtggggtcgtttagtattgcgagtcgcgttgaattttattttcggtttgtagggtgcggttttttggttgtttcgtggattcggttagttcgggacgaggacgtaggatttcggtagggacgtcggagttagtttttcgttatttttatacgtttcgcggtttagtggtcgcgcgtacgttatttgcggagttcggttttgttcgttcgtttgggttgtcgtttttcgttatggatgttttcgttttcgcggtcgtttttgattcgcgtacgtttttcgggtaggaagtagaacgattcgcgattattttcggcgtcgagggtaatggggggcgcgtcggggtcgcggttttcggcgggcgcgcgtcggttttattggttttcggggtcgcgtaggggttacgttttcgttttcggtttcgttgtttagtagggcgttggttggttttttcgttcggcgggaatttcgcgattaatcgattttttggatgtcggtcgcgttgtggtttttttatataagaagttaaggagtcggaaagtcgggtgtttgaggtagtagtttgggaatttcggttcggcgggtcgtttttatttatacggacggggcgtggtttttgttagatgcgggcggggtttcgagggtcgtggcgggcgggattcgggtttcggtcgggttggtttggttttcgtaggtgtttttcgttagttacgagtagtttcgggagggtggattcggaggcgcggggattggtgagggtttat

SEQ ID NO: 12306 - DNA, 791 bp, Artificial Sequence
  chemically treated genomic DNA (Homo sapiens) CpG-island No: 12306
ataaaccctcaccaatccccgcgcctccgaatccaccctcccgaaactactcgtaactaacgaaaaacacctacgaaaaccaaaccaacccgaccgaaacccgaatcccgcccgccacgaccctcgaaaccccgcccgcatctaacaaaaaccacgccccgtccgtataaataaaaacgacccgccgaaccgaaattcccaaactactacctcaaacacccgactttccgactccttaacttcttatataaaaaaaccacaacgcgaccgacatccaaaaaatcgattaatcgcgaaattcccgccgaacgaaaaaaccaaccaacgccctactaaacaacgaaaccgaaaacgaaaacgtaacccctacgcgaccccgaaaaccaataaaaccgacgcgcgcccgccgaaaaccgcgaccccgacgcgccccccattaccctcgacgccgaaaataatcgcgaatcgttctacttcctacccgaaaaacgtacgcgaatcaaaaacgaccgcgaaaacgaaaacatccataacgaaaaacgacaacccaaacgaacgaacaaaaccgaactccgcaaataacgtacgcgcgaccactaaaccgcgaaacgtataaaaataacgaaaaactaactccgacgtccctaccgaaatcctacgtcctcgtcccgaactaaccgaatccacgaaacaaccaaaaaaccgcaccctacaaaccgaaaataaaattcaacgcgactcgcaatactaaacgaccccaccacgaacgcgctaccctctcctcgacctcg

SEQ ID NO: 12307 - DNA, 791 bp, Artificial Sequence
  chemically treated genomic DNA (Homo sapiens) CpG-island No: 12307
gtgggtttttattagttttcgcgttttcgaatttattttttcggggttgttcgtggttagcggggggtatttgcggggattaagttagttcggtcgaggttcgggtttcgttcgttacggttttcggggtttcgttcgtatttggtagaagttacgtttcgttcgtgtgggtggggacggttcgtcggatcgaaatttttagattgttgttttaggtattcggtttttcgattttttggttttttatgtgaggaaattatagcgcggtcggtatttagagagtcggttagtcgcgaagttttcgtcggacgaagggattagttagcgttttgttagatagcgaggtcggaagcggaggcgtggtttttgcgcggtttcggaaattagtgaggtcggcgcgcgttcgtcggaagtcgcgatttcgacgcgttttttattgttttcggcgtcggaagtggtcgcgggtcgttttgttttttgttcgaggggcgtgcgcgggttaggggcggtcgcggaggcggaagtatttatggcggagggcggtagtttagacgggcgggtagggtcgggtttcgtaggtaacgtgcgcgcggttattgggtcgcggggcgtgtggggatggcgaagggttggtttcggcgtttttgtcgaggttttgcgttttcgtttcgggttggtcgggtttacggggtagttagggagtcgtattttgtaggtcgggggtggggtttagcgcggttcgtagtgttgggcgattttattacggacgcgttgtttttttttcggtttcg

SEQ ID NO: 12308 - DNA, 791 bp, Artificial Sequence
  chemically treated genomic DNA (Homo sapiens) CpG-island No: 12308
cgaaaccgaaaaaaaaacaacgcgtccgtaataaaatcgcccaacactacgaaccgcgctaaaccccacccccgacctacaaaatacgactccctaactaccccgtaaacccgaccaacccgaaacgaaaacgcaaaacctcgacaaaaacgccgaaaccaacccttcgccatccccacacgccccgcgacccaataaccgcgcgcacgttacctacgaaacccgaccctacccgcccgtctaaactaccgccctccgccataaatacttccgcctccgcgaccgcccctaacccgcgcacgcccctcgaacaaaaaacaaaacgacccgcgaccacttccgacgccgaaaacaataaaaaacgcgtcgaaatcgcgacttccgacgaacgcgcgccgacctcactaatttccgaaaccgcgcaaaaaccacgcctccgcttccgacctcgctatctaacaaaacgctaactaatcccttcgtccgacgaaaacttcgcgactaaccgactctctaaataccgaccgcgctataatttcctcacataaaaaaccaaaaaatcgaaaaaccgaatacctaaaacaacaatctaaaaatttcgatccgacgaaccgtccccacccacacgaacgaaacgtaacttctaccaaatacgaacgaaaccccgaaaaccgtaacgaacgaaacccgaacctcgaccgaactaacttaatccccgcaaataccccccgctaaccacgaacaaccccgaaaaaataaattcgaaaacgcgaaaactaataaaaacccac

SEQ ID NO: 12309 - DNA, 902 bp, Artificial Sequence
  chemically treated genomic DNA (Homo sapiens) CpG-island No: 12309
tcgtaaggttggtgtcggtcgataaacgacgcggcgcgggcgagtgggcggaggcggttgcggggaaggttgggttgtcgcgggacgcggtgaagatagtttgcggagtgttcgggttgaatacgtgagtttgagggtcgttagggaattattgcgtggttgtttttgtgtcggagatttagatgtttggattggtttcggggttttagcgtttgttcggcgagtcggcggttcggggacgggttcgggtcgaggtttgcggtgaattcggttcggcgggtgtttaggaggcgggttcggggcggggtttgcggtgaattcggttcggcgggtgtttaggaggcgggttcggggcggggtttgcggtgaattcggttcggcgggtgtttaggaggcgggttcggggcggggtttgcggtgaattcggttcggcgggtgtttaggaggcggggtaggggcggggtttgtagtgagcgcggtttggtgagtagtttaggaggcgggttcggggcggggtttgcggtgagttcggttcggggggttgtttaggaggtggggtcggggtaggtttggggcggggtttgcggtgagttcgcgttgggcgggttgtttcgggggcgggattgggttgggtttgcggtgagtattaggcgatgcggtacgggtgttgcgggatatatagatacgtttacgattagatttaggtaggtatttatcggcgagcggtcgcgggtgatttttaggcgcggcggtattttacggtggtgaaggttataggtgaggttattttgatagtttcgttcgcgtcgagagtttttttttcgatttgggatcgtagtgtttggggcggggtttttcgtgagggggttgggaagttcgaagtcgtaggtttgattttggtt

SEQ ID NO: 12310 - DNA, 902 bp, Artificial Sequence
  chemically treated genomic DNA (Homo sapiens) CpG-island No: 12310
aaccaaaatcaaacctacgacttcgaacttcccaaccccctcacgaaaaaccccgccccaaacactacgatcccaaatcgaaaaaaaaactctcgacgcgaacgaaactatcaaaataacctcacctataaccttcaccaccgtaaaataccgccgcgcctaaaaatcacccgcgaccgctcgccgataaatacctacctaaatctaatcgtaaacgtatctatatatcccgcaacacccgtaccgcatcgcctaatactcaccgcaaacccaacccaatcccgcccccgaaacaacccgcccaacgcgaactcaccgcaaaccccgccccaaacctaccccgaccccacctcctaaacaaccccccgaaccgaactcaccgcaaaccccgccccgaacccgcctcctaaactactcaccaaaccgcgctcactacaaaccccgcccctaccccgcctcctaaacacccgccgaaccgaattcaccgcaaaccccgccccgaacccgcctcctaaacacccgccgaaccgaattcaccgcaaaccccgccccgaacccgcctcctaaacacccgccgaaccgaattcaccgcaaaccccgccccgaacccgcctcctaaacacccgccgaaccgaattcaccgcaaacctcgacccgaacccgtccccgaaccgccgactcgccgaacaaacgctaaaaccccgaaaccaatccaaacatctaaatctccgacacaaaaacaaccacgcaataattccctaacgaccctcaaactcacgtattcaacccgaacactccgcaaactatcttcaccgcgtcccgcgacaacccaaccttccccgcaaccgcctccgcccactcgcccgcgccgcgtcgtttatcgaccgacaccaaccttacga

SEQ ID NO: 12311 - DNA, 902 bp, Artificial Sequence
  chemically treated genomic DNA (Homo sapiens) CpG-island No: 12311
ggttagagttaggtttgcggtttcgagttttttaatttttttacggagagtttcgttttaaatattgcggttttaggtcgaggggagggttttcggcgcgagcgggattattagggtgattttatttgtgatttttattatcgtgaggtatcgtcgcgtttgggagttattcgcggtcgttcgtcggtaggtgtttgtttgagtttaatcgtaggcgtgtttgtgtgtttcgtagtattcgtgtcgtatcgtttgatgtttatcgtaggtttagtttagtttcgttttcggaatagttcgtttagcgcgagtttatcgtaggtttcgttttaggtttgtttcggttttattttttgagtaatttttcgagtcgagtttatcgtaggtttcgtttcggattcgttttttgggttatttattaagtcgcgtttattgtaggtttcgtttttgtttcgttttttgggtattcgtcgagtcgagtttatcgtaggtttcgtttcggattcgttttttgggtattcgtcgagtcgagtttatcgtaggtttcgtttcggattcgttttttgggtattcgtcgagtcgagtttatcgtaggtttcgtttcggattcgttttttgggtattcgtcgagtcgagtttatcgtaggtttcggttcggattcgttttcggatcgtcggttcgtcgggtaagcgttgggatttcgaggttagtttaggtatttggattttcgatatagaggtagttacgtagtgattttttggcgatttttagatttacgtgtttagttcggatatttcgtaggttatttttatcgcgtttcgcggtagtttagtttttttcgtagtcgttttcgtttattcgttcgcgtcgcgtcgtttgtcggtcggtattagttttgcgg

SEQ ID NO: 12312 - DNA, 902 bp, Artificial Sequence
  chemically treated genomic DNA (Homo sapiens) CpG-island No: 12312
ccgcaaaactaataccgaccgacaaacgacgcgacgcgaacgaataaacgaaaacgactacgaaaaaaactaaactaccgcgaaacgcgataaaaataacctacgaaatatccgaactaaacacgtaaatctaaaaatcgccaaaaaatcactacgtaactacctctatatcgaaaatccaaatacctaaactaacctcgaaatcccaacgcttacccgacgaaccgacgatccgaaaacgaatccgaaccgaaacctacgataaactcgactcgacgaatacccaaaaaacgaatccgaaacgaaacctacgataaactcgactcgacgaatacccaaaaaacgaatccgaaacgaaacctacgataaactcgactcgacgaatacccaaaaaacgaatccgaaacgaaacctacgataaactcgactcgacgaatacccaaaaaacgaaacaaaaacgaaacctacaataaacgcgacttaataaataacccaaaaaacgaatccgaaacgaaacctacgataaactcgactcgaaaaattactcaaaaaataaaaccgaaacaaacctaaaacgaaacctacgataaactcgcgctaaacgaactattccgaaaacgaaactaaactaaacctacgataaacatcaaacgatacgacacgaatactacgaaacacacaaacacgcctacgattaaactcaaacaaacacctaccgacgaacgaccgcgaataactcccaaacgcgacgatacctcacgataataaaaatcacaaataaaatcaccctaataatcccgctcgcgccgaaaaccctcccctcgacctaaaaccgcaatatttaaaacgaaactctccgtaaaaaaattaaaaaactcgaaaccgcaaacctaactctaacc

SEQ ID NO: 12313 - DNA, 1390 bp, Artificial Sequence
  chemically treated genomic DNA (Homo sapiens) CpG-island No: 12313
acgcgttcgggtgaggtgtttagtaggtgttgtcggaagcgtagtagcgcgtatacgaaatcgtttcgtaggttgataaagcgcgtttttaggtagaacgcgcggtcgttttagtttagtaggcgggtgcgtatttcgaagggttttagtaggcgtagcgagcggcggtggcgcgcgtacgaggtcgttagtatcgtgtgcgttcgtaatttttttagcgtttcgagtatttcgtagcgggttaggtgcgcgacgcgcgtaaagtcggtttcgcgtaggtagcgcgcgttgtttatgtgtaatagtaggtttaagttcgagggtagtacgcggttcgggaagcgttgtttagttagtaggttacggacgcgcggttgtagtaggcgcgcgcgtagtacggcgtacggaaggcgtattaggtattagacgtttagtagcgtaaagatagcgagttttagggttagtaacgttattagtagttttagtatagcggcggcggcgggcgcggggttttgcggagttcgtggcgtcggtgtcggtgttcgcggcgttggttacggtgttcgttaggttttttgggaattcgcgagcgtagcgcgttcggagcgaattatagcgcgagggcggtcgagggggaggggttcggagtttcgtttatcgtggcgcgatttttttagcgttttacgtggttcgtttcgtcgtttaggttcgcgttattttcgcgttttttggggcggggcgggcggcgcgttgagcgttatagcggtatttggcggtcgtgcgcggcgttgtaggcgcgagggtgtacgcgcgtttcggcgttttcgtttttttagtagcgcgagattttcgttaggttttgaagacgcggtttggttttggtcgttcggtttttcgtttgagcgtaaaggttttagtattttcgcggtcgaagtcgcgggatttttcgtggaaaatgggatttagttcgatcgttagcggcgttgtagcggattttgcgggaatttagtttttgttttaggatttttagggttattttagttcgtagggcgttcgtagcggtttagggcgaattatttttatggttttcgtgcgtatttttagttttagtcggtatttttttattcgtttttacgatatttattttattttttaaaggttttgttaattttaggtttttttcgagtattttcgtttttttttttttttgaaatcggagtaaattacggtcgggcggaagcgggggagttcgggtgagagttagtgatttagttgcggattttaagtgtcgtcggaggttttggggcgtaggtttagcgggttgtcgcgtagttcggttgttttgtgtttttttttgacgaggttggggaggaaaggcggtttagagaag

SEQ ID NO: 12314 - DNA, 1390 bp, Artificial Sequence
  chemically treated genomic DNA (Homo sapiens) CpG-island No: 12314
cttctctaaaccgcctttcctccccaacctcgtcaaaaaaaaacacaaaacaaccgaactacgcgacaacccgctaaacctacgccccaaaacctccgacgacacttaaaatccgcaactaaatcactaactctcacccgaactcccccgcttccgcccgaccgtaatttactccgatttcaaaaaaaaaaaaaaacgaaaatactcgaaaaaaacctaaaattaacaaaacctttaaaaaataaaataaatatcgtaaaaacgaataaaaaaataccgactaaaactaaaaatacgcacgaaaaccataaaaataattcgccctaaaccgctacgaacgccctacgaactaaaataaccctaaaaatcctaaaacaaaaactaaattcccgcaaaatccgctacaacgccgctaacgatcgaactaaatcccattttccacgaaaaatcccgcgacttcgaccgcgaaaatactaaaacctttacgctcaaacgaaaaaccgaacgaccaaaaccaaaccgcgtcttcaaaacctaacgaaaatctcgcgctactaaaaaaacgaaaacgccgaaacgcgcgtacaccctcgcgcctacaacgccgcgcacgaccgccaaataccgctataacgctcaacgcgccgcccgccccgccccaaaaaacgcgaaaataacgcgaacctaaacgacgaaacgaaccacgtaaaacgctaaaaaaatcgcgccacgataaacgaaactccgaacccctccccctcgaccgccctcgcgctataattcgctccgaacgcgctacgctcgcgaattcccaaaaaacctaacgaacaccgtaaccaacgccgcgaacaccgacaccgacgccacgaactccgcaaaaccccgcgcccgccgccgccgctatactaaaactactaataacgttactaaccctaaaactcgctatctttacgctactaaacgtctaatacctaatacgccttccgtacgccgtactacgcgcgcgcctactacaaccgcgcgtccgtaacctactaactaaacaacgcttcccgaaccgcgtactaccctcgaacttaaacctactattacacataaacaacgcgcgctacctacgcgaaaccgactttacgcgcgtcgcgcacctaacccgctacgaaatactcgaaacgctaaaaaaattacgaacgcacacgatactaacgacctcgtacgcgcgccaccgccgctcgctacgcctactaaaacccttcgaaatacgcacccgcctactaaactaaaacgaccgcgcgttctacctaaaaacgcgctttatcaacctacgaaacgatttcgtatacgcgctactacgcttccgacaacacctactaaacacctcacccgaacgcgt

SEQ ID NO: 12315 - DNA, 1390 bp, Artificial Sequence
  chemically treated genomic DNA (Homo sapiens) CpG-island No: 12315
tttttttgggtcgttttttttttttagtttcgttaggaaggggtataggatagtcgagttgcgcgatagttcgttgggtttgcgttttagggttttcggcgatatttggagttcgtagttgagttattgatttttattcgggttttttcgttttcgttcggtcgtgatttgtttcggttttaaaagggaggaagggcgggaatgttcgggaagagtttggggttggtaggatttttagggggtggaatgaatgtcgtgagggcgagtaaggaggtatcggttggggttgaaaatgcgtacggggattatgagggtgattcgttttgagtcgttgcgaacgttttgcgagttggggtggttttggaggttttggagtagaagttaggttttcgtagagttcgttgtagcgtcgttggcgatcgggttgggttttattttttacgaaaagtttcgcggtttcggtcgcggaggtgttggagtttttgcgtttagacgaagggtcgaacggttagggttaggtcgcgtttttagagtttggcgagggtttcgcgttgttgggaaggcggagacgtcggggcgcgcgtgtattttcgcgtttgtagcgtcgcgtacggtcgttaggtgtcgttgtggcgtttagcgcgtcgttcgtttcgttttagggaacgcgaaagtggcgcgggtttggacggcgggacggattacgtagggcgttgagaaggtcgcgttacggtgggcggggtttcgggtttttttttttcggtcgttttcgcgttgtggttcgtttcgggcgcgttgcgttcgcgagtttttaggaggtttggcgggtatcgtaattagcgtcgcggatatcggtatcggcgttacggatttcgtaggatttcgcgttcgtcgtcgtcgttatgttggggttgttggtggcgttgttggttttggggttcgttgtttttgcgttgttggacgtttggtatttggtgcgtttttcgtgcgtcgtgttgcgcgcgcgtttgttgtagtcgcgcgttcgtgatttgttagttgagtagcgtttttcgggtcgcgtgttgttttcggatttggatttgttgttgtatatgaataacgcgcgttatttgcgcgaggtcgattttgcgcgcgtcgcgtatttgattcgttgcggggtgttcggggcgttgagggagttgcgggcgtatacggtgttggcggtttcgtgcgcgcgttatcgtcgttcgttgcgtttgttggagtttttcgaggtgcgtattcgtttgttgggttgggacgatcgcgcgttttatttggaggcgcgttttgttagtttgcgggacggtttcgtgtgcgcgttgttgcgttttcggtagtatttgttgggtattttattcgagcgcgt

SEQ ID NO: 12316 - DNA, 1390 bp, Artificial Sequence
  chemically treated genomic DNA (Homo sapiens) CpG-island No: 12316
acgcgctcgaataaaatacccaacaaatactaccgaaaacgcaacaacgcgcacacgaaaccgtcccgcaaactaacaaaacgcgcctccaaataaaacgcgcgatcgtcccaacccaacaaacgaatacgcacctcgaaaaactccaacaaacgcaacgaacgacgataacgcgcgcacgaaaccgccaacaccgtatacgcccgcaactccctcaacgccccgaacaccccgcaacgaatcaaatacgcgacgcgcgcaaaatcgacctcgcgcaaataacgcgcgttattcatatacaacaacaaatccaaatccgaaaacaacacgcgacccgaaaaacgctactcaactaacaaatcacgaacgcgcgactacaacaaacgcgcgcgcaacacgacgcacgaaaaacgcaccaaataccaaacgtccaacaacgcaaaaacaacgaaccccaaaaccaacaacgccaccaacaaccccaacataacgacgacgacgaacgcgaaatcctacgaaatccgtaacgccgataccgatatccgcgacgctaattacgatacccgccaaacctcctaaaaactcgcgaacgcaacgcgcccgaaacgaaccacaacgcgaaaacgaccgaaaaaaaaaaacccgaaaccccgcccaccgtaacgcgaccttctcaacgccctacgtaatccgtcccgccgtccaaacccgcgccactttcgcgttccctaaaacgaaacgaacgacgcgctaaacgccacaacgacacctaacgaccgtacgcgacgctacaaacgcgaaaatacacgcgcgccccgacgtctccgccttcccaacaacgcgaaaccctcgccaaactctaaaaacgcgacctaaccctaaccgttcgacccttcgtctaaacgcaaaaactccaacacctccgcgaccgaaaccgcgaaacttttcgtaaaaaataaaacccaacccgatcgccaacgacgctacaacgaactctacgaaaacctaacttctactccaaaacctccaaaaccaccccaactcgcaaaacgttcgcaacgactcaaaacgaatcaccctcataatccccgtacgcattttcaaccccaaccgatacctccttactcgccctcacgacattcattccaccccctaaaaatcctaccaaccccaaactcttcccgaacattcccgcccttcctcccttttaaaaccgaaacaaatcacgaccgaacgaaaacgaaaaaacccgaataaaaatcaataactcaactacgaactccaaatatcgccgaaaaccctaaaacgcaaacccaacgaactatcgcgcaactcgactatcctataccccttcctaacgaaactaaaaaaaaaaaacgacccaaaaaaa

SEQ ID NO: 12317 - DNA, 627 bp, Artificial Sequence
  chemically treated genomic DNA (Homo sapiens) CpG-island No: 12317
acgaggcgaggttttttagaggtttttaggcgttacgggtcgtttgaacgtttcgtttttacggtttggtcggggcggtggttacgcggtgttaggtagacgtcgttcggttttgttttttcggttcgtggttgtggagggcgagttaggtttattcgttcgttgggagttttttggatttcgttgtttcgtagttaggttggcgtttgtttatattcgcggtagggttacgattagtagtaaggcgacgagcgttatcgtttttagcggtgtttagggagggttagcgcgcggcgtttttttttcgtttttttggaattttcgtagttttcgcgcgtttttttttgggtttggtcggtagggggagtttcgttcgtttcggggcgcgcgttttttattcgtcggggtttgtcggggtttttggagttttattttagggtttcgcggtcgttggcggttttgaacgtcggttttgagtttcgttttgtgttgttgttggagcggtcggcggttaggtaggaacgggcgcgggagttttgggaaaggcgcgtgtggaaacgtagtttttgagtttaagggtcgtttttttgaggattttacggtttatagaaagtggtcggcggttag

SEQ ID NO: 12318 - DNA, 627 bp, Artificial Sequence
  chemically treated genomic DNA (Homo sapiens) CpG-island No: 12318
ctaaccgccgaccactttctataaaccgtaaaatcctcaaaaaaacgacccttaaactcaaaaactacgtttccacacgcgcctttcccaaaactcccgcgcccgttcctacctaaccgccgaccgctccaacaacaacacaaaacgaaactcaaaaccgacgttcaaaaccgccaacgaccgcgaaaccctaaaataaaactccaaaaaccccgacaaaccccgacgaataaaaaacgcgcgccccgaaacgaacgaaactccccctaccgaccaaacccaaaaaaaaacgcgcgaaaactacgaaaattccaaaaaaacgaaaaaaaaacgccgcgcgctaaccctccctaaacaccgctaaaaacgataacgctcgtcgccttactactaatcgtaaccctaccgcgaatataaacaaacgccaacctaactacgaaacaacgaaatccaaaaaactcccaacgaacgaataaacctaactcgccctccacaaccacgaaccgaaaaaacaaaaccgaacgacgtctacctaacaccgcgtaaccaccgccccgaccaaaccgtaaaaacgaaacgttcaaacgacccgtaacgcctaaaaacctctaaaaaacctcgcctcgt

SEQ ID NO: 12319 - DNA, 627 bp, Artificial Sequence
  chemically treated genomic DNA (Homo sapiens) CpG-island No: 12319
ttggtcgtcggttattttttgtgggtcgtggggtttttaaggagacggtttttgggtttaggggttgcgtttttatacgcgttttttttagggttttcgcgttcgtttttgtttggtcgtcggtcgttttaatagtagtataaggcgggatttagaatcggcgtttagggtcgttagcggtcgcgaggttttgagatgaggttttaaagatttcgataggtttcggcgggtgggaggcgcgcgtttcggggcgggcggggttttttttatcggttagatttagggagaggcgcgcggaggttgcgaaggttttagaagggcggggagggggcgtcgcgcgttgattttttttgggtatcgttggggacgatggcgttcgtcgttttgttgttggtcgtggttttatcgcgggtgtggatagacgttaatttgattgcgagataacgagatttagaggatttttagcggacgggtgagtttggttcgttttttatagttacgggtcgagaggatagggtcgggcggcgtttgtttggtatcgcgtggttatcgtttcgattaggtcgtgagaacggagcgtttaggcggttcgtggcgtttggaagtttttggggagtttcgtttcgt

SEQ ID NO: 12320 - DNA, 627 bp, Artificial Sequence
  chemically treated genomic DNA (Homo sapiens) CpG-island No: 12320
acgaaacgaaactccccaaaaacttccaaacgccacgaaccgcctaaacgctccgttctcacgacctaatcgaaacgataaccacgcgataccaaacaaacgccgcccgaccctatcctctcgacccgtaactataaaaaacgaaccaaactcacccgtccgctaaaaatcctctaaatctcgttatctcgcaatcaaattaacgtctatccacacccgcgataaaaccacgaccaacaacaaaacgacgaacgccatcgtccccaacgatacccaaaaaaaatcaacgcgcgacgccccctccccgcccttctaaaaccttcgcaacctccgcgcgcctctccctaaatctaaccgataaaaaaaaccccgcccgccccgaaacgcgcgcctcccacccgccgaaacctatcgaaatctttaaaacctcatctcaaaacctcgcgaccgctaacgaccctaaacgccgattctaaatcccgccttatactactattaaaacgaccgacgaccaaacaaaaacgaacgcgaaaaccctaaaaaaaacgcgtataaaaacgcaacccctaaacccaaaaaccgtctccttaaaaaccccacgacccacaaaaaataaccgacgaccaa

SEQ ID NO: 12321 - DNA, 889 bp, Artificial Sequence
  chemically treated genomic DNA (Homo sapiens) CpG-island No: 12321
agacgttgaaagttggcgttcgttgacgtttcgacgcgttttttttatgacgtatgcgtttatcggtcgtgagcgcgggttcggttttcggtgacgtggcggtgaggaggcggagttaagattagcggcgggagggtgggggaggaagagcgaggtgagcgcggacgttagagtggagagcggaaggttagggaggttcggagcggaagtgagattagggagtttgttcgttattgtggattcgagaagtagagagcgagagggggaagaggagcgtgtaagcggaaaagacgggttttttttttcgattttcgagcgcgaggtttttattttgggtttttagcgaacggcggtagcggcggcggttggaataattattcggttaagggcgatagttaattgttgtgagtgtacggggagaggtttaggtagcggcggcggcggcggttttcgggttgcggtgaagaatgttagttattagcgtggattaggtgagggagtagaggttttaggtttggcgaaggttcgagtttcggagttttattttcgcgcggggtttcggttttttttcgtcgtcgtcgttgtcggttttataacggtgtttcgggcgtaagttgttgcggtgtagttattcgggtcggggcgtgcgttttggtttcgtagtttgcgggcgggcgggcgcggtgtcgcggcgggtgggggtaaggatcggttttaggggttttaggatagattttgagggcggtagatatggggcggagatcgggcgagttttgggagacggatttcgagtggcgggtgggaggtttaaaggttgggggtggttgggaaattggtggttgtggaggatatggtgggtttttatttttacgcggatagtttaaaataa

SEQ ID NO: 12322 - DNA, 889 bp, Artificial Sequence
  chemically treated genomic DNA (Homo sapiens) CpG-island No: 12322
ttattttaaactatccgcgtaaaaataaaaacccaccatatcctccacaaccaccaatttcccaaccacccccaacctttaaacctcccacccgccactcgaaatccgtctcccaaaactcgcccgatctccgccccatatctaccgccctcaaaatctatcctaaaacccctaaaaccgatccttacccccacccgccgcgacaccgcgcccgcccgcccgcaaactacgaaaccaaaacgcacgccccgacccgaataactacaccgcaacaacttacgcccgaaacaccgttataaaaccgacaacgacgacgacgaaaaaaaaccgaaaccccgcgcgaaaataaaactccgaaactcgaaccttcgccaaacctaaaacctctactccctcacctaatccacgctaataactaacattcttcaccgcaacccgaaaaccgccgccgccgccgctacctaaacctctccccgtacactcacaacaattaactatcgcccttaaccgaataattattccaaccgccgccgctaccgccgttcgctaaaaacccaaaataaaaacctcgcgctcgaaaatcgaaaaaaaaaacccgtcttttccgcttacacgctcctcttccccctctcgctctctacttctcgaatccacaataacgaacaaactccctaatctcacttccgctccgaacctccctaaccttccgctctccactctaacgtccgcgctcacctcgctcttcctcccccaccctcccgccgctaatcttaactccgcctcctcaccgccacgtcaccgaaaaccgaacccgcgctcacgaccgataaacgcatacgtcataaaaaaaacgcgtcgaaacgtcaacgaacgccaactttcaacgtct

SEQ ID NO: 12323 - DNA, 889 bp, Artificial Sequence
  chemically treated genomic DNA (Homo sapiens) CpG-island No: 12323
ttattttagattattcgcgtaggagtaaaaatttattatattttttatagttattaattttttaattatttttagtttttaaattttttattcgttattcggaattcgttttttagagttcgttcggttttcgttttatgtttgtcgtttttaggatttgttttaaggtttttaagatcggtttttgtttttattcgtcgcggtatcgcgttcgttcgttcgtaagttacggggttagggcgtacgtttcggttcgggtagttatatcgtagtaatttgcgttcggggtatcgttatggggtcggtagcggcggcgacggggaggagtcgaagtttcgcgcgagggtggagtttcggggttcgggttttcgttaagtttggggtttttgtttttttatttgatttacgttagtggttgatattttttatcgtaattcgagagtcgtcgtcgtcgtcgttgtttgggttttttttcgtgtatttatagtagttggttgtcgtttttggtcgagtgattgttttagtcgtcgtcgttgtcgtcgttcgttgagaatttaaaatgagggtttcgcgttcgggagtcggaggaagaggttcgtttttttcgtttgtacgttttttttttttttttcgttttttgtttttcgggtttataatggcggatagattttttagttttattttcgtttcgagtttttttgatttttcgttttttattttgacgttcgcgtttatttcgtttttttttttttattttttcgtcgttgattttggtttcgtttttttatcgttacgttatcggagatcggattcgcgtttacggtcggtgggcgtatgcgttatggagggagcgcgtcggggcgttagcgagcgttaatttttagcgttt

SEQ ID NO: 12324 - DNA, 889 bp, Artificial Sequence
  chemically treated genomic DNA (Homo sapiens) CpG-island No: 12324
aaacgctaaaaattaacgctcgctaacgccccgacgcgctccctccataacgcatacgcccaccgaccgtaaacgcgaatccgatctccgataacgtaacgataaaaaaacgaaaccaaaatcaacgacgaaaaaataaaaaaaaaaaaacgaaataaacgcgaacgtcaaaataaaaaacgaaaaatcaaaaaaactcgaaacgaaaataaaactaaaaaatctatccgccattataaacccgaaaaacaaaaaacgaaaaaaaaaaaaaaaacgtacaaacgaaaaaaacgaacctcttcctccgactcccgaacgcgaaaccctcattttaaattctcaacgaacgacgacaacgacgacgactaaaacaatcactcgaccaaaaacgacaaccaactactataaatacacgaaaaaaaacccaaacaacgacgacgacgacgactctcgaattacgataaaaaatatcaaccactaacgtaaatcaaataaaaaaacaaaaaccccaaacttaacgaaaacccgaaccccgaaactccaccctcgcgcgaaacttcgactcctccccgtcgccgccgctaccgaccccataacgataccccgaacgcaaattactacgatataactacccgaaccgaaacgtacgccctaaccccgtaacttacgaacgaacgaacgcgataccgcgacgaataaaaacaaaaaccgatcttaaaaaccttaaaacaaatcctaaaaacgacaaacataaaacgaaaaccgaacgaactctaaaaaacgaattccgaataacgaataaaaaatttaaaaactaaaaataattaaaaaattaataactataaaaaatataataaatttttactcctacgcgaataatctaaaataa

SEQ ID NO: 12325 - DNA, 610 bp, Artificial Sequence
  chemically treated genomic DNA (Homo sapiens) CpG-island No: 12325
cgtaggaaagcgaggggggagcggtcggtcgtttttgtaatcgaatttaggtagcggcgttggttttttcggcgtcgcggtttcggtcgtcgggtgttcgcgttcgtcgtttttattttgggcgtgtgcggggtgtcgaagagtcgtagtttgcggaaggttttgtgtggcggggtgttcgggtggttcggtcgcggcgagcggcggttttcgttcgttcggcgcgtttcgtaatttcgcggcgacgtattttttgggtcgtcgtagcgtatcggcgagaaagagttatttaggaagtagggggtcgtcggcgatttgatcggcgacgaggagtcgaagtttttttttttttacgagtcgtttttcgttttatcgttcgtttcgttcgcgttcgggtaggcgtcgggtagtaataggtttttttttagttcgtcggggttttcgggggtcggttcgggcgagcggcggcgttcgggttcgggtttcgtggggtttcgcgcgggcggtagcggcgagtcgggtttttgaaaggtcgagtttttttcggtgttgtggtcgttgttttttttttttttttttttttttttttttttatagtcgttgtagggcg

SEQ ID NO: 12326 - DNA, 610 bp, Artificial Sequence
  chemically treated genomic DNA (Homo sapiens) CpG-island No: 12326
cgccctacaacgactataaaaaaaaaaaaaaaaaaaaaaaaaaaaaaaacaacgaccacaacaccgaaaaaaactcgacctttcaaaaacccgactcgccgctaccgcccgcgcgaaaccccacgaaacccgaacccgaacgccgccgctcgcccgaaccgacccccgaaaaccccgacgaactaaaaaaaaacctattactacccgacgcctacccgaacgcgaacgaaacgaacgataaaacgaaaaacgactcgtaaaaaaaaaaaaacttcgactcctcgtcgccgatcaaatcgccgacgaccccctacttcctaaataactctttctcgccgatacgctacgacgacccaaaaaatacgtcgccgcgaaattacgaaacgcgccgaacgaacgaaaaccgccgctcgccgcgaccgaaccacccgaacaccccgccacacaaaaccttccgcaaactacgactcttcgacaccccgcacacgcccaaaataaaaacgacgaacgcgaacacccgacgaccgaaaccgcgacgccgaaaaaaccaacgccgctacctaaattcgattacaaaaacgaccgaccgctcccccctcgctttcctacg

SEQ ID NO: 12327 - DNA, 610 bp, Artificial Sequence
  chemically treated genomic DNA (Homo sapiens) CpG-island No: 12327
cgttttgtagcgattgtgaggaggaggaagaagaggaggaggaggagggtagcggttatagtatcggggaggattcggttttttaagagttcgattcgtcgttgtcgttcgcgcggagttttacggagttcgggttcgagcgtcgtcgttcgttcgggtcggttttcgggagtttcggcgagttggaggaggatttgttgttgttcggcgtttgttcgggcgcggacgaggcgggcggtggggcggagggcgattcgtgggaggaggagggtttcggtttttcgtcgtcggttaagtcgtcggcggttttttattttttgggtagttttttttcgtcggtgcgttgcggcggtttaggagatgcgtcgtcgcggggttgcggggcgcgtcgggcgggcgaaggtcgtcgttcgtcgcggtcggattattcgggtatttcgttatataagatttttcgtaagttgcgatttttcgatatttcgtatacgtttaaggtgagagcggcgggcgcgggtattcggcggtcggggtcgcggcgtcggaggggttagcgtcgttgtttgggttcggttatagaagcggtcggtcgtttttttttcgtttttttgcg

SEQ ID NO: 12328 - DNA, 610 bp, Artificial Sequence
  chemically treated genomic DNA (Homo sapiens) CpG-island No: 12328
cgcaaaaaaacgaaaaaaaaacgaccgaccgcttctataaccgaacccaaacaacgacgctaacccctccgacgccgcgaccccgaccgccgaatacccgcgcccgccgctctcaccttaaacgtatacgaaatatcgaaaaatcgcaacttacgaaaaatcttatataacgaaatacccgaataatccgaccgcgacgaacgacgaccttcgcccgcccgacgcgccccgcaaccccgcgacgacgcatctcctaaaccgccgcaacgcaccgacgaaaaaaaactacccaaaaaataaaaaaccgccgacgacttaaccgacgacgaaaaaccgaaaccctcctcctcccacgaatcgccctccgccccaccgcccgcctcgtccgcgcccgaacaaacgccgaacaacaacaaatcctcctccaactcgccgaaactcccgaaaaccgacccgaacgaacgacgacgctcgaacccgaactccgtaaaactccgcgcgaacgacaacgacgaatcgaactcttaaaaaaccgaatcctccccgatactataaccgctaccctcctcctcctcctcttcttcctcctcctcacaatcgctacaaaacg

SEQ ID NO: 12329 - DNA, 728 bp, Artificial Sequence
  chemically treated genomic DNA (Homo sapiens) CpG-island No: 12329
ttcggcgcggcggggtggcggcggttgttgtcggtttaggaagtttatcgcggttttggggacggggtcgaggataggagagcggaggtttgcggggtttaggatattgcgggtttgggggcgggttcgttacgtgcggttgggcgcgtttagtcgtagtcgcggcgtttttgcgcggcggcggtttgcggtttcggggcgttcgggttgcggacggtggcggtagcggcggcgcggatttttcggtagaggcggggcggttcgagtatcgaggttgaggtttttttaggtttagttttaggttcgggtttcgcggtttttcgcgatcgttaattacgtgagtgtttagtttattaattttagtgtagtttcgggtttgaaaaaaaaaggagggcgcgacgtagttcgcgggggaaggattagttacgcgattttggcgggaattcgttggttttattttcggttcggcgttagttaagtttgggcgggttgtggtgtttcgggtttatgagcgagtttggggcggcggggggttcggttcggcgtcgttcgaatatcgttcggacggggttgggttttttgggaggggtaaaagagagttggattcgtttaagtcgattcgaaagtcggtttggacgtatttttttcgttgttttttcggtgttgggggatttgaagaggggtaggcggtcgggtagcgttttcgggtttttgcgagttgggaagag

SEQ ID NO: 12330 - DNA, 728 bp, Artificial Sequence
  chemically treated genomic DNA (Homo sapiens) CpG-island No: 12330
ctcttcccaactcgcaaaaacccgaaaacgctacccgaccgcctacccctcttcaaatcccccaacaccgaaaaaacaacgaaaaaaatacgtccaaaccgactttcgaatcgacttaaacgaatccaactctcttttacccctcccaaaaaacccaaccccgtccgaacgatattcgaacgacgccgaaccgaaccccccgccgccccaaactcgctcataaacccgaaacaccacaacccgcccaaacttaactaacgccgaaccgaaaataaaaccaacgaattcccgccaaaatcgcgtaactaatccttcccccgcgaactacgtcgcgccctcctttttttttcaaacccgaaactacactaaaattaataaactaaacactcacgtaattaacgatcgcgaaaaaccgcgaaacccgaacctaaaactaaacctaaaaaaacctcaacctcgatactcgaaccgccccgcctctaccgaaaaatccgcgccgccgctaccgccaccgtccgcaacccgaacgccccgaaaccgcaaaccgccgccgcgcaaaaacgccgcgactacgactaaacgcgcccaaccgcacgtaacgaacccgcccccaaacccgcaatatcctaaaccccgcaaacctccgctctcctatcctcgaccccgtccccaaaaccgcgataaacttcctaaaccgacaacaaccgccgccaccccgccgcgccgaa

SEQ ID NO: 12331 - DNA, 728 bp, Artificial Sequence
  chemically treated genomic DNA (Homo sapiens) CpG-island No: 12331
ttttttttagttcgtagagattcggaggcgttgttcggtcgtttgtttttttttagattttttagtatcggaggagtagcgaggggggtgcgtttaggtcggttttcgggtcggtttaggcgaatttagtttttttttgttttttttagaaggtttagtttcgttcgggcggtgttcgggcggcgtcgggtcgggtttttcgtcgttttaggttcgtttataggttcggaatattatagttcgtttagatttggttggcgtcgagtcgggggtggagttagcgggttttcgttaaaatcgcgtagttggtttttttttcgcgggttacgtcgcgttttttttttttttttaaattcggagttgtattgggattggtggattgggtatttacgtggttaacggtcgcgggaagtcgcggagttcgaatttgagattggatttgaggagattttagtttcggtgttcgggtcgtttcgtttttgtcggaaagttcgcgtcgtcgttgtcgttatcgttcgtagttcgagcgtttcggagtcgtaggtcgtcgtcgcgtagagacgtcgcggttgcgattaggcgcgtttagtcgtacgtggcggattcgtttttaggttcgtagtgttttggatttcgtaggttttcgtttttttgttttcggtttcgtttttagggtcgcgatgagttttttgagtcgatagtagtcgtcgttatttcgtcgcgtcggg

SEQ ID NO: 12332 - DNA, 728 bp, Artificial Sequence
  chemically treated genomic DNA (Homo sapiens) CpG-island No: 12332
cccgacgcgacgaaataacgacgactactatcgactcaaaaaactcatcgcgaccctaaaaacgaaaccgaaaacaaaaaaacgaaaacctacgaaatccaaaacactacgaacctaaaaacgaatccgccacgtacgactaaacgcgcctaatcgcaaccgcgacgtctctacgcgacgacgacctacgactccgaaacgctcgaactacgaacgataacgacaacgacgacgcgaactttccgacaaaaacgaaacgacccgaacaccgaaactaaaatctcctcaaatccaatctcaaattcgaactccgcgacttcccgcgaccgttaaccacgtaaatacccaatccaccaatcccaatacaactccgaatttaaaaaaaaaaaaaaaacgcgacgtaacccgcgaaaaaaaaaccaactacgcgattttaacgaaaacccgctaactccacccccgactcgacgccaaccaaatctaaacgaactataatattccgaacctataaacgaacctaaaacgacgaaaaacccgacccgacgccgcccgaacaccgcccgaacgaaactaaaccttctaaaaaaaacaaaaaaaaactaaattcgcctaaaccgacccgaaaaccgacctaaacgcacccccctcgctactcctccgatactaaaaaatctaaaaaaaaacaaacgaccgaacaacgcctccgaatctctacgaactaaaaaaaa

SEQ ID NO: 12333 - DNA, 636 bp, Artificial Sequence
  chemically treated genomic DNA (Homo sapiens) CpG-island No: 12333
gtgcggaagagtttgtcgcgcgagtagtcggtttttcgtaggagtcgagggattcgcgcggttgcggtttaggagcggcggtcgcggagttcggagatttcgtagtcgcggcggcggcggcggcggcggtagtagttagagtagcgtttttcgtcgtcgttcgggaggagttcgtcgcgttcgttcgtcgtttcgttttttagcggcggcgggaggcgcgttttttcggtttagttcgcgttcggtttcgcggggtcgtttcggttcgtttcgaggtaaggggtcgcgtttaggggcgcgggggatttagggtgggtagtacgtgcgcgcggggtcgtaggattcggttatttgttcgttagcgtggaggacgcgcgggggcggaggggcgtttaggcgcgaggttgcgcggtatcggggatttcggacgcgggggcgcggagaggtgggtttttttttatagttaggtcgttgggggtttcgcgtttttgtaggaggtagtaatcgttaagtcggtgggtttcgggcgcgtttcgtcgtagaagatagaggattgggtattcgagtttcggaatttgggggttttcggggtgttcgatagggtggagaaggatcgtgttttagggtaatagtttt

SEQ ID NO: 12334 - DNA, 636 bp, Artificial Sequence
  chemically treated genomic DNA (Homo sapiens) CpG-island No: 12334
aaaactattaccctaaaacacgatccttctccaccctatcgaacaccccgaaaacccccaaattccgaaactcgaatacccaatcctctatcttctacgacgaaacgcgcccgaaacccaccgacttaacgattactacctcctacaaaaacgcgaaacccccaacgacctaactataaaaaaaaacccacctctccgcgcccccgcgtccgaaatccccgataccgcgcaacctcgcgcctaaacgcccctccgcccccgcgcgtcctccacgctaacgaacaaataaccgaatcctacgaccccgcgcgcacgtactacccaccctaaatcccccgcgcccctaaacgcgaccccttacctcgaaacgaaccgaaacgaccccgcgaaaccgaacgcgaactaaaccgaaaaaacgcgcctcccgccgccgctaaaaaacgaaacgacgaacgaacgcgacgaactcctcccgaacgacgacgaaaaacgctactctaactactaccgccgccgccgccgccgccgcgactacgaaatctccgaactccgcgaccgccgctcctaaaccgcaaccgcgcgaatccctcgactcctacgaaaaaccgactactcgcgcgacaaactcttccgcac

SEQ ID NO: 12335 - DNA, 636 bp, Artificial Sequence
  chemically treated genomic DNA (Homo sapiens) CpG-island No: 12335
aaagttgttgttttggggtacgatttttttttattttgtcggatatttcgaggatttttaaatttcgaggttcggatgtttaattttttgttttttgcggcgaaacgcgttcggagtttatcggtttagcgattgttattttttgtagggacgcgaagtttttagcggtttgattgtggaggggaatttattttttcgcgttttcgcgttcggggttttcggtgtcgcgtagtttcgcgtttgagcgttttttcgttttcgcgcgttttttacgttggcgagtaggtgatcgagttttgcgatttcgcgcgtacgtattatttattttgggtttttcgcgtttttaggcgcggttttttatttcggagcgggtcggagcggtttcgcggggtcgggcgcggattgggtcggggagacgcgtttttcgtcgtcgttgggagacgaggcggcgagcgggcgcggcgagtttttttcgggcggcggcgggaggcgttgttttagttgttgtcgtcgtcgtcgtcgtcgtcgcggttgcggggttttcgggtttcgcggtcgtcgtttttgggtcgtagtcgcgcgggtttttcggtttttgcgagaggtcggttgttcgcgcggtaaattttttcgtat

SEQ ID NO: 12336 - DNA, 636 bp, Artificial Sequence
  chemically treated genomic DNA (Homo sapiens) CpG-island No: 12336
atacgaaaaaatttaccgcgcgaacaaccgacctctcgcaaaaaccgaaaaacccgcgcgactacgacccaaaaacgacgaccgcgaaacccgaaaaccccgcaaccgcgacgacgacgacgacgacgacaacaactaaaacaacgcctcccgccgccgcccgaaaaaaactcgccgcgcccgctcgccgcctcgtctcccaacgacgacgaaaaacgcgtctccccgacccaatccgcgcccgaccccgcgaaaccgctccgacccgctccgaaataaaaaaccgcgcctaaaaacgcgaaaaacccaaaataaataatacgtacgcgcgaaatcgcaaaactcgatcacctactcgccaacgtaaaaaacgcgcgaaaacgaaaaaacgctcaaacgcgaaactacgcgacaccgaaaaccccgaacgcgaaaacgcgaaaaaataaattcccctccacaatcaaaccgctaaaaacttcgcgtccctacaaaaaataacaatcgctaaaccgataaactccgaacgcgtttcgccgcaaaaaacaaaaaattaaacatccgaacctcgaaatttaaaaatcctcgaaatatccgacaaaataaaaaaaaatcgtaccccaaaacaacaacttt

SEQ ID NO: 12337 - DNA, 832 bp, Artificial Sequence
  chemically treated genomic DNA (Homo sapiens) CpG-island No: 12337
cggtgcggcgcggttttgtttattttgatgatgttgttgcgtcggggggtcgttcgtgttgtttttaggaggttcgtttcgttgttcgttggggttttcgcggcgtttggtagtgcgatttcgttgcgacggttttttattcggtttttagaggtcgtcgttacgtagttttcggcggtattcgggtttattcgggggtcgttttcgtttttcgtcgcgtcgggcgtcggcggattttttttgtcggtcgcgtttcggttagtggtttggagcgtttagggtttttcgggggaaagcgggacgtcggtagcggagtttagtcgttaggtatcggttgcgtttttgtatcgggaggcggtttcgttagattttgttttatcgtttagcgcgatatgtggcggcggcggcggcggcggcggtaattttttggagaggggatatcgttcgggtagagacgttttcgggtttcggtttaggaggttagtagttcggcgggggacggtggcgggagtggggaggcgatgtgagcgggaggtagaaggagaggcgaaaaagagagggaggtattcgaaatgtgatgtaaacgtcggttttgcgttagataaaaggtatcgggcgtttagttaggcggtttttggagttcggacgtcggcggttcgataggggttagagtcgggcgattgcggtcgggcgtattcgttatttgttcgcggattgcggcgtagcggttttaggaagtgcggcggcggcggcggtttttatttagttttgttgtgatagggagggagatttgttttgatagtttttggggattggtaggcgtttgggtttt

SEQ ID NO: 12338 - DNA, 832 bp, Artificial Sequence
  chemically treated genomic DNA (Homo sapiens) CpG-island No: 12338
aaaacccaaacgcctaccaatccccaaaaactatcaaaacaaatctccctccctatcacaacaaaactaaataaaaaccgccgccgccgccgcacttcctaaaaccgctacgccgcaatccgcgaacaaataacgaatacgcccgaccgcaatcgcccgactctaacccctatcgaaccgccgacgtccgaactccaaaaaccgcctaactaaacgcccgataccttttatctaacgcaaaaccgacgtttacatcacatttcgaatacctccctctctttttcgcctctccttctacctcccgctcacatcgcctccccactcccgccaccgtcccccgccgaactactaacctcctaaaccgaaacccgaaaacgtctctacccgaacgatatcccctctccaaaaaattaccgccgccgccgccgccgccgccacatatcgcgctaaacgataaaacaaaatctaacgaaaccgcctcccgatacaaaaacgcaaccgatacctaacgactaaactccgctaccgacgtcccgctttcccccgaaaaaccctaaacgctccaaaccactaaccgaaacgcgaccgacaaaaaaaatccgccgacgcccgacgcgacgaaaaacgaaaacgacccccgaataaacccgaataccgccgaaaactacgtaacgacgacctctaaaaaccgaataaaaaaccgtcgcaacgaaatcgcactaccaaacgccgcgaaaaccccaacgaacaacgaaacgaacctcctaaaaacaacacgaacgaccccccgacgcaacaacatcatcaaaataaacaaaaccgcgccgcaccg

SEQ ID NO: 12339 - DNA, 832 bp, Artificial Sequence
  chemically treated genomic DNA (Homo sapiens) CpG-island No: 12339
gaggtttagacgtttgttaatttttaagggttgttaaaataagtttttttttttgttataatagagttgagtggaggtcgtcgtcgtcgtcgtattttttgggatcgttgcgtcgtagttcgcgggtaggtggcgggtgcgttcggtcgtagtcgttcggttttggtttttatcgggtcgtcggcgttcgggttttagaggtcgtttggttgggcgttcggtgttttttgtttggcgtagggtcggcgtttgtattatatttcggatatttttttttttttttcgtttttttttttgtttttcgtttatatcgtttttttattttcgttatcgtttttcgtcggattgttagttttttagatcgaagttcgaggacgtttttgttcgagcgatgttttttttttagaaagttgtcgtcgtcgtcgtcgtcgtcgttatatgtcgcgttgggcggtgaaataaagtttggcggggtcgtttttcggtgtaggagcgtaatcggtgtttagcggttggatttcgttgtcggcgtttcgttttttttcggggagttttaaacgttttaggttattggtcgaggcgcggtcggtagggaggattcgtcggcgttcgacgcggcggggggcgaagacgattttcgagtgggttcggatgtcgtcggggattgcgtgacggcggtttttgggggtcggatgagggatcgtcgtagcggggtcgtattgttaggcgtcgcggggattttagcggatagcgaggcgggttttttggaggtagtacgggcgatttttcggcgtagtagtattattaaggtaagtaaagtcgcgtcgtatcg

SEQ ID NO: 12340 - DNA, 832 bp, Artificial Sequence
  chemically treated genomic DNA (Homo sapiens) CpG-island No: 12340
cgatacgacgcgactttacttaccttaataatactactacgccgaaaaatcgcccgtactacctccaaaaaacccgcctcgctatccgctaaaatccccgcgacgcctaacaatacgaccccgctacgacgatccctcatccgacccccaaaaaccgccgtcacgcaatccccgacgacatccgaacccactcgaaaatcgtcttcgccccccgccgcgtcgaacgccgacgaatcctccctaccgaccgcgcctcgaccaataacctaaaacgtttaaaactccccgaaaaaaaacgaaacgccgacaacgaaatccaaccgctaaacaccgattacgctcctacaccgaaaaacgaccccgccaaactttatttcaccgcccaacgcgacatataacgacgacgacgacgacgacgacaactttctaaaaaaaaaacatcgctcgaacaaaaacgtcctcgaacttcgatctaaaaaactaacaatccgacgaaaaacgataacgaaaataaaaaaacgatataaacgaaaaacaaaaaaaaaaacgaaaaaaaaaaaaaaatatccgaaatataatacaaacgccgaccctacgccaaacaaaaaacaccgaacgcccaaccaaacgacctctaaaacccgaacgccgacgacccgataaaaaccaaaaccgaacgactacgaccgaacgcacccgccacctacccgcgaactacgacgcaacgatcccaaaaaatacgacgacgacgacgacctccactcaactctattataacaaaaaaaaaaacttattttaacaacccttaaaaattaacaaacgtctaaacctc

SEQ ID NO: 12341 - DNA, 646 bp, Artificial Sequence
  chemically treated genomic DNA (Homo sapiens) CpG-island No: 12341
cgttaatattatattatattcgaaaatttaggcgatttttatatagggttttcgtaataatacgatattaatattatattatattcgaaaatttaggcgatttttatatagggttttcgtaataatacgatattaatattatattatattcgaaaatttaggcgatttttatatagggttttcgtaataatacgatattaatattatattatattcgaaaatttcggcgatttttatatagggttttcgtaataatacgatattaatattatattatattcgaaaatcgaggcgatttttatatagggttttcgtaataatacgacgttaatattatattatattcgaaaatttaggcgatttttatatagggttttcgtaataatacgacgttaatattatattatattcgaaaatttaggcgatttttatatagggttttcgtaataatacgatattaatattatattatattcgaaaatttaggcgatttttatatagggttttcgtaataatacgtattaatattatattatattagaaaatcgaggcgatttttagatagggttttcgtaataatacgatattaatattatattatatttaaaaatcgaggcgattttttttacgtttatgttagtaatgt

SEQ ID NO: 12342 - DNA, 646 bp, Artificial Sequence
  chemically treated genomic DNA (Homo sapiens) CpG-island No: 12342
acattactaacataaacgtaaaaaaaatcgcctcgatttttaaatataatataatattaatatcgtattattacgaaaaccctatctaaaaatcgcctcgattttctaatataatataatattaatacgtattattacgaaaaccctatataaaaatcgcctaaattttcgaatataatataatattaatatcgtattattacgaaaaccctatataaaaatcgcctaaattttcgaatataatataatattaacgtcgtattattacgaaaaccctatataaaaatcgcctaaattttcgaatataatataatattaacgtcgtattattacgaaaaccctatataaaaatcgcctcgattttcgaatataatataatattaatatcgtattattacgaaaaccctatataaaaatcgccgaaattttcgaatataatataatattaatatcgtattattacgaaaaccctatataaaaatcgcctaaattttcgaatataatataatattaatatcgtattattacgaaaaccctatataaaaatcgcctaaattttcgaatataatataatattaatatcgtattattacgaaaaccctatataaaaatcgcctaaattttcgaatataatataatattaacg

SEQ ID NO: 12343 - DNA, 646 bp, Artificial Sequence
  chemically treated genomic DNA (Homo sapiens) CpG-island No: 12343
gtattattaatatggacgtgaagaaagtcgtttcggtttttgggtgtgatgtggtgttggtgtcgtgttgttgcgaaggttttgtttgaaagtcgtttcggttttttggtgtgatgtggtgttggtgcgtgttgttgcgaaggttttgtgtgaaagtcgtttgggttttcgggtgtgatgtggtattggtgtcgtgttgttgcgaaggttttgtgtgaaagtcgtttgggttttcgggtgtgatgtggtgttggcgtcgtgttgttgcgaaggttttgtgtgaaagtcgtttgggttttcgggtgtgatgtggtgttggcgtcgtgttgttgcgaaggttttgtgtgaaagtcgtttcggttttcgggtgtgatgtggtgttggtgtcgtgttgttgcgaaggttttgtgtgaaagtcgtcggggttttcgggtgtgatgtggtgttggtgtcgtgttgttgcgaaggttttgtgtgaaggtcgtttgggttttcgggtgtgatgtggtgttggtgtcgtgttgttgcgaaggttttgtgtgaaggtcgtttgggttttcgggtgtgatgtggtgttggtgtcgtgttgttgcgaaggttttgtgtgaaagtcgtttgggttttcgggtgtgatgtggtgttggcg

SEQ ID NO: 12344 - DNA, 646 bp, Artificial Sequence
  chemically treated genomic DNA (Homo sapiens) CpG-island No: 12344
cgccaacaccacatcacacccgaaaacccaaacgactttcacacaaaaccttcgcaacaacacgacaccaacaccacatcacacccgaaaacccaaacgaccttcacacaaaaccttcgcaacaacacgacaccaacaccacatcacacccgaaaacccaaacgaccttcacacaaaaccttcgcaacaacacgacaccaacaccacatcacacccgaaaaccccgacgactttcacacaaaaccttcgcaacaacacgacaccaacaccacatcacacccgaaaaccgaaacgactttcacacaaaaccttcgcaacaacacgacgccaacaccacatcacacccgaaaacccaaacgactttcacacaaaaccttcgcaacaacacgacgccaacaccacatcacacccgaaaacccaaacgactttcacacaaaaccttcgcaacaacacgacaccaataccacatcacacccgaaaacccaaacgactttcacacaaaaccttcgcaacaacacgcaccaacaccacatcacaccaaaaaaccgaaacgactttcaaacaaaaccttcgcaacaacacgacaccaacaccacatcacacccaaaaaccgaaacgactttcttcacgtccatattaataatac

SEQ ID NO: 12345 - DNA, 660 bp, Artificial Sequence
  chemically treated genomic DNA (Homo sapiens) CpG-island No: 12345
gtcgcggtcgcgagatcgcgcggaggagtttcgagggagggcgggggtcgtggtgcgcggaggtgatattggcggatgtttcgggttcgttcggtatttatagtatacgaaggttagggtttttaggagtacgattcgggttagttagaaggtgttcgtgtggagatgggtcggagagtttgcggggttacgtttcggcgcgggcggcgatttaggtttcggattcgagtatttagtttttcgtttttttagcgatttcgcgggcgtcgttattgttgggttgttagggcgtatgtgcggggagggcgtattttcggaggtttcgtttattttcggaggtttcgtttattttcggaggtttcgtttttttttggtcggttttgtttacggcgaagttttatttatatttcgggaggtttcgtttatagtttcggagtatcgtttttttagtcggtttcgtttacgcgcgggagcgggtgttcggagtttgtttttttcgtagttttcgttgggcgttgttgcgggtagggcgcggggtcgggtatttgggaggtggtgcgcgtcgttcgattcgagtttattggggtaggtacgcgtgtttttcgttagttcgagttgtagaggttaggtgtttttttttagttaggcgtttttttagtt

SEQ ID NO: 12346 - DNA, 660 bp, Artificial Sequence
  chemically treated genomic DNA (Homo sapiens) CpG-island No: 12346
aactaaaaaaacgcctaactaaaaaaaaacacctaacctctacaactcgaactaacgaaaaacacgcgtacctaccccaataaactcgaatcgaacgacgcgcaccacctcccaaatacccgaccccgcgccctacccgcaacaacgcccaacgaaaactacgaaaaaaacaaactccgaacacccgctcccgcgcgtaaacgaaaccgactaaaaaaacgatactccgaaactataaacgaaacctcccgaaatataaataaaacttcgccgtaaacaaaaccgaccaaaaaaaaacgaaacctccgaaaataaacgaaacctccgaaaataaacgaaacctccgaaaatacgccctccccgcacatacgccctaacaacccaacaataacgacgcccgcgaaatcgctaaaaaaacgaaaaactaaatactcgaatccgaaacctaaatcgccgcccgcgccgaaacgtaaccccgcaaactctccgacccatctccacacgaacaccttctaactaacccgaatcgtactcctaaaaaccctaaccttcgtatactataaataccgaacgaacccgaaacatccgccaatatcacctccgcgcaccacgacccccgccctccctcgaaactcctccgcgcgatctcgcgaccgcgac

SEQ ID NO: 12347 - DNA, 660 bp, Artificial Sequence
  chemically treated genomic DNA (Homo sapiens) CpG-island No: 12347
agttgggaaggcgtttggttgggggagggtatttggtttttgtaattcggattgacggaaggtacgcgtgtttgttttagtgagttcgggtcgggcgacgcgtattattttttaggtattcggtttcgcgttttattcgtagtagcgtttagcgagaattgcgaaggaggtaggtttcgggtattcgttttcgcgcgtgggcggggtcggttggaggggcggtgtttcgggattgtgagcggggtttttcggggtgtgggtggggtttcgtcgtgggtagggtcggttagggagaggcggggttttcgagaatgggcggggttttcgagaatgggcggggttttcgggagtgcgtttttttcgtatatgcgttttgatagtttaataatggcggcgttcgcggagtcgttgaggaggcggaagattgggtattcggattcggagtttgagtcgtcgttcgcgtcggggcgtggtttcgtaggtttttcggtttatttttatacgggtattttttggttgattcggatcgtgtttttgaaggttttagttttcgtgtattgtgagtgtcgggcgggttcgggatattcgttagtgttattttcgcgtattacgattttcgttttttttcgagattttttcgcgcggtttcgcggtcgcggt

SEQ ID NO: 12348 - DNA, 660 bp, Artificial Sequence
  chemically treated genomic DNA (Homo sapiens) CpG-island No: 12348
accgcgaccgcgaaaccgcgcgaaaaaatctcgaaaaaaaacgaaaatcgtaatacgcgaaaataacactaacgaatatcccgaacccgcccgacactcacaatacacgaaaactaaaaccttcaaaaacacgatccgaatcaaccaaaaaatacccgtataaaaataaaccgaaaaacctacgaaaccacgccccgacgcgaacgacgactcaaactccgaatccgaatacccaatcttccgcctcctcaacgactccgcgaacgccgccattattaaactatcaaaacgcatatacgaaaaaaacgcactcccgaaaaccccgcccattctcgaaaaccccgcccattctcgaaaaccccgcctctccctaaccgaccctacccacgacgaaaccccacccacaccccgaaaaaccccgctcacaatcccgaaacaccgcccctccaaccgaccccgcccacgcgcgaaaacgaatacccgaaacctacctccttcgcaattctcgctaaacgctactacgaataaaacgcgaaaccgaatacctaaaaaataatacgcgtcgcccgacccgaactcactaaaacaaacacgcgtaccttccgtcaatccgaattacaaaaaccaaataccctcccccaaccaaacgccttcccaact

SEQ ID NO: 12349 - DNA, 584 bp, Artificial Sequence
  chemically treated genomic DNA (Homo sapiens) CpG-island No: 12349
gtttcgaatgttttttttttaatttttttttcgtttttggttttggtttataatttttttttattttttatttatttcgtttttattttcgtattttttaatatggtttatttaagtatcgtcgttttgttttttcgcgtttttaatttttcggtagttttattcggttcgttacgtttattttttcgcgttttttttttttttacgttttttttttacggtaacgattatttttatcgtttttttttatttttatcgttagcggtttcgtttacgcgtcggcgttatttttcggcgttcgttttgtttttacgttattcgtatcgggtattttagcgcgcgtcgatacgttttttttttcgtttcggtatcgtttcggcgaaattttacgttattttttttcgtacgcgttaagttttatgtttcggttaggataacgttcgcggttagcgtttacgcgtatttttatcgtacggttttcgtcgtcgttttcgtttcggttgttttaggttattttcgtgaatttttttaggttgttttttttgttattaatttttttttcggttttatatttattttaagtt

SEQ ID NO: 12350 - DNA, 584 bp, Artificial Sequence
  chemically treated genomic DNA (Homo sapiens) CpG-island No: 12350
aacttaaaataaatataaaaccgaaaaaaaaattaataacaaaaaaaacaacctaaaaaaattcacgaaaataacctaaaacaaccgaaacgaaaacgacgacgaaaaccgtacgataaaaatacgcgtaaacgctaaccgcgaacgttatcctaaccgaaacataaaacttaacgcgtacgaaaaaaaataacgtaaaatttcgccgaaacgataccgaaacgaaaaaaaaaacgtatcgacgcgcgctaaaatacccgatacgaataacgtaaaaacaaaacgaacgccgaaaaataacgccgacgcgtaaacgaaaccgctaacgataaaaataaaaaaaaacgataaaaataatcgttaccgtaaaaaaaaaacgtaaaaaaaaaaaaaacgcgaaaaaataaacgtaacgaaccgaataaaactaccgaaaaattaaaaacgcgaaaaaacaaaacgacgatacttaaataaaccatattaaaaaatacgaaaataaaaacgaaataaataaaaaataaaaaaaaattataaaccaaaaccaaaaacgaaaaaaaaattaaaaaaaaaacattcgaaac

SEQ ID NO: 12351 - DNA, 584 bp, Artificial Sequence
  chemically treated genomic DNA (Homo sapiens) CpG-island No: 12351
agtttgaggtgggtgtagggtcgggaaggaggttggtggtagaaggagtagtttgaaagaatttacgaaggtgatttaaagtagtcggggcggagacggcggcgggagtcgtacggtgggggtgcgcgtagacgttagtcgcgagcgttgttttagtcgaagtatgaggtttagcgcgtacgggagggggtggcgtagagtttcgtcgaggcgatgtcgaggcggaggagggggcgtgtcggcgcgcgttgggatgttcggtgcgggtagcgtaggggtagagcgggcgtcgaggagtagcgtcgacgcgtaagcggagtcgttggcgataggagtggggagaggcggtgggagtggtcgttgtcgtgggagagaggcgtagggggggggggggcgcgagggagtgagcgtggcggatcggatagggttgtcggggggttgggggcgcggggaagtagggcggcggtgtttgggtaggttatgttgggggatgcgggagtaagaacggggtgggtggggagtggagaggggttgtaaattaaagttaggggcgagaaggggattgggggggaaatattcgggat

SEQ ID NO: 12352 - DNA, 584 bp, Artificial Sequence
  chemically treated genomic DNA (Homo sapiens) CpG-island No: 12352
atcccgaatatttcccccccaatccccttctcgcccctaactttaatttacaacccctctccactccccacccaccccgttcttactcccgcatcccccaacataacctacccaaacaccgccgccctacttccccgcgcccccaaccccccgacaaccctatccgatccgccacgctcactccctcgcgccccccccccccctacgcctctctcccacgacaacgaccactcccaccgcctctccccactcctatcgccaacgactccgcttacgcgtcgacgctactcctcgacgcccgctctacccctacgctacccgcaccgaacatcccaacgcgcgccgacacgccccctcctccgcctcgacatcgcctcgacgaaactctacgccaccccctcccgtacgcgctaaacctcatacttcgactaaaacaacgctcgcgactaacgtctacgcgcacccccaccgtacgactcccgccgccgtctccgccccgactactttaaatcaccttcgtaaattctttcaaactactccttctaccaccaacctccttcccgaccctacacccacctcaaact

SEQ ID NO: 12353 - DNA, 665 bp, Artificial Sequence
  chemically treated genomic DNA (Homo sapiens) CpG-island No: 12353
  misc_feature (440)..(440): n is either a, c, g or t
ttttatttcgagttttacggaggttttttcggaattagtttttgttttttcgtatcggttaggttttttttttatttttcgatttattttttattcgatttttattcgttatttcgtttttttttttttttttttttcgcggttttttttttttttttttcggtttatatcgattgtatatcgcgttcgttttttgcgtaatgttattttttcgtttttatttttttaatattcgtttttttttatcgtttttttgttttttttttttcgtttttaatttgtcgtatcgttttttttttgtcgttttatcgtcgttttttttttttttattttcgattttttttttttttttttttcgttgtcgtatcgcgtatttttttcgttttcgttgtttttttttttttttgttttttcgtattttttttttttttttttttttnttttttttttttttttttttttttttttatttttattttttattttcgtttttttttttttttatcgtttttttttttttttgtagtttcgttttttcgtttatcgttttttttttttttcgttacgttttcgtatcgttacgcgttttttgttttttagtgtacgcggttgttttagtgtattatttatttttgtattgagaaatatagacgtagtttatttta

SEQ ID NO: 12354 - DNA, 665 bp, Artificial Sequence
  chemically treated genomic DNA (Homo sapiens) CpG-island No: 12354
  misc_feature (226)..(226): n is either a, c, g or t
taaaataaactacgtctatatttctcaatacaaaaataaataatacactaaaacaaccgcgtacactaaaaaacaaaaaacgcgtaacgatacgaaaacgtaacgaaaaaaaaaaaaaacgataaacgaaaaaacgaaactacaaaaaaaaaaaaaaacgataaaaaaaaaaaaaaacgaaaataaaaaataaaaataaaaaaaaaaaaaaaaaaaaaaaaaaaanaaaaaaaaaaaaaaaaaaaaaatacgaaaaaacaaaaaaaaaaaaaaacaacgaaaacgaaaaaaatacgcgatacgacaacgaaaaaaaaaaaaaaaaaaaatcgaaaataaaaaaaaaaaaaacgacgataaaacgacaaaaaaaaaacgatacgacaaattaaaaacgaaaaaaaaaaaacaaaaaaacgataaaaaaaaacgaatattaaaaaaataaaaacgaaaaaataacattacgcaaaaaacgaacgcgatatacaatcgatataaaccgaaaaaaaaaaaaaaaaaaccgcgaaaaaaaaaaaaaaaaaaaaacgaaataacgaataaaaatcgaataaaaaataaatcgaaaaataaaaaaaaaacctaaccgatacgaaaaaacaaaaactaattccgaaaaaacctccgtaaaactcgaaataaaa

SEQ ID NO: 12355 - DNA, 665 bp, Artificial Sequence
  chemically treated genomic DNA (Homo sapiens) CpG-island No: 12355
  misc_feature (226)..(226): n is either a, c, g or t
taagatgaattacgtttgtattttttagtatagaaataaatgatgtattaaggtagtcgcgtgtattggggggtaggagacgcgtagcgatgcggaagcgtggcggggagagaggaaggcggtagacgagagggcgaggttgtagagggaaggggaggcggtgagggggaggaggagcgagggtgggaagtgggggtggggggggagagagagagggggggggggngggagaaaggagagagagggggtgcgggagaatagggggggggggggataacgggggcgagggaggtacgcggtacggtagcgaggaggagggagggagggggtcgggagtgggggaagaagaggcggcggtgggacggtaaggggagagcgatgcgataagttgagagcgaagagaggaggatagaggggcgatggagagggacgagtattgagaggatggagacgaagaggtggtattacgtaaggaacgagcgcggtgtgtagtcgatataggtcggaaggggagggggagaggtcgcgggaagaagggggaagggaggacgagatggcgagtgagaatcggatgggaagtaagtcgaaggatgagggaggggtttagtcggtgcgggaggataggagttggtttcgaaagaattttcgtgaggttcgaggtgggg

SEQ ID NO: 12356 - DNA, 665 bp, Artificial Sequence
  chemically treated genomic DNA (Homo sapiens) CpG-island No: 12356
  misc_feature (440)..(440): n is either a, c, g or t
ccccacctcgaacctcacgaaaattctttcgaaaccaactcctatcctcccgcaccgactaaacccctccctcatccttcgacttacttcccatccgattctcactcgccatctcgtcctcccttcccccttcttcccgcgacctctccccctccccttccgacctatatcgactacacaccgcgctcgttccttacgtaataccacctcttcgtctccatcctctcaatactcgtccctctccatcgcccctctatcctcctctcttcgctctcaacttatcgcatcgctctccccttaccgtcccaccgccgcctcttcttcccccactcccgaccccctccctccctcctcctcgctaccgtaccgcgtacctccctcgcccccgttatccccccccccccctattctcccgcaccccctctctctcctttctcccnccccccccccctctctctctccccccccacccccacttcccaccctcgctcctcctccccctcaccgcctccccttccctctacaacctcgccctctcgtctaccgccttcctctctccccgccacgcttccgcatcgctacgcgtctcctaccccccaatacacgcgactaccttaatacatcatttatttctatactaaaaaatacaaacgtaattcatctta

SEQ ID NO: 12357 - DNA, 570 bp, Artificial Sequence
  chemically treated genomic DNA (Homo sapiens) CpG-island No: 12357
  misc_feature (93)..(93): n is either a, c, g or t
  misc_feature (104)..(104): n is either a, c, g or t
cgtattttgcggattaatcgttttattttgtcgtatttttatcgggttatcgattggtaaaagttttcgaacgtgttcgcggcgtttttattncgttttcgggnttcgcgaatatttattttagttttttgtttgtttaggatttcgttttttcggtttttttagttttaaaattttttttttatcgtttgattttaattttatatgcgggttcgttagttttaggagttaattagacgcgttgtttttgcgcgaatcggttagttttgatttgatgaaacgtagtaatattattatcgtaaaagtggaatatggcgtcgatatcgcgtggttggtcgattattatatagaagattttatcgttagttatgtcgtttaatattggttggacgttgtcgtataatagaaaacggtggttattattttgcgcgaattggtatcgtttgataaacgtttcggtattatttaataagcgtatgaaaaagtttttgtcggggtggttaatcgtattttcgatgaagggtattaggtgattgcgttttttatttgtacgggtattgatagttataa

SEQ ID NO: 12358 - DNA, 570 bp, Artificial Sequence
  chemically treated genomic DNA (Homo sapiens) CpG-island No: 12358
  misc_feature (467)..(467): n is either a, c, g or t
  misc_feature (478)..(478): n is either a, c, g or t
ttataactatcaatacccgtacaaataaaaaacgcaatcacctaatacccttcatcgaaaatacgattaaccaccccgacaaaaactttttcatacgcttattaaataataccgaaacgtttatcaaacgataccaattcgcgcaaaataataaccaccgttttctattatacgacaacgtccaaccaatattaaacgacataactaacgataaaatcttctatataataatcgaccaaccacgcgatatcgacgccatattccacttttacgataataatattactacgtttcatcaaatcaaaactaaccgattcgcgcaaaaacaacgcgtctaattaactcctaaaactaacgaacccgcatataaaattaaaatcaaacgataaaaaaaaaattttaaaactaaaaaaaccgaaaaaacgaaatcctaaacaaacaaaaaactaaaataaatattcgcgaancccgaaaacgnaataaaaacgccgcgaacacgttcgaaaacttttaccaatcgataacccgataaaaatacgacaaaataaaacgattaatccgcaaaatacg

SEQ ID NO: 12359 - DNA, 570 bp, Artificial Sequence
  chemically treated genomic DNA (Homo sapiens) CpG-island No: 12359
  misc_feature (467)..(467): n is either a, c, g or t
  misc_feature (478)..(478): n is either a, c, g or t
ttatagttgttaatgttcgtataggtggagagcgtaattatttgatattttttatcgagaatgcgattgattatttcggtaaaggtttttttatacgtttgttgagtggtgtcgagacgtttgttaaacggtgttagttcgcgtagggtaatggttatcgttttttgttgtgcggtaacgtttagttagtgttgaacggtatagttggcggtgaagttttttgtgtggtgatcgattagttacgcggtatcgacgttatgttttatttttgcggtggtgatattgttgcgttttattagattaaagttgatcgattcgcgtaggaatagcgcgtttgattaatttttagggttggcgggttcgtatatggggttggagttagacgatgagaagggaattttgaagttgaaggggtcgagagaacgggattttgggtaggtagggagttgaaataagtgttcgcgggnttcgggaacgnaatgaaagcgtcgcgagtacgttcgggggtttttgttagtcgataattcggtaaaaatgcggtagggtgggacggttaattcgtaaaatgcg

SEQ ID NO: 12360 - DNA, 570 bp, Artificial Sequence
  chemically treated genomic DNA (Homo sapiens) CpG-island No: 12360
  misc_feature (93)..(93): n is either a, c, g or t
  misc_feature (104)..(104): n is either a, c, g or t
cgcattttacgaattaaccgtcccaccctaccgcatttttaccgaattatcgactaacaaaaacccccgaacgtactcgcgacgctttcattncgttcccgaancccgcgaacacttatttcaactccctacctacccaaaatcccgttctctcgaccccttcaacttcaaaattcccttctcatcgtctaactccaaccccatatacgaacccgccaaccctaaaaattaatcaaacgcgctattcctacgcgaatcgatcaactttaatctaataaaacgcaacaatatcaccaccgcaaaaataaaacataacgtcgataccgcgtaactaatcgatcaccacacaaaaaacttcaccgccaactataccgttcaacactaactaaacgttaccgcacaacaaaaaacgataaccattaccctacgcgaactaacaccgtttaacaaacgtctcgacaccactcaacaaacgtataaaaaaacctttaccgaaataatcaatcgcattctcgataaaaaatatcaaataattacgctctccacctatacgaacattaacaactataa

SEQ ID NO: 12361 - DNA, 776 bp, Artificial Sequence
  chemically treated genomic DNA (Homo sapiens) CpG-island No: 12361
acggttcgcggtttgacgattcgatcgaggcgtaggcgttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaattttcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtatttcgttggcgttgattcggtcggcgttggatggacgaacgggggtgttgggttttattcgtaaatagcgttgtacggcgtgtaaagcgttgtgtgtttgggtttacgttatggaagttgggtgatacggcgaacgtcgattcgttttagtatcgttaaatagtcgtttttgtgtgaagaatgtatcgttgttatattcgttgtagttagggaagttttaaataagcgataaaaggtaaattatttagtatat

SEQ ID NO: 12362 - DNA, 776 bp, Artificial Sequence
  chemically treated genomic DNA (Homo sapiens) CpG-island No: 12362
atatactaaataatttaccttttatcgcttatttaaaacttccctaactacaacgaatataacaacgatacattcttcacacaaaaacgactatttaacgatactaaaacgaatcgacgttcgccgtatcacccaacttccataacgtaaacccaaacacacaacgctttacacgccgtacaacgctatttacgaataaaacccaacacccccgttcgtccatccaacgccgaccgaatcaacgccaacgaaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgaaaattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaacgcctacgcctcgatcgaatcgtcaaaccgcgaaccgt

SEQ ID NO: 12363 - DNA, 776 bp, Artificial Sequence
  chemically treated genomic DNA (Homo sapiens) CpG-island No: 12363
atgtgttgggtggtttattttttgtcgtttgtttggggtttttttggttgtagcggatatgataacggtgtattttttatatagggacggttgtttagcgatgttgaggcgggtcggcgttcgtcgtattatttaatttttataacgtaaatttaggtatatagcgttttgtacgtcgtataacgttgtttacgggtgaggtttaatattttcgttcgtttatttagcgtcggtcgggttaacgttagcgaggtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggagattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattagcgtttgcgtttcgatcggatcgttaagtcgcggatcgt

SEQ ID NO: 12364 - DNA, 776 bp, Artificial Sequence
  chemically treated genomic DNA (Homo sapiens) CpG-island No: 12364
acgatccgcgacttaacgatccgatcgaaacgcaaacgctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatctccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatacctcgctaacgttaacccgaccgacgctaaataaacgaacgaaaatattaaacctcacccgtaaacaacgttatacgacgtacaaaacgctatatacctaaatttacgttataaaaattaaataatacgacgaacgccgacccgcctcaacatcgctaaacaaccgtccctatataaaaaatacaccgttatcatatccgctacaaccaaaaaaaccccaaacaaacgacaaaaaataaaccacccaacacat

SEQ ID NO: 12365 - DNA, 786 bp, Artificial Sequence
  chemically treated genomic DNA (Homo sapiens) CpG-island No: 12365
  misc_feature (716)..(716): n is either a, c, g or t
  misc_feature (736)..(736): n is either a, c, g or t
  misc_feature (743)..(743): n is either a, c, g or t
cgtttcgttattcgttcgtttttacgtttattacggatcggatatttttcgttttgggaaatttattacgagaattttttggcgatatttttcgcgagttttaggtcgcgttggcgttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgtttgtgtgcggtgtgaaagcgttgtttgtcggttatgaggtttttggngtggggatcggatttgtggnggttggnggttcgatcgggtttgtgtttttcgttaaggtggttagtggtt

SEQ ID NO: 12366 - DNA, 786 bp, Artificial Sequence
  chemically treated genomic DNA (Homo sapiens) CpG-island No: 12366
  misc_feature (44)..(44): n is either a, c, g or t
  misc_feature (51)..(51): n is either a, c, g or t
  misc_feature (71)..(71): n is either a, c, g or t
aaccactaaccaccttaacgaaaaacacaaacccgatcgaaccnccaaccnccacaaatccgatccccacnccaaaaacctcataaccgacaaacaacgctttcacaccgcacacaaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaacgccaacgcgacctaaaactcgcgaaaaatatcgccaaaaaattctcgtaataaatttcccaaaacgaaaaatatccgatccgtaataaacgtaaaaacgaacgaataacgaaacg

SEQ ID NO: 12367 - DNA, 786 bp, Artificial Sequence
  chemically treated genomic DNA (Homo sapiens) CpG-island No: 12367
  misc_feature (44)..(44): n is either a, c, g or t
  misc_feature (51)..(51): n is either a, c, g or t
  misc_feature (71)..(71): n is either a, c, g or t
agttattggttattttgacggaaaatataaattcgatcgggttnttagttnttatagattcggtttttatnttagaagttttatgatcggtagatagcgtttttatatcgtatataaacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattagcgttagcgcgatttaaaattcgcggggggtgtcgttaaagggttttcgtaatgggttttttaaagcggaaaatgttcggttcgtggtgggcgtgaaggcgagcgaatagcgaggcg

SEQ ID NO: 12368 - DNA, 786 bp, Artificial Sequence
  chemically treated genomic DNA (Homo sapiens) CpG-island No: 12368
  misc_feature (716)..(716): n is either a, c, g or t
  misc_feature (736)..(736): n is either a, c, g or t
  misc_feature (743)..(743): n is either a, c, g or t
cgcctcgctattcgctcgccttcacgcccaccacgaaccgaacattttccgctttaaaaaacccattacgaaaaccctttaacgacaccccccgcgaattttaaatcgcgctaacgctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgtttatatacgatataaaaacgctatctaccgatcataaaacttctaanataaaaaccgaatctataanaactaanaacccgatcgaatttatattttccgtcaaaataaccaataact

SEQ ID NO: 12369 - DNA, 783 bp, Artificial Sequence
  chemically treated genomic DNA (Homo sapiens) CpG-island No: 12369
gtcgaaacggggttggttgtagtcggtggtcggggagatttttagtttgcgttcgagtatttcggggtgtggggttagaggtaggtcgatttcggcgtgtatatcgttcgttttgtattcgagcgtttttattcggttttttttgaagtttgtgtattgcgatcgagtttttttaaagtagtagcggggttcgcggttacgtgaggtcgatttttggaaagtttttggaaagtcgttttcgtagtagtcgggcggggcgcgagcggagcgttgattggggagggaggcggggagtaagggaggcgcgtcggtttgggaagtcgcgcgtattcgttgtttttgggatcgacgtttaatttttgttaagtttcgtcgtagtcgtcgcggttggcgggttttgggttttttttgaagtatgagttttttcgttcgtagttatttttatcgcgtggttcgcggatagtgcgcgtcggggtttcgggtgtatagttttaggatatttcgtgttcgtagttcgggcgttcgcggtaggtatcggtagtgggggaagttcgaaggtttcgtttcgaggagagttatcggggagggcggcgaggcgcggtcgcgtgcgtcggggagcggcggacggtttgggttttcgtagttcggagcgtcggggaagagagagttcgaatcgcggttttgtttcgcggtttagcgttgttgtttgttttttttagttttttttcggcgtttggaagtgtttggagttttttttttttattttttttaaattgttattta

SEQ ID NO: 12370 - DNA, 783 bp, Artificial Sequence
  chemically treated genomic DNA (Homo sapiens) CpG-island No: 12370
taaataacaatttaaaaaaaataaaaaaaaaaaactccaaacacttccaaacgccgaaaaaaaactaaaaaaaacaaacaacaacgctaaaccgcgaaacaaaaccgcgattcgaactctctcttccccgacgctccgaactacgaaaacccaaaccgtccgccgctccccgacgcacgcgaccgcgcctcgccgccctccccgataactctcctcgaaacgaaaccttcgaacttcccccactaccgatacctaccgcgaacgcccgaactacgaacacgaaatatcctaaaactatacacccgaaaccccgacgcgcactatccgcgaaccacgcgataaaaataactacgaacgaaaaaactcatacttcaaaaaaaacccaaaacccgccaaccgcgacgactacgacgaaacttaacaaaaattaaacgtcgatcccaaaaacaacgaatacgcgcgacttcccaaaccgacgcgcctcccttactccccgcctccctccccaatcaacgctccgctcgcgccccgcccgactactacgaaaacgactttccaaaaactttccaaaaatcgacctcacgtaaccgcgaaccccgctactactttaaaaaaactcgatcgcaatacacaaacttcaaaaaaaaccgaataaaaacgctcgaatacaaaacgaacgatatacacgccgaaatcgacctacctctaaccccacaccccgaaatactcgaacgcaaactaaaaatctccccgaccaccgactacaaccaaccccgtttcgac

SEQ ID NO: 12371 - DNA, 783 bp, Artificial Sequence
  chemically treated genomic DNA (Homo sapiens) CpG-island No: 12371
tgaatggtagtttaggggaaataaaaaaaagaaattttagatatttttagacgtcgagaaggggttggagaaagtaggtagtaacgttaggtcgcggggtagagtcgcggttcggattttttttttttcggcgtttcgagttgcggaagtttaggtcgttcgtcgtttttcggcgtacgcggtcgcgtttcgtcgtttttttcggtaatttttttcggggcggagttttcgggttttttttattatcggtatttgtcgcgggcgttcgagttgcgggtacggggtattttgaggttgtgtattcgggatttcggcgcgtattgttcgcgggttacgcggtgagggtggttgcgggcgagagggtttatgttttaggggaagtttaaggttcgttagtcgcggcggttgcgacgagatttggtaagagttaaacgtcggttttaggagtagcgagtgcgcgcgattttttagatcgacgcgttttttttgtttttcgtttttttttttagttagcgtttcgttcgcgtttcgttcggttgttgcggaggcggttttttaggaattttttaggaatcggttttacgtgatcgcgggtttcgttattgttttaaagaggttcggtcgtaatatataggttttagggaagatcgggtgagagcgttcgggtgtagggcgggcggtgtgtacgtcggggtcggtttgtttttggttttatatttcggggtgttcgggcgtaagttagagattttttcggttatcggttatagttaatttcgtttcggt

SEQ ID NO: 12372 - DNA, 783 bp, Artificial Sequence
  chemically treated genomic DNA (Homo sapiens) CpG-island No: 12372
accgaaacgaaattaactataaccgataaccgaaaaaatctctaacttacgcccgaacaccccgaaatataaaaccaaaaacaaaccgaccccgacgtacacaccgcccgccctacacccgaacgctctcacccgatcttccctaaaacctatatattacgaccgaacctctttaaaacaataacgaaacccgcgatcacgtaaaaccgattcctaaaaaattcctaaaaaaccgcctccgcaacaaccgaacgaaacgcgaacgaaacgctaactaaaaaaaaaaacgaaaaacaaaaaaaacgcgtcgatctaaaaaatcgcgcgcactcgctactcctaaaaccgacgtttaactcttaccaaatctcgtcgcaaccgccgcgactaacgaaccttaaacttcccctaaaacataaaccctctcgcccgcaaccaccctcaccgcgtaacccgcgaacaatacgcgccgaaatcccgaatacacaacctcaaaataccccgtacccgcaactcgaacgcccgcgacaaataccgataataaaaaaaacccgaaaactccgccccgaaaaaaattaccgaaaaaaacgacgaaacgcgaccgcgtacgccgaaaaacgacgaacgacctaaacttccgcaactcgaaacgccgaaaaaaaaaaaatccgaaccgcgactctaccccgcgacctaacgttactacctactttctccaaccccttctcgacgtctaaaaatatctaaaatttcttttttttatttcccctaaactaccattca

SEQ ID NO: 12373 - DNA, 827 bp, Artificial Sequence
  chemically treated genomic DNA (Homo sapiens) CpG-island No: 12373
ggacgcgaatttttttttgattttagttcgggcggttatttgtttttgtcgcggtgattttttttttatgattttgcggtgttttgagtttttcgggaatggcggggaagggacgcggagttagtgggggatcgcggggtcggcggaggagttattttcgtaggcggcgcgtttggcgaaggttttgcgggagttcggttagataggtagggagtcgatcggtcgcgacgcgtgcgggagggagcgtttttttaaggaagtagttaggaagcggggtcgaggtgggaagtaaagaataagatggaaatacgttttttgtttttaagggatcgcggagagtacgttcgtagggttttgggtttttgggaatgcgtaaggaaagtggttttttagggatttaggtttggcggagcgtagagcgcgggaagagttttttggaaatagttttttagtacgttggaagatttattgtttttcgtagttgtttagggttaggttttcgggttcgaatttcggtcggggaaagcgtcgggcgtttttttttgtacggggtgtaattagtaagtcggtgtcgcgggtttcgtaggtttagtagtatttggttttcgggcggagttgcggttgtagtttaggattttggcggttaagtttagggattgatattgtcgcgagggcggttgttcgggcgtcgagagtaggttgcgaagttttcgtcgagcgcggtttttatggtcggcgcgtttagggtattgtcgtttttaagtatagttaggtaattcgcgcggtacgttgtttttaggtatttgaaaaaagaaaaaagaaaaaaa

SEQ ID NO: 12374 - DNA, 827 bp, Artificial Sequence
  chemically treated genomic DNA (Homo sapiens) CpG-island No: 12374
tttttttcttttttcttttttcaaatacctaaaaacaacgtaccgcgcgaattacctaactatacttaaaaacgacaataccctaaacgcgccgaccataaaaaccgcgctcgacgaaaacttcgcaacctactctcgacgcccgaacaaccgccctcgcgacaatatcaatccctaaacttaaccgccaaaatcctaaactacaaccgcaactccgcccgaaaaccaaatactactaaacctacgaaacccgcgacaccgacttactaattacaccccgtacaaaaaaaaacgcccgacgctttccccgaccgaaattcgaacccgaaaacctaaccctaaacaactacgaaaaacaataaatcttccaacgtactaaaaaactatttccaaaaaactcttcccgcgctctacgctccgccaaacctaaatccctaaaaaaccactttccttacgcattcccaaaaacccaaaaccctacgaacgtactctccgcgatcccttaaaaacaaaaaacgtatttccatcttattctttacttcccacctcgaccccgcttcctaactacttccttaaaaaaacgctccctcccgcacgcgtcgcgaccgatcgactccctacctatctaaccgaactcccgcaaaaccttcgccaaacgcgccgcctacgaaaataactcctccgccgaccccgcgatcccccactaactccgcgtcccttccccgccattcccgaaaaactcaaaacaccgcaaaatcataaaaaaaaaatcaccgcgacaaaaacaaataaccgcccgaactaaaatcaaaaaaaaattcgcgtcc

SEQ ID NO: 12375 - DNA, 827 bp, Artificial Sequence
  chemically treated genomic DNA (Homo sapiens) CpG-island No: 12375
ttttttttttttttttttttttagatgtttagagatagcgtgtcgcgcgaattgtttgattgtatttgaaagcggtagtattttgggcgcgtcgattatggaagtcgcgttcggcgggggtttcgtagtttattttcgacgttcgggtagtcgttttcgcggtagtgttagtttttgaatttggtcgttaagattttgggttgtagtcgtagtttcgttcgggagttagatgttgttgggtttgcggggttcgcggtatcgatttgttgattgtatttcgtgtaaagggaggcgttcgacgtttttttcggtcggggttcgagttcgggagtttaattttgagtagttgcggaaaatagtaaattttttagcgtgttaagaagttatttttaagaagtttttttcgcgttttgcgtttcgttaggtttgagtttttggagaattattttttttacgtatttttaaggatttaggattttgcgagcgtgtttttcgcggttttttggaagtaagggacgtatttttattttattttttgttttttatttcgatttcgttttttagttgtttttttggggaggcgttttttttcgtacgcgtcgcggtcgatcggttttttatttgtttgatcgagttttcgtagggttttcgttagacgcgtcgtttgcggggatggttttttcgtcgatttcgcggttttttattggtttcgcgtttttttttcgttattttcggagggtttaaggtatcgtagggttatgagagaagggttatcgcggtaaagataggtggtcgttcgagttggggttagagaagggttcgcgttt

SEQ ID NO: 12376 - DNA, 827 bp, Artificial Sequence
  chemically treated genomic DNA (Homo sapiens) CpG-island No: 12376
aaacgcgaacccttctctaaccccaactcgaacgaccacctatctttaccgcgataacccttctctcataaccctacgataccttaaaccctccgaaaataacgaaaaaaaaacgcgaaaccaataaaaaaccgcgaaatcgacgaaaaaaccatccccgcaaacgacgcgtctaacgaaaaccctacgaaaactcgatcaaacaaataaaaaaccgatcgaccgcgacgcgtacgaaaaaaaacgcctccccaaaaaaacaactaaaaaacgaaatcgaaataaaaaacaaaaaataaaataaaaatacgtcccttacttccaaaaaaccgcgaaaaacacgctcgcaaaatcctaaatccttaaaaatacgtaaaaaaaataattctccaaaaactcaaacctaacgaaacgcaaaacgcgaaaaaaacttcttaaaaataacttcttaacacgctaaaaaatttactattttccgcaactactcaaaattaaactcccgaactcgaaccccgaccgaaaaaaacgtcgaacgcctccctttacacgaaatacaatcaacaaatcgataccgcgaaccccgcaaacccaacaacatctaactcccgaacgaaactacgactacaacccaaaatcttaacgaccaaattcaaaaactaacactaccgcgaaaacgactacccgaacgtcgaaaataaactacgaaacccccgccgaacgcgacttccataatcgacgcgcccaaaatactaccgctttcaaatacaatcaaacaattcgcgcgacacgctatctctaaacatctaaaaaaaaaaaaaaaaaaaaaa

SEQ ID NO: 12377 - DNA, 570 bp, Artificial Sequence
  chemically treated genomic DNA (Homo sapiens) CpG-island No: 12377
tcgggtttgtttgtttttggtcgtcgtcgttatcgtcgcgtaagtcggatagtcgtgagggttggaggggaaattaggttatcggttcgtagacgcggcgcggagtaggcgtttcgggttcggagtaagatagcgttcgggaagcgggtcggggcgggtcgggtacgcgggggattcggagaggcggggattttggtgttttagtcgtagtagttttttacgtttataaaagtggagagatcggggaggtgcggcgcggttttggttgcggtcgttttttttcgtttaaggagttgatattttgtaggattcgcgcgacgtttagtcgtcggcgtttttcgggatttcgtcgtcgggaggagggggcggaggagggtggagattgcggggtttggttaaggaaggcgtatattttcgggcgggcggtcgtgacgcggcggggattaattttgtatgaataatgtgagtgcgtttggaaaagagattttttgtttcgcgggttcggggtaagagttcgtaggttatttttttcgggtaggggcgtttaatttaatcggttttagggtattg

SEQ ID NO: 12378 - DNA, 570 bp, Artificial Sequence
  chemically treated genomic DNA (Homo sapiens) CpG-island No: 12378
caataccctaaaaccgattaaattaaacgcccctacccgaaaaaaataacctacgaactcttaccccgaacccgcgaaacaaaaaatctcttttccaaacgcactcacattattcatacaaaattaatccccgccgcgtcacgaccgcccgcccgaaaatatacgccttccttaaccaaaccccgcaatctccaccctcctccgccccctcctcccgacgacgaaatcccgaaaaacgccgacgactaaacgtcgcgcgaatcctacaaaatatcaactccttaaacgaaaaaaaacgaccgcaaccaaaaccgcgccgcacctccccgatctctccacttttataaacgtaaaaaactactacgactaaaacaccaaaatccccgcctctccgaatcccccgcgtacccgacccgccccgacccgcttcccgaacgctatcttactccgaacccgaaacgcctactccgcgccgcgtctacgaaccgataacctaatttcccctccaaccctcacgactatccgacttacgcgacgataacgacgacgaccaaaaacaaacaaacccga

SEQ ID NO: 12379 - DNA, 570 bp, Artificial Sequence
  chemically treated genomic DNA (Homo sapiens) CpG-island No: 12379
tagtgttttggagtcggttgggttgagcgtttttgttcggggaaggtagtttgcgggtttttgtttcgagttcgcggagtaggaggttttttttttaagcgtatttatattatttatgtaaagttaattttcgtcgcgttacggtcgttcgttcgaggatgtgcgttttttttggttaagtttcgtagtttttattttttttcgtttttttttttcggcggcggggtttcggggagcgtcggcgattgggcgtcgcgcgagttttgtaaaatgttaattttttgggcgaagagaggcggtcgtagttagggtcgcgtcgtattttttcggtttttttatttttataggcgtaggaagttattgcggttggggtattagagttttcgttttttcgggtttttcgcgtgttcggttcgtttcggttcgtttttcgggcgttgttttatttcgggttcggggcgtttgtttcgcgtcgcgtttgcgaatcggtgatttggttttttttttagtttttacggttgttcgatttgcgcggcggtggcggcggcggttaagagtaggtaaattcgg

SEQ ID NO: 12380 - DNA, 570 bp, Artificial Sequence
  chemically treated genomic DNA (Homo sapiens) CpG-island No: 12380
ccgaatttacctactcttaaccgccgccgccaccgccgcgcaaatcgaacaaccgtaaaaactaaaaaaaaaaccaaatcaccgattcgcaaacgcgacgcgaaacaaacgccccgaacccgaaataaaacaacgcccgaaaaacgaaccgaaacgaaccgaacacgcgaaaaacccgaaaaaacgaaaactctaataccccaaccgcaataacttcctacgcctataaaaataaaaaaaccgaaaaaatacgacgcgaccctaactacgaccgcctctcttcgcccaaaaaattaacattttacaaaactcgcgcgacgcccaatcgccgacgctccccgaaaccccgccgccgaaaaaaaaaaacgaaaaaaaataaaaactacgaaacttaaccaaaaaaaacgcacatcctcgaacgaacgaccgtaacgcgacgaaaattaactttacataaataatataaatacgcttaaaaaaaaaacctcctactccgcgaactcgaaacaaaaacccgcaaactaccttccccgaacaaaaacgctcaacccaaccgactccaaaacacta

SEQ ID NO: 12381 - DNA, 500 bp, Artificial Sequence
  chemically treated genomic DNA (Homo sapiens) CpG-island No: 12381
  misc_feature (382)..(382): n is either a, c, g or t
  misc_feature (422)..(422): n is either a, c, g or t
  misc_feature (424)..(424): n is either a, c, g or t
  misc_feature (436)..(436): n is either a, c, g or t
  misc_feature (453)..(453): n is either a, c, g or t
ggtatagtaggtagcgtagattattaacggtgtgtttagttagttattggtaattttttcggcgagtttggttaatcgtgattagaacgaagtgaacgaaattcgtcgttagtgggttttggtttttcgggaaacgggattattacgatggaataggttaacgtaggaatgcgcgtagttcgtcggtagaatcgattatttttgttattattcgggtagtttgttgtatgggtgtcggaagaagtattcgttatcgtcggattgttaaacgttagcgagttggttgatatggtttacgagtattgtcggaagcgaggtttgtattcggatgtcggagttttatttcgtggaaattaaacgcgtattattggttggttattantttgtattagaatatgcgggtttatgcgtttattgatgtngnattacgtcgtanggtcgtagatgagtttngttatatgattgcgagattaatcgtggtgaggcgatttttgaatagt

SEQ ID NO: 12382 - DNA, 500 bp, Artificial Sequence
  chemically treated genomic DNA (Homo sapiens) CpG-island No: 12382
  misc_feature (48)..(48): n is either a, c, g or t
  misc_feature (65)..(65): n is either a, c, g or t
  misc_feature (77)..(77): n is either a, c, g or t
  misc_feature (79)..(79): n is either a, c, g or t
  misc_feature (119)..(119): n is either a, c, g or t
actattcaaaaatcgcctcaccacgattaatctcgcaatcatataacnaaactcatctacgaccntacgacgtaatncnacatcaataaacgcataaacccgcatattctaatacaaantaataaccaaccaataatacgcgtttaatttccacgaaataaaactccgacatccgaatacaaacctcgcttccgacaatactcgtaaaccatatcaaccaactcgctaacgtttaacaatccgacgataacgaatacttcttccgacacccatacaacaaactacccgaataataacaaaaataatcgattctaccgacgaactacgcgcattcctacgttaacctattccatcgtaataatcccgtttcccgaaaaaccaaaacccactaacgacgaatttcgttcacttcgttctaatcacgattaaccaaactcgccgaaaaaattaccaataactaactaaacacaccgttaataatctacgctacctactatacc

SEQ ID NO: 12383 - DNA, 500 bp, Artificial Sequence
  chemically treated genomic DNA (Homo sapiens) CpG-island No: 12383
  misc_feature (48)..(48): n is either a, c, g or t
  misc_feature (65)..(65): n is either a, c, g or t
  misc_feature (77)..(77): n is either a, c, g or t
  misc_feature (79)..(79): n is either a, c, g or t
  misc_feature (119)..(119): n is either a, c, g or t
attgtttagggatcgttttattacggttaatttcgtagttatatgatnaagtttatttgcggttntacggcgtaatntngtattagtaagcgtatgggttcgtatgttttgatataggntggtaattagttagtagtgcgcgtttgatttttacgggataagatttcggtattcggatataggtttcgttttcggtaatattcgtaaattatattaattagttcgttgacgtttggtagttcggcggtaacggatgtttttttcggtatttatgtaataaattgttcgggtgatggtagaaatggtcgattttgtcgacgggttacgcgtatttttgcgttaatttgttttatcgtggtgatttcgtttttcgaaaagttagaatttattggcgacggatttcgtttatttcgttttggttacggttagttaggttcgtcgggaaagttgttagtaattggttgaatatatcgttgatgatttgcgttatttgttgtatt

SEQ ID NO: 12384 - DNA, 500 bp, Artificial Sequence
  chemically treated genomic DNA (Homo sapiens) CpG-island No: 12384
  misc_feature (382)..(382): n is either a, c, g or t
  misc_feature (422)..(422): n is either a, c, g or t
  misc_feature (424)..(424): n is either a, c, g or t
  misc_feature (436)..(436): n is either a, c, g or t
  misc_feature (453)..(453): n is either a, c, g or t
aatacaacaaataacgcaaatcatcaacgatatattcaaccaattactaacaactttcccgacgaacctaactaaccgtaaccaaaacgaaataaacgaaatccgtcgccaataaattctaacttttcgaaaaacgaaatcaccacgataaaacaaattaacgcaaaaatacgcgtaacccgtcgacaaaatcgaccatttctaccatcacccgaacaatttattacataaataccgaaaaaaacatccgttaccgccgaactaccaaacgtcaacgaactaattaatataatttacgaatattaccgaaaacgaaacctatatccgaataccgaaatcttatcccgtaaaaatcaaacgcgcactactaactaattaccancctatatcaaaacatacgaacccatacgcttactaatacnanattacgccgtanaaccgcaaataaacttnatcatataactacgaaattaaccgtaataaaacgatccctaaacaat

SEQ ID NO: 12385 - DNA, 842 bp, Artificial Sequence
  chemically treated genomic DNA (Homo sapiens) CpG-island No: 12385
  misc_feature (28)..(28): n is either a, c, g or t
ttcgtagacgcggcgcggagtaggcgtntcgggttcggagtaagatagcgttcgggaagcgggtcggggcgggtcgggtacgcgggggattcggagaggcggggattttggtgttttagtcgtagtagttttttacgtttataaaagtggagagatcggggaggtgcggcgcggttttggttgcggtcgttttttttcgtttaaggagttgatattttgtaggattcgcgcgacgtttagtcgtcggcgtttttcgggatttcgtcgtcgggaggagggggcggaggagggtggagattgcggggtttggttaaggaaggcgtatattttcgggcgggcggtcgtgacgcggcggggattaattttgtatgaataatgtgagtgcgtttggaaaagagattttttgtttcgcgggttcggggtaagagttcgtaggttatttttttcgggtaggggcgtttaatttaatcggttttagggaattggtaatttggttagaggatcgcgcgaaggtaagcggggtgagaggaggagggggcgatagttttaattgtttatagggtgggcgggatggtgacggagcgtcgtaagaattcggaggggtgcgggcggttaagtcgagcgcgcgcgggcgggtaggcgggtgagcgtgggtggtgggggtgttattagtttgattatttgttttcgcggggtttttgcgtttcggatttgggaggaggtgttttttcgtgttcgggtatcgcgcggcggtaggttgggagttacggagtggatagtggtggaatagggtggtcgggttttgttttaatcgtagcggttttgttttttaaattttaagt

SEQ ID NO: 12386 - DNA, 842 bp, Artificial Sequence
  chemically treated genomic DNA (Homo sapiens) CpG-island No: 12386
  misc_feature (815)..(815): n is either a, c, g or t
acttaaaatttaaaaaacaaaaccgctacgattaaaacaaaacccgaccaccctattccaccactatccactccgtaactcccaacctaccgccgcgcgatacccgaacacgaaaaaacacctcctcccaaatccgaaacgcaaaaaccccgcgaaaacaaataatcaaactaataacacccccaccacccacgctcacccgcctacccgcccgcgcgcgctcgacttaaccgcccgcacccctccgaattcttacgacgctccgtcaccatcccgcccaccctataaacaattaaaactatcgccccctcctcctctcaccccgcttaccttcgcgcgatcctctaaccaaattaccaattccctaaaaccgattaaattaaacgcccctacccgaaaaaaataacctacgaactcttaccccgaacccgcgaaacaaaaaatctcttttccaaacgcactcacattattcatacaaaattaatccccgccgcgtcacgaccgcccgcccgaaaatatacgccttccttaaccaaaccccgcaatctccaccctcctccgccccctcctcccgacgacgaaatcccgaaaaacgccgacgactaaacgtcgcgcgaatcctacaaaatatcaactccttaaacgaaaaaaaacgaccgcaaccaaaaccgcgccgcacctccccgatctctccacttttataaacgtaaaaaactactacgactaaaacaccaaaatccccgcctctccgaatcccccgcgtacccgacccgccccgacccgcttcccgaacgctatcttactccgaacccganacgcctactccgcgccgcgtctacgaa

SEQ ID NO: 12387 - DNA, 842 bp, Artificial Sequence
  chemically treated genomic DNA (Homo sapiens) CpG-island No: 12387
  misc_feature (815)..(815): n is either a, c, g or t
gtttggggtttgaggaatagagtcgttgcgattggaatagagttcggttattttgttttattattgtttatttcgtagtttttagtttgtcgtcgcgcggtgttcgaatacgagagggtatttttttttagattcggggcgtagaagtttcgcggaggtaggtaattaggttgatgatatttttattatttacgtttattcgtttgttcgttcgcgcgcgttcggtttagtcgttcgtattttttcgggtttttgcgacgtttcgttattatttcgtttattttgtggatagttggaattgtcgtttttttttttttttatttcgtttgttttcgcgcggttttttagttaaattattagttttttggagtcggttgggttgagcgtttttgttcggggaaggtagtttgcgggtttttgtttcgagttcgcggagtaggaggttttttttttaagcgtatttatattatttatgtaaagttaattttcgtcgcgttacggtcgttcgttcgaggatgtgcgttttttttggttaagtttcgtagtttttattttttttcgtttttttttttcggcggcggggtttcggggagcgtcggcgattgggcgtcgcgcgagttttgtaaaatgttaattttttgggcgaagagaggcggtcgtagttagggtcgcgtcgtattttttcggtttttttatttttataggcgtaggaagttattgcggttggggtattagagttttcgttttttcgggtttttcgcgtgttcggttcgtttcggttcgtttttcgggcgttgttttatttcgggttcggngcgtttgtttcgcgtcgcgtttgcgaa

SEQ ID NO: 12388 - DNA, 842 bp, Artificial Sequence
  chemically treated genomic DNA (Homo sapiens) CpG-island No: 12388
  misc_feature (28)..(28): n is either a, c, g or t
ttcgcaaacgcgacgcgaaacaaacgcnccgaacccgaaataaaacaacgcccgaaaaacgaaccgaaacgaaccgaacacgcgaaaaacccgaaaaaacgaaaactctaataccccaaccgcaataacttcctacgcctataaaaataaaaaaaccgaaaaaatacgacgcgaccctaactacgaccgcctctcttcgcccaaaaaattaacattttacaaaactcgcgcgacgcccaatcgccgacgctccccgaaaccccgccgccgaaaaaaaaaaacgaaaaaaaataaaaactacgaaacttaaccaaaaaaaacgcacatcctcgaacgaacgaccgtaacgcgacgaaaattaactttacataaataatataaatacgcttaaaaaaaaaacctcctactccgcgaactcgaaacaaaaacccgcaaactaccttccccgaacaaaaacgctcaacccaaccgactccaaaaaactaataatttaactaaaaaaccgcgcgaaaacaaacgaaataaaaaaaaaaaaaaacgacaattccaactatccacaaaataaacgaaataataacgaaacgtcgcaaaaacccgaaaaaatacgaacgactaaaccgaacgcgcgcgaacgaacaaacgaataaacgtaaataataaaaatatcatcaacctaattacctacctccgcgaaacttctacgccccgaatctaaaaaaaaataccctctcgtattcgaacaccgcgcgacgacaaactaaaaactacgaaataaacaataataaaacaaaataaccgaactctattccaatcgcaacgactctattcctcaaaccccaaac

SEQ ID NO: 12389 - DNA, 760 bp, Artificial Sequence
  chemically treated genomic DNA (Homo sapiens) CpG-island No: 12389
cgcggaattttgcggtcggtagcggttttttttttttttcgggtcgcgatttcgtcgattcgcgttaaatatatggagattaataaagttacgttttcgagttacgtggttagtgttttttttttttcgcgggcgggttgggggcgcgcgaggaggggcgtcgcgagtttgaggagcggggggcggtgatagcgtcgtttttcgtcgcgggatttcggtcgttacgggattttcgtttcgtttcggttttttcggtagttcggtttgcgaagttcggtggttaggtcggtgggttttagtcgcgtcgggtattggttcgttcgttcgtttatttattatagtgatcggggatattatggcggcggcggcggcggttggtattttgtttcgggttgtagcggttaggacgcgtttacggttaggtaagtcggcgacgattttataaagttcggagacgggataataattttcgagcgttcgcgttcggggttttgttagttagtttcgtgacgttattttgttagggtaatgagcgggcgggacggggggcgaggcggttggcgcgcggtaggtttcggttgttgttcggagaaggaggatttttcggggttagaggcgatatttttatgttcgttttttggaggcgtgtaaggcgtttacggaacgtgaacgtgatcgtgatttcggtgtttgggtgaggattgagtttggttgagagataaatatattgttgttttggacgtatagttatatatatttt

SEQ ID NO: 12390 - DNA, 760 bp, Artificial Sequence
  chemically treated genomic DNA (Homo sapiens) CpG-island No: 12390
aaaatatatataactatacgtccaaaacaacaatatatttatctctcaaccaaactcaatcctcacccaaacaccgaaatcacgatcacgttcacgttccgtaaacgccttacacgcctccaaaaaacgaacataaaaatatcgcctctaaccccgaaaaatcctccttctccgaacaacaaccgaaacctaccgcgcgccaaccgcctcgccccccgtcccgcccgctcattaccctaacaaaataacgtcacgaaactaactaacaaaaccccgaacgcgaacgctcgaaaattattatcccgtctccgaactttataaaatcgtcgccgacttacctaaccgtaaacgcgtcctaaccgctacaacccgaaacaaaataccaaccgccgccgccgccgccataatatccccgatcactataataaataaacgaacgaacgaaccaatacccgacgcgactaaaacccaccgacctaaccaccgaacttcgcaaaccgaactaccgaaaaaaccgaaacgaaacgaaaatcccgtaacgaccgaaatcccgcgacgaaaaacgacgctatcaccgccccccgctcctcaaactcgcgacgcccctcctcgcgcgcccccaacccgcccgcgaaaaaaaaaaaacactaaccacgtaactcgaaaacgtaactttattaatctccatatatttaacgcgaatcgacgaaatcgcgacccgaaaaaaaaaaaaaaccgctaccgaccgcaaaattccgcg

SEQ ID NO: 12391 - DNA, 760 bp, Artificial Sequence
  chemically treated genomic DNA (Homo sapiens) CpG-island No: 12391
aaaatgtatgtggttgtgcgtttaggatagtaatgtgtttgttttttagttaagtttagtttttatttaggtatcggggttacggttacgtttacgtttcgtggacgttttgtacgtttttaagaggcgggtatgggggtatcgtttttgatttcgggagatttttttttttcgagtagtagtcggggtttgtcgcgcgttagtcgtttcgtttttcgtttcgttcgtttattgttttggtagggtgacgttacggggttagttgatagaatttcgggcgcgggcgttcggaagttattgtttcgttttcgggttttgtagaatcgtcgtcggtttatttggtcgtgggcgcgttttggtcgttgtagttcggagtagggtgttagtcgtcgtcgtcgtcgttatggtgttttcggttattgtggtgagtgagcgagcgagcgagttagtgttcggcgcggttggagtttatcggtttggttatcggatttcgtaggtcgagttgtcgaaggggtcgaggcggggcgggggtttcgtggcggtcggagtttcgcggcgggaggcggcgttgttatcgtttttcgttttttagattcgcggcgttttttttcgcgcgtttttagttcgttcgcggagggaggaaaatattggttacgtgattcggaagcgtgattttgttgatttttatgtatttggcgcgggtcggcggggtcgcggttcgggagagggaggggatcgttgtcggtcgtagagtttcgcg

SEQ ID NO: 12392 - DNA, 760 bp, Artificial Sequence
  chemically treated genomic DNA (Homo sapiens) CpG-island No: 12392
cgcgaaactctacgaccgacaacgatcccctccctctcccgaaccgcgaccccgccgacccgcgccaaatacataaaaatcaacaaaatcacgcttccgaatcacgtaaccaatattttcctccctccgcgaacgaactaaaaacgcgcgaaaaaaaacgccgcgaatctaaaaaacgaaaaacgataacaacgccgcctcccgccgcgaaactccgaccgccacgaaacccccgccccgcctcgaccccttcgacaactcgacctacgaaatccgataaccaaaccgataaactccaaccgcgccgaacactaactcgctcgctcgctcactcaccacaataaccgaaaacaccataacgacgacgacgacgactaacaccctactccgaactacaacgaccaaaacgcgcccacgaccaaataaaccgacgacgattctacaaaacccgaaaacgaaacaataacttccgaacgcccgcgcccgaaattctatcaactaaccccgtaacgtcaccctaccaaaacaataaacgaacgaaacgaaaaacgaaacgactaacgcgcgacaaaccccgactactactcgaaaaaaaaaaatctcccgaaatcaaaaacgatacccccatacccgcctcttaaaaacgtacaaaacgtccacgaaacgtaaacgtaaccgtaaccccgatacctaaataaaaactaaacttaactaaaaaacaaacacattactatcctaaacgcacaaccacatacatttt

SEQ ID NO: 12393 - DNA, 1043 bp, Artificial Sequence
  chemically treated genomic DNA (Homo sapiens) CpG-island No: 12393
tcgggcgtttagggttcgagtgttttgcgtttcggttattttttttagggcgtcgtcgggttggttggggcgtagtttatacgttcgcgggggcgaagcgatagtagtcgtagggttgggagcgaggagttatttatcgtagtacgtcgagtttagtaatagcgtcgttattaggggttatattttcgcgttcgtcgcggggtcgtcgtcgtcgtcgtaggtgttcggagtagtagtcgtcgtcgtcgttataggtaggatcgatcgtcgtcgcgcgttataggtaggatttattgtttaggttgtacggtcgcgcgtacgcgcgtttttattgtttttcgttcgttttttcgtttgtttttcgttcgcgagagtcgcgtacgcgtattcggtttcgtttcgtaatcgttgttgttgacgcggcgttttttttagtcgtaggttttagattcggggttcgtttgttcgttttacggaggtcggatgtttgttttagggcggtggtacgcgtcgcgtttttaggttacgttttgtcgtattcgttcgtttttggggttcgcgtgttcgttcgtcgtaggaggttgaattttgtgtttttacgttcgtcggggattttattgtattcgtttttgttcgcgggtcggtttttgtttttcgcgcggcgttgggttttattgttttttttttttattttttttttttttgtttttatttttattttcgcgttttaggggtcgggtttcgtttcgttttagttcgcgtttttttttggattcgacgttcggttgcgcgcgtggattaggatatttaggtttttattagcgttcgtttttttcggacgcggtcgtttagcgtcgaagcggtttttgagttcgaggtcgttacgtttagggtagggcggtggtcgggtatttgttcgtagggagtttttattcgtttttcgcgggttttgcgttcggttcgtttattcgttttgtttttttttatgcggttttttttttttttttttatttggttttttagtgtttttattttttgattag

SEQ ID NO: 12394 - DNA, 1043 bp, Artificial Sequence
  chemically treated genomic DNA (Homo sapiens) CpG-island No: 12394
ctaatcaaaaaataaaaacactaaaaaaccaaataaaaaaaaaaaaaaaaaaccgcataaaaaaaaacaaaacgaataaacgaaccgaacgcaaaacccgcgaaaaacgaataaaaactccctacgaacaaatacccgaccaccgccctaccctaaacgtaacgacctcgaactcaaaaaccgcttcgacgctaaacgaccgcgtccgaaaaaaacgaacgctaataaaaacctaaatatcctaatccacgcgcgcaaccgaacgtcgaatccaaaaaaaaacgcgaactaaaacgaaacgaaacccgacccctaaaacgcgaaaataaaaataaaaacaaaaaaaaaaaaaataaaaaaaaaaaacaataaaacccaacgccgcgcgaaaaacaaaaaccgacccgcgaacaaaaacgaatacaataaaatccccgacgaacgtaaaaacacaaaattcaacctcctacgacgaacgaacacgcgaaccccaaaaacgaacgaatacgacaaaacgtaacctaaaaacgcgacgcgtaccaccgccctaaaacaaacatccgacctccgtaaaacgaacaaacgaaccccgaatctaaaacctacgactaaaaaaaacgccgcgtcaacaacaacgattacgaaacgaaaccgaatacgcgtacgcgactctcgcgaacgaaaaacaaacgaaaaaacgaacgaaaaacaataaaaacgcgcgtacgcgcgaccgtacaacctaaacaataaatcctacctataacgcgcgacgacgatcgatcctacctataacgacgacgacgactactactccgaacacctacgacgacgacgacgaccccgcgacgaacgcgaaaatataacccctaataacgacgctattactaaactcgacgtactacgataaataactcctcgctcccaaccctacgactactatcgcttcgcccccgcgaacgtataaactacgccccaaccaacccgacgacgccctaaaaaaaataaccgaaacgcaaaacactcgaaccctaaacgcccga

SEQ ID NO: 12395 - DNA, 1043 bp, Artificial Sequence
  chemically treated genomic DNA (Homo sapiens) CpG-island No: 12395
ttgattagaggatgaaaatattaaagaattaagtgagaaagagggaagagaatcgtatagggaagagtagagcgagtagacgagtcgaacgtagagttcgcgaggggcgagtggaagttttttgcgggtaggtattcgattatcgttttgttttgggcgtggcggtttcgggtttagggatcgtttcggcgttagacggtcgcgttcggaggaaacgggcgttggtgaaagtttaggtgttttggtttacgcgcgtagtcggacgtcgggtttagggagagacgcgggttggggcgggacgggattcggtttttgaagcgcgagggtgggagtgaaagtaaagaggagaaaagtagagagagaggatagtggggtttagcgtcgcgcgaaaggtaggaatcgattcgcggataggaacgggtgtaatgaggttttcggcgagcgtgggaatatagggtttagttttttgcggcgggcgagtacgcggattttaggggcgggcgggtgcgataggacgtgatttggaagcgcggcgcgtgttatcgttttggagtaggtattcggttttcgtggagcgggtaggcgggtttcgggtttggagtttgcgattggggagggcgtcgcgttaatagtagcggttgcggggcggggtcgagtgcgcgtgcgcggttttcgcgggcggggagtaggcgggggagcgggcgggaagtagtgggagcgcgcgtgcgcgcggtcgtgtagtttgggtagtgggttttgtttgtgacgcgcggcggcggtcggttttgtttgtaacggcggcggcggttgttgtttcggatatttgcggcggcggcggcgatttcgcggcgggcgcggagatgtggtttttggtagcggcgttgttgttgggttcggcgtgttgcggtgagtggtttttcgtttttagttttgcggttgttgtcgtttcgttttcgcgggcgtgtgggttgcgttttagttagttcggcggcgttttgaagagggtggtcggggcgtagaatattcgggttttgagcgttcga

SEQ ID NO: 12396 - DNA, 1043 bp, Artificial Sequence
  chemically treated genomic DNA (Homo sapiens) CpG-island No: 12396
tcgaacgctcaaaacccgaatattctacgccccgaccaccctcttcaaaacgccgccgaactaactaaaacgcaacccacacgcccgcgaaaacgaaacgacaacaaccgcaaaactaaaaacgaaaaaccactcaccgcaacacgccgaacccaacaacaacgccgctaccaaaaaccacatctccgcgcccgccgcgaaatcgccgccgccgccgcaaatatccgaaacaacaaccgccgccgccgttacaaacaaaaccgaccgccgccgcgcgtcacaaacaaaacccactacccaaactacacgaccgcgcgcacgcgcgctcccactacttcccgcccgctcccccgcctactccccgcccgcgaaaaccgcgcacgcgcactcgaccccgccccgcaaccgctactattaacgcgacgccctccccaatcgcaaactccaaacccgaaacccgcctacccgctccacgaaaaccgaatacctactccaaaacgataacacgcgccgcgcttccaaatcacgtcctatcgcacccgcccgcccctaaaatccgcgtactcgcccgccgcaaaaaactaaaccctatattcccacgctcgccgaaaacctcattacacccgttcctatccgcgaatcgattcctacctttcgcgcgacgctaaaccccactatcctctctctctacttttctcctctttactttcactcccaccctcgcgcttcaaaaaccgaatcccgtcccgccccaacccgcgtctctccctaaacccgacgtccgactacgcgcgtaaaccaaaacacctaaactttcaccaacgcccgtttcctccgaacgcgaccgtctaacgccgaaacgatccctaaacccgaaaccgccacgcccaaaacaaaacgataatcgaatacctacccgcaaaaaacttccactcgcccctcgcgaactctacgttcgactcgtctactcgctctactcttccctatacgattctcttccctctttctcacttaattctttaatattttcatcctctaatcaa

SEQ ID NO: 12397 - DNA, 1003 bp, Artificial Sequence
  chemically treated genomic DNA (Homo sapiens) CpG-island No: 12397
  misc_feature (925)..(925): n is either a, c, g or t
atcgcgtttttattaatatttttaatttatttatatacgtaatataacgaattatttttttttaattatttcgtttttttttaattttttttttttatttttttttacgtatcgcgtatttatcgttatttatttcgttcgtatttattttcgatatgtagtttattcgtaacgtattttcgttttatttttattttttatttacgtatttttatcgacgcgcgttagttattgcgatttttatcgcgatacgacgattttttatttttgattagtattcgttatcgtttatttcgattatatattcgcgtaatattcgatatcgcgtacgttatattaacgtcgttaatatcgtcgattgttgttcgtttgtagtgcgtagtatacgttcgtgcgacgtcgttgcgattgatttacggcgttacgtcgattattggttattattataatattttatttttattttttagtattattcgattttattgttttatatagatattttatttttgttatacgtaaatcgcgtttatcggtaatagttaatttacgtttacggtatacgtcgtattcgcgtttcgcgtattttttttattttataatttcgttttcgttatatttttaatattcgatttttttatttttattaatttcgtacgtaacgtcgcgtttcgtaatttcgtattcggagacgtattagatttatttcgtttatttcgtaacgtattacgttatttttattacgtatatcgtatttttcgcgtattcgggtttttattttgcgatttaatttcgcgcgttcgcgatattttttggttttatatcggatatgtcgcggttcgtaatatcgttatttttatttatacgtatacggattttattattattttattatagattcgcgattcggataggcgttattttngtattcgtgatacgtaatttcgcgatcgtattatttcgttttagtagttatttatttttatttattgtaaaaagaaat

SEQ ID NO: 12398 - DNA, 1003 bp, Artificial Sequence
  chemically treated genomic DNA (Homo sapiens) CpG-island No: 12398
  misc_feature (79)..(79): n is either a, c, g or t
atttctttttacaataaataaaaataaataactactaaaacgaaataatacgatcgcgaaattacgtatcacgaatacnaaaataacgcctatccgaatcgcgaatctataataaaataataataaaatccgtatacgtataaataaaaataacgatattacgaaccgcgacatatccgatataaaaccaaaaaatatcgcgaacgcgcgaaattaaatcgcaaaataaaaacccgaatacgcgaaaaatacgatatacgtaataaaaataacgtaatacgttacgaaataaacgaaataaatctaatacgtctccgaatacgaaattacgaaacgcgacgttacgtacgaaattaataaaaataaaaaaatcgaatattaaaaatataacgaaaacgaaattataaaataaaaaaaatacgcgaaacgcgaatacgacgtataccgtaaacgtaaattaactattaccgataaacgcgatttacgtataacaaaaataaaatatctatataaaacaataaaatcgaataatactaaaaaataaaaataaaatattataataataaccaataatcgacgtaacgccgtaaatcaatcgcaacgacgtcgcacgaacgtatactacgcactacaaacgaacaacaatcgacgatattaacgacgttaatataacgtacgcgatatcgaatattacgcgaatatataatcgaaataaacgataacgaatactaatcaaaaataaaaaatcgtcgtatcgcgataaaaatcgcaataactaacgcgcgtcgataaaaatacgtaaataaaaaataaaaataaaacgaaaatacgttacgaataaactacatatcgaaaataaatacgaacgaaataaataacgataaatacgcgatacgtaaaaaaaaataaaaaaaaaaaattaaaaaaaaacgaaataattaaaaaaaaataattcgttatattacgtatataaataaattaaaaatattaataaaaacgcgat

SEQ ID NO: 12399 - DNA, 1003 bp, Artificial Sequence
  chemically treated genomic DNA (Homo sapiens) CpG-island No: 12399
  misc_feature (79)..(79): n is either a, c, g or t
gtttttttttgtaataaataaaaatgagtaattattagagcggggtggtgcgatcgcgaagttgcgtgttacgggtgtnggggtggcgtttgttcgggtcgcgaatttgtagtagagtgatggtagagttcgtgtacgtgtgagtgagggtgacggtattgcggatcgcgatatgttcgatgtaagattaggaagtgtcgcgagcgcgcgaggttgagtcgtaagatgagagttcgggtacgcggagggtgcgatgtgcgtgatggagatgacgtaatgcgttgcggaatggacgaggtagatttggtgcgttttcggatgcggaattgcggagcgcggcgttgcgtgcggagttggtagaggtgggagaatcgagtgttggaggtatgacggagacggagttgtagagtggaggaggtgcgcgaggcgcgggtgcggcgtatgtcgtgagcgtggattggttgttatcgatgagcgcgatttgcgtgtggtaagagtaaggtgtttatgtgaggtagtgaggtcgagtagtgttggagagtgggaatggggtgttgtgatagtggttagtgatcggcgtagcgtcgtaggttagtcgtagcggcgtcgtacgagcgtgtgttgcgtattgtaggcgggtagtagtcggcggtgttgacgacgttgatgtggcgtgcgcggtatcgggtattgcgcgaatgtgtggtcggaataggcggtggcgggtgttgattagagatgggggatcgtcgtgtcgcgatggaggtcgtaatggttggcgcgcgtcggtggggatgcgtggatgggaggtagaggtgagacggaggtgcgttgcgagtgggttgtatatcgggagtgagtgcggacgaggtagatggcggtgggtgcgcgatgcgtgagaagaggtggagggaggaggttgggagggagcgaggtggttgagagggggtagttcgttgtgttacgtgtgtggatgggttggaggtgttgatggagacgcggt

SEQ ID NO: 12400 - DNA, 1003 bp, Artificial Sequence
  chemically treated genomic DNA (Homo sapiens) CpG-island No: 12400
  misc_feature (925)..(925): n is either a, c, g or t
accgcgtctccatcaacacctccaacccatccacacacgtaacacaacgaactaccccctctcaaccacctcgctccctcccaacctcctccctccacctcttctcacgcatcgcgcacccaccgccatctacctcgtccgcactcactcccgatatacaacccactcgcaacgcacctccgtctcacctctacctcccatccacgcatccccaccgacgcgcgccaaccattacgacctccatcgcgacacgacgatcccccatctctaatcaacacccgccaccgcctattccgaccacacattcgcgcaatacccgataccgcgcacgccacatcaacgtcgtcaacaccgccgactactacccgcctacaatacgcaacacacgctcgtacgacgccgctacgactaacctacgacgctacgccgatcactaaccactatcacaacaccccattcccactctccaacactactcgacctcactacctcacataaacaccttactcttaccacacgcaaatcgcgctcatcgataacaaccaatccacgctcacgacatacgccgcacccgcgcctcgcgcacctcctccactctacaactccgtctccgtcatacctccaacactcgattctcccacctctaccaactccgcacgcaacgccgcgctccgcaattccgcatccgaaaacgcaccaaatctacctcgtccattccgcaacgcattacgtcatctccatcacgcacatcgcaccctccgcgtacccgaactctcatcttacgactcaacctcgcgcgctcgcgacacttcctaatcttacatcgaacatatcgcgatccgcaataccgtcaccctcactcacacgtacacgaactctaccatcactctactacaaattcgcgacccgaacaaacgccaccccnacacccgtaacacgcaacttcgcgatcgcaccaccccgctctaataattactcatttttatttattacaaaaaaaaac

SEQ ID NO: 12401 - DNA, 809 bp, Artificial Sequence
  chemically treated genomic DNA (Homo sapiens) CpG-island No: 12401
  misc_feature (633)..(633): n is either a, c, g or t
tgtcggaatagtacgacgaaaagtcgtaggtatagtaggtagcgtagattattaacggtgtgtttagttagttattggtaattttttcggcgagttttggttaatcgtgattagaacgaagtgaacgaaattcggcgttagggggttttggtttttcgggaaaacgggattaattaggatggaatagggtaacgtaggaatgcgcgtaaattcgatcggagaaacgattattttttgttattaattcgggtagatttggtgtatgggggtcgggaagaaaataattcgttattcgatcggaatggttaaaacgttaagcggagattgggtggaaaatggggtttaaataaggaattggttcgggaagatcgaagggttcgtggaaattcgggaaggtcggaggaggtattaaaatcgcgggaaaaaagataaaatttcgttatttaaaaggggatgggtgtaattatttattttgggtattaaggaaatatcggcgcgggtttaaaaaggcggatttttaaacgggagggcgcgaaaaaaaaaaaatttcggcgagagggtcgttttagaaaaaaaagattatttcgcgttatatatgagatatgggcgcggaaataataagatatttcgaancggaaagggtaaaaatacgttcggtggaacgcgcgaggtgaaaacgaaaacgtaacgttgagcgtaaaagggagtcgcggtgcgtgatacgttatttgaaaaaagcgagggcgaatacgcgagttatatgggggggggagaaaaagattcggaaatgaaaaattaagaacgtatcg

SEQ ID NO: 12402 - DNA, 809 bp, Artificial Sequence
  chemically treated genomic DNA (Homo sapiens) CpG-island No: 12402
  misc_feature (177)..(177): n is either a, c, g or t
cgatacgttcttaatttttcatttccgaatctttttctcccccccccatataactcgcgtattcgccctcgcttttttcaaataacgtatcacgcaccgcgactcccttttacgctcaacgttacgttttcgttttcacctcgcgcgttccaccgaacgtatttttaccctttccgnttcgaaatatcttattatttccgcgcccatatctcatatataacgcgaaataatcttttttttctaaaacgaccctctcgccgaaattttttttttttcgcgccctcccgtttaaaaatccgcctttttaaacccgcgccgatatttccttaatacccaaaataaataattacacccatccccttttaaataacgaaattttatcttttttcccgcgattttaatacctcctccgaccttcccgaatttccacgaacccttcgatcttcccgaaccaattccttatttaaaccccattttccacccaatctccgcttaacgttttaaccattccgatcgaataacgaattattttcttcccgacccccatacaccaaatctacccgaattaataacaaaaaataatcgtttctccgatcgaatttacgcgcattcctacgttaccctattccatcctaattaatcccgttttcccgaaaaaccaaaaccccctaacgccgaatttcgttcacttcgttctaatcacgattaaccaaaactcgccgaaaaaattaccaataactaactaaacacaccgttaataatctacgctacctactatacctacgacttttcgtcgtactattccgaca

SEQ ID NO: 12403 - DNA, 809 bp, Artificial Sequence
  chemically treated genomic DNA (Homo sapiens) CpG-island No: 12403
  misc_feature (177)..(177): n is either a, c, g or t
cggtacgtttttgattttttattttcgagttttttttttttttttttatgtaattcgcgtgttcgttttcgttttttttaagtggcgtgttacgtatcgcggtttttttttgcgtttagcgttgcgttttcgtttttatttcgcgcgttttatcgagcgtatttttgtttttttcgnttcggggtgttttattgttttcgcgtttatgttttatgtgtggcgcgagatggttttttttttttggggcggttttttcgtcggggttttttttttttcgcgttttttcgtttaaaggttcgtttttttgggttcgcgtcggtgtttttttgatatttagggtgggtggttatatttatttttttttaggtggcggggttttgttttttttttcgcggttttaatgtttttttcggttttttcgggtttttacgggtttttcggttttttcgggttaattttttgtttaaattttattttttatttagttttcgtttgacgttttggttatttcggtcgggtaacggattgtttttttttcggtttttatgtattaaatttgttcgggttgatggtaaaaaatggtcgttttttcgatcgggtttacgcgtatttttgcgttattttgttttattttggttgatttcgttttttcgaaaagttagaattttttggcgtcggatttcgtttatttcgttttggttacggttagttagggttcgtcgggaaagttgttagtaattggttgaatatatcgttgatgatttgcgttatttgttgtatttgcggtttttcgtcgtattgtttcggta

SEQ ID NO: 12404 - DNA, 809 bp, Artificial Sequence
  chemically treated genomic DNA (Homo sapiens) CpG-island No: 12404
  misc_feature (633)..(633): n is either a, c, g or t
taccgaaacaatacgacgaaaaaccgcaaatacaacaaataacgcaaatcatcaacgatatattcaaccaattactaacaactttcccgacgaaccctaactaaccgtaaccaaaacgaaataaacgaaatccgacgccaaaaaattctaacttttcgaaaaaacgaaatcaaccaaaataaaacaaaataacgcaaaaatacgcgtaaacccgatcgaaaaaacgaccattttttaccatcaacccgaacaaatttaatacataaaaaccgaaaaaaaaacaatccgttacccgaccgaaataaccaaaacgtcaaacgaaaactaaataaaaaataaaatttaaacaaaaaattaacccgaaaaaaccgaaaaacccgtaaaaacccgaaaaaaccgaaaaaaacattaaaaccgcgaaaaaaaaaacaaaaccccgccacctaaaaaaaaataaatataaccacccaccctaaatatcaaaaaaacaccgacgcgaacccaaaaaaacgaacctttaaacgaaaaaacgcgaaaaaaaaaaaaccccgacgaaaaaaccgccccaaaaaaaaaaaaccatctcgcgccacacataaaacataaacgcgaaaacaataaaacaccccgaancgaaaaaaacaaaaatacgctcgataaaacgcgcgaaataaaaacgaaaacgcaacgctaaacgcaaaaaaaaaccgcgatacgtaacacgccacttaaaaaaaacgaaaacgaacacgcgaattacataaaaaaaaaaaaaaaaaactcgaaaataaaaaatcaaaaacgtaccg

SEQ ID NO: 12405 - DNA, 817 bp, Artificial Sequence
  chemically treated genomic DNA (Homo sapiens) CpG-island No: 12405
tttttggaatttttcgtatgtttaggcgcgcgatcgaatgaaaagggaggggggaagggaagggtggagaggggagggggaagaggagcggcggttacgcgttaggttttggcggcgttacgaggaaagcgcgcggtcgtcgtttttttattattcggcggacgaggacgattcgcgcgggttttattatcggtcggtcgtagttagtcggattttggcgttgttttttgtttcgttttacgtttcgttttaggtcgtttttttatttgggtggtttttttcgatcgattttgaggtgaaaaggaatgtgtttttttcgatgaacgtttcgtggaagtcgttgagttgttcgtttatgttggtgtcggtgtgcggaagtggttttacgaaggagtagcggcgaggcggtagcggttgcgaaatgcgtaagttgcggatagcgttttattcgtagtaggcgggcggcgcggagcgaacgaagtagcgggcggtgcggttcggtatttatagagtagcgttcgcgcgcgttcggttcgggtttcgtttttcggcgtcgcgcgttaatgtattatttgcgcgggggtcgggggaggaagggtagttcgtttcgcggagttcgggttgaattatattgcgcggtcgcgggaggtgtcgtggtaattcggttttttagagatcgtttagttattttgagtcgttagagttaggagaaaaatgtagacgcgaggagacgtgggggattgtttttttttgtttgatgtgggagaaaaagcgattggggtttgttggattcgtttttttgtgcggtgatatggta

SEQ ID NO: 12406 - DNA, 817 bp, Artificial Sequence
  chemically treated genomic DNA (Homo sapiens) CpG-island No: 12406
taccatatcaccgcacaaaaaaacgaatccaacaaaccccaatcgctttttctcccacatcaaacaaaaaaaaacaatcccccacgtctcctcgcgtctacatttttctcctaactctaacgactcaaaataactaaacgatctctaaaaaaccgaattaccacgacacctcccgcgaccgcgcaatataattcaacccgaactccgcgaaacgaactacccttcctcccccgacccccgcgcaaataatacattaacgcgcgacgccgaaaaacgaaacccgaaccgaacgcgcgcgaacgctactctataaataccgaaccgcaccgcccgctacttcgttcgctccgcgccgcccgcctactacgaataaaacgctatccgcaacttacgcatttcgcaaccgctaccgcctcgccgctactccttcgtaaaaccacttccgcacaccgacaccaacataaacgaacaactcaacgacttccacgaaacgttcatcgaaaaaaacacattccttttcacctcaaaatcgatcgaaaaaaaccacccaaataaaaaaacgacctaaaacgaaacgtaaaacgaaacaaaaaacaacgccaaaatccgactaactacgaccgaccgataataaaacccgcgcgaatcgtcctcgtccgccgaataataaaaaaacgacgaccgcgcgctttcctcgtaacgccgccaaaacctaacgcgtaaccgccgctcctcttccccctcccctctccacccttcccttcccccctcccttttcattcgatcgcgcgcctaaacatacgaaaaattccaaaaa

SEQ ID NO: 12407 - DNA, 817 bp, Artificial Sequence
  chemically treated genomic DNA (Homo sapiens) CpG-island No: 12407
tgttatgttatcgtataggggagcgggtttagtaagttttagtcgtttttttttttatattaaataaggaagagtaattttttacgttttttcgcgtttgtattttttttttagttttagcggtttaagatagttgaacggtttttggagggtcggattgttacggtatttttcgcggtcgcgtagtgtggtttagttcggatttcgcggggcgagttgttttttttttttcgattttcgcgtaagtggtgtattggcgcgcggcgtcgaggggcggggttcgagtcgggcgcgcgcgggcgttgttttataaatatcgggtcgtatcgttcgttgtttcgttcgtttcgcgtcgttcgtttgttacgagtagaacgttgttcgtagtttgcgtatttcgtagtcgttgtcgtttcgtcgttgttttttcgtaaggttattttcgtatatcgatattaatatgaacggatagtttaacggtttttacgaggcgtttatcgaggagggtatatttttttttattttagagtcggtcggggaaggttatttaggtgaggggacggtttgaagcgaagcgtggggcggggtagaaggtagcgttaaggttcggttggttgcggtcggtcggtggtggggttcgcgcgggtcgttttcgttcgtcgggtgatggaagagcggcgatcgcgcgtttttttcgtggcgtcgttagggtttggcgcgtggtcgtcgtttttttttttttttttttttttatttttttttttttttttttttttttattcggtcgcgcgtttaggtatgcggaaggttttagaaa

SEQ ID NO: 12408 - DNA, 817 bp, Artificial Sequence
  chemically treated genomic DNA (Homo sapiens) CpG-island No: 12408
tttctaaaaccttccgcatacctaaacgcgcgaccgaataaaaaaaaaaaaaaaaaaaaaaaaataaaaaaaaaaaaaaaaaaaaaaacgacgaccacgcgccaaaccctaacgacgccacgaaaaaaacgcgcgatcgccgctcttccatcacccgacgaacgaaaacgacccgcgcgaaccccaccaccgaccgaccgcaaccaaccgaaccttaacgctaccttctaccccgccccacgcttcgcttcaaaccgtcccctcacctaaataaccttccccgaccgactctaaaataaaaaaaaatataccctcctcgataaacgcctcgtaaaaaccgttaaactatccgttcatattaatatcgatatacgaaaataaccttacgaaaaaacaacgacgaaacgacaacgactacgaaatacgcaaactacgaacaacgttctactcgtaacaaacgaacgacgcgaaacgaacgaaacaacgaacgatacgacccgatatttataaaacaacgcccgcgcgcgcccgactcgaaccccgcccctcgacgccgcgcgccaatacaccacttacgcgaaaatcgaaaaaaaaaaaacaactcgccccgcgaaatccgaactaaaccacactacgcgaccgcgaaaaataccgtaacaatccgaccctccaaaaaccgttcaactatcttaaaccgctaaaactaaaaaaaaaatacaaacgcgaaaaaacgtaaaaaattactcttccttatttaatataaaaaaaaaaacgactaaaacttactaaacccgctcccctatacgataacataaca

SEQ ID NO: 12409 - DNA, 743 bp, Artificial Sequence
  chemically treated genomic DNA (Homo sapiens) CpG-island No: 12409
gcggagagacgtttttttagttatgtgtacggcgataattttaggtagagttggaatgtaggttgtttcgagatttttatttgttgacgttttttcggtaggaatcggttaaacggaatttttagttatttcggttttagagcggtttttacgttatagtttttcgcgtttaggtttttcgaagttgggatatcgtttacgtttttttcgtgacgcgggcgcggggttcgggagttgtagtttcgggtagggcgcgggtatcgaggtcggggttgcgcggattttacgtttcggcgggcggcgcggcgaggtttggggtttttaggggcggggtcgttcggttttttaaattttttagggttgtttcgagggtcgtagttagagtcggcgttacgagggggtcgagtagggtgcggcggcggcggggcgtttcggggaggtgcgtattgggtttttttttttttttcgggtttttaggaattatttggggattttcgcgtttcgggttttggggggtcgtcggtcgtagggttcggttttagtcggggttttcgcgtttaggcgagcgggggtcgggtcgggttgggtttttcgcgtgaattcgtttttcgtttagggcgtcgatggttaggtggttgtttgcgcgtcgtcgattcgttatcgttttattgggtcggtatttagtttttttttggcgtggttttttcggttgtttagttttttttttagttttggttttttag

SEQ ID NO: 12410 - DNA, 743 bp, Artificial Sequence
  chemically treated genomic DNA (Homo sapiens) CpG-island No: 12410
ctaaaaaaccaaaactaaaaaaaaaactaaacaaccgaaaaaaccacgccaaaaaaaaactaaataccgacccaataaaacgataacgaatcgacgacgcgcaaacaaccacctaaccatcgacgccctaaacgaaaaacgaattcacgcgaaaaacccaacccgacccgacccccgctcgcctaaacgcgaaaaccccgactaaaaccgaaccctacgaccgacgaccccccaaaacccgaaacgcgaaaatccccaaataattcctaaaaacccgaaaaaaaaaaaaaaacccaatacgcacctccccgaaacgccccgccgccgccgcaccctactcgaccccctcgtaacgccgactctaactacgaccctcgaaacaaccctaaaaaatttaaaaaaccgaacgaccccgcccctaaaaaccccaaacctcgccgcgccgcccgccgaaacgtaaaatccgcgcaaccccgacctcgatacccgcgccctacccgaaactacaactcccgaaccccgcgcccgcgtcacgaaaaaaacgtaaacgatatcccaacttcgaaaaacctaaacgcgaaaaactataacgtaaaaaccgctctaaaaccgaaataactaaaaattccgtttaaccgattcctaccgaaaaaacgtcaacaaataaaaatctcgaaacaacctacattccaactctacctaaaattatcgccgtacacataactaaaaaaacgtctctccgc

SEQ ID NO: 12411 - DNA, 743 bp, Artificial Sequence
  chemically treated genomic DNA (Homo sapiens) CpG-island No: 12411
ttgagggattagggttgggagaagggttggataatcgaagaggttacgttaaggagaggttgggtgtcggtttagtggagcggtggcgagtcggcggcgcgtaggtaattatttgattatcggcgttttgggcgaggggcgggtttacgcggaaagtttagttcggttcggttttcgttcgtttgggcgcggggatttcggttggggtcggattttgcggtcggcgattttttaggattcgggacgcgagagtttttaggtgatttttggaagttcggaggaagggaaggagtttagtacgtattttttcggagcgtttcgtcgtcgtcgtattttgttcggttttttcgtggcgtcgattttagttgcggttttcggagtagttttgaaaggtttaaagggtcgagcggtttcgtttttggaggttttaggtttcgtcgcgtcgttcgtcgggacgtggagttcgcgtagtttcggtttcggtgttcgcgttttgttcgagattataattttcgagtttcgcgttcgcgttacgggggaaacgtgggcggtgttttaatttcggaggatttgggcgcggagggttgtggcgtgaagatcgttttaaaatcgagatgattagaggtttcgtttaatcgatttttgtcggggaagcgttagtaggtggggatttcggggtagtttgtattttagttttatttgggattgtcgtcgtgtatatggttggaggagcgttttttcgt

SEQ ID NO: 12412 - DNA, 743 bp, Artificial Sequence
  chemically treated genomic DNA (Homo sapiens) CpG-island No: 12412
acgaaaaaacgctcctccaaccatatacacgacgacaatcccaaataaaactaaaatacaaactaccccgaaatccccacctactaacgcttccccgacaaaaatcgattaaacgaaacctctaatcatctcgattttaaaacgatcttcacgccacaaccctccgcgcccaaatcctccgaaattaaaacaccgcccacgtttcccccgtaacgcgaacgcgaaactcgaaaattataatctcgaacaaaacgcgaacaccgaaaccgaaactacgcgaactccacgtcccgacgaacgacgcgacgaaacctaaaacctccaaaaacgaaaccgctcgaccctttaaacctttcaaaactactccgaaaaccgcaactaaaatcgacgccacgaaaaaaccgaacaaaatacgacgacgacgaaacgctccgaaaaaatacgtactaaactccttcccttcctccgaacttccaaaaatcacctaaaaactctcgcgtcccgaatcctaaaaaatcgccgaccgcaaaatccgaccccaaccgaaatccccgcgcccaaacgaacgaaaaccgaaccgaactaaactttccgcgtaaacccgcccctcgcccaaaacgccgataatcaaataattacctacgcgccgccgactcgccaccgctccactaaaccgacacccaacctctccttaacgtaacctcttcgattatccaacccttctcccaaccctaatccctcaa

SEQ ID NO: 12413 - DNA, 674 bp, Artificial Sequence
  chemically treated genomic DNA (Homo sapiens) CpG-island No: 12413
taggcgttgatcgttatttattgtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgtttgggtcggatcgtgaaacgttgttgtgcggtgtgaaagcgttgtttgtcgggttatgaggttttttgggttggtgatcgggattttgggggggttggggggttcgttatcggggttttgttgtttttttcgggtt

SEQ ID NO: 12414 - DNA, 674 bp, Artificial Sequence
  chemically treated genomic DNA (Homo sapiens) CpG-island No: 12414
aacccgaaaaaaacaacaaaaccccgataacgaaccccccaacccccccaaaatcccgatcaccaacccaaaaaacctcataacccgacaaacaacgctttcacaccgcacaacaacgtttcacgatccgacccaaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgacaataaataacgatcaacgccta

SEQ ID NO: 12415 - DNA, 674 bp, Artificial Sequence
  chemically treated genomic DNA (Homo sapiens) CpG-island No: 12415
gattcggaaaaaataataaaatttcgatggcgggttttttagtttttttaagatttcggttattaatttagaaagttttatgattcggtagatagcgtttttatatcgtataataacgttttacggttcgatttaagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtaataggtggcgattagcgtttg

SEQ ID NO: 12416 - DNA, 674 bp, Artificial Sequence
  chemically treated genomic DNA (Homo sapiens) CpG-island No: 12416
caaacgctaatcgccacctattaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatacttaaatcgaaccgtaaaacgttattatacgatataaaaacgctatctaccgaatcataaaactttctaaattaataaccgaaatcttaaaaaaactaaaaaacccgccatcgaaattttattattttttccgaatc

SEQ ID NO: 12417 - DNA, 544 bp, Artificial Sequence
  chemically treated genomic DNA (Homo sapiens) CpG-island No: 12417
  misc_feature (131)..(131): n is either a, c, g or t
  misc_feature (135)..(136): n is either a, c, g or t
  misc_feature (191)..(191): n is either a, c, g or t
tttttcgcgggggcgcgggcgttttttttcgcgttttcggtcgttttttttttttttttcgttttttcgttttttcgcgtttttttttttttcgtttcgttcgggtcgtttcgcggggggggcggcggcgngttnncgcgcgttttcgttttttcggttttttttcgcgcgcgtttttttttcgggtcgtnttttcgcgtcgtcgggcgcgcgcgggcggcgttttttcggttttttgtttttcgttcggcgttttttttttcggcgttcgtgtggttcgtcgggttgggtgttcgcgtttttttgtttttttttttcgttcgcgtcggttttttttgttcgtttgtttttttttttcgtgtgtttttttgtcggttcgtttcgcgcgggtttgtttgcgtttttttttttttcgtgttttttttcgtttcgcgtttttcgcgcggcgggttttttcggttgttttttgtttgttttttttttttttttttttttttttcgtttttttcgtcgggatgcgtattagaaaataaaaaaaaaaaaa

SEQ ID NO: 12418 - DNA, 544 bp, Artificial Sequence
  chemically treated genomic DNA (Homo sapiens) CpG-island No: 12418
  misc_feature (354)..(354): n is either a, c, g or t
  misc_feature (409)..(410): n is either a, c, g or t
  misc_feature (414)..(414): n is either a, c, g or t
tttttttttttttattttctaatacgcatcccgacgaaaaaaacgaaaaaaaaaaaaaaaaaaaaaaaaaacaaacaaaaaacaaccgaaaaaacccgccgcgcgaaaaacgcgaaacgaaaaaaaacacgaaaaaaaaaaaaacgcaaacaaacccgcgcgaaacgaaccgacaaaaaaacacacgaaaaaaaaaaacaaacgaacaaaaaaaaccgacgcgaacgaaaaaaaaaaacaaaaaaacgcgaacacccaacccgacgaaccacacgaacgccgaaaaaaaaaacgccgaacgaaaaacaaaaaaccgaaaaaacgccgcccgcgcgcgcccgacgacgcgaaaanacgacccgaaaaaaaaacgcgcgcgaaaaaaaaccgaaaaaacgaaaacgcgcgnnaacncgccgccgccccccccgcgaaacgacccgaacgaaacgaaaaaaaaaaaaacgcgaaaaaacgaaaaaacgaaaaaaaaaaaaaaaacgaccgaaaacgcgaaaaaaaacgcccgcgcccccgcgaaaaa

SEQ ID NO: 12419 - DNA, 544 bp, Artificial Sequence
  chemically treated genomic DNA (Homo sapiens) CpG-island No: 12419
  misc_feature (354)..(354): n is either a, c, g or t
  misc_feature (409)..(410): n is either a, c, g or t
  misc_feature (414)..(414): n is either a, c, g or t
tttttttttttttgttttttaatgcgtatttcgacgggaggggcggaggaggagagaagagagaagagagatagataagaggtagtcggagaggttcgtcgcgcgaagagcgcggggcggagagaagtacggggaagaggaaggcgtagatagattcgcgcggaacggatcgataggggggtatacgaaggaagagaatagacggatagggggagtcggcgcgggcgggaaggaaagataggggagcgcggatatttagttcgacgagttatacgggcgtcgaggagggaggcgtcgggcgggggatagagggtcgggggggcgtcgttcgcgcgcgttcggcggcgcgggggngcggttcggggggggggcgcgcgcgggggggggtcgggggggcgggggcgcgcgnnggtncgtcgtcgtttttttcgcggggcggttcgggcggggcggggggggggggggcgcgggggggcgggggggcgggggggggggggggggcggtcgggggcgcgggggggggcgttcgcgttttcgcgggggg

SEQ ID NO: 12420 - DNA, 544 bp, Artificial Sequence
  chemically treated genomic DNA (Homo sapiens) CpG-island No: 12420
  misc_feature (131)..(131): n is either a, c, g or t
  misc_feature (135)..(136): n is either a, c, g or t
  misc_feature (191)..(191): n is either a, c, g or t
ccccccgcgaaaacgcgaacgcccccccccgcgcccccgaccgcccccccccccccccccgcccccccgcccccccgcgccccccccccccccgccccgcccgaaccgccccgcgaaaaaaacgacgacgnaccnncgcgcgcccccgcccccccgacccccccccgcgcgcgccccccccccgaaccgcncccccgcgccgccgaacgcgcgcgaacgacgcccccccgaccctctatcccccgcccgacgcctccctcctcgacgcccgtataactcgtcgaactaaatatccgcgctcccctatctttccttcccgcccgcgccgactccccctatccgtctattctcttccttcgtatacccccctatcgatccgttccgcgcgaatctatctacgccttcctcttccccgtacttctctccgccccgcgctcttcgcgcgacgaacctctccgactacctcttatctatctctcttctctcttctctcctcctccgcccctcccgtcgaaatacgcattaaaaaacaaaaaaaaaaaaa

SEQ ID NO: 12421 - DNA, 1025 bp, Artificial Sequence
  chemically treated genomic DNA (Homo sapiens) CpG-island No: 12421
  misc_feature (582)..(582): n is either a, c, g or t
  misc_feature (596)..(596): n is either a, c, g or t
  misc_feature (605)..(605): n is either a, c, g or t
  misc_feature (706)..(706): n is either a, c, g or t
  misc_feature (870)..(870): n is either a, c, g or t
  misc_feature (942)..(942): n is either a, c, g or t
atagcgggggcggtcgtcgcgtttttttttttttttcggtgtgtaaatgtgtgtgtgcggtgttatgtcggataagagggaggtgatcgtggcggcggcggcggcggttttgtttattgtttttttcggtgtgtgtgtgtgaggaaatcggggttgtagcgaggttaaggttgtttttgaagtagcggcggcgatcgggacgattattttggcgattcgagtggttggttttcgcggagtgtgagaaggataaggtatttttgcgttttcgttacgttcgagcgtttcgggtttttcggtcgttttcgcggttcgtacgttcgggttttagttcggtttgtagcggcgttcgcgggcgggcgagaaggtaacgtcgtcgttcggtcgtcgtcggtcgttttttgttttttttttagtcgtcgcgttaggttcgggcgacgcggacgtcgcgtttcgagtttgagggtagtcggcggcgcggtttttttagcgggttcggttggacgttcgtttcggattttcgcgatggggcgcgggggtcggcgcggttaggagtgcggcgagtggagcggtgggtgcggngcggcggggttttncggttcgtngggcggcggtggcggcgtttgtgttttgtgtttttgcgcgtcgtcggtttttcgtttgtcgcggtttcgtgcgtttcgtcgggggcgtcgcgtttcgcgtntttcgtgcgcggcgtttttcgttttttcgttttttttttcgtttgttttttgcgtttttttttggtttttgttttttcgttttcgtttttttttttttttgttttttgcgtttttggcgtttcgcgtttcgcgttttgttttttttttcgcgtcgtcgtcgttncggttgttcgtgtgtcgtcgttttttcgcgttttttgttttttcgtttttgttttttttttgtttttgtttnttttttttttttgtttttttttcggttcgtgcgtttgtcgtttttttttttattttcgcgtgtttagtatataaatagtaaaa

SEQ ID NO: 12422 - DNA, 1025 bp, Artificial Sequence
  chemically treated genomic DNA (Homo sapiens) CpG-island No: 12422
  misc_feature (84)..(84): n is either a, c, g or t
  misc_feature (156)..(156): n is either a, c, g or t
  misc_feature (320)..(320): n is either a, c, g or t
  misc_feature (421)..(421): n is either a, c, g or t
  misc_feature (430)..(430): n is either a, c, g or t
  misc_feature (444)..(444): n is either a, c, g or t
ttttactatttatatactaaacacgcgaaaataaaaaaaaaaacgacaaacgcacgaaccgaaaaaaaaacaaaaaaaaaaaanaaacaaaaacaaaaaaaaaacaaaaacgaaaaaacaaaaaacgcgaaaaaacgacgacacacgaacaaccgnaacgacgacgacgcgaaaaaaaaaacaaaacgcgaaacgcgaaacgccaaaaacgcaaaaaacaaaaaaaaaaaaaaacgaaaacgaaaaaacaaaaaccaaaaaaaaacgcaaaaaacaaacgaaaaaaaaaacgaaaaaacgaaaaacgccgcgcacgaaanacgcgaaacgcgacgcccccgacgaaacgcacgaaaccgcgacaaacgaaaaaccgacgacgcgcaaaaacacaaaacacaaacgccgccaccgccgcccnacgaaccgnaaaaccccgccgcnccgcacccaccgctccactcgccgcactcctaaccgcgccgacccccgcgccccatcgcgaaaatccgaaacgaacgtccaaccgaacccgctaaaaaaaccgcgccgccgactaccctcaaactcgaaacgcgacgtccgcgtcgcccgaacctaacgcgacgactaaaaaaaaaacaaaaaacgaccgacgacgaccgaacgacgacgttaccttctcgcccgcccgcgaacgccgctacaaaccgaactaaaacccgaacgtacgaaccgcgaaaacgaccgaaaaacccgaaacgctcgaacgtaacgaaaacgcaaaaataccttatccttctcacactccgcgaaaaccaaccactcgaatcgccaaaataatcgtcccgatcgccgccgctacttcaaaaacaaccttaacctcgctacaaccccgatttcctcacacacacacaccgaaaaaaacaataaacaaaaccgccgccgccgccgccacgatcacctccctcttatccgacataacaccgcacacacacatttacacaccgaaaaaaaaaaaaaaacgcgacgaccgcccccgctat

SEQ ID NO: 12423 - DNA, 1025 bp, Artificial Sequence
  chemically treated genomic DNA (Homo sapiens) CpG-island No: 12423
  misc_feature (84)..(84): n is either a, c, g or t
  misc_feature (156)..(156): n is either a, c, g or t
  misc_feature (320)..(320): n is either a, c, g or t
  misc_feature (421)..(421): n is either a, c, g or t
  misc_feature (430)..(430): n is either a, c, g or t
  misc_feature (444)..(444): n is either a, c, g or t
ttttattgtttgtgtattaggtacgcggggatggaaaaagaaacggtaaacgtacgagtcggaggaggggtagaagggaaggangagtaaaagtaaaaggggggtaggagcgaagagataaagaacgcgagggaacgacgatatacgaataatcgnagcgacggcgacgcgagagagggaatagaacgcggggcgcggggcgttagaaacgtagaggataaaagggaggggggacgggagcgagggaatagaaattagaggagagcgtaagaaatagacgaggagaagaacggagaggcgggaggcgtcgcgtacgaaanacgcgaggcgcggcgttttcggcggagcgtacggggtcgcggtaggcggagagtcggcggcgcgtaggggtataggatataggcgtcgttatcgtcgtttngcgggtcgnggggtttcgtcgtntcgtatttatcgttttattcgtcgtatttttagtcgcgtcgattttcgcgttttatcgcgaagattcggagcggacgtttagtcgagttcgttgaggaggtcgcgtcgtcggttgtttttaaattcgaggcgcggcgttcgcgtcgttcgggtttagcgcggcggttgaggagaaagtagggagcgatcggcggcggtcgagcggcggcgttgttttttcgttcgttcgcgggcgtcgttgtaggtcgggttgaagttcgggcgtgcgagtcgcgagggcggtcggggagttcgaggcgttcggacgtggcgaggacgtagaggtgttttgttttttttatatttcgcgaaggttagttattcgagtcgttagagtagtcgtttcggtcgtcgtcgttgttttaaaggtagttttagtttcgttgtagtttcgatttttttatatatatatatcgagagggataataaatagagtcgtcgtcgtcgtcgttacggttattttttttttgttcggtataatatcgtatatatatatttgtatatcggggagagagggagggcgcggcggtcgttttcgttgt

SEQ ID NO: 12424 - DNA, 1025 bp, Artificial Sequence
  chemically treated genomic DNA (Homo sapiens) CpG-island No: 12424
  misc_feature (582)..(582): n is either a, c, g or t
  misc_feature (596)..(596): n is either a, c, g or t
  misc_feature (605)..(605): n is either a, c, g or t
  misc_feature (706)..(706): n is either a, c, g or t
  misc_feature (870)..(870): n is either a, c, g or t
  misc_feature (942)..(942): n is either a, c, g or t
acaacgaaaacgaccgccgcgccctccctctctccccgatatacaaatatatatatacgatattataccgaacaaaaaaaaaataaccgtaacgacgacgacgacgactctatttattatccctctcgatatatatatataaaaaaatcgaaactacaacgaaactaaaactacctttaaaacaacgacgacgaccgaaacgactactctaacgactcgaataactaaccttcgcgaaatataaaaaaaacaaaacacctctacgtcctcgccacgtccgaacgcctcgaactccccgaccgccctcgcgactcgcacgcccgaacttcaacccgacctacaacgacgcccgcgaacgaacgaaaaaacaacgccgccgctcgaccgccgccgatcgctccctactttctcctcaaccgccgcgctaaacccgaacgacgcgaacgccgcgcctcgaatttaaaaacaaccgacgacgcgacctcctcaacgaactcgactaaacgtccgctccgaatcttcgcgataaaacgcgaaaatcgacgcgactaaaaatacgacgaataaaacgataaatacganacgacgaaaccccncgacccgcnaaacgacgataacgacgcctatatcctatacccctacgcgccgccgactctccgcctaccgcgaccccgtacgctccgccgaaaacgccgcgcctcgcgtntttcgtacgcgacgcctcccgcctctccgttcttctcctcgtctatttcttacgctctcctctaatttctattccctcgctcccgtcccccctcccttttatcctctacgtttctaacgccccgcgccccgcgttctattccctctctcgcgtcgccgtcgctncgattattcgtatatcgtcgttccctcgcgttctttatctcttcgctcctaccccccttttacttttactcntccttcccttctacccctcctccgactcgtacgtttaccgtttctttttccatccccgcgtacctaatacacaaacaataaaa

SEQ ID NO: 12425 - DNA, 644 bp, Artificial Sequence
  chemically treated genomic DNA (Homo sapiens) CpG-island No: 12425
  misc_feature (323)..(323): n is either a, c, g or t
cgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcgtttgtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggngtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacgggtcggcgttggatgagcgagcggtggtgttggggtcggattcgtgaacgttgttgtgcggtgtgaaagcgttggttgtcgggtatgaggtttttggggttggggatcggattttgggggggtttgggggtcgtatcgggttttggggtttttcggtta

SEQ ID NO: 12426 - DNA, 644 bp, Artificial Sequence
  chemically treated genomic DNA (Homo sapiens) CpG-island No: 12426
  misc_feature (322)..(322): n is either a, c, g or t
taaccgaaaaaccccaaaacccgatacgacccccaaacccccccaaaatccgatccccaaccccaaaaacctcatacccgacaaccaacgctttcacaccgcacaacaacgttcacgaatccgaccccaacaccaccgctcgctcatccaacgccgacccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgacnccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacaaacgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacg

SEQ ID NO: 12427 - DNA, 644 bp, Artificial Sequence
  chemically treated genomic DNA (Homo sapiens) CpG-island No: 12427
  misc_feature (322)..(322): n is either a, c, g or t
tggtcgggaaattttaaaattcgatgcggtttttaagtttttttagaattcggtttttaattttagaagttttatgttcggtagttagcgtttttatatcgtataataacgtttacgggttcgattttagtattatcgttcgtttatttagcgtcgattcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtntcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttataaacggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacg

SEQ ID NO: 12428 - DNA, 644 bp, Artificial Sequence
  chemically treated genomic DNA (Homo sapiens) CpG-island No: 12428
  misc_feature (323)..(323): n is either a, c, g or t
cgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgtttataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacganaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgaatcgacgctaaataaacgaacgataatactaaaatcgaacccgtaaacgttattatacgatataaaaacgctaactaccgaacataaaacttctaaaattaaaaaccgaattctaaaaaaacttaaaaaccgcatcgaattttaaaatttcccgacca

SEQ ID NO: 12429 - DNA, 629 bp, Artificial Sequence
  chemically treated genomic DNA (Homo sapiens) CpG-island No: 12429
ggtaaaagtatcgtcggtattagcgtttttttgtttttattgtcgtaaaatatggtaattgtagtttatttatatcgttttttaattcggttcgtattagaaaattattggtgtggttatgaatggcgttggatgttcgggtaatagttcgtattatgggcgttggttttaatacgattttacgttatttaaaaaatttaggtcgtagtcggtaatttcgcgtatatagtcgggtagtgacgttatcgtttgcgcggaaatggacgaatagtggggttatgtcggggttaaatcgcgttagcgttggttgttttacgcgtatgatagttttcggaagacggttgttgcgtacgtattcggtgaacgtattatggcgacgttggggcgttttatgagtttgttgttattttttgacgtggtgatatggatgacggatggttggtcgttgtatgaatttcgtttgaagggaaagttgtacgtaattagtaagcgatatacgtagcgaattgagcggtataatttgaatttgaggtagtatttggtacggttgggacggaagtcgttgtcgtttttaaaatcggtggagttgtatgataaagttatcgggtattatttgaatataaaatatt

SEQ ID NO: 12430 - DNA, 629 bp, Artificial Sequence
  chemically treated genomic DNA (Homo sapiens) CpG-island No: 12430
aatattttatattcaaataatacccgataactttatcatacaactccaccgattttaaaaacgacaacgacttccgtcccaaccgtaccaaatactacctcaaattcaaattataccgctcaattcgctacgtatatcgcttactaattacgtacaactttcccttcaaacgaaattcatacaacgaccaaccatccgtcatccatatcaccacgtcaaaaaataacaacaaactcataaaacgccccaacgtcgccataatacgttcaccgaatacgtacgcaacaaccgtcttccgaaaactatcatacgcgtaaaacaaccaacgctaacgcgatttaaccccgacataaccccactattcgtccatttccgcgcaaacgataacgtcactacccgactatatacgcgaaattaccgactacgacctaaattttttaaataacgtaaaatcgtattaaaaccaacgcccataatacgaactattacccgaacatccaacgccattcataaccacaccaataattttctaatacgaaccgaattaaaaaacgatataaataaactacaattaccatattttacgacaataaaaacaaaaaaacgctaataccgacgatacttttacc

SEQ ID NO: 12431 - DNA, 629 bp, Artificial Sequence
  chemically treated genomic DNA (Homo sapiens) CpG-island No: 12431
agtgttttatgtttagataatgttcgatgattttgttatgtagttttatcgattttgagaacgatagcgattttcgttttagtcgtgttaggtgttgttttagatttaggttatgtcgtttaattcgttgcgtatatcgtttgttgattacgtgtagttttttttttaggcgggatttatatagcggttagttattcgttatttatattattacgttaaagggtgatagtaggtttataagacgttttagcgtcgttatagtgcgtttatcgaatacgtgcgtaataatcgtttttcggagattgttatacgcgtaaaatagttagcgttggcgcgatttagtttcgatatagttttattgttcgtttattttcgcgtagacgatgacgttattgttcggttgtatgcgcgaggttatcgattgcggtttgagttttttaagtgacgtaaaatcgtgttgaggttaacgtttataatgcgggttgttgttcgggtatttaacgttatttatggttatattaatgattttttggtgcggatcgggttgagaagcggtgtaagtgaattgtagttgttatgttttacggtagtgagagtagagaagcgttgatgtcggcggtgtttttgtt

SEQ ID NO: 12432 - DNA, 629 bp, Artificial Sequence
  chemically treated genomic DNA (Homo sapiens) CpG-island No: 12432
aacaaaaacaccgccgacatcaacgcttctctactctcactaccgtaaaacataacaactacaattcacttacaccgcttctcaacccgatccgcaccaaaaaatcattaatataaccataaataacgttaaatacccgaacaacaacccgcattataaacgttaacctcaacacgattttacgtcacttaaaaaactcaaaccgcaatcgataacctcgcgcatacaaccgaacaataacgtcatcgtctacgcgaaaataaacgaacaataaaactatatcgaaactaaatcgcgccaacgctaactattttacgcgtataacaatctccgaaaaacgattattacgcacgtattcgataaacgcactataacgacgctaaaacgtcttataaacctactatcaccctttaacgtaataatataaataacgaataactaaccgctatataaatcccgcctaaaaaaaaaactacacgtaatcaacaaacgatatacgcaacgaattaaacgacataacctaaatctaaaacaacacctaacacgactaaaacgaaaatcgctatcgttctcaaaatcgataaaactacataacaaaatcatcgaacattatctaaacataaaacact

SEQ ID NO: 12433 - DNA, 570 bp, Artificial Sequence
  chemically treated genomic DNA (Homo sapiens) CpG-island No: 12433
tttcgattttttttttatttcgagggcggatggttttcggggtttcggggacgaagacgcggagggcggcgtcggttataggtttttgggagtttcgggattgcggggcgacggttgttgttcgcgaaggtcgtttggtttaaatgtagttatttttatcggtaggattcggggtaggggggtcgtagtttttggggttcggttcgtttcggtgtcgtgaagtggtgggcgtttcggggtttcgtttggtttcgcgcgtgaggttttcgcggacgtggcggcgaagaggggtgagcgcggtgttcggggtttggttggtttaggtcgaggaaagtttagtttttcgagttttcggtagtcgattgttttcggatcgggtttttatggtaatcgcgagcggaggtggggtagggggcgcggcgcgagggtcgttttcgcgggatttggcgggtgttatttgttgtcgggagagtcgttttttttttagcgcgcggagatatttgttttagttttttcgagttagaggttttttgtatagtttttggattttatcgggtttgagtgcgtgtt

SEQ ID NO: 12434 - DNA, 570 bp, Artificial Sequence
  chemically treated genomic DNA (Homo sapiens) CpG-island No: 12434
aacacgcactcaaacccgataaaatccaaaaactatacaaaaaacctctaactcgaaaaaactaaaacaaatatctccgcgcgctaaaaaaaaaacgactctcccgacaacaaataacacccgccaaatcccgcgaaaacgaccctcgcgccgcgccccctaccccacctccgctcgcgattaccataaaaacccgatccgaaaacaatcgactaccgaaaactcgaaaaactaaactttcctcgacctaaaccaaccaaaccccgaacaccgcgctcacccctcttcgccgccacgtccgcgaaaacctcacgcgcgaaaccaaacgaaaccccgaaacgcccaccacttcacgacaccgaaacgaaccgaaccccaaaaactacgacccccctaccccgaatcctaccgataaaaataactacatttaaaccaaacgaccttcgcgaacaacaaccgtcgccccgcaatcccgaaactcccaaaaacctataaccgacgccgccctccgcgtcttcgtccccgaaaccccgaaaaccatccgccctcgaaataaaaaaaaaatcgaaa

SEQ ID NO: 12435 - DNA, 570 bp, Artificial Sequence
  chemically treated genomic DNA (Homo sapiens) CpG-island No: 12435
ggtacgtatttaggttcggtgaggtttaggaattgtgtaagaggtttttggttcggaggggttgaaataggtgttttcgcgcgttgggggaagagcgattttttcggtaataggtagtattcgttaaatttcgcgggaacggttttcgcgtcgcgttttttgttttattttcgttcgcggttgttatgaagattcggttcgggagtagtcgattgtcggagattcgggaggttgagtttttttcggtttgagttagttagatttcgggtatcgcgtttattttttttcgtcgttacgttcgcgaaggttttacgcgcgaggttaggcgaggtttcgaggcgtttattattttacgatatcggagcgaatcgggttttagaggttgcgatttttttgtttcgaattttgtcggtgggagtggttgtatttgaattaaacggttttcgcgggtagtagtcgtcgtttcgtagtttcggggtttttaagggtttgtgatcgacgtcgtttttcgcgttttcgttttcgaagtttcgggaattattcgttttcggggtaagggaggagtcgggg

SEQ ID NO: 12436 - DNA, 570 bp, Artificial Sequence
  chemically treated genomic DNA (Homo sapiens) CpG-island No: 12436
ccccgactcctcccttaccccgaaaacgaataattcccgaaacttcgaaaacgaaaacgcgaaaaacgacgtcgatcacaaacccttaaaaaccccgaaactacgaaacgacgactactacccgcgaaaaccgtttaattcaaatacaaccactcccaccgacaaaattcgaaacaaaaaaatcgcaacctctaaaacccgattcgctccgatatcgtaaaataataaacgcctcgaaacctcgcctaacctcgcgcgtaaaaccttcgcgaacgtaacgacgaaaaaaaataaacgcgatacccgaaatctaactaactcaaaccgaaaaaaactcaacctcccgaatctccgacaatcgactactcccgaaccgaatcttcataacaaccgcgaacgaaaataaaacaaaaaacgcgacgcgaaaaccgttcccgcgaaatttaacgaatactacctattaccgaaaaaatcgctcttcccccaacgcgcgaaaacacctatttcaacccctccgaaccaaaaacctcttacacaattcctaaacctcaccgaacctaaatacgtacc

SEQ ID NO: 12437 - DNA, 867 bp, Artificial Sequence
  chemically treated genomic DNA (Homo sapiens) CpG-island No: 12437
gggacgttttacgcgagagcgttataggtcgggagtttttttcgttttttcgcgcgggataatcggcgataggcgtcggtcgttttttagttttgttttaaaggcgcgtattttttcggcgagttgtgtttttcgtagtcgttgggttgattcgtcgcgggtgtcggcgtattttttttcggcgttacggtcgtttttattttcgttttattgttgtcgggtatttagtttttttttcgcggagcgttacgggtttagagcgtcggggaggaggcggggtcgcgacgttcgggcgcgttcggattggttgagcgaagtattttagttaatttattcgttttagagggtcgtcgagttttagcggggaggcgacgtgcgttgggttaggtgacgggtgggggcggggtttagcgcgttatagagtttttcgggaatcgggcgttagaagtcgcgttttttgggtcggcggattttcgtatttttattttcgggggagtttcgtgatttttgttgtttgcggtagggtcgttatcgggtcgcggtcggttagtcggcgtaagagtaggcggggttcgagttggatttgaggagtagaggcggttgggtagttttgcgggtgtttttttttagtcgtatgagcgcgggatcgtgtatttcgggagagtcggggtcgcgcggttttgtttttcgcgaattttcgaggggaagtgtcggggtcgcggtagatagttagggtttcgggagtttttcgtaggttattttggatagtgatgagtaggttcgttggatttgcgcgttcgttagtcggagcggttttataggggatttggatggcgtgaagttaagagttacgtatcgaggatggat

SEQ ID NO: 12438 - DNA, 867 bp, Artificial Sequence
  chemically treated genomic DNA (Homo sapiens) CpG-island No: 12438
atccatcctcgatacgtaactcttaacttcacgccatccaaatcccctataaaaccgctccgactaacgaacgcgcaaatccaacgaacctactcatcactatccaaaataacctacgaaaaactcccgaaaccctaactatctaccgcgaccccgacacttcccctcgaaaattcgcgaaaaacaaaaccgcgcgaccccgactctcccgaaatacacgatcccgcgctcatacgactaaaaaaaaacacccgcaaaactacccaaccgcctctactcctcaaatccaactcgaaccccgcctactcttacgccgactaaccgaccgcgacccgataacgaccctaccgcaaacaacaaaaatcacgaaactcccccgaaaataaaaatacgaaaatccgccgacccaaaaaacgcgacttctaacgcccgattcccgaaaaactctataacgcgctaaaccccgcccccacccgtcacctaacccaacgcacgtcgcctccccgctaaaactcgacgaccctctaaaacgaataaattaactaaaatacttcgctcaaccaatccgaacgcgcccgaacgtcgcgaccccgcctcctccccgacgctctaaacccgtaacgctccgcgaaaaaaaaactaaatacccgacaacaataaaacgaaaataaaaacgaccgtaacgccgaaaaaaaatacgccgacacccgcgacgaatcaacccaacgactacgaaaaacacaactcgccgaaaaaatacgcgcctttaaaacaaaactaaaaaacgaccgacgcctatcgccgattatcccgcgcgaaaaaacgaaaaaaactcccgacctataacgctctcgcgtaaaacgtccc

SEQ ID NO: 12439 - DNA, 867 bp, Artificial Sequence
  chemically treated genomic DNA (Homo sapiens) CpG-island No: 12439
gtttattttcgatgcgtgatttttaattttacgttatttaggttttttatggagtcgtttcgattaacggacgcgtaggtttagcggatttgtttattattgtttagggtggtttgcgggagattttcggggttttggttgtttgtcgcggtttcggtattttttttcgagggttcgcggggaataaggtcgcgcggtttcggttttttcggagtgtacggtttcgcgtttatgcggttagagggaggtattcgtaggattgtttagtcgtttttgttttttaggtttagttcgggtttcgtttgtttttacgtcgattaatcggtcgcggttcgatggcggttttgtcgtagatagtaaaggttacggggttttttcggaagtgaaagtgcggggattcgtcggtttaggagacgcggtttttagcgttcggttttcgggaagttttgtgacgcgttaagtttcgtttttattcgttatttgatttagcgtacgtcgttttttcgttggggttcggcggttttttgaagcgggtggattggttggggtgtttcgtttagttaattcggacgcgttcgggcgtcgcggtttcgtttttttttcggcgttttgggttcgtagcgtttcgcgggaaggaggttggatgttcggtagtagtggggcggggatggaggcggtcgtggcgtcggggagggatgcgtcggtattcgcggcgagttagtttagcggttgcgggaaatataattcgtcggagaggtgcgcgtttttagggtagggttggggagcggtcggcgtttgtcgtcgattgtttcgcgcgggaggacgaagggggttttcggtttgtggcgttttcgcgtggggcgtttt

SEQ ID NO: 12440 - DNA, 867 bp, Artificial Sequence
  chemically treated genomic DNA (Homo sapiens) CpG-island No: 12440
aaaacgccccacgcgaaaacgccacaaaccgaaaacccccttcgtcctcccgcgcgaaacaatcgacgacaaacgccgaccgctccccaaccctaccctaaaaacgcgcacctctccgacgaattatatttcccgcaaccgctaaactaactcgccgcgaataccgacgcatccctccccgacgccacgaccgcctccatccccgccccactactaccgaacatccaacctccttcccgcgaaacgctacgaacccaaaacgccgaaaaaaaaacgaaaccgcgacgcccgaacgcgtccgaattaactaaacgaaacaccccaaccaatccacccgcttcaaaaaaccgccgaaccccaacgaaaaaacgacgtacgctaaatcaaataacgaataaaaacgaaacttaacgcgtcacaaaacttcccgaaaaccgaacgctaaaaaccgcgtctcctaaaccgacgaatccccgcactttcacttccgaaaaaaccccgtaacctttactatctacgacaaaaccgccatcgaaccgcgaccgattaatcgacgtaaaaacaaacgaaacccgaactaaacctaaaaaacaaaaacgactaaacaatcctacgaatacctccctctaaccgcataaacgcgaaaccgtacactccgaaaaaaccgaaaccgcgcgaccttattccccgcgaaccctcgaaaaaaaataccgaaaccgcgacaaacaaccaaaaccccgaaaatctcccgcaaaccaccctaaacaataataaacaaatccgctaaacctacgcgtccgttaatcgaaacgactccataaaaaacctaaataacgtaaaattaaaaatcacgcatcgaaaataaac

SEQ ID NO: 12441 - DNA, 882 bp, Artificial Sequence
  chemically treated genomic DNA (Homo sapiens) CpG-island No: 12441
gaaatatcgcggggtttagacggcgtcgttcgttcggttcgtagtcggggcgcgggaggggttacgcgtatggtatcgtttcgtttttagtcgtttcgtttagttcgcgcgtagtttttggggcggtcgggttacgtcgcgcgtcgattggtggcgttcgggattttttttgtaggtgattgacggcgtcggtcgtttttgttcgtcgttcgttcgttgttgtcgttcgttcggggtgtggagttcggtcgttgttcgcgggttgagtgtttgtcgttgttgtcgtttttatttagttttcgttatggattttttcggggatttgtcggagttcgagcgttcgtcgcgttcggttgtcggtaagcgggttgcgcgggtcggttagggaagggagagtaggcgggatgggggcggtttgaggtcggggcggttgaggcggcgttcgcgttgggaggcggcgggcggcgcgggttgtacggggtttgtttttgtttggttaggtttcgttcgggttattggcggttttgtcggaggttcggtcgttcgcggattacggagaggtcgtttcgttattttcgttacgtaggaaggaaagggtcgagtcgtcgtggttacggttttttgcgtggcggtgaaaggcgtcggcgcgatcgcgtgggtcgattcgagggatcggttttgaacgttcggcggtatcgcggttttcgcgtttcgattttattcgcggtttgggttgttttgcgcgtcgttcgttcgcgtatttcgggtcgtattttattcgcgggttgtggaacggtcgcgtttcgggtcggtgtaagtttaggggtttggcgtttttatttgtattggagattgaattaattattattttaatttttcgtg

SEQ ID NO: 12442 - DNA, 882 bp, Artificial Sequence
  chemically treated genomic DNA (Homo sapiens) CpG-island No: 12442
cacgaaaaattaaaataataattaattcaatctccaatacaaataaaaacgccaaacccctaaacttacaccgacccgaaacgcgaccgttccacaacccgcgaataaaatacgacccgaaatacgcgaacgaacgacgcgcaaaacaacccaaaccgcgaataaaatcgaaacgcgaaaaccgcgataccgccgaacgttcaaaaccgatccctcgaatcgacccacgcgatcgcgccgacgcctttcaccgccacgcaaaaaaccgtaaccacgacgactcgaccctttccttcctacgtaacgaaaataacgaaacgacctctccgtaatccgcgaacgaccgaacctccgacaaaaccgccaataacccgaacgaaacctaaccaaacaaaaacaaaccccgtacaacccgcgccgcccgccgcctcccaacgcgaacgccgcctcaaccgccccgacctcaaaccgcccccatcccgcctactctcccttccctaaccgacccgcgcaacccgcttaccgacaaccgaacgcgacgaacgctcgaactccgacaaatccccgaaaaaatccataacgaaaactaaataaaaacgacaacaacgacaaacactcaacccgcgaacaacgaccgaactccacaccccgaacgaacgacaacaacgaacgaacgacgaacaaaaacgaccgacgccgtcaatcacctacaaaaaaaatcccgaacgccaccaatcgacgcgcgacgtaacccgaccgccccaaaaactacgcgcgaactaaacgaaacgactaaaaacgaaacgataccatacgcgtaacccctcccgcgccccgactacgaaccgaacgaacgacgccgtctaaaccccgcgatatttc

SEQ ID NO: 12443 - DNA, 882 bp, Artificial Sequence
  chemically treated genomic DNA (Homo sapiens) CpG-island No: 12443
tacgaaggattaagatggtgattaatttaatttttagtgtaaataaaaacgttaagtttttgaatttgtatcggttcggaacgcggtcgttttatagttcgcgggtgaagtgcggttcggaatgcgcgggcgggcgacgcgtaaggtagtttaggtcgcgggtggaatcggggcgcgggggtcgcggtgtcgtcgggcgtttagagtcggtttttcgggtcggtttacgcggtcgcgtcggcgttttttatcgttacgtagagggtcgtggttacgacggttcggtttttttttttttgcgtagcgaaaatggcggagcggttttttcgtagttcgcgagcgatcgggttttcgatagggtcgttagtggttcggacggggtttggttaggtaggagtaggtttcgtgtagttcgcgtcgttcgtcgttttttagcgcgggcgtcgttttagtcgtttcggttttaggtcgtttttatttcgtttgtttttttttttttggtcggttcgcgtaattcgtttatcggtagtcgggcgcggcgagcgttcgggtttcggtaggttttcgaagaggtttatggcggaggttgggtggaggcggtagtagcgatagatatttagttcgcgagtagcggtcgggttttatatttcgggcgggcggtagtagcgggcgggcgacgggtaggggcggtcggcgtcgttagttatttgtagggagagtttcggacgttattaatcggcgcgcggcgtggttcggtcgttttagaggttgcgcgcgggttgggcggggcggttgggggcggggcggtgttatgcgcgtggtttttttcgcgtttcgattgcgagtcgggcggacggcgtcgtttgggtttcgcggtgtttt

SEQ ID NO: 12444 - DNA, 882 bp, Artificial Sequence
  chemically treated genomic DNA (Homo sapiens) CpG-island No: 12444
aaaacaccgcgaaacccaaacgacgccgtccgcccgactcgcaatcgaaacgcgaaaaaaaccacgcgcataacaccgccccgcccccaaccgccccgcccaacccgcgcgcaacctctaaaacgaccgaaccacgccgcgcgccgattaataacgtccgaaactctccctacaaataactaacgacgccgaccgcccctacccgtcgcccgcccgctactaccgcccgcccgaaatataaaacccgaccgctactcgcgaactaaatatctatcgctactaccgcctccacccaacctccgccataaacctcttcgaaaacctaccgaaacccgaacgctcgccgcgcccgactaccgataaacgaattacgcgaaccgaccaaaaaaaaaaaaacaaacgaaataaaaacgacctaaaaccgaaacgactaaaacgacgcccgcgctaaaaaacgacgaacgacgcgaactacacgaaacctactcctacctaaccaaaccccgtccgaaccactaacgaccctatcgaaaacccgatcgctcgcgaactacgaaaaaaccgctccgccattttcgctacgcaaaaaaaaaaaaaccgaaccgtcgtaaccacgaccctctacgtaacgataaaaaacgccgacgcgaccgcgtaaaccgacccgaaaaaccgactctaaacgcccgacgacaccgcgacccccgcgccccgattccacccgcgacctaaactaccttacgcgtcgcccgcccgcgcattccgaaccgcacttcacccgcgaactataaaacgaccgcgttccgaaccgatacaaattcaaaaacttaacgtttttatttacactaaaaattaaattaatcaccatcttaatccttcgta

SEQ ID NO: 12445 - DNA, 590 bp, Artificial Sequence
  chemically treated genomic DNA (Homo sapiens) CpG-island No: 12445
gtagcgcgtacgggagtcgggagggggcgcgggcgggcgcgcggtttcgggcgaggcgggggatttaagcgcgttataaggcgaggagttcggcgttcgagacgtcgcgttcggagtcgcgagggaatcgtcgttcgtatgtttcggttcgtcgtttcgtcggagttcgtttgttgttcgtttaacgcggtttgttggtcgcgtttcgcgggtttggggttttcggagtttgggcgttttcgaggagtcgcgttcgtagggagtcgtcgttcgggaacgagttagttcggggtttcggggagagtcgcgcggggtcggtcgttcgttcgtcggtaagacgttcgggttcgttttagattttagattcgattgttttcggttcggggcggcgggaggcggacgtggagtcgagttcgtttttattttcgagggttgttgtatcgtttggtatcggggtttcggcgttcgtagagatttagggtcgtgtagacgtcgtttttagttcggcggggtagttttgattttggttttggggtagtttgatttaaagtaaggttttattaggtcggcgaaatttttttttttttttg

SEQ ID NO: 12446 - DNA, 590 bp, Artificial Sequence
  chemically treated genomic DNA (Homo sapiens) CpG-island No: 12446
caaaaaaaaaaaaaaatttcgccgacctaataaaaccttactttaaatcaaactaccccaaaaccaaaatcaaaactaccccgccgaactaaaaacgacgtctacacgaccctaaatctctacgaacgccgaaaccccgataccaaacgatacaacaaccctcgaaaataaaaacgaactcgactccacgtccgcctcccgccgccccgaaccgaaaacaatcgaatctaaaatctaaaacgaacccgaacgtcttaccgacgaacgaacgaccgaccccgcgcgactctccccgaaaccccgaactaactcgttcccgaacgacgactccctacgaacgcgactcctcgaaaacgcccaaactccgaaaaccccaaacccgcgaaacgcgaccaacaaaccgcgttaaacgaacaacaaacgaactccgacgaaacgacgaaccgaaacatacgaacgacgattccctcgcgactccgaacgcgacgtctcgaacgccgaactcctcgccttataacgcgcttaaatcccccgcctcgcccgaaaccgcgcgcccgcccgcgccccctcccgactcccgtacgcgctac

SEQ ID NO: 12447 - DNA, 590 bp, Artificial Sequence
  chemically treated genomic DNA (Homo sapiens) CpG-island No: 12447
taaaagaaaaggggggtttcgtcgatttagtagaattttgttttaagttaaattattttaaagttaaagttaaggttgtttcgtcgggttgagggcggcgtttatacggttttgagtttttgcggacgtcggagtttcggtgttaggcgatgtagtagttttcgggggtgagggcgggttcggttttacgttcgtttttcgtcgtttcgagtcgggggtagtcgggtttagggtttggagcgggttcgggcgttttatcggcggacgagcggtcggtttcgcgcggtttttttcggggtttcgggttagttcgttttcgggcggcggttttttgcgggcgcggtttttcgagggcgtttaggtttcggggattttaggttcgcggggcgcggttagtaggtcgcgttagacgagtagtaggcgggtttcggcggggcggcgggtcggggtatgcgggcggcggttttttcgcggtttcgagcgcggcgtttcggacgtcgggtttttcgttttataacgcgtttgaatttttcgtttcgttcgagatcgcgcgttcgttcgcgttttttttcggttttcgtgcgcgttgt

SEQ ID NO: 12448 - DNA, 590 bp, Artificial Sequence
  chemically treated genomic DNA (Homo sapiens) CpG-island No: 12448
acaacgcgcacgaaaaccgaaaaaaaacgcgaacgaacgcgcgatctcgaacgaaacgaaaaattcaaacgcgttataaaacgaaaaacccgacgtccgaaacgccgcgctcgaaaccgcgaaaaaaccgccgcccgcataccccgacccgccgccccgccgaaacccgcctactactcgtctaacgcgacctactaaccgcgccccgcgaacctaaaatccccgaaacctaaacgccctcgaaaaaccgcgcccgcaaaaaaccgccgcccgaaaacgaactaacccgaaaccccgaaaaaaaccgcgcgaaaccgaccgctcgtccgccgataaaacgcccgaacccgctccaaaccctaaacccgactacccccgactcgaaacgacgaaaaacgaacgtaaaaccgaacccgccctcacccccgaaaactactacatcgcctaacaccgaaactccgacgtccgcaaaaactcaaaaccgtataaacgccgccctcaacccgacgaaacaaccttaactttaactttaaaataatttaacttaaaacaaaattctactaaatcgacgaaaccccccttttctttta

SEQ ID NO: 12449 - DNA, 895 bp, Artificial Sequence
  chemically treated genomic DNA (Homo sapiens) CpG-island No: 12449
ttaggtcgagggacgtcgttttcgttttatttttgcgttcggtaggtttttggtttcgttagtatttgtcgtttagggttggatttacgcggcgggcgggtgaggggtttttggcgcgcggttatcgttcgttttgtgttaggtgcggtgcggtagcgggagcgcgcggagttcgaattttgtacgtgtggtttcgtcgggtcggtcgttgcgagtttcgtttcggtttcggttatcgtcggggaggacgacgacgacgtggtgggggacgtgttggtattgttggtcgcgtttttggtttcggggcgcgggcgtcgcgcgtggaggtcgtttttttttgtcgtttgcgtcgggacgcgttggtggagcggcgcgcgttgtacgagtttggcgtttattatttggtgagtgtcggcgcgcgggagggcgggtgagttcggtcgggcgggagtcggggtgattattcgtgtttttcgtagttcgacgtcgagggtgtttttcgtcgcggttcgggtttgaatttgattagcggttagtatagggcgttcgtggttggtttttacgttttcgtcgttacgttgtacgtgggtgaggttcggggcgtgggaggatcgttcgttttgtcgtttatttcgtcgttcgttcgtttgattacgttttattttttttcgtagcgttcggggagtcgtcgaggagggggtcgtcgcgttttcgggattatttgcgtttgtttatttgtatttagtttcggtgttagcgtaacgcgtgagtgtatttcggttcggattttatattcgtattcgttcggtttttataagttggaggtggttaaataggtattggacggggttttcgttcgtttatattttatcgtggtttaggtgattttatattt

SEQ ID NO: 12450 - DNA, 895 bp, Artificial Sequence
  chemically treated genomic DNA (Homo sapiens) CpG-island No: 12450
aaatataaaatcacctaaaccacgataaaatataaacgaacgaaaaccccgtccaatacctatttaaccacctccaacttataaaaaccgaacgaatacgaatataaaatccgaaccgaaatacactcacgcgttacgctaacaccgaaactaaatacaaataaacaaacgcaaataatcccgaaaacgcgacgaccccctcctcgacgactccccgaacgctacgaaaaaaaataaaacgtaatcaaacgaacgaacgacgaaataaacgacaaaacgaacgatcctcccacgccccgaacctcacccacgtacaacgtaacgacgaaaacgtaaaaaccaaccacgaacgccctatactaaccgctaatcaaattcaaacccgaaccgcgacgaaaaacaccctcgacgtcgaactacgaaaaacacgaataatcaccccgactcccgcccgaccgaactcacccgccctcccgcgcgccgacactcaccaaataataaacgccaaactcgtacaacgcgcgccgctccaccaacgcgtcccgacgcaaacgacaaaaaaaaacgacctccacgcgcgacgcccgcgccccgaaaccaaaaacgcgaccaacaataccaacacgtcccccaccacgtcgtcgtcgtcctccccgacgataaccgaaaccgaaacgaaactcgcaacgaccgacccgacgaaaccacacgtacaaaattcgaactccgcgcgctcccgctaccgcaccgcacctaacacaaaacgaacgataaccgcgcgccaaaaacccctcacccgcccgccgcgtaaatccaaccctaaacgacaaatactaacgaaaccaaaaacctaccgaacgcaaaaataaaacgaaaacgacgtccctcgacctaa

SEQ ID NO: 12451 - DNA, 895 bp, Artificial Sequence
  chemically treated genomic DNA (Homo sapiens) CpG-island No: 12451
aggtgtggggttatttaggttacggtggggtgtgaacgggcggaagtttcgtttagtgtttgtttaattatttttagtttgtggaggtcgagcgaatgcgggtgtggggttcgggtcggggtatatttacgcgttgcgttggtatcgggattggatgtagatgagtaggcgtaggtggtttcgggggcgcggcggtttttttttcggcggtttttcgagcgttgcgggggagggtgggacgtggttaagcgggcgggcggcggggtgggcgatagagcgggcgatttttttacgtttcgggttttatttacgtgtagcgtggcggcgagagcgtagaagttagttacgggcgttttgtattggtcgttggttaagtttaggttcgggtcgcggcggaaggtattttcggcgtcgggttgcgaggggtacggatggttatttcggttttcgttcggtcggatttattcgttttttcgcgcgtcggtatttattaggtagtagacgttaagttcgtgtagcgcgcgtcgttttattaacgcgtttcggcgtaggcggtagaggaaagcggtttttacgcgcggcgttcgcgtttcggggttaggggcgcggttagtagtgttagtacgttttttattacgtcgtcgtcgtttttttcggcggtggtcgagatcggggcgaggttcgtagcgatcggttcggcggggttatacgtatagggttcgggtttcgcgcgttttcgttgtcgtatcgtatttggtatagagcgagcggtggtcgcgcgttagggattttttattcgttcgtcgcgtgggtttagttttgaacgataggtgttagcgagattaggggtttgtcgggcgtaggggtggggcgagggcgacgtttttcggtttga

SEQ ID NO: 12452 - DNA, 895 bp, Artificial Sequence
  chemically treated genomic DNA (Homo sapiens) CpG-island No: 12452
tcaaaccgaaaaacgtcgccctcgccccacccctacgcccgacaaacccctaatctcgctaacacctatcgttcaaaactaaacccacgcgacgaacgaataaaaaatccctaacgcgcgaccaccgctcgctctataccaaatacgatacgacaacgaaaacgcgcgaaacccgaaccctatacgtataaccccgccgaaccgatcgctacgaacctcgccccgatctcgaccaccgccgaaaaaaacgacgacgacgtaataaaaaacgtactaacactactaaccgcgcccctaaccccgaaacgcgaacgccgcgcgtaaaaaccgctttcctctaccgcctacgccgaaacgcgttaataaaacgacgcgcgctacacgaacttaacgtctactacctaataaataccgacgcgcgaaaaaacgaataaatccgaccgaacgaaaaccgaaataaccatccgtacccctcgcaacccgacgccgaaaataccttccgccgcgacccgaacctaaacttaaccaacgaccaatacaaaacgcccgtaactaacttctacgctctcgccgccacgctacacgtaaataaaacccgaaacgtaaaaaaatcgcccgctctatcgcccaccccgccgcccgcccgcttaaccacgtcccaccctcccccgcaacgctcgaaaaaccgccgaaaaaaaaaccgccgcgcccccgaaaccacctacgcctactcatctacatccaatcccgataccaacgcaacgcgtaaatataccccgacccgaaccccacacccgcattcgctcgacctccacaaactaaaaataattaaacaaacactaaacgaaacttccgcccgttcacaccccaccgtaacctaaataaccccacacct

SEQ ID NO: 12453 - DNA, 1340 bp, Artificial Sequence
  chemically treated genomic DNA (Homo sapiens) CpG-island No: 12453
agcgacggtagcgtcgatggtttggtacgtggatacgaacgtgtgtatttcgtgtatgtattggatgtagtcggtagcgaaggttcgttcgttttcgtttgtagttgttcgcgttttgggttcgagggtgggagggagagagtcgcgtttcgcgcggtgagcggcgattgcgtggtttagttattcggttcgcggggacgcggtttatttaggagacgcgggggcgtattttgtttcggtgggagttttcgtcgtcgataggataggggcgtcgggagggaagtttttcgtttggtaggggttataggcgttcgcggtcggcgttttcgttcgtttcgtcgttatttatcgcgcgttcggtttcgtagtatattttggattcgtcgtatcgttagttttagtatttcggcgttttttagtttggtttgtatttgcgcgggcgggaagggcggtgagtcggtagcgcgttttcggattcgttcgttcgtttcgtagttttttacgcgtttgtttcggcgtcgtatttcggcgttcgttagtagtagtcgtagtttttgtaggttttcgttgaattcgcgcgcgtcgttttttttttattaggggttttcgggtttgcggggagcggggtattgaattttagtttcgtacgtttttcgttcgtttgttcgtttatgtttcgtacgtatttgcggttttttcgcgttttttagtcgtttttattttacggtttatacggtttcggttaggcgtcgcgggtggcgttattgtcgtttcgtcggggacgcggtaggggttaggagtagcggggacggggagcggcggggatcggagtgtcggcgtttttcgttgtttcgcggtcgtttagtagtagtttagtcgttgcgtttttcgcggttttcggttcgtcgcggtttcgttttttttatagtcgtttatttgtattttaatgcgtcgattggtcgcgcgggttcggggcggtcgatcgcgaggcgcgttgtagttaatcggggtagcgcgttttgttcggtttagcggttttggcggtcgggtagttggttgagttaggcgggtttttagttcggttttttttagatttcgcgggggggcggtatcggggcggcgatttcgggtagttgcggttttgttcgcgtttgttttttttcgtttgttgttttaggattattgatttgtcgcgcgtgcgagtaggcgtttattcgttcgttcgttcgttcgtttatttatttatttatttattaatttatttatttttttttttcgtcgatggcgtttttagagttgagcgttggggttattggttttagaatgcgtttttggtgtgt

SEQ ID NO: 12454 - DNA, 1340 bp, Artificial Sequence
  chemically treated genomic DNA (Homo sapiens) CpG-island No: 12454
acacaccaaaaacgcattctaaaaccaataaccccaacgctcaactctaaaaacgccatcgacgaaaaaaaaaaataaataaattaataaataaataaataaataaacgaacgaacgaacgaacgaataaacgcctactcgcacgcgcgacaaatcaataatcctaaaacaacaaacgaaaaaaaacaaacgcgaacaaaaccgcaactacccgaaatcgccgccccgataccgcccccccgcgaaatctaaaaaaaaccgaactaaaaacccgcctaactcaaccaactacccgaccgccaaaaccgctaaaccgaacaaaacgcgctaccccgattaactacaacgcgcctcgcgatcgaccgccccgaacccgcgcgaccaatcgacgcattaaaatacaaataaacgactataaaaaaaacgaaaccgcgacgaaccgaaaaccgcgaaaaacgcaacgactaaactactactaaacgaccgcgaaacaacgaaaaacgccgacactccgatccccgccgctccccgtccccgctactcctaacccctaccgcgtccccgacgaaacgacaataacgccacccgcgacgcctaaccgaaaccgtataaaccgtaaaataaaaacgactaaaaaacgcgaaaaaaccgcaaatacgtacgaaacataaacgaacaaacgaacgaaaaacgtacgaaactaaaattcaataccccgctccccgcaaacccgaaaacccctaataaaaaaaaaacgacgcgcgcgaattcaacgaaaacctacaaaaactacgactactactaacgaacgccgaaatacgacgccgaaacaaacgcgtaaaaaactacgaaacgaacgaacgaatccgaaaacgcgctaccgactcaccgcccttcccgcccgcgcaaatacaaaccaaactaaaaaacgccgaaatactaaaactaacgatacgacgaatccaaaatatactacgaaaccgaacgcgcgataaataacgacgaaacgaacgaaaacgccgaccgcgaacgcctataacccctaccaaacgaaaaacttccctcccgacgcccctatcctatcgacgacgaaaactcccaccgaaacaaaatacgcccccgcgtctcctaaataaaccgcgtccccgcgaaccgaataactaaaccacgcaatcgccgctcaccgcgcgaaacgcgactctctccctcccaccctcgaacccaaaacgcgaacaactacaaacgaaaacgaacgaaccttcgctaccgactacatccaatacatacacgaaatacacacgttcgtatccacgtaccaaaccatcgacgctaccgtcgct

SEQ ID NO: 12455 - DNA, 1340 bp, Artificial Sequence
  chemically treated genomic DNA (Homo sapiens) CpG-island No: 12455
gtatattagggacgtattttggggttagtggttttagcgtttaattttggaggcgttatcggcgaaggagggaaatgaatgaattaatgggtgaatgaatgagtggacggacggacggacggacgggtggacgtttgttcgtacgcgcggtagattagtggttttagagtagtagacggagagaaataagcgcgggtagggtcgtagttattcggggtcgtcgtttcggtgtcgttttttcgcggggtttagggaaggtcgggttgggggttcgtttagtttagttagttgttcgatcgttagagtcgttgggtcggataaagcgcgttgtttcgattggttgtagcgcgtttcgcggtcggtcgtttcgggttcgcgcggttaatcggcgtattgagatgtaaataagcggttataaaaggggcgggatcgcggcgggtcggaagtcgcgaggagcgtaacggttgggttgttgttgggcggtcgcggggtagcggagggcgtcggtatttcggttttcgtcgtttttcgttttcgttgtttttagtttttgtcgcgttttcggcggagcggtaatggcgttattcgcggcgtttggtcgggatcgtgtgggtcgtgagatgaggacggttgggagacgcgaggggatcgtaagtgcgtgcggggtatgggcgagtaagcgggcgggaggcgtgcggggttgggatttagtgtttcgtttttcgtaggttcggaagtttttggtggagaagaagcggcgcgcgcggatttaacgagagtttgtaggagttgcggttgttgttggcgggcgtcgaggtgcggcgtcgagataggcgcgtaggaggttgcggggcgggcgggcgggttcgggagcgcgttgtcggtttatcgtttttttcgttcgcgtaggtgtaggttaagttggagaacgtcgaagtgttggagttgacggtgcggcgggtttagggtgtgttgcggggtcgggcgcgcggtgagtggcggcggggcgggcgggggcgtcggtcgcgggcgtttgtaatttttgttagacggaggatttttttttcggcgtttttgttttgtcggcggcgagggtttttatcggagtagggtgcgttttcgcgttttttgggtgagtcgcgttttcgcgggtcgggtggttgggttacgtagtcgtcgtttatcgcgcgggacgcggtttttttttttttattttcgggtttagagcgcgagtagttgtaggcggaagcgagcgagttttcgttgtcggttatatttagtgtatgtacgaggtgtatacgttcgtgtttacgtgttaggttatcgacgttatcgtcgtt

SEQ ID NO: 12456 - DNA, 1340 bp, Artificial Sequence
  chemically treated genomic DNA (Homo sapiens) CpG-island No: 12456
aacgacgataacgtcgataacctaacacgtaaacacgaacgtatacacctcgtacatacactaaatataaccgacaacgaaaactcgctcgcttccgcctacaactactcgcgctctaaacccgaaaataaaaaaaaaaaaaccgcgtcccgcgcgataaacgacgactacgtaacccaaccacccgacccgcgaaaacgcgactcacccaaaaaacgcgaaaacgcaccctactccgataaaaaccctcgccgccgacaaaacaaaaacgccgaaaaaaaaatcctccgtctaacaaaaattacaaacgcccgcgaccgacgcccccgcccgccccgccgccactcaccgcgcgcccgaccccgcaacacaccctaaacccgccgcaccgtcaactccaacacttcgacgttctccaacttaacctacacctacgcgaacgaaaaaaacgataaaccgacaacgcgctcccgaacccgcccgcccgccccgcaacctcctacgcgcctatctcgacgccgcacctcgacgcccgccaacaacaaccgcaactcctacaaactctcgttaaatccgcgcgcgccgcttcttctccaccaaaaacttccgaacctacgaaaaacgaaacactaaatcccaaccccgcacgcctcccgcccgcttactcgcccataccccgcacgcacttacgatcccctcgcgtctcccaaccgtcctcatctcacgacccacacgatcccgaccaaacgccgcgaataacgccattaccgctccgccgaaaacgcgacaaaaactaaaaacaacgaaaacgaaaaacgacgaaaaccgaaataccgacgccctccgctaccccgcgaccgcccaacaacaacccaaccgttacgctcctcgcgacttccgacccgccgcgatcccgccccttttataaccgcttatttacatctcaatacgccgattaaccgcgcgaacccgaaacgaccgaccgcgaaacgcgctacaaccaatcgaaacaacgcgctttatccgacccaacgactctaacgatcgaacaactaactaaactaaacgaacccccaacccgaccttccctaaaccccgcgaaaaaacgacaccgaaacgacgaccccgaataactacgaccctacccgcgcttatttctctccgtctactactctaaaaccactaatctaccgcgcgtacgaacaaacgtccacccgtccgtccgtccgtccgtccactcattcattcacccattaattcattcatttccctccttcgccgataacgcctccaaaattaaacgctaaaaccactaaccccaaaatacgtccctaatatac

SEQ ID NO: 12457 - DNA, 641 bp, Artificial Sequence
  chemically treated genomic DNA (Homo sapiens) CpG-island No: 12457
  misc_feature (300)..(300): n is either a, c, g or t
  misc_feature (441)..(441): n is either a, c, g or t
gttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcgtttttggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggngtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgngtattcgttggcgttgatacggtcggcgttggatgagcgagcggtggtgttggggtcgggatcgtgaaacgttgttgtgcggggtgaaagcgttgtttgtcggttatgaggtttttggggttggtgatcggatttgtgggggttggggggtcgatcgggttttggttttttcgtttagggtggttagtggttggggattg

SEQ ID NO: 12458 - DNA, 641 bp, Artificial Sequence
  chemically treated genomic DNA (Homo sapiens) CpG-island No: 12458
  misc_feature (201)..(201): n is either a, c, g or t
  misc_feature (342)..(342): n is either a, c, g or t
caatccccaaccactaaccaccctaaacgaaaaaaccaaaacccgatcgaccccccaacccccacaaatccgatcaccaaccccaaaaacctcataaccgacaaacaacgctttcaccccgcacaacaacgtttcacgatcccgaccccaacaccaccgctcgctcatccaacgccgaccgtatcaacgccaacgaatacncaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgacnccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccaaaaacgacgacgacgattccacgtacaacgtacgtaacaactacccgtaccgcatcgccatcaccatcttaatcacaccaaccacacccgccgccgcttacgtataaccgatattcgacttaaccgaccccaaccacaac

SEQ ID NO: 12459 - DNA, 641 bp, Artificial Sequence
  chemically treated genomic DNA (Homo sapiens) CpG-island No: 12459
  misc_feature (201)..(201): n is either a, c, g or t
  misc_feature (342)..(342): n is either a, c, g or t
taatttttagttattgattattttgaacggaaaaattaaaattcgatcggttttttagtttttatagattcggttattaattttagaagttttatgatcggtagatagcgtttttatttcgtataataacgttttacggtttcgattttagtattatcgttcgtttatttagcgtcgatcgtgttaacgttagcgagtatntaatatttagcgaggagatattaggtcgttcgtttagataggttattaacgtcgttgtttgcgcggatagcgtttcgggtgttttgttcgatattatttacggtattatcggaatatttacgatagaattcgaattcggtntcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttaaaaacggcgacggcgattttacgtgtaacgtgcgtggtagttgttcgtgtcgtatcgttattattattttgattatattagttatattcgtcgtcgtttgcgtatgatcgatgttcgatttgatcgattttaattataat

SEQ ID NO: 12460 - DNA, 641 bp, Artificial Sequence
  chemically treated genomic DNA (Homo sapiens) CpG-island No: 12460
  misc_feature (300)..(300): n is either a, c, g or t
  misc_feature (441)..(441): n is either a, c, g or t
attataattaaaatcgatcaaatcgaacatcgatcatacgcaaacgacgacgaatataactaatataatcaaaataataataacgatacgacacgaacaactaccacgcacgttacacgtaaaatcgccgtcgccgtttttaaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacganaccgaattcgaattctatcgtaaatattccgataataccgtaaataatatcgaacaaaacacccgaaacgctatccgcgcaaacaacgacgttaataacctatctaaacgaacgacctaatatctcctcgctaaatattanatactcgctaacgttaacacgatcgacgctaaataaacgaacgataatactaaaatcgaaaccgtaaaacgttattatacgaaataaaaacgctatctaccgatcataaaacttctaaaattaataaccgaatctataaaaactaaaaaaccgatcgaattttaatttttccgttcaaaataatcaataactaaaaatta

SEQ ID NO: 12461 - DNA, 1067 bp, Artificial Sequence
  chemically treated genomic DNA (Homo sapiens) CpG-island No: 12461
tttttcgcgttttgtttttgtgcgttttttttttttttttttttttgttcgtttttttttttttttttttttacgtattcgtttttcgcgcgtagggatttttgggtaaggttattgcgtttcggattcgcggtcgttggtagggcgtttagggggcgtatttacgcggatgacgtagcgcgaggagtttttgtcgtttaggttgatttagagcgagaagagcgcggcggtattgtatacgttttgcgttttgtatagtagttggttgaggttttagttggttgaggtttcgcgattttcggacgttttttcgcgtcgtttaggttttagttttcgtagttttttatgatttttagtatgggtcgaggatttagtcgttcgatttcgcgtatgtcgaggtacgaacggaaaaaggcgtttattttgtattgggtcgcgtcgtcgggtttatttttgggtcgtgttagtaggcgttttaggcgtttttttttttgttcgtcgaaggtcgcgatggtgttataggtgagtttttcgtcgggggtggcgtggcgtcgtagttagtagtcgtagacgaacgagtagaagttttggtatgggtcgatgttggcgtttaggttggcggttaggaagcgagcggcgcgcgcgaaggttttgcgtttagggtagttttcgggataggcgtcgtcgtcggtcgcgatcgggtttaggtatttgagcgttagtatagtcgttagaatggcgtagagattagcggcgaatattagtttcgatagtaggtttattttacgtagggttttagcgcggtagttcggatcgggtttcggtggcgttgcgcgttgttttttgagagaagttcgggggtagggaggtttcgcgcgcgtttttcgcgtcgtagcggtttacgtatttgattttttggaatttatcgtagtgcgtcgttagcgaatatcgggttttatggcgtcgaggtcgtcgcggtgtagatttgggttatttgggttatgggatgcgcgtggtcgtcggttttttagtgggtttttgtatggtttcggggggttaaagttgcg

SEQ ID NO: 12462 - DNA, 1067 bp, Artificial Sequence
  chemically treated genomic DNA (Homo sapiens) CpG-island No: 12462
cgcaactttaaccccccgaaaccatacaaaaacccactaaaaaaccgacgaccacgcgcatcccataacccaaataacccaaatctacaccgcgacgacctcgacgccataaaacccgatattcgctaacgacgcactacgataaattccaaaaaatcaaatacgtaaaccgctacgacgcgaaaaacgcgcgcgaaacctccctacccccgaacttctctcaaaaaacaacgcgcaacgccaccgaaacccgatccgaactaccgcgctaaaaccctacgtaaaataaacctactatcgaaactaatattcgccgctaatctctacgccattctaacgactatactaacgctcaaatacctaaacccgatcgcgaccgacgacgacgcctatcccgaaaactaccctaaacgcaaaaccttcgcgcgcgccgctcgcttcctaaccgccaacctaaacgccaacatcgacccataccaaaacttctactcgttcgtctacgactactaactacgacgccacgccacccccgacgaaaaactcacctataacaccatcgcgaccttcgacgaacaaaaaaaaaaacgcctaaaacgcctactaacacgacccaaaaataaacccgacgacgcgacccaatacaaaataaacgcctttttccgttcgtacctcgacatacgcgaaatcgaacgactaaatcctcgacccatactaaaaatcataaaaaactacgaaaactaaaacctaaacgacgcgaaaaaacgtccgaaaatcgcgaaacctcaaccaactaaaacctcaaccaactactatacaaaacgcaaaacgtatacaataccgccgcgctcttctcgctctaaatcaacctaaacgacaaaaactcctcgcgctacgtcatccgcgtaaatacgccccctaaacgccctaccaacgaccgcgaatccgaaacgcaataaccttacccaaaaatccctacgcgcgaaaaacgaatacgtaaaaaaaaaaaaaaaaaaaaacgaacaaaaaaaaaaaaaaaaaaaaaacgcacaaaaacaaaacgcgaaaaa

SEQ ID NO: 12463 - DNA, 1067 bp, Artificial Sequence
  chemically treated genomic DNA (Homo sapiens) CpG-island No: 12463
cgtagttttggtttttcggggttatgtagaggtttattaggaggtcggcggttacgcgtattttatagtttaggtggtttaggtttgtatcgcggcggtttcggcgttatggagttcggtattcgttgacggcgtattacgatgagttttaagaggttaagtacgtgagtcgttgcggcgcggggggcgcgcgcggggtttttttgttttcgggttttttttaaggagtagcgcgtagcgttatcggggttcggttcgggttgtcgcgttggaattttgcgtgaggtgagtttgttgtcggggttggtgttcgtcgttgatttttgcgttattttggcggttatgttggcgtttaagtatttgggttcggtcgcggtcggcggcggcgtttgtttcgagagttgttttgagcgtaaggttttcgcgcgcgtcgttcgttttttggtcgttaatttggacgttagtatcgatttatgttaggatttttattcgttcgtttgcggttgttgattgcggcgttacgttattttcgacgaaaagtttatttatggtattatcgcggttttcggcgagtagaaagaggagcgtttgaggcgtttgttggtacggtttagggatgggttcggcggcgcggtttagtgtaaggtgagcgttttttttcgttcgtgtttcgatatgcgcgagatcgagcgattgagttttcggtttatgttagaggttatggaggattgcgggggttgggatttgggcggcgcggaggagcgttcgggggtcgcgggattttaattagttgggattttaattagttgttgtataaggcgtagggcgtgtatagtgtcgtcgcgtttttttcgttttagattagtttggacgataggaatttttcgcgttacgttattcgcgtgagtgcgttttttgagcgttttgttagcggtcgcggattcggggcgtagtggttttgtttaggggtttttgcgcgcgggaggcgggtgcgtgagaggagaggagggaagagacgagtaggagaggggaggggaggggagcgtatagaggtagagcgcgggagg

SEQ ID NO: 12464 - DNA, 1067 bp, Artificial Sequence
  chemically treated genomic DNA (Homo sapiens) CpG-island No: 12464
cctcccgcgctctacctctatacgctcccctcccctcccctctcctactcgtctcttccctcctctcctctcacgcacccgcctcccgcgcgcaaaaacccctaaacaaaaccactacgccccgaatccgcgaccgctaacaaaacgctcaaaaaacgcactcacgcgaataacgtaacgcgaaaaattcctatcgtccaaactaatctaaaacgaaaaaaacgcgacgacactatacacgccctacgccttatacaacaactaattaaaatcccaactaattaaaatcccgcgacccccgaacgctcctccgcgccgcccaaatcccaacccccgcaatcctccataacctctaacataaaccgaaaactcaatcgctcgatctcgcgcatatcgaaacacgaacgaaaaaaaacgctcaccttacactaaaccgcgccgccgaacccatccctaaaccgtaccaacaaacgcctcaaacgctcctctttctactcgccgaaaaccgcgataataccataaataaacttttcgtcgaaaataacgtaacgccgcaatcaacaaccgcaaacgaacgaataaaaatcctaacataaatcgatactaacgtccaaattaacgaccaaaaaacgaacgacgcgcgcgaaaaccttacgctcaaaacaactctcgaaacaaacgccgccgccgaccgcgaccgaacccaaatacttaaacgccaacataaccgccaaaataacgcaaaaatcaacgacgaacaccaaccccgacaacaaactcacctcacgcaaaattccaacgcgacaacccgaaccgaaccccgataacgctacgcgctactccttaaaaaaaacccgaaaacaaaaaaaccccgcgcgcgccccccgcgccgcaacgactcacgtacttaacctcttaaaactcatcgtaatacgccgtcaacgaataccgaactccataacgccgaaaccgccgcgatacaaacctaaaccacctaaactataaaatacgcgtaaccgccgacctcctaataaacctctacataaccccgaaaaaccaaaactacg

SEQ ID NO: 12465 - DNA, 550 bp, Artificial Sequence
  chemically treated genomic DNA (Homo sapiens) CpG-island No: 12465
ttgcgcgaagttttatttacgttggggcgcgagttgttcgggcgagtttagagttatgtaggcgcggcgcgtagtttatggagttttagagtcgagtttgggagtcgtagtcggcggatggacgtaaataaagtcgggaggtttcgcgtagcggttacgaaggtgacggaagtggtcgcggttgtagggatttaggcgttatttattcggtaggtgcgcgtcggagtttggcggtgatcgagcgggtcgggttcgagcgggggtttgagtaggagcgaagcggcgttagcgttcggtgttttttagcgttcgtcgttttttttgtcgtcgcgtcgagttcgtcgcgtcgttcgttagtaggttcgagggagggggcgcgtcggcggttttattttttttcgttcgtttcgcgcgtttttttttttttttgtatttttcgggttatttggtagtggggcggtagcgcggacgtgggtcggcgaagtagagggatagtaagcggttagttttgaagttttgtttttagtttggttttttttggaggggttgg

SEQ ID NO: 12466 - DNA, 550 bp, Artificial Sequence
  chemically treated genomic DNA (Homo sapiens) CpG-island No: 12466
ccaacccctccaaaaaaaaccaaactaaaaacaaaacttcaaaactaaccgcttactatccctctacttcgccgacccacgtccgcgctaccgccccactaccaaataacccgaaaaatacaaaaaaaaaaaaaaacgcgcgaaacgaacgaaaaaaaataaaaccgccgacgcgccccctccctcgaacctactaacgaacgacgcgacgaactcgacgcgacgacaaaaaaaacgacgaacgctaaaaaacaccgaacgctaacgccgcttcgctcctactcaaacccccgctcgaacccgacccgctcgatcaccgccaaactccgacgcgcacctaccgaataaataacgcctaaatccctacaaccgcgaccacttccgtcaccttcgtaaccgctacgcgaaacctcccgactttatttacgtccatccgccgactacgactcccaaactcgactctaaaactccataaactacgcgccgcgcctacataactctaaactcgcccgaacaactcgcgccccaacgtaaataaaacttcgcgcaa

SEQ ID NO: 12467 - DNA, 550 bp, Artificial Sequence
  chemically treated genomic DNA (Homo sapiens) CpG-island No: 12467
ttaatttttttagggagggttaggttggagatagaattttaaggttggtcgtttgttgtttttttatttcgtcgatttacgttcgcgttgtcgttttattgttaggtggttcgagagatgtaggaggaaggaggggcgcgcggggcgggcggaggagggtggagtcgtcggcgcgttttttttttcgggtttgttggcgggcggcgcggcgggttcggcgcggcggtagaggaggcggcgggcgttgggagatatcggacgttagcgtcgtttcgtttttgtttaggttttcgttcgggttcgattcgttcggttatcgttaggtttcggcgcgtatttgtcgggtaggtggcgtttgagtttttgtagtcgcggttattttcgttattttcgtagtcgttgcgcggagtttttcggttttgtttgcgtttattcgtcggttgcgatttttaggttcggttttgaggttttatggattgcgcgtcgcgtttgtatggttttgggttcgttcggatagttcgcgttttagcgtgggtgaaatttcgcgtaa

SEQ ID NO: 12468 - DNA, 550 bp, Artificial Sequence
  chemically treated genomic DNA (Homo sapiens) CpG-island No: 12468
ttacgcgaaatttcacccacgctaaaacgcgaactatccgaacgaacccaaaaccatacaaacgcgacgcgcaatccataaaacctcaaaaccgaacctaaaaatcgcaaccgacgaataaacgcaaacaaaaccgaaaaactccgcgcaacgactacgaaaataacgaaaataaccgcgactacaaaaactcaaacgccacctacccgacaaatacgcgccgaaacctaacgataaccgaacgaatcgaacccgaacgaaaacctaaacaaaaacgaaacgacgctaacgtccgatatctcccaacgcccgccgcctcctctaccgccgcgccgaacccgccgcgccgcccgccaacaaacccgaaaaaaaaaacgcgccgacgactccaccctcctccgcccgccccgcgcgcccctccttcctcctacatctctcgaaccacctaacaataaaacgacaacgcgaacgtaaatcgacgaaataaaaaaacaacaaacgaccaaccttaaaattctatctccaacctaaccctccctaaaaaaattaa

SEQ ID NO: 12469 - DNA, 719 bp, Artificial Sequence
  chemically treated genomic DNA (Homo sapiens) CpG-island No: 12469
cgcgaacgcggttgtatcgcgtgggagggcggttacggcgagtttaagtttacggattcggacgaggtggcgcggcggtggggcgagcgtaagagtaagtttaatatgaattacgataagttgagtcgcgttttgttatttattacgataagaatattatgagtaaggtgtatggtaagcgttacgtttatcgtttcgatttttagggtttggcgtaggtttgttagtcgtcgttcgcgtacgtttatgtcgtcgtcgtagttgttgtcgtcgtcgcgtcgtttaggacggcgcgttttataagttgttcgtcggtttcgattcgttgttttttttcggtttttttaaatttaattttatggtcgtttcgttggaggtcgcgtcgacggttttttttattggtcgggtcggtgtcgacgttatcgttgaagtcgttagcgtcgcgttttaatttagtcgtagtttgtagttttagttacgaatattcggtcgtagagcgttagtttcgtatttgggaggttattattattagatagggcggtcgagtgtttgcggtttcggtcggacgttttagagtttcgtcgtattttatttgtatttcggggaggtttcgggagttttcgttaatcgttttttaatttagagtttattttatttgtcgtatttagtagggggacgggatcgaagtttttttaatttttgtttggtattagatttgt

SEQ ID NO: 12470 - DNA, 719 bp, Artificial Sequence
  chemically treated genomic DNA (Homo sapiens) CpG-island No: 12470
acaaatctaataccaaacaaaaattaaaaaaacttcgatcccgtccccctactaaatacgacaaataaaataaactctaaattaaaaaacgattaacgaaaactcccgaaacctccccgaaatacaaataaaatacgacgaaactctaaaacgtccgaccgaaaccgcaaacactcgaccgccctatctaataataataacctcccaaatacgaaactaacgctctacgaccgaatattcgtaactaaaactacaaactacgactaaattaaaacgcgacgctaacgacttcaacgataacgtcgacaccgacccgaccaataaaaaaaaccgtcgacgcgacctccaacgaaacgaccataaaattaaatttaaaaaaaccgaaaaaaaacaacgaatcgaaaccgacgaacaacttataaaacgcgccgtcctaaacgacgcgacgacgacaacaactacgacgacgacataaacgtacgcgaacgacgactaacaaacctacgccaaaccctaaaaatcgaaacgataaacgtaacgcttaccatacaccttactcataatattcttatcgtaataaataacaaaacgcgactcaacttatcgtaattcatattaaacttactcttacgctcgccccaccgccgcgccacctcgtccgaatccgtaaacttaaactcgccgtaaccgccctcccacgcgatacaaccgcgttcgcg

SEQ ID NO: 12471 - DNA, 719 bp, Artificial Sequence
  chemically treated genomic DNA (Homo sapiens) CpG-island No: 12471
gtaaatttagtattagataaggattgagggagtttcggtttcgtttttttgttaagtgcggtaggtggagtaaattttggattagaggacggttgacggaggttttcgggattttttcgagatgtagatgggatacggcgagattttaggacgttcggtcgaggtcgtaggtattcgatcgttttgtttagtggtaatggttttttaagtgcgaggttgacgttttacggtcgaatgttcgtggttggggttgtaagttgcgattgggttagagcgcggcgttggcggttttagcggtggcgtcggtatcggttcggttagtaggagaagtcgtcggcgcgatttttagcgaggcggttatgaggttgagtttggagaggtcggggaagggtagcgggtcgaggtcggcgggtagtttgtagagcgcgtcgttttgggcgacgcggcggcggtagtagttgcggcggcggtatgagcgtgcgcgggcggcggttggtagatttgcgttaggttttggaagtcgaagcggtaggcgtagcgtttattatgtattttgtttatgatgtttttgtcgtagtagatagtagggcgcggtttagtttgtcgtagtttatgttgggtttgtttttgcgttcgttttatcgtcgcgttatttcgttcgggttcgtgagtttgaattcgtcgtgatcgtttttttacgcgatgtagtcgcgttcgcg

SEQ ID NO: 12472 - DNA, 719 bp, Artificial Sequence
  chemically treated genomic DNA (Homo sapiens) CpG-island No: 12472
cgcgaacgcgactacatcgcgtaaaaaaacgatcacgacgaattcaaactcacgaacccgaacgaaataacgcgacgataaaacgaacgcaaaaacaaacccaacataaactacgacaaactaaaccgcgccctactatctactacgacaaaaacatcataaacaaaatacataataaacgctacgcctaccgcttcgacttccaaaacctaacgcaaatctaccaaccgccgcccgcgcacgctcataccgccgccgcaactactaccgccgccgcgtcgcccaaaacgacgcgctctacaaactacccgccgacctcgacccgctacccttccccgacctctccaaactcaacctcataaccgcctcgctaaaaatcgcgccgacgacttctcctactaaccgaaccgataccgacgccaccgctaaaaccgccaacgccgcgctctaacccaatcgcaacttacaaccccaaccacgaacattcgaccgtaaaacgtcaacctcgcacttaaaaaaccattaccactaaacaaaacgatcgaatacctacgacctcgaccgaacgtcctaaaatctcgccgtatcccatctacatctcgaaaaaatcccgaaaacctccgtcaaccgtcctctaatccaaaatttactccacctaccgcacttaacaaaaaaacgaaaccgaaactccctcaatccttatctaatactaaatttac

SEQ ID NO: 12473 - DNA, 1046 bp, Artificial Sequence
  chemically treated genomic DNA (Homo sapiens) CpG-island No: 12473
ttttcgtcgagaataaaatggcggcgttggcggagggttaattataaggcggggtcgcggttattttttttttatttttatttttgcgtcggtcgggtcggttagggggaattcgttcgtttcgttcggtcgcgggcggggaggggaggggagcggttcggtttattatgtaaagcgtcgggcgtcgtcgtcgttatttcgtggtaaaggtaaaagggtcgggtttagtcgtcgtcgcggcgtttttatgttcgcgcgttaggttcgtttttttcgtcgtcggttcgagttcgttcgatttttttttaattttattttaggatttggcgttaaagcggtttcgaagcgggtttcgtgtttgcggcgggcggttttcggcgcggagggtagggcgcggggagttcgggttttcggtgtcggcggatggcgggagttcgggggtcgcgggttcgcggggtagcgggcgagagacgagacgtcgaggtgggagcggggtggcggggacgggttcgggggcgtcgtcggggtcgcggagaagggggggtttgttattgtttttgttagtgaaaggttagagttcgtgatttcggtgtcgtcgtcgtcgtcgttcgcgcgttggtaggaggagggcgaatgtttttttttttttttttagcgttagtttcgtcgtcgcggcggggggcgggcgagaacgcgattggttgaggcgcgcgcgcgtatcggaacgtcgtagtcggcgttcggtttattcggttcgtgggttgtggggtttcgggcggcggcggttacgtagttgtcgtcggttttggtcgcggtcgggcgggcggatatgtggtttaaatggcgtaggcgtcggggtttagaggttgaagggttggtcgttttaaaaattcgtggacgtcgcgtacggttattcggacgtaggttcgtttttttggggaatcgcgagtttttcgtagttgggtggggatcgttttcgtagtggcggtttttattttgttttttcgtttagttaaggtttttggaaggttcgtaaagtgtttgtt

SEQ ID NO: 12474 - DNA, 1046 bp, Artificial Sequence
  chemically treated genomic DNA (Homo sapiens) CpG-island No: 12474
aacaaacactttacgaaccttccaaaaaccttaactaaacgaaaaaacaaaataaaaaccgccactacgaaaacgatccccacccaactacgaaaaactcgcgattccccaaaaaaacgaacctacgtccgaataaccgtacgcgacgtccacgaatttttaaaacgaccaacccttcaacctctaaaccccgacgcctacgccatttaaaccacatatccgcccgcccgaccgcgaccaaaaccgacgacaactacgtaaccgccgccgcccgaaaccccacaacccacgaaccgaataaaccgaacgccgactacgacgttccgatacgcgcgcgcgcctcaaccaatcgcgttctcgcccgccccccgccgcgacgacgaaactaacgctaaaaaaaaaaaaaaaaacattcgccctcctcctaccaacgcgcgaacgacgacgacgacgacaccgaaatcacgaactctaacctttcactaacaaaaacaataacaaacccccccttctccgcgaccccgacgacgcccccgaacccgtccccgccaccccgctcccacctcgacgtctcgtctctcgcccgctaccccgcgaacccgcgacccccgaactcccgccatccgccgacaccgaaaacccgaactccccgcgccctaccctccgcgccgaaaaccgcccgccgcaaacacgaaacccgcttcgaaaccgctttaacgccaaatcctaaaataaaattaaaaaaaaatcgaacgaactcgaaccgacgacgaaaaaaacgaacctaacgcgcgaacataaaaacgccgcgacgacgactaaacccgacccttttacctttaccacgaaataacgacgacgacgcccgacgctttacataataaaccgaaccgctcccctcccctccccgcccgcgaccgaacgaaacgaacgaattccccctaaccgacccgaccgacgcaaaaataaaaataaaaaaaaaataaccgcgaccccgccttataattaaccctccgccaacgccgccattttattctcgacgaaaa

SEQ ID NO: 12475 - DNA, 1046 bp, Artificial Sequence
  chemically treated genomic DNA (Homo sapiens) CpG-island No: 12475
aatagatattttgcgagttttttagaagttttggttaagcgagaaggtagggtggaggtcgttattgcgaggacggtttttatttagttgcgaggagttcgcggttttttagaggggcgggtttgcgttcgggtaatcgtgcgcgacgtttacgagtttttaggacgattagttttttagtttttaggtttcgacgtttgcgttatttaagttatatattcgttcgttcggtcgcggttaaggtcggcggtagttacgtagtcgtcgtcgttcggggttttatagtttacgggtcggatggatcgagcgtcggttgcggcgtttcggtgcgcgcgcgcgttttagttaatcgcgttttcgttcgtttttcgtcgcggcggcgaggttggcgttgggaagaggaagaagaatattcgttttttttttattagcgcgcgggcggcggcggcggcggtatcggggttacgaattttgattttttattgataaaaataataataaattttttttttttcgcgatttcggcggcgttttcgggttcgttttcgttatttcgtttttatttcggcgtttcgtttttcgttcgttgtttcgcgagttcgcggttttcgggttttcgttattcgtcgatatcgggagttcgggtttttcgcgttttgtttttcgcgtcgggggtcgttcgtcgtagatacgggattcgtttcgaggtcgttttggcgttaaattttgaggtaaaattgaaagagggtcgggcgggttcgggtcggcggcggagggggcgggtttggcgcgcggatatggaggcgtcgcggcggcggttgaattcgatttttttatttttgttacggggtggcggcggcggcgttcggcgttttgtatagtgggtcgggtcgtttttttttttttttcgttcgcggtcgggcgaagcgagcgggttttttttgatcggttcggtcggcgtaagggtgggggtggagggggaatggtcgcggtttcgttttatagttggtttttcgttagcgtcgttattttgttttcgacggaga

SEQ ID NO: 12476 - DNA, 1046 bp, Artificial Sequence
  chemically treated genomic DNA (Homo sapiens) CpG-island No: 12476
tctccgtcgaaaacaaaataacgacgctaacgaaaaaccaactataaaacgaaaccgcgaccattccccctccacccccacccttacgccgaccgaaccgatcaaaaaaaacccgctcgcttcgcccgaccgcgaacgaaaaaaaaaaaaaaacgacccgacccactatacaaaacgccgaacgccgccgccgccaccccgtaacaaaaataaaaaaatcgaattcaaccgccgccgcgacgcctccatatccgcgcgccaaacccgccccctccgccgccgacccgaacccgcccgaccctctttcaattttacctcaaaatttaacgccaaaacgacctcgaaacgaatcccgtatctacgacgaacgacccccgacgcgaaaaacaaaacgcgaaaaacccgaactcccgatatcgacgaataacgaaaacccgaaaaccgcgaactcgcgaaacaacgaacgaaaaacgaaacgccgaaataaaaacgaaataacgaaaacgaacccgaaaacgccgccgaaatcgcgaaaaaaaaaaaatttattattatttttatcaataaaaaatcaaaattcgtaaccccgataccgccgccgccgccgcccgcgcgctaataaaaaaaaaacgaatattcttcttcctcttcccaacgccaacctcgccgccgcgacgaaaaacgaacgaaaacgcgattaactaaaacgcgcgcgcgcaccgaaacgccgcaaccgacgctcgatccatccgacccgtaaactataaaaccccgaacgacgacgactacgtaactaccgccgaccttaaccgcgaccgaacgaacgaatatataacttaaataacgcaaacgtcgaaacctaaaaactaaaaaactaatcgtcctaaaaactcgtaaacgtcgcgcacgattacccgaacgcaaacccgcccctctaaaaaaccgcgaactcctcgcaactaaataaaaaccgtcctcgcaataacgacctccaccctaccttctcgcttaaccaaaacttctaaaaaactcgcaaaatatctatt

SEQ ID NO: 12477 - DNA, 975 bp, Artificial Sequence
  chemically treated genomic DNA (Homo sapiens) CpG-island No: 12477
ggggagcgggttggaggattttgtaagtataggtttttatggagcgttcgttcgggggacgggattttttttttttttttttttttcgttcgttcggaatttcgttttcgtcgcgggttcggaataatgtagtcgttcgtttcggggattagttatttattatttaggttagtgtttcgttgtcgtcgtttacgtcggttttcgcgtcgtagttattcgatttggttatggcgagtgtttttagtttataggttttgaggtcgtagtcgtcgttttcgtttttttgcgggtcgttgggtttcgtcgtttcgtatttatcgttttattcgtcgtatttttagtcgcgtcgattttcgcgttttatcgcgaagattcggagcggacgtttagtcgagttcgttgaggaggtcgcgtcgtcggttgtttttaaattcgaggcgcggcgttcgcgtcgttcgggtttagcgcggcggttgaggagaaagtagggagcgatcggcggcggtcgagcggcggcgttgttttttcgttcgttcgcgggcgtcgttgtaggtcgggttgaagttcgggcgtgcgagtcgcgagggcggtcggggagttcgaggcgttcggacgtggcgaggacgtagaggtgttttgttttttttatatttcgcgaaggttagttattcgagtcgttagagtagtcgtttcggtcgtcgtcgttgttttaaaggtagttttagtttcgttgtagtttcgatttttttatatatatatatcgagagggttaataaatagagtcgtcgtcgtcgtcgttacggttattttttttttgttcggtatattatcgtatatatatatttgtatatcggggagagagggagggcgcgtcggtcgttttcgttgttagttagcgttatgttgtttaattcgggttttgtcgttatagtttttcggttaattttaaaattttaagttttttggaggggcggg

SEQ ID NO: 12478 - DNA, 975 bp, Artificial Sequence
  chemically treated genomic DNA (Homo sapiens) CpG-island No: 12478
cccgcccctccaaaaaacttaaaattttaaaattaaccgaaaaactataacgacaaaacccgaattaaacaacataacgctaactaacaacgaaaacgaccgacgcgccctccctctctccccgatatacaaatatatatatacgataatataccgaacaaaaaaaaaataaccgtaacgacgacgacgacgactctatttattaaccctctcgatatatatatataaaaaaatcgaaactacaacgaaactaaaactacctttaaaacaacgacgacgaccgaaacgactactctaacgactcgaataactaaccttcgcgaaatataaaaaaaacaaaacacctctacgtcctcgccacgtccgaacgcctcgaactccccgaccgccctcgcgactcgcacgcccgaacttcaacccgacctacaacgacgcccgcgaacgaacgaaaaaacaacgccgccgctcgaccgccgccgatcgctccctactttctcctcaaccgccgcgctaaacccgaacgacgcgaacgccgcgcctcgaatttaaaaacaaccgacgacgcgacctcctcaacgaactcgactaaacgtccgctccgaatcttcgcgataaaacgcgaaaatcgacgcgactaaaaatacgacgaataaaacgataaatacgaaacgacgaaacccaacgacccgcaaaaaaacgaaaacgacgactacgacctcaaaacctataaactaaaaacactcgccataaccaaatcgaataactacgacgcgaaaaccgacgtaaacgacgacaacgaaacactaacctaaataataaataactaatccccgaaacgaacgactacattattccgaacccgcgacgaaaacgaaattccgaacgaacgaaaaaaaaaaaaaaaaaaaaaatcccgtcccccgaacgaacgctccataaaaacctatacttacaaaatcctccaacccgctcccc

SEQ ID NO: 12479 - DNA, 975 bp, Artificial Sequence
  chemically treated genomic DNA (Homo sapiens) CpG-island No: 12479
ttcgtttttttagggggtttggaattttgggattggtcgagaggttgtggcgataaggttcggattggatagtatggcgttgattgatagcgggggcggtcggcgcgtttttttttttttttcggtgtgtaaatgtgtgtgtgcggtggtatgtcggataagagggaggtgatcgtggcggcggcggcggcggttttgtttattggttttttcggtgtgtgtgtgtgaggaaatcggggttgtagcgaggttaaggttgtttttgaagtagcggcggcgatcgggacgattattttggcgattcgagtggttggttttcgcggagtgtgagaaggataaggtatttttgcgttttcgttacgttcgagcgtttcgggtttttcggtcgttttcgcggttcgtacgttcgggttttagttcggtttgtagcggcgttcgcgggcgggcgagaaggtaacgtcgtcgttcggtcgtcgtcggtcgttttttgttttttttttagtcgtcgcgttaggttcgggcgacgcggacgtcgcgtttcgagtttgagggtagtcggcggcgcggtttttttagcgggttcggttggacgttcgtttcggattttcgcgatggggcgcgggggtcggcgcggttaggagtgcggcgagtggagcggtgggtgcggagcggcggggtttagcggttcgtagggaggcgggagcggcggttgcggttttagggtttgtgagttggaggtattcgttatggttaagtcgggtggttgcggcgcgggagtcggcgtgggcggcggtaacggggtattgatttgggtggtaagtggttggttttcgggacgggcggttgtattgtttcgggttcgcggcgggggcggaatttcgaacgggcgggggaggggaaagggagggaaatttcgtttttcgaacgggcgttttataggggtttgtgtttgtagaattttttagttcgtttttt

SEQ ID NO: 12480 - DNA, 975 bp, Artificial Sequence
  chemically treated genomic DNA (Homo sapiens) CpG-island No: 12480
aaaaaacgaactaaaaaattctacaaacacaaacccctataaaacgcccgttcgaaaaacgaaatttccctccctttcccctcccccgcccgttcgaaattccgcccccgccgcgaacccgaaacaatacaaccgcccgtcccgaaaaccaaccacttaccacccaaatcaataccccgttaccgccgcccacgccgactcccgcgccgcaaccacccgacttaaccataacgaatacctccaactcacaaaccctaaaaccgcaaccgccgctcccgcctccctacgaaccgctaaaccccgccgctccgcacccaccgctccactcgccgcactcctaaccgcgccgacccccgcgccccatcgcgaaaatccgaaacgaacgtccaaccgaacccgctaaaaaaaccgcgccgccgactaccctcaaactcgaaacgcgacgtccgcgtcgcccgaacctaacgcgacgactaaaaaaaaaacaaaaaacgaccgacgacgaccgaacgacgacgttaccttctcgcccgcccgcgaacgccgctacaaaccgaactaaaacccgaacgtacgaaccgcgaaaacgaccgaaaaacccgaaacgctcgaacgtaacgaaaacgcaaaaataccttatccttctcacactccgcgaaaaccaaccactcgaatcgccaaaataatcgtcccgatcgccgccgctacttcaaaaacaaccttaacctcgctacaaccccgatttcctcacacacacacaccgaaaaaaccaataaacaaaaccgccgccgccgccgccacgatcacctccctcttatccgacataccaccgcacacacacatttacacaccgaaaaaaaaaaaaaaacgcgccgaccgcccccgctatcaatcaacgccatactatccaatccgaaccttatcgccacaacctctcgaccaatcccaaaattccaaaccccctaaaaaaacgaa

SEQ ID NO: 12481 - DNA, 738 bp, Artificial Sequence
  chemically treated genomic DNA (Homo sapiens) CpG-island No: 12481
tcggtcgttatattttttgcgattgaagtatttgtttcgttatgaatttgttaagagttgagcgttttcgttttatatcgtagcgtagttttcgggatttcgatggggaagacggtaaaatcgatgttttgggagaggaggaagatgaagacgaggtggaagacgaggaggaggaggcgagttagtagtttttagagtagtcgttttagtcggggttgtaggtggttcggtggggcggggttgcgttttttcgagagtatatcgagggcggcggcggttcgagcgattttttagagtttggtatcgagtttagggtatcgttaaggtttgcggcggtttttgaagatgttcggtagtcggtaaagttttttattcgtatatcgcgtttattattatggttattttgtaaagttcgtataagcgttttacgtttagcggtatttgcgtttttattagtggcgttttttttattatcgtcgtaagtttttcgtttggtagaatagtattcgttataatttttcgttgaacgattgtttcgttaagatttttcgcgagtcgggtcgtttaggaagggtaattattggagtttggatttcgttttttaggatatgttcgataatggtagtttttttcggcgtaggaagcgtttttagcgttattaattgatttcgggagtttatttgttttattttttttttttatttgttgtatacgtcgttttgtataattttcgtttag

SEQ ID NO: 12482 - DNA, 738 bp, Artificial Sequence
  chemically treated genomic DNA (Homo sapiens) CpG-island No: 12482
ctaaacgaaaattatacaaaacgacgtatacaacaaataaaaaaaaaaaataaaacaaataaactcccgaaatcaattaataacgctaaaaacgcttcctacgccgaaaaaaactaccattatcgaacatatcctaaaaaacgaaatccaaactccaataattacccttcctaaacgacccgactcgcgaaaaatcttaacgaaacaatcgttcaacgaaaaattataacgaatactattctaccaaacgaaaaacttacgacgataataaaaaaaacgccactaataaaaacgcaaataccgctaaacgtaaaacgcttatacgaactttacaaaataaccataataataaacgcgatatacgaataaaaaactttaccgactaccgaacatcttcaaaaaccgccgcaaaccttaacgataccctaaactcgataccaaactctaaaaaatcgctcgaaccgccgccgccctcgatatactctcgaaaaaacgcaaccccgccccaccgaaccacctacaaccccgactaaaacgactactctaaaaactactaactcgcctcctcctcctcgtcttccacctcgtcttcatcttcctcctctcccaaaacatcgattttaccgtcttccccatcgaaatcccgaaaactacgctacgatataaaacgaaaacgctcaactcttaacaaattcataacgaaacaaatacttcaatcgcaaaaaatataacgaccga

SEQ ID NO: 12483 - DNA, 738 bp, Artificial Sequence
  chemically treated genomic DNA (Homo sapiens) CpG-island No: 12483
ttgggcgggggttgtgtagggcggcgtgtgtagtaggtagagggaaggggtggggtaggtgggttttcggggttagttggtggcgttggaaacgttttttacgtcggagaaagttgttattgtcgaatatgttttgggaggcggggtttaggttttagtagttgttttttttgggcggttcggttcgcgggggattttgacgaagtagtcgtttagcgagaggttgtggcggatgttgttttgttaggcggggaatttgcggcggtagtaggggaagcgttattaatgaaggcgtagatgtcgttgagcgtgaggcgtttgtgcgggttttgtaggatggttatggtgatgagcgcgatgtacgagtagggggttttgtcggttgtcgggtatttttagaggtcgtcgtagattttggcggtgttttgaattcggtgttaaattttgaggggtcgttcgggtcgtcgtcgttttcgatgtgttttcggggaagcgtaatttcgttttatcgggttatttgtagtttcggttggagcgattgttttaggaattgttggttcgttttttttttttcgttttttatttcgtttttatttttttttttttttaggatatcgattttatcgttttttttatcggagtttcggaggttgcgttgcggtgtggagcgaaggcgtttagtttttggtaagtttatggcggagtaggtgttttagtcgtaggggatgtggcggtcga

SEQ ID NO: 12484 - DNA, 738 bp, Artificial Sequence
  chemically treated genomic DNA (Homo sapiens) CpG-island No: 12484
tcgaccgccacatcccctacgactaaaacacctactccgccataaacttaccaaaaactaaacgccttcgctccacaccgcaacgcaacctccgaaactccgataaaaaaaacgataaaatcgatatcctaaaaaaaaaaaaaaataaaaacgaaataaaaaacgaaaaaaaaaaaacgaaccaacaattcctaaaacaatcgctccaaccgaaactacaaataacccgataaaacgaaattacgcttccccgaaaacacatcgaaaacgacgacgacccgaacgacccctcaaaatttaacaccgaattcaaaacaccgccaaaatctacgacgacctctaaaaatacccgacaaccgacaaaaccccctactcgtacatcgcgctcatcaccataaccatcctacaaaacccgcacaaacgcctcacgctcaacgacatctacgccttcattaataacgcttcccctactaccgccgcaaattccccgcctaacaaaacaacatccgccacaacctctcgctaaacgactacttcgtcaaaatcccccgcgaaccgaaccgcccaaaaaaaacaactactaaaacctaaaccccgcctcccaaaacatattcgacaataacaactttctccgacgtaaaaaacgtttccaacgccaccaactaaccccgaaaacccacctaccccaccccttccctctacctactacacacgccgccctacacaacccccgcccaa

SEQ ID NO: 12485 - DNA, 532 bp, Artificial Sequence
  chemically treated genomic DNA (Homo sapiens) CpG-island No: 12485
gttaggttgttcgtttcgttttttataatagtttcgcgaagttattttttcgtgtttttttcgattcggacgttttttcgtttatatcgttagggaggtttcggaggggttgttttcgcgtgttaagttagttatcggggcggattttgtttttacgtgcggtttcgagtgagggttggagagattagggacgttgcgggtcggttttttcgggttttgtcgttagtttggattttgcgcgttttcgaattacgttcgtcggtttagttcgcgtcgtagcgattttattttcggttcgtttcgcgttttcgtagttgttacgtaatcgcgtaaggatttcgagggaggttgttcggtcgaacgtgaaggatttcgtcggtcgttggttgtttagcggcgtttggcgggagggtcgtaggagtgcgtatgcggtcgagtgcgggattggggtttttggttgtgggtgtggtattgaggttttagcgggtgtcgttcgtttagagggagtggagcggtgagtacgttaggggtg

SEQ ID NO: 12486 - DNA, 532 bp, Artificial Sequence
  chemically treated genomic DNA (Homo sapiens) CpG-island No: 12486
cacccctaacgtactcaccgctccactccctctaaacgaacgacacccgctaaaacctcaataccacacccacaaccaaaaaccccaatcccgcactcgaccgcatacgcactcctacgaccctcccgccaaacgccgctaaacaaccaacgaccgacgaaatccttcacgttcgaccgaacaacctccctcgaaatccttacgcgattacgtaacaactacgaaaacgcgaaacgaaccgaaaataaaatcgctacgacgcgaactaaaccgacgaacgtaattcgaaaacgcgcaaaatccaaactaacgacaaaacccgaaaaaaccgacccgcaacgtccctaatctctccaaccctcactcgaaaccgcacgtaaaaacaaaatccgccccgataactaacttaacacgcgaaaacaacccctccgaaacctccctaacgatataaacgaaaaaacgtccgaatcgaaaaaaacacgaaaaaataacttcgcgaaactattataaaaaacgaaacgaacaacctaac

SEQ ID NO: 12487 - DNA, 532 bp, Artificial Sequence
  chemically treated genomic DNA (Homo sapiens) CpG-island No: 12487
tatttttgacgtgtttatcgttttattttttttaggcgggcggtattcgttgaagttttagtattatatttatagttaggagttttagtttcgtattcggtcgtatgcgtatttttgcggttttttcgttaggcgtcgttgggtagttagcgatcggcggggttttttacgttcggtcgggtagtttttttcggggtttttgcgcggttgcgtagtagttgcgaggacgcggggcgagtcggaagtggagtcgttgcggcgcgagttgggtcggcgggcgtggttcgagagcgcgtagagtttagattggcggtagggttcgaaggggtcgattcgtagcgtttttggtttttttagtttttattcggaatcgtacgtgagggtaaaattcgtttcggtggttggtttagtacgcggggatagttttttcgaggtttttttagcggtgtgggcgagagggcgttcgggtcgggggaagtacggaaaggtggtttcgcgaggttgttgtggggggcgggacgggtagtttggt

SEQ ID NO: 12488 - DNA, 532 bp, Artificial Sequence
  chemically treated genomic DNA (Homo sapiens) CpG-island No: 12488
accaaactacccgtcccgccccccacaacaacctcgcgaaaccacctttccgtacttcccccgacccgaacgccctctcgcccacaccgctaaaaaaacctcgaaaaaactatccccgcgtactaaaccaaccaccgaaacgaattttaccctcacgtacgattccgaataaaaactaaaaaaaccaaaaacgctacgaatcgaccccttcgaaccctaccgccaatctaaactctacgcgctctcgaaccacgcccgccgacccaactcgcgccgcaacgactccacttccgactcgccccgcgtcctcgcaactactacgcaaccgcgcaaaaaccccgaaaaaaactacccgaccgaacgtaaaaaaccccgccgatcgctaactacccaacgacgcctaacgaaaaaaccgcaaaaatacgcatacgaccgaatacgaaactaaaactcctaactataaatataatactaaaacttcaacgaataccgcccgcctaaaaaaaataaaacgataaacacgtcaaaaata

SEQ ID NO: 12489 - DNA, 931 bp, Artificial Sequence
  chemically treated genomic DNA (Homo sapiens) CpG-island No: 12489
ggtcgagtaggcggtcgagcgacgtttttacgtcgttaaataggcggtggatgcgttcggtgtattcggcgtcgcggatgaaggttttgtagttagcgaaggttaagtcgcgcgtttgttgtagtagttgcgttcgttttttcgttaggcgttcgggttcgcgtcgtagtcgttttagtttcgagtcgtttaattttcggaggtagcggtttatatcgggtcgttcgcgttattgggtttcggggaagcggtttcggaatagcgacgttaggagttttttattttttatttcgtcgagagtcgttgttgtggtcgtggttatcgatgggatagtcgtcgcggtcgttatttttttagtaataacgttatttttttttcggattataaggggcgttgatttcgaatttaggataggaagaaataggtatattttcggtttttatgtttttttattcggtcggtttgtttttttttgcggtcgtttagattattgggcgttagcgagacgaattattggtacggggttagagaggaaggttttgggattgtcggggagtagcgagcgatcgattttcgtttttagttattaaggtacgaggattcggtgttttaatttagggggaaaaatgcggtttttgattgaagaggagattcgtgttatgtttgagaagatagcgaaatagtaggagcgcgcggggcggacgcgggagtgtgtgggtgtggtggttaagggtggagtgggggcgcggtgtcggagatcggttcgttcgggcgcggtttttagttttttttttgtttttagtattggggagaatttttaattgttggtggatcggttcgatggtatttattgttttcgtttgtataacgatcgggtgtattatgtgaggtgaggcggggtcgggtaggtagtatggatttaggggagagg

SEQ ID NO: 12490 - DNA, 931 bp, Artificial Sequence
  chemically treated genomic DNA (Homo sapiens) CpG-island No: 12490
cctctcccctaaatccatactacctacccgaccccgcctcacctcacataatacacccgatcgttatacaaacgaaaacaataaataccatcgaaccgatccaccaacaattaaaaattctccccaatactaaaaacaaaaaaaaaactaaaaaccgcgcccgaacgaaccgatctccgacaccgcgcccccactccacccttaaccaccacacccacacactcccgcgtccgccccgcgcgctcctactatttcgctatcttctcaaacataacacgaatctcctcttcaatcaaaaaccgcatttttccccctaaattaaaacaccgaatcctcgtaccttaataactaaaaacgaaaatcgatcgctcgctactccccgacaatcccaaaaccttcctctctaaccccgtaccaataattcgtctcgctaacgcccaataatctaaacgaccgcaaaaaaaaacaaaccgaccgaataaaaaaacataaaaaccgaaaatatacctatttcttcctatcctaaattcgaaatcaacgccccttataatccgaaaaaaaaataacgttattactaaaaaaataacgaccgcgacgactatcccatcgataaccacgaccacaacaacgactctcgacgaaataaaaaataaaaaactcctaacgtcgctattccgaaaccgcttccccgaaacccaataacgcgaacgacccgatataaaccgctacctccgaaaattaaacgactcgaaactaaaacgactacgacgcgaacccgaacgcctaacgaaaaaacgaacgcaactactacaacaaacgcgcgacttaaccttcgctaactacaaaaccttcatccgcgacgccgaatacaccgaacgcatccaccgcctatttaacgacgtaaaaacgtcgctcgaccgcctactcgacc

SEQ ID NO: 12491 - DNA, 931 bp, Artificial Sequence
  chemically treated genomic DNA (Homo sapiens) CpG-island No: 12491
ttttttttttgggtttatgttgtttgttcggtttcgttttattttatatagtatattcggtcgttgtgtagacggaaatagtaggtgttatcgggtcggtttattagtagttgaagattttttttaatgttgagggtaaaaagaggattggagatcgcgttcgaacgaatcggttttcggtatcgcgtttttattttatttttggttattatatttatatattttcgcgttcgtttcgcgcgtttttattatttcgttatttttttaaatatgatacgggttttttttttagttaaaggtcgtatttttttttttgggttggaatatcggattttcgtgttttggtaattggaaacggaagtcggtcgttcgttgtttttcggtaattttaaagtttttttttttagtttcgtattaatagttcgtttcgttagcgtttaatagtttggacgatcgtaggggaaagtaagtcggtcggatgagaaagtatagagatcggaaatgtgtttgtttttttttgttttaagttcggagttagcgttttttgtggttcggaagggaagtgacgttgttgttgggaagatggcgatcgcggcgattattttatcggtagttacggttatagtagcggttttcggcgaggtggaggatgaagggtttttggcgtcgttgtttcgggatcgttttttcgaggtttagtggcgcgagcggttcgatgtgggtcgttattttcgggagttgagcggttcggggttggagcggttgcggcgcgagttcgagcgtttggcggaggagcgggcgtagttgttgtagtagacgcgcgatttggttttcgttaattataagatttttattcgcggcgtcgagtgtatcgagcgtatttatcgtttgtttggcgacgtggaggcgtcgttcggtcgtttgttcgatt

SEQ ID NO: 12492 - DNA, 931 bp, Artificial Sequence
  chemically treated genomic DNA (Homo sapiens) CpG-island No: 12492
aatcgaacaaacgaccgaacgacgcctccacgtcgccaaacaaacgataaatacgctcgatacactcgacgccgcgaataaaaatcttataattaacgaaaaccaaatcgcgcgtctactacaacaactacgcccgctcctccgccaaacgctcgaactcgcgccgcaaccgctccaaccccgaaccgctcaactcccgaaaataacgacccacatcgaaccgctcgcgccactaaacctcgaaaaaacgatcccgaaacaacgacgccaaaaacccttcatcctccacctcgccgaaaaccgctactataaccgtaactaccgataaaataatcgccgcgatcgccatcttcccaacaacaacgtcacttcccttccgaaccacaaaaaacgctaactccgaacttaaaacaaaaaaaaacaaacacatttccgatctctatactttctcatccgaccgacttactttcccctacgatcgtccaaactattaaacgctaacgaaacgaactattaatacgaaactaaaaaaaaaaactttaaaattaccgaaaaacaacgaacgaccgacttccgtttccaattaccaaaacacgaaaatccgatattccaacccaaaaaaaaaaatacgacctttaactaaaaaaaaaacccgtatcatatttaaaaaaataacgaaataataaaaacgcgcgaaacgaacgcgaaaatatataaatataataaccaaaaataaaataaaaacgcgataccgaaaaccgattcgttcgaacgcgatctccaatcctctttttaccctcaacattaaaaaaaatcttcaactactaataaaccgacccgataacacctactatttccgtctacacaacgaccgaatatactatataaaataaaacgaaaccgaacaaacaacataaacccaaaaaaaaaa

SEQ ID NO: 12493 - DNA, 645 bp, Artificial Sequence
  chemically treated genomic DNA (Homo sapiens) CpG-island No: 12493
cgttttaatttttttttttcggttcggtttttattttgtatgatgtttcggatttgtttgaagttttcgtatcggttatttcgaaaggttcgtagcgtttcgtggaagtagaatttgagtatttagcgattgattgttttttttagtcgtgtttttttcgcgtcgcgtttcgtcgggttttttagtttcggttcgtggcgttttcgtcgggttcgttcgttattgcgggacgttcgtttgttagttgttcgttcgttgtcgtcgttattttcgttttttttcgttatcgtgttcgatcgtcgcgcgtttttttcgttttttcggtcgggtcgttttttcggttgtgacgtcgttgggttacgtacgacgttcgggtcgttagcggggttcgtcgtttcggttttcgcggttatgatagaaatagcgtttcgagtcgttcgcgggtttttgggagggaaaggatcggagggttcggttttttttttagacgtcgtagttttcgatgtgtcggtcgtaatgttttttggggtttgaagtttatatcgtttaggtcggtgaattcggcgggttttgtagttaatttcgtttcgaatttatagaaaatagttattatgttagggacgcggaatagtgtattagagattg

SEQ ID NO: 12494 - DNA, 645 bp, Artificial Sequence
  chemically treated genomic DNA (Homo sapiens) CpG-island No: 12494
caatctctaatacactattccgcgtccctaacataataactattttctataaattcgaaacgaaattaactacaaaacccgccgaattcaccgacctaaacgatataaacttcaaaccccaaaaaacattacgaccgacacatcgaaaactacgacgtctaaaaaaaaaaccgaaccctccgatcctttccctcccaaaaacccgcgaacgactcgaaacgctatttctatcataaccgcgaaaaccgaaacgacgaaccccgctaacgacccgaacgtcgtacgtaacccaacgacgtcacaaccgaaaaaacgacccgaccgaaaaaacgaaaaaaacgcgcgacgatcgaacacgataacgaaaaaaaacgaaaataacgacgacaacgaacgaacaactaacaaacgaacgtcccgcaataacgaacgaacccgacgaaaacgccacgaaccgaaactaaaaaacccgacgaaacgcgacgcgaaaaaaacacgactaaaaaaaacaatcaatcgctaaatactcaaattctacttccacgaaacgctacgaacctttcgaaataaccgatacgaaaacttcaaacaaatccgaaacatcatacaaaataaaaaccgaaccgaaaaaaaaaaattaaaacg

SEQ ID NO: 12495 - DNA, 645 bp, Artificial Sequence
  chemically treated genomic DNA (Homo sapiens) CpG-island No: 12495
tagtttttaatatattgtttcgcgtttttagtatagtagttgttttttgtaaattcggagcgaagttgattgtaaaattcgtcgggtttatcggtttgggcggtgtggattttaagttttaggaggtattgcggtcggtatatcgggaattacggcgtttgagaagggggtcgggtttttcggtttttttttttttagaagttcgcgggcggttcggaacgttgtttttattatggtcgcgggagtcgggacggcgggtttcgttaacggttcgggcgtcgtgcgtgatttagcggcgttatagtcgaggaagcggttcggtcgggagggcggggagggcgcgcggcgatcggatacgatggcgggaggaggcgggagtagcgacggtagcgggcgggtagttggtaggcgggcgtttcgtagtagcgggcgggttcggcgggggcgttacgagtcggggttggggggttcggcggagcgcggcgcgggggaggtacggttggaagaggtagttaatcgttgggtgtttaagttttatttttacgaggcgttgcgggtttttcggggtagtcggtacggggattttagatagattcgggatattatgtagggtgagggtcgggtcgggggaggggggttggagcg

SEQ ID NO: 12496 - DNA, 645 bp, Artificial Sequence
  chemically treated genomic DNA (Homo sapiens) CpG-island No: 12496
cgctccaacccccctcccccgacccgaccctcaccctacataatatcccgaatctatctaaaatccccgtaccgactaccccgaaaaacccgcaacgcctcgtaaaaataaaacttaaacacccaacgattaactacctcttccaaccgtacctcccccgcgccgcgctccgccgaaccccccaaccccgactcgtaacgcccccgccgaacccgcccgctactacgaaacgcccgcctaccaactacccgcccgctaccgtcgctactcccgcctcctcccgccatcgtatccgatcgccgcgcgccctccccgccctcccgaccgaaccgcttcctcgactataacgccgctaaatcacgcacgacgcccgaaccgttaacgaaacccgccgtcccgactcccgcgaccataataaaaacaacgttccgaaccgcccgcgaacttctaaaaaaaaaaaaaccgaaaaacccgacccccttctcaaacgccgtaattcccgatataccgaccgcaatacctcctaaaacttaaaatccacaccgcccaaaccgataaacccgacgaattttacaatcaacttcgctccgaatttacaaaaaacaactactatactaaaaacgcgaaacaatatattaaaaacta

SEQ ID NO: 12497 - DNA, 935 bp, Artificial Sequence
  chemically treated genomic DNA (Homo sapiens) CpG-island No: 12497
tgttcgaagtgaggtcgagggatttttaggattcgggataggagaggagggagcgagataggagaggagggagcgagtatcgttgtttgaacgtttagtcggatttcgggtcgagttttttgagggtgtttgtgcggttcgggtgaggttgatttttacggcggtatcggggcgtcggttatacgaagcggttttggggttgggttagtcgggtagggtcggaaggtttgagggtggagatgttattcggtttcgagcgcgtggaaatagatacgggcggaagcggcgagggggcggtcggagcggggtcgcgaggtcggggttgggaggcgtttatttgattattcgttcgtcgttcggttttgcggttcgtaggattcgttgttttcggttttcgaagtcgggtcgggtcgtacgaagtatttggagggttgacgttgttattttattttttgggttcgttttatatttcgcggcgttgtttgcggtttcggttcggtttcggggagtcgaggtattgggttcggcgcgggaagttcggcggtgggcgttgagcgcggtgcgcgggtagggcggtcgttcgtagcgggagtcgagttcgagggtaagcgaggagcgtagtttagagcggtcgggttcgagtcgagcggttgttttttagcgtttacggttcgtattgtaggtatttttttttgtttcggcgaaggtagggggcggttcgagaggtaggattgattggggacgaggaggtgggattagggcgagacggatagggggcggggacggggtgggtgggataaggtcggggcggggtttggcgggacgtatattttcggggcggggttaggggcggagcggggtagaattcggaaattttgatttcgtttggaataatagcgtttattgagtagttttatttttataataaaacgaat

SEQ ID NO: 12498 - DNA, 935 bp, Artificial Sequence
  chemically treated genomic DNA (Homo sapiens) CpG-island No: 12498
attcgttttattataaaaataaaactactcaataaacgctattattccaaacgaaatcaaaatttccgaattctaccccgctccgcccctaaccccgccccgaaaatatacgtcccgccaaaccccgccccgaccttatcccacccaccccgtccccgccccctatccgtctcgccctaatcccacctcctcgtccccaatcaatcctacctctcgaaccgccccctaccttcgccgaaacaaaaaaaaatacctacaatacgaaccgtaaacgctaaaaaacaaccgctcgactcgaacccgaccgctctaaactacgctcctcgcttaccctcgaactcgactcccgctacgaacgaccgccctacccgcgcaccgcgctcaacgcccaccgccgaacttcccgcgccgaacccaatacctcgactccccgaaaccgaaccgaaaccgcaaacaacgccgcgaaatataaaacgaacccaaaaaataaaataacaacgtcaaccctccaaatacttcgtacgacccgacccgacttcgaaaaccgaaaacaacgaatcctacgaaccgcaaaaccgaacgacgaacgaataatcaaataaacgcctcccaaccccgacctcgcgaccccgctccgaccgccccctcgccgcttccgcccgtatctatttccacgcgctcgaaaccgaataacatctccaccctcaaaccttccgaccctacccgactaacccaaccccaaaaccgcttcgtataaccgacgccccgataccgccgtaaaaatcaacctcacccgaaccgcacaaacaccctcaaaaaactcgacccgaaatccgactaaacgttcaaacaacgatactcgctccctcctctcctatctcgctccctcctctcctatcccgaatcctaaaaatccctcgacctcacttcgaaca

SEQ ID NO: 12499 - DNA, 935 bp, Artificial Sequence
  chemically treated genomic DNA (Homo sapiens) CpG-island No: 12499
gttcgttttattgtgagaataaaattgtttaatgggcgttgttattttaagcgaggttaggattttcggattttatttcgtttcgtttttggtttcgtttcgagaatgtacgtttcgttaggtttcgtttcggttttgttttatttatttcgttttcgttttttgttcgtttcgttttagttttattttttcgtttttagttagttttgtttttcgaatcgttttttgttttcgtcgaggtagggagaggtgtttgtagtgcgagtcgtggacgttagggggtagtcgttcggttcgggttcgatcgttttgggttgcgtttttcgtttgttttcggattcggttttcgttgcgagcggtcgttttgttcgcgtatcgcgtttagcgtttatcgtcgggtttttcgcgtcggatttagtatttcggtttttcggggtcggatcgaggtcgtaagtagcgtcgcggggtgtggggcggatttaggagatgaaatgataacgttaattttttaggtatttcgtgcggttcggttcgatttcggaggtcgaaggtagcgggttttgcgggtcgtagagtcgggcggcgggcgggtggttaggtgggcgttttttagtttcggtttcgcgatttcgtttcggtcgttttttcgtcgttttcgttcgtgtttgtttttacgcgttcggagtcgggtggtatttttatttttaggtttttcggttttgttcggttggtttagttttagggtcgtttcgtgtagtcggcgtttcggtatcgtcgtggggattagttttattcgagtcgtataggtatttttaggaagttcggttcggggttcggttgggcgtttagatagcgatgttcgttttttttttttttgtttcgttttttttttttttgtttcgggttttggaagtttttcgattttatttcgaata

SEQ ID NO: 12500 - DNA, 935 bp, Artificial Sequence
  chemically treated genomic DNA (Homo sapiens) CpG-island No: 12500
tattcgaaataaaatcgaaaaacttccaaaacccgaaacaaaaaaaaaaaaaacgaaacaaaaaaaaaaaaaacgaacatcgctatctaaacgcccaaccgaaccccgaaccgaacttcctaaaaatacctatacgactcgaataaaactaatccccacgacgataccgaaacgccgactacacgaaacgaccctaaaactaaaccaaccgaacaaaaccgaaaaacctaaaaataaaaataccacccgactccgaacgcgtaaaaacaaacacgaacgaaaacgacgaaaaaacgaccgaaacgaaatcgcgaaaccgaaactaaaaaacgcccacctaaccacccgcccgccgcccgactctacgacccgcaaaacccgctaccttcgacctccgaaatcgaaccgaaccgcacgaaatacctaaaaaattaacgttatcatttcatctcctaaatccgccccacaccccgcgacgctacttacgacctcgatccgaccccgaaaaaccgaaatactaaatccgacgcgaaaaacccgacgataaacgctaaacgcgatacgcgaacaaaacgaccgctcgcaacgaaaaccgaatccgaaaacaaacgaaaaacgcaacccaaaacgatcgaacccgaaccgaacgactaccccctaacgtccacgactcgcactacaaacacctctccctacctcgacgaaaacaaaaaacgattcgaaaaacaaaactaactaaaaacgaaaaaataaaactaaaacgaaacgaacaaaaaacgaaaacgaaataaataaaacaaaaccgaaacgaaacctaacgaaacgtacattctcgaaacgaaaccaaaaacgaaacgaaataaaatccgaaaatcctaacctcgcttaaaataacaacgcccattaaacaattttattctcacaataaaacgaac

SEQ ID NO: 12501 - DNA, 584 bp, Artificial Sequence
  chemically treated genomic DNA (Homo sapiens) CpG-island No: 12501
tgtttattcgtcgtatatcgtttaaaaagtttagagatagtatggcggggacggcgagtaggatatcggtaggggaaagggcgcgatgattagcgggcggaattattggagttcgggtcgggtttatattggataggatttcgtagtgtttgtattttcgttttcggggcgggagttggtacggtcgggtacggttttcgtttttcgcgttttttcgttgcggagagttgatagagagatttacgattttgttagtttagttttagggtttggtttcgtcgtgggagggtttttacgttttggttttcgtttgttaaaaattcgattggacgttatttttcgcgttcggtttcgcggtttttatcgaggacgcgatttaggtttagttggggaggttgttttgttattttcggaaggcgggtttttgtgttcgttcgggtaatcgcgagtaattttttcggtgtcggcggtagaagcggtttcggtttcggtttgtgtatgtgtgtgtagtggatgtgtcgtttgatcgtagttattttgatcgagtacgttttatgcgttatggaaagttgaggagatgtttt

SEQ ID NO: 12502 - DNA, 584 bp, Artificial Sequence
  chemically treated genomic DNA (Homo sapiens) CpG-island No: 12502
aaaacatctcctcaactttccataacgcataaaacgtactcgatcaaaataactacgatcaaacgacacatccactacacacacatacacaaaccgaaaccgaaaccgcttctaccgccgacaccgaaaaaattactcgcgattacccgaacgaacacaaaaacccgccttccgaaaataacaaaacaacctccccaactaaacctaaatcgcgtcctcgataaaaaccgcgaaaccgaacgcgaaaaataacgtccaatcgaatttttaacaaacgaaaaccaaaacgtaaaaaccctcccacgacgaaaccaaaccctaaaactaaactaacaaaatcgtaaatctctctatcaactctccgcaacgaaaaaacgcgaaaaacgaaaaccgtacccgaccgtaccaactcccgccccgaaaacgaaaatacaaacactacgaaatcctatccaatataaacccgacccgaactccaataattccgcccgctaatcatcgcgccctttcccctaccgatatcctactcgccgtccccgccatactatctctaaactttttaaacgatatacgacgaataaaca

SEQ ID NO: 12503 - DNA, 584 bp, Artificial Sequence
  chemically treated genomic DNA (Homo sapiens) CpG-island No: 12503
aaagtatttttttagttttttatagcgtatgagacgtgttcgattagagtaattacggttagacgatatatttattgtatatatatatataagtcgggatcggaatcgtttttatcgtcgatatcggagaggttgttcgcgattgttcgggcgggtatagaggttcgtttttcgaaggtggtagagtagtttttttaattaagtttgggtcgcgttttcggtgaaggtcgcggggtcgagcgcgggaagtggcgtttagtcgggtttttggtaggcgagagttagagcgtgagaatttttttacggcgaggttaagttttgagattggattagtaaggtcgtgagtttttttgttagtttttcgtagcgaaggggcgcggggggcggggatcgtgttcgatcgtgttagttttcgtttcggaagcggaagtgtaagtattgcggggttttgtttagtgtgagttcgattcgagttttagtagtttcgttcgttggttatcgcgtttttttttttgtcggtgttttgttcgtcgttttcgttatgttgtttttagattttttggacgatgtgcggcggatgaata

SEQ ID NO: 12504 - DNA, 584 bp, Artificial Sequence
  chemically treated genomic DNA (Homo sapiens) CpG-island No: 12504
tattcatccgccgcacatcgtccaaaaaatctaaaaacaacataacgaaaacgacgaacaaaacaccgacaaaaaaaaaaacgcgataaccaacgaacgaaactactaaaactcgaatcgaactcacactaaacaaaaccccgcaatacttacacttccgcttccgaaacgaaaactaacacgatcgaacacgatccccgccccccgcgccccttcgctacgaaaaactaacaaaaaaactcacgaccttactaatccaatctcaaaacttaacctcgccgtaaaaaaattctcacgctctaactctcgcctaccaaaaacccgactaaacgccacttcccgcgctcgaccccgcgaccttcaccgaaaacgcgacccaaacttaattaaaaaaactactctaccaccttcgaaaaacgaacctctatacccgcccgaacaatcgcgaacaacctctccgatatcgacgataaaaacgattccgatcccgacttatatatatatatacaataaatatatcgtctaaccgtaattactctaatcgaacacgtctcatacgctataaaaaactaaaaaaatacttt

SEQ ID NO: 12505 - DNA, 567 bp, Artificial Sequence
  chemically treated genomic DNA (Homo sapiens) CpG-island No: 12505
  misc_feature (387)..(387): n is either a, c, g or t
  misc_feature (408)..(408): n is either a, c, g or t
atttttttcgtttttagcgtatattgagtaaattcggcgtgtgtttgatgatatcgcgtagcgtatggataatcgtgttttgggtgttggcgtaaatttgtagtaatatattattatgatataacgtcgtatttagcgagtcgttggggaaacgcgttattttttgtagtttttttggtatttgtggcgtaaggttaaagcgtttattaaataatgagtgatttatcgataacgtgatggtgagattatcgggcgtaatgtagtcgttaagaatgtcggaatcgagtggtggtaggcgcggatttggcgtttttggtgttgtttcgttttgagttagaaaagtaaaacgttgagttaataagcgaaataatcgtttaagatcggttntatcgttggtaagtatattanacgttattagtattattgcggtttgttgtggcgttaggatttttgtttgatgtttattatataacggttgttttttattgcgagtattcggtgaaagcgtattcggcgtattgtgacgtttttgtgtatgagcgatcggatagtttttcggtagggtta

SEQ ID NO: 12506 - DNA, 567 bp, Artificial Sequence
  chemically treated genomic DNA (Homo sapiens) CpG-island No: 12506
  misc_feature (160)..(160): n is either a, c, g or t
  misc_feature (181)..(181): n is either a, c, g or t
taaccctaccgaaaaactatccgatcgctcatacacaaaaacgtcacaatacgccgaatacgctttcaccgaatactcgcaataaaaaacaaccgttatataataaacatcaaacaaaaatcctaacgccacaacaaaccgcaataatactaataacgtntaatatacttaccaacgatanaaccgatcttaaacgattatttcgcttattaactcaacgttttacttttctaactcaaaacgaaacaacaccaaaaacgccaaatccgcgcctaccaccactcgattccgacattcttaacgactacattacgcccgataatctcaccatcacgttatcgataaatcactcattatttaataaacgctttaaccttacgccacaaataccaaaaaaactacaaaaaataacgcgtttccccaacgactcgctaaatacgacgttatatcataataatatattactacaaatttacgccaacacccaaaacacgattatccatacgctacgcgatatcatcaaacacacgccgaatttactcaatatacgctaaaaacgaaaaaaat

SEQ ID NO: 12507 - DNA, 567 bp, Artificial Sequence
  chemically treated genomic DNA (Homo sapiens) CpG-island No: 12507
  misc_feature (160)..(160): n is either a, c, g or t
  misc_feature (181)..(181): n is either a, c, g or t
tggttttgtcgggaaattgttcggtcgtttatgtataaaaacgttatagtgcgtcgggtacgtttttatcggatgttcgtaatgagaaatagtcgttgtatggtgagtattaggtagggattttgacgttataataggtcgtaatgatgttggtggcgtntgatgtgtttgttagcgatanagtcgattttgagcggttgtttcgtttgttgatttagcgttttgtttttttgatttagggcggagtagtattagaaacgttaaattcgcgtttgttattattcgatttcggtatttttggcggttatattgcgttcgataattttattattacgttatcggtgggttatttattgtttgatgagcgttttggttttgcgttatagatgttaaaaaagttgtagaagatgacgcgtttttttaacgattcgttggatgcggcgttatgttatggtgatgtgttgttatagatttgcgttaatatttaggatacggttatttatgcgttgcgcgatattattaaatatacgtcggatttgtttagtgtgcgttggaagcgggaagggt

SEQ ID NO: 12508 - DNA, 567 bp, Artificial Sequence
  chemically treated genomic DNA (Homo sapiens) CpG-island No: 12508
  misc_feature (387)..(387): n is either a, c, g or t
  misc_feature (408)..(408): n is either a, c, g or t
acccttcccgcttccaacgcacactaaacaaatccgacgtatatttaataatatcgcgcaacgcataaataaccgtatcctaaatattaacgcaaatctataacaacacatcaccataacataacgccgcatccaacgaatcgttaaaaaaacgcgtcatcttctacaacttttttaacatctataacgcaaaaccaaaacgctcatcaaacaataaataacccaccgataacgtaataataaaattatcgaacgcaatataaccgccaaaaataccgaaatcgaataataacaaacgcgaatttaacgtttctaatactactccgccctaaatcaaaaaaacaaaacgctaaatcaacaaacgaaacaaccgctcaaaatcgactntatcgctaacaaacacatcanacgccaccaacatcattacgacctattataacgtcaaaatccctacctaatactcaccatacaacgactatttctcattacgaacatccgataaaaacgtacccgacgcactataacgtttttatacataaacgaccgaacaatttcccgacaaaacca

SEQ ID NO: 12509 - DNA, 679 bp, Artificial Sequence
  chemically treated genomic DNA (Homo sapiens) CpG-island No: 12509
agttcgttagagattttgatttttttcgggagtataatatagattcgaattggttaattcgggttgacgtcggtttagttgatttttattttggtaagaggttttcggagtgttttagcgttttttaggtttgttgcggtcgttttagtttacgggtcgcgcggaggatttaagataaaaggacgtagggtgtcgatttgatcgatttcggtatcgcgagagcgcgacgaggtttttggagttcgcggtttcgttaagggttttatcgcgtttcgattttcgggtttcgcgtttatttttcgggtttgcgttcggcgtcgcggtgttttgtttttcggcgtaattcggtttattagcgtttgcgtcggttttgcgttttcgttttaggttttatcgcgcgggggacggcgggttgcggggagggacgcggtcggttgggtacgggaggttcgggatcgttttataatttcgtttttttatatttcggttcgtataattttacgtacgggtacggttttttgttcgggtagttcggtttatttggttcggcgcgtcgagtacggcggtgcgggcgtaggtatggtagtacgggtacgcggagcgtagggcgaggcgaggcggcggggattttatagagtcgacgtgcgggtttgtagcgcgtgcgagtttattttgtttt

SEQ ID NO: 12510 - DNA, 679 bp, Artificial Sequence
  chemically treated genomic DNA (Homo sapiens) CpG-island No: 12510
aaaacaaaataaactcgcacgcgctacaaacccgcacgtcgactctataaaatccccgccgcctcgcctcgccctacgctccgcgtacccgtactaccatacctacgcccgcaccgccgtactcgacgcgccgaaccaaataaaccgaactacccgaacaaaaaaccgtacccgtacgtaaaattatacgaaccgaaatataaaaaaacgaaattataaaacgatcccgaacctcccgtacccaaccgaccgcgtccctccccgcaacccgccgtcccccgcgcgataaaacctaaaacgaaaacgcaaaaccgacgcaaacgctaataaaccgaattacgccgaaaaacaaaacaccgcgacgccgaacgcaaacccgaaaaataaacgcgaaacccgaaaatcgaaacgcgataaaacccttaacgaaaccgcgaactccaaaaacctcgtcgcgctctcgcgataccgaaatcgatcaaatcgacaccctacgtccttttatcttaaatcctccgcgcgacccgtaaactaaaacgaccgcaacaaacctaaaaaacgctaaaacactccgaaaacctcttaccaaaataaaaatcaactaaaccgacgtcaacccgaattaaccaattcgaatctatattatactcccgaaaaaaatcaaaatctctaacgaact

SEQ ID NO: 12511 - DNA, 679 bp, Artificial Sequence
  chemically treated genomic DNA (Homo sapiens) CpG-island No: 12511
aaaatagagtaagttcgtacgcgttgtaggttcgtacgtcgattttataggattttcgtcgtttcgtttcgttttgcgtttcgcgtgttcgtgttgttatgtttgcgttcgtatcgtcgtgttcggcgcgtcgggttaggtgggtcgggttgttcgggtagggagtcgtgttcgtgcgtggggttgtgcgggtcggggtgtgggagggcgaggttgtaaggcggtttcgaatttttcgtgtttagtcgatcgcgttttttttcgtagttcgtcgtttttcgcgcgatggagtttgggacggaagcgtagagtcgacgtaggcgttggtaggtcgaattacgtcgaggagtagagtatcgcggcgtcgagcgtagattcgagaggtgggcgcgggattcgggggtcggggcgcggtggggtttttgacgaggtcgcgggttttagggatttcgtcgcgttttcgcggtgtcgggatcggttaggtcggtattttgcgtttttttattttgggtttttcgcgcggttcgtggattggggcggtcgtagtaggtttgggaggcgttggaatatttcggaagttttttgttaggatgggagttagttgaatcggcgttagttcgagttagttagttcgagtttgtgttgtgttttcgggagaggttagggtttttgacgagtt

SEQ ID NO: 12512 - DNA, 679 bp, Artificial Sequence
  chemically treated genomic DNA (Homo sapiens) CpG-island No: 12512
aactcgtcaaaaaccctaacctctcccgaaaacacaacacaaactcgaactaactaactcgaactaacgccgattcaactaactcccatcctaacaaaaaacttccgaaatattccaacgcctcccaaacctactacgaccgccccaatccacgaaccgcgcgaaaaacccaaaataaaaaaacgcaaaataccgacctaaccgatcccgacaccgcgaaaacgcgacgaaatccctaaaacccgcgacctcgtcaaaaaccccaccgcgccccgacccccgaatcccgcgcccacctctcgaatctacgctcgacgccgcgatactctactcctcgacgtaattcgacctaccaacgcctacgtcgactctacgcttccgtcccaaactccatcgcgcgaaaaacgacgaactacgaaaaaaaacgcgatcgactaaacacgaaaaattcgaaaccgccttacaacctcgccctcccacaccccgacccgcacaaccccacgcacgaacacgactccctacccgaacaacccgacccacctaacccgacgcgccgaacacgacgatacgaacgcaaacataacaacacgaacacgcgaaacgcaaaacgaaacgaaacgacgaaaatcctataaaatcgacgtacgaacctacaacgcgtacgaacttactctatttt

SEQ ID NO: 12513 - DNA, 736 bp, Artificial Sequence
  chemically treated genomic DNA (Homo sapiens) CpG-island No: 12513
gcgcgggtagagagcgtagagtagagtagggtagggttgaggtagaaattcgcgttttcggtcggcgtttacgagttttgcgcgtttcgtttttaatcgtttttatgtgggcgtcgggttcgtttcggtttttcgcgcgcgtcgggtcgggcgagattatcgggttacgtcgtagggtttatttagttgtgcgcgtttcggagtcgattggggttagggcgaggtttcgggatcgcgggtagtcgcgaagttcgattgttcggttttcggttcgggagttagatggacgtcgtgggttgaggagaggtttgaggaaaaggttgtttttattcgcgggattgaggcggtcgggcgggggtttttgcgacgttgataggtcgcgttttggcgggcgggggtagttttggcgggagattcggtcgcgcgcgacgcggcgtaggtcgtgggggaagggtaagcggtacgtttttcggtttgggtcgtggcgtattttttattggtttcggtttgggtggagcgcggttttgtttggtttttgtttaggtgggggcgtgttttttttttggcgggaattcggaattcggaattcggaaggcgcggtttgtggcgggtattgattgttttttacggtttcgtggtcgttgtaggtttcgtacgcgtcgtttattgttttgagtcgtttaaagttttggagtaattttttaggtcgtaatagttgataattatattgagtttt

SEQ ID NO: 12514 - DNA, 736 bp, Artificial Sequence
  chemically treated genomic DNA (Homo sapiens) CpG-island No: 12514
aaaactcaatataattatcaactattacgacctaaaaaattactccaaaactttaaacgactcaaaacaataaacgacgcgtacgaaacctacaacgaccacgaaaccgtaaaaaacaatcaatacccgccacaaaccgcgccttccgaattccgaattccgaattcccgccaaaaaaaaaacacgcccccacctaaacaaaaaccaaacaaaaccgcgctccacccaaaccgaaaccaataaaaaatacgccacgacccaaaccgaaaaacgtaccgcttacccttcccccacgacctacgccgcgtcgcgcgcgaccgaatctcccgccaaaactacccccgcccgccaaaacgcgacctatcaacgtcgcaaaaacccccgcccgaccgcctcaatcccgcgaataaaaacaaccttttcctcaaacctctcctcaacccacgacgtccatctaactcccgaaccgaaaaccgaacaatcgaacttcgcgactacccgcgatcccgaaacctcgccctaaccccaatcgactccgaaacgcgcacaactaaataaaccctacgacgtaacccgataatctcgcccgacccgacgcgcgcgaaaaaccgaaacgaacccgacgcccacataaaaacgattaaaaacgaaacgcgcaaaactcgtaaacgccgaccgaaaacgcgaatttctacctcaaccctaccctactctactctacgctctctacccgcgc

SEQ ID NO: 12515 - DNA, 736 bp, Artificial Sequence
  chemically treated genomic DNA (Homo sapiens) CpG-island No: 12515
aagatttagtgtagttgttaattgttgcgatttaaaaggttattttaaaattttaagcggtttaaaataatagacggcgcgtacggggtttgtagcggttacgggatcgtgggaagtagttagtattcgttataggtcgcgtttttcgggtttcgggtttcgggttttcgttagggaggagatacgtttttatttgggtaggaattaagtagagtcgcgttttatttaggtcggaattaatgggagatgcgttacgatttaggtcgagaaacgtgtcgtttattttttttttacgatttgcgtcgcgtcgcgcgcggtcgaatttttcgttaaagttgttttcgttcgttaaggcgcgatttattagcgtcgtagaggttttcgttcggtcgttttaatttcgcgggtgggggtaattttttttttaggtttttttttagtttacggcgtttatttggttttcgagtcgagggtcgggtagtcgggtttcgcggttgttcgcggtttcgaggtttcgttttagttttagtcggtttcgaggcgcgtatagttgagtggattttgcggcgtggttcgatggtttcgttcgattcggcgcgcgcgggaggtcgaggcgggttcggcgtttatataaaggcggttgggggcggggcgcgtagagttcgtgagcgtcggtcggggacgcgggtttttgttttagttttgttttgttttattttgcgttttttgttcgcgt

SEQ ID NO: 12516 - DNA, 736 bp, Artificial Sequence
  chemically treated genomic DNA (Homo sapiens) CpG-island No: 12516
acgcgaacaaaaaacgcaaaataaaacaaaacaaaactaaaacaaaaacccgcgtccccgaccgacgctcacgaactctacgcgccccgcccccaaccgcctttatataaacgccgaacccgcctcgacctcccgcgcgcgccgaatcgaacgaaaccatcgaaccacgccgcaaaatccactcaactatacgcgcctcgaaaccgactaaaactaaaacgaaacctcgaaaccgcgaacaaccgcgaaacccgactacccgaccctcgactcgaaaaccaaataaacgccgtaaactaaaaaaaaacctaaaaaaaaaattacccccacccgcgaaattaaaacgaccgaacgaaaacctctacgacgctaataaatcgcgccttaacgaacgaaaacaactttaacgaaaaattcgaccgcgcgcgacgcgacgcaaatcgtaaaaaaaaaataaacgacacgtttctcgacctaaatcgtaacgcatctcccattaattccgacctaaataaaacgcgactctacttaattcctacccaaataaaaacgtatctcctccctaacgaaaacccgaaacccgaaacccgaaaaacgcgacctataacgaatactaactacttcccacgatcccgtaaccgctacaaaccccgtacgcgccgtctattattttaaaccgcttaaaattttaaaataaccttttaaatcgcaacaattaacaactacactaaatctt

SEQ ID NO: 12517 - DNA, 505 bp, Artificial Sequence
  chemically treated genomic DNA (Homo sapiens) CpG-island No: 12517
ggtgcgtaggagttttcgtttgtttagtttcgttgtcggcgtttttcggtcggcggttatagttttgatgttgttttaataaaataaagtttttttttcgtgcgcggtttttagtggtgaaagggtcgatttatagagttagagttttttttcggcgtttcgttcgttcgttttgcggtggcgttggtttggtcgcgggtaatttatagttttaatttagtatatttgttcgggttagggcggtatgattggggttttttatttcggtttcgggcgcggggcggtttaaggttttatttacggttatcgtaggttttcgttcggttacgttttttatgtaggcgtttggaagtttcgcggtattcggtgggtgaagataagttgtgtcgtttgtgttttggcggcggtcgttttttaatttttatggttcggtttttttttagttcggtcgttcgtttataggtgaggagatcgaggtcgaggtagaggcgttggagtttttttt

SEQ ID NO: 12518 - DNA, 505 bp, Artificial Sequence
  chemically treated genomic DNA (Homo sapiens) CpG-island No: 12518
aaaaaaaactccaacgcctctacctcgacctcgatctcctcacctataaacgaacgaccgaactaaaaaaaaaccgaaccataaaaattaaaaaacgaccgccgccaaaacacaaacgacacaacttatcttcacccaccgaataccgcgaaacttccaaacgcctacataaaaaacgtaaccgaacgaaaacctacgataaccgtaaataaaaccttaaaccgccccgcgcccgaaaccgaaataaaaaaccccaatcataccgccctaacccgaacaaatatactaaattaaaactataaattacccgcgaccaaaccaacgccaccgcaaaacgaacgaacgaaacgccgaaaaaaaactctaactctataaatcgaccctttcaccactaaaaaccgcgcacgaaaaaaaaactttattttattaaaacaacatcaaaactataaccgccgaccgaaaaacgccgacaacgaaactaaacaaacgaaaactcctacgcacc

SEQ ID NO: 12519 - DNA, 505 bp, Artificial Sequence
  chemically treated genomic DNA (Homo sapiens) CpG-island No: 12519
gagagaaattttagcgtttttgtttcggtttcggtttttttatttgtggacgggcggtcgggttggggaggggtcgggttatgggggttggagagcggtcgtcgttaaggtataaacgatatagtttgtttttatttatcgggtgtcgcggggtttttaaacgtttgtatgaggaacgtggtcgggcgggagtttgcggtggtcgtgaatggagttttgagtcgtttcgcgttcggggtcgggataaagggttttagttatgtcgttttggttcgggtaagtgtgttaagttgaggttataaattattcgcggttaggttagcgttatcgtagggcgggcgggcggggcgtcgggagggggttttggttttgtaaatcggtttttttattattggaggtcgcgtacgaaagaaaaattttgttttattaaagtaatattagggttgtggtcgtcggtcgagaggcgtcggtagcgaggttgggtaggcgagggtttttgcgtatt

SEQ ID NO: 12520 - DNA, 505 bp, Artificial Sequence
  chemically treated genomic DNA (Homo sapiens) CpG-island No: 12520
aatacgcaaaaaccctcgcctacccaacctcgctaccgacgcctctcgaccgacgaccacaaccctaatattactttaataaaacaaaatttttctttcgtacgcgacctccaataataaaaaaaccgatttacaaaaccaaaaccccctcccgacgccccgcccgcccgccctacgataacgctaacctaaccgcgaataatttataacctcaacttaacacacttacccgaaccaaaacgacataactaaaaccctttatcccgaccccgaacgcgaaacgactcaaaactccattcacgaccaccgcaaactcccgcccgaccacgttcctcatacaaacgtttaaaaaccccgcgacacccgataaataaaaacaaactatatcgtttataccttaacgacgaccgctctccaacccccataacccgacccctccccaacccgaccgcccgtccacaaataaaaaaaccgaaaccgaaacaaaaacgctaaaatttctctc

SEQ ID NO: 12521 - DNA, 590 bp, Artificial Sequence
  chemically treated genomic DNA (Homo sapiens) CpG-island No: 12521
ggttatagacgtagattgtatggcggttcggcggttcgcggggaggtgtgagcgacgcgggcgcgcgggtcggggagggcgtttgagggtcgaggtagatggcgttcgtttcgttcggttttcgcgttttttttttcgtcggcggttgtagtttttcggaataatgttattttttttatgaatgaaagtggttcggcgtttgaatgtgcgtgttatttagcggcgtgataggggtcgtcgggaggttagcgcgcgtttttagcgtttgttcgggcggtttcgtttttaggggtgtcggaggggcggtcgcggggggagtttggttttcgtatttttatttagataaagatattattttttacggttcgggaatgttagttagtttcggggaagggcggcggttaggttgcggagttttttttggattttttgcgggcgcgcggggttttttttagtcgtttttggaacgtttcgtttatttttttttcggggcgttttcgttcgtattggagttggtgaaataggtagtgagttgatcggttaataaatttaattcggttttttaataagatgggtcgggtagtaaaaat

SEQ ID NO: 12522 - DNA, 590 bp, Artificial Sequence
  chemically treated genomic DNA (Homo sapiens) CpG-island No: 12522
atttttactacccgacccatcttattaaaaaaccgaattaaatttattaaccgatcaactcactacctatttcaccaactccaatacgaacgaaaacgccccgaaaaaaaaataaacgaaacgttccaaaaacgactaaaaaaaaccccgcgcgcccgcaaaaaatccaaaaaaaactccgcaacctaaccgccgcccttccccgaaactaactaacattcccgaaccgtaaaaaataatatctttatctaaataaaaatacgaaaaccaaactccccccgcgaccgcccctccgacacccctaaaaacgaaaccgcccgaacaaacgctaaaaacgcgcgctaacctcccgacgacccctatcacgccgctaaataacacgcacattcaaacgccgaaccactttcattcataaaaaaaataacattattccgaaaaactacaaccgccgacgaaaaaaaaaacgcgaaaaccgaacgaaacgaacgccatctacctcgaccctcaaacgccctccccgacccgcgcgcccgcgtcgctcacacctccccgcgaaccgccgaaccgccatacaatctacgtctataacc

SEQ ID NO: 12523 - DNA, 590 bp, Artificial Sequence
  chemically treated genomic DNA (Homo sapiens) CpG-island No: 12523
atttttattgttcggtttattttgttaaggaatcggattaagtttattgatcgattaatttattatttgttttattagttttagtgcgggcgggggcgtttcgggggaggggtgggcggggcgttttaggagcgattgggggaggtttcgcgcgttcgtagggggtttaggagaggtttcgtagtttggtcgtcgttttttttcggggttggttgatattttcgggtcgtagggagtaatatttttatttgaatgagaatgcgaaagttaagtttttttcgcggtcgttttttcggtatttttggaagcggggtcgttcgagtagacgttaaaagcgcgcgttgatttttcgacggtttttgttacgtcgttgaatgatacgtatatttaagcgtcgggttatttttatttataaaaaaaatgatattgtttcgggaggttgtagtcgtcgacggagaaaggggcgcgggggtcgggcggggcggacgttatttgtttcggtttttaggcgtttttttcggttcgcgcgttcgcgtcgtttatattttttcgcgagtcgtcgagtcgttatataatttgcgtttgtgatt

SEQ ID NO: 12524 - DNA, 590 bp, Artificial Sequence
  chemically treated genomic DNA (Homo sapiens) CpG-island No: 12524
aatcacaaacgcaaattatataacgactcgacgactcgcgaaaaaatataaacgacgcgaacgcgcgaaccgaaaaaaacgcctaaaaaccgaaacaaataacgtccgccccgcccgacccccgcgcccctttctccgtcgacgactacaacctcccgaaacaatatcattttttttataaataaaaataacccgacgcttaaatatacgtatcattcaacgacgtaacaaaaaccgtcgaaaaatcaacgcgcgcttttaacgtctactcgaacgaccccgcttccaaaaataccgaaaaaacgaccgcgaaaaaaacttaactttcgcattctcattcaaataaaaatattactccctacgacccgaaaatatcaaccaaccccgaaaaaaaacgacgaccaaactacgaaacctctcctaaaccccctacgaacgcgcgaaacctcccccaatcgctcctaaaacgccccgcccacccctcccccgaaacgcccccgcccgcactaaaactaataaaacaaataataaattaatcgatcaataaacttaatccgattccttaacaaaataaaccgaacaataaaaat

SEQ ID NO: 12525 - DNA, 916 bp, Artificial Sequence
  chemically treated genomic DNA (Homo sapiens) CpG-island No: 12525
cgttttatcgttttatggcgtttttaattgtattttgtcgatttcgtattcggtttttttggtgtttttgttttttggtacgtattattttattttttttgtcgtgtatttttttgaatttatagttttttttgcgttttatcgtatgggtttagtttttgtaattttgcgttcgatgtcgtgggttagcgttcggtaatttttattttcgtttagtagtttgtcggtcgcgttcgtaagtttcgttatcggggttttacggttcgtcggtgtattttttgtttcgcgacgtacgtttatatttgttcgtttttttcgtattttcgacgtttattttttattttttattttgtcgtagaaatagttcgtttttgttcgatatttatggttttttgcggtgtggtcgtattcgttgtttttattggcgattatatacgttgtttgacgtatcgtatgcggtatgatttttacgtacgggaatatcgtcgtttttatttattattattggcggttcgtttggtatagtggtgacggagtagcgtcgtcgttattcgtacgtagaggttaggtgtagcgtttgttaatttttagtgtggcgattatatatagtacgtttttgttttgcgtttttttattacgttcggttattgttttacgtatttgtgtttgcgtcgacgttttggttatcggttcgggttatcgaatgacgcggcggttatgatttacggtttattggtttgcggtttgggagtatgtgattgttgcgtcgttaataggataatatttattcgtaagtcgtgttattttttcgttcgtacgttcgagtatcggaattttttagtttttttggtagcgttttaatagtattatttattatttattggcgtttgtcgcgtaaggttgtagtaatcgtgtg

SEQ ID NO: 12526 - DNA, 916 bp, Artificial Sequence
  chemically treated genomic DNA (Homo sapiens) CpG-island No: 12526
cacacgattactacaaccttacgcgacaaacgccaataaataataaataatactattaaaacgctaccaaaaaaactaaaaaattccgatactcgaacgtacgaacgaaaaaataacacgacttacgaataaatattatcctattaacgacgcaacaatcacatactcccaaaccgcaaaccaataaaccgtaaatcataaccgccgcgtcattcgataacccgaaccgataaccaaaacgtcgacgcaaacacaaatacgtaaaacaataaccgaacgtaataaaaaaacgcaaaacaaaaacgtactatatataatcgccacactaaaaattaacaaacgctacacctaacctctacgtacgaataacgacgacgctactccgtcaccactataccaaacgaaccgccaataataataaataaaaacgacgatattcccgtacgtaaaaatcataccgcatacgatacgtcaaacaacgtatataatcgccaataaaaacaacgaatacgaccacaccgcaaaaaaccataaatatcgaacaaaaacgaactatttctacgacaaaataaaaaataaaaaataaacgtcgaaaatacgaaaaaaacgaacaaatataaacgtacgtcgcgaaacaaaaaatacaccgacgaaccgtaaaaccccgataacgaaacttacgaacgcgaccgacaaactactaaacgaaaataaaaattaccgaacgctaacccacgacatcgaacgcaaaattacaaaaactaaacccatacgataaaacgcaaaaaaaactataaattcaaaaaaatacacgacaaaaaaaataaaataatacgtaccaaaaaacaaaaacaccaaaaaaaccgaatacgaaatcgacaaaatacaattaaaaacgccataaaacgataaaacg

SEQ ID NO: 12527 - DNA, 916 bp, Artificial Sequence
  chemically treated genomic DNA (Homo sapiens) CpG-island No: 12527
tatacgattgttataattttgcgcgataagcgttagtagatgatgagtagtattattaggacgttattagaagagttaggagatttcgatattcgggcgtgcgagcgaggaagtagtacggtttacgaatggatgttgttttattagcggcgtagtaattatatgtttttagatcgtaggttagtgagtcgtggattatgatcgtcgcgttattcggtggttcgagtcgatagttagagcgtcggcgtaggtataggtacgtagaatagtgatcgggcgtgatgaaggagcgtagaataagggcgtgttgtgtgtagtcgttatattaagagttagtaagcgttgtatttgatttttgcgtacgggtggcgacggcgttgtttcgttattattgtgttagacgaatcgttagtgatgataggtaggggcggcggtgttttcgtgcgtaggaattatatcgtatacggtgcgttaggtagcgtatgtagtcgttagtaagaatagcggatgcgattatatcgtaggaagttatagatatcgagtagaagcgagttgtttttacggtaggatgagagataaaaggtaagcgtcgggggtacgaagggagcgaatagatgtgagcgtgcgtcgcggggtaggaaatgtatcggcgggtcgtggggtttcggtggcgaggtttgcgggcgcggtcggtagattattaagcgggaatggggattgtcgaacgttggtttacggtatcgggcgtaaagttgtaaggattaggtttatgcgatgaagcgtagggagggttataaatttaagggaatgtacggtaagagaggtgagataatacgtgttagaaagtaaggatattagaaaggtcggatacggggtcggtaagatgtaattgagagcgttatggggcgatggagcg

SEQ ID NO: 12528 - DNA, 916 bp, Artificial Sequence
  chemically treated genomic DNA (Homo sapiens) CpG-island No: 12528
cgctccatcgccccataacgctctcaattacatcttaccgaccccgtatccgacctttctaatatccttactttctaacacgtattatctcacctctcttaccgtacattcccttaaatttataaccctccctacgcttcatcgcataaacctaatccttacaactttacgcccgataccgtaaaccaacgttcgacaatccccattcccgcttaataatctaccgaccgcgcccgcaaacctcgccaccgaaaccccacgacccgccgatacatttcctaccccgcgacgcacgctcacatctattcgctcccttcgtacccccgacgcttaccttttatctctcatcctaccgtaaaaacaactcgcttctactcgatatctataacttcctacgatataatcgcatccgctattcttactaacgactacatacgctacctaacgcaccgtatacgatataattcctacgcacgaaaacaccgccgcccctacctatcatcactaacgattcgtctaacacaataataacgaaacaacgccgtcgccacccgtacgcaaaaatcaaatacaacgcttactaactcttaatataacgactacacacaacacgcccttattctacgctccttcatcacgcccgatcactattctacgtacctatacctacgccgacgctctaactatcgactcgaaccaccgaataacgcgacgatcataatccacgactcactaacctacgatctaaaaacatataattactacgccgctaataaaacaacatccattcgtaaaccgtactacttcctcgctcgcacgcccgaatatcgaaatctcctaactcttctaataacgtcctaataatactactcatcatctactaacgcttatcgcgcaaaattataacaatcgtata

SEQ ID NO: 12529 - DNA, 549 bp, Artificial Sequence
  chemically treated genomic DNA (Homo sapiens) CpG-island No: 12529
ttttcgaacgatcgtcgggtcgtattttattgattgatcgtagcgttacggattttatttgttatacgtcgatattcgttattgtattattttagcggcgtgaattggcgtaagttttcgtttaatacgttttgcgtgatatcggttttgtttaattttattaggatacgttttatattataacgttatttttattcgtttttttttatggtatatcgtcgtacgatttttatagtcgttcgttcgtttatttttcgggtgttcgtatttttaatatttaggtatataattcgttatcggcgattagagtagtatattttcgttatgtattcggttttcgcgcgcgtagcgggtatatacgtattcgttgaagtttttgatttttttttatataagtgcgttcgtatcgggtttttttattatttaatatttgcgagagttcgcggattacgttcgtatattttaattgtttattttgagttacgtatttattataaattattattgtattttttttagtcgttttttattttagtggtatttaatatt

SEQ ID NO: 12530 - DNA, 549 bp, Artificial Sequence
  chemically treated genomic DNA (Homo sapiens) CpG-island No: 12530
aatattaaataccactaaaataaaaaacgactaaaaaaaatacaataataatttataataaatacgtaactcaaaataaacaattaaaatatacgaacgtaatccgcgaactctcgcaaatattaaataataaaaaaacccgatacgaacgcacttatataaaaaaaaatcaaaaacttcaacgaatacgtatatacccgctacgcgcgcgaaaaccgaatacataacgaaaatatactactctaatcgccgataacgaattatatacctaaatattaaaaatacgaacacccgaaaaataaacgaacgaacgactataaaaatcgtacgacgatataccataaaaaaaaacgaataaaaataacgttataatataaaacgtatcctaataaaattaaacaaaaccgatatcacgcaaaacgtattaaacgaaaacttacgccaattcacgccgctaaaataatacaataacgaatatcgacgtataacaaataaaatccgtaacgctacgatcaatcaataaaatacgacccgacgatcgttcgaaaa

SEQ ID NO: 12531 - DNA, 549 bp, Artificial Sequence
  chemically treated genomic DNA (Homo sapiens) CpG-island No: 12531
ggtgttagatattattggggtagagagcgattgaagggagtgtagtggtgatttatagtgaatacgtagtttaaagtgggtagttggggtgtgcgagcgtgattcgcgggttttcgtagatgttagatagtagaaaggttcgatgcggacgtatttatgtaggagggaattagaagttttagcgggtgcgtatatgttcgttacgcgcgcgaaagtcggatatatggcggagatatattgttttggtcgtcggtgacgagttgtgtgtttaggtgttgagagtacggatattcggagaataggcgggcgaacggttatgggggtcgtgcggcgatatgttatggagaggagcgagtgaggatgacgttgtggtgtgggacgtattttaatgagattgagtagagtcgatattacgtaggacgtgttgagcgagaatttgcgttagtttacgtcgttgaggtaatgtaatagcggatatcgacgtgtagtagatggggttcgtgacgttgcgattaattagtggggtgcggttcggcgatcgttcgaaga

SEQ ID NO: 12532 - DNA, 549 bp, Artificial Sequence
  chemically treated genomic DNA (Homo sapiens) CpG-island No: 12532
tcttcgaacgatcgccgaaccgcaccccactaattaatcgcaacgtcacgaaccccatctactacacgtcgatatccgctattacattacctcaacgacgtaaactaacgcaaattctcgctcaacacgtcctacgtaatatcgactctactcaatctcattaaaatacgtcccacaccacaacgtcatcctcactcgctcctctccataacatatcgccgcacgacccccataaccgttcgcccgcctattctccgaatatccgtactctcaacacctaaacacacaactcgtcaccgacgaccaaaacaatatatctccgccatatatccgactttcgcgcgcgtaacgaacatatacgcacccgctaaaacttctaattccctcctacataaatacgtccgcatcgaacctttctactatctaacatctacgaaaacccgcgaatcacgctcgcacaccccaactacccactttaaactacgtattcactataaatcaccactacactcccttcaatcgctctctaccccaataatatctaacacc

SEQ ID NO: 12533 - DNA, 583 bp, Artificial Sequence
  chemically treated genomic DNA (Homo sapiens) CpG-island No: 12533
  misc_feature (509)..(509): n is either a, c, g or t
gggagtagtggaataggtagttggggcgaatgttttggacgggtgtacgagaggagtttagattcgcggggtcgaggggagacggagggagaaggaggaagttaagatgagggtgggaggatttgtcgagacggtggagagacgcgggaaaagggggtgagagtgaggtgtgtagggtgcgagattggaggagtaagtaacgcgcgggtcgaggcggagaggtaggaacgaggtatcgaggtggagggtagcggcggatcggcgtagataggcggcgtcgtagcgagatgaggtagacggcgacgcgtggtggtacggtgttttgtattgcggtggattggcgtatgtgttgtacggatcgaagcgatgtggcgtgatgtcgtgttacggcgttcgagtacgagcgagcgcgttgagcgtcgtgagtggtgtaaggtgtgtaggttgattcgatattgtgtgcgacggcgtgtgagcgagagtagcgcgcgcgagagcgcgacgggatnggtgtgagcgtatgagacgaggtgtgcgtgggtgcgtgggtcgtgtgttattgttatgtgtttttgataaatga

SEQ ID NO: 12534 - DNA, 583 bp, Artificial Sequence
  chemically treated genomic DNA (Homo sapiens) CpG-island No: 12534
  misc_feature (75)..(75): n is either a, c, g or t
tcatttatcaaaaacacataacaataacacacgacccacgcacccacgcacacctcgtctcatacgctcacaccnatcccgtcgcgctctcgcgcgcgctactctcgctcacacgccgtcgcacacaatatcgaatcaacctacacaccttacaccactcacgacgctcaacgcgctcgctcgtactcgaacgccgtaacacgacatcacgccacatcgcttcgatccgtacaacacatacgccaatccaccgcaatacaaaacaccgtaccaccacgcgtcgccgtctacctcatctcgctacgacgccgcctatctacgccgatccgccgctaccctccacctcgatacctcgttcctacctctccgcctcgacccgcgcgttacttactcctccaatctcgcaccctacacacctcactctcacccccttttcccgcgtctctccaccgtctcgacaaatcctcccaccctcatcttaacttcctccttctccctccgtctcccctcgaccccgcgaatctaaactcctctcgtacacccgtccaaaacattcgccccaactacctattccactactccc

SEQ ID NO: 12535 - DNA, 583 bp, Artificial Sequence
  chemically treated genomic DNA (Homo sapiens) CpG-island No: 12535
  misc_feature (75)..(75): n is either a, c, g or t
ttatttattaggaatatataataatggtatacgatttacgtatttacgtatatttcgttttatgcgtttatattngtttcgtcgcgttttcgcgcgcgttgttttcgtttatacgtcgtcgtatatagtatcgggttagtttatatattttatattatttacggcgtttagcgcgttcgttcgtattcgagcgtcgtggtacggtattacgttatatcgtttcgattcgtgtagtatatacgttagtttatcgtagtgtaagatatcgtgttattacgcgtcgtcgtttgttttatttcgttacggcgtcgtttgtttgcgtcggttcgtcgttgttttttatttcggtgtttcgtttttgttttttcgtttcgattcgcgcgttatttgtttttttaatttcgtattttgtatattttatttttatttttttttttcgcgtttttttatcgtttcgatagatttttttatttttattttggtttttttttttttttttcgttttttttcgatttcgcgagtttgaatttttttcgtgtattcgtttagggtattcgttttagttgtttattttattgttttt

SEQ ID NO: 12536 - DNA, 583 bp, Artificial Sequence
  chemically treated genomic DNA (Homo sapiens) CpG-island No: 12536
  misc_feature (509)..(509): n is either a, c, g or t
aaaaacaataaaataaacaactaaaacgaataccctaaacgaatacacgaaaaaaattcaaactcgcgaaatcgaaaaaaaacgaaaaaaaaaaaaaaaaaccaaaataaaaataaaaaaatctatcgaaacgataaaaaaacgcgaaaaaaaaaaataaaaataaaatatacaaaatacgaaattaaaaaaacaaataacgcgcgaatcgaaacgaaaaaacaaaaacgaaacaccgaaataaaaaacaacgacgaaccgacgcaaacaaacgacgccgtaacgaaataaaacaaacgacgacgcgtaataacacgatatcttacactacgataaactaacgtatatactacacgaatcgaaacgatataacgtaataccgtaccacgacgctcgaatacgaacgaacgcgctaaacgccgtaaataatataaaatatataaactaacccgatactatatacgacgacgtataaacgaaaacaacgcgcgcgaaaacgcgacgaaacnaatataaacgcataaaacgaaatatacgtaaatacgtaaatcgtataccattattatatattcctaataaataa

SEQ ID NO: 12537 - DNA, 694 bp, Artificial Sequence
  chemically treated genomic DNA (Homo sapiens) CpG-island No: 12537
  misc_feature (178)..(178): n is either a, c, g or t
  misc_feature (180)..(180): n is either a, c, g or t
  misc_feature (292)..(292): n is either a, c, g or t
  misc_feature (429)..(430): n is either a, c, g or t
gcgttgaacgtcgaggtgtacgcgtaggtattggttaagtgcgcgttagggtgttcgggagggggcgggtgcgggtcgtattgtcgggcggggtgcgcgagtgaggagggcggggtgcgcgagtgaggagggcgggggagtgcgcgagtgaggagggcggggtgcgcgagtgaggagngngcgggggagtgcgcgagtgaggagggcgggggagtgcgcgagtgaggagggcgggggagtgcgcgagtgaggagggaggggtgtattagtgaggaggttgtgggagtgcgtngaggaaggagggtcggggagggggcgagtgacgaaggcgggggagtgttttaatgaggagggcgggggagtgcgcgagtgaggagggttgggtgcgttaatgaggagggcggggtgcgcgagtgaggagggcggggnntgcgcgagtgaggagggcggggtgcgcgagttaggagggcggggtgcgcgagcgagggcgttcggtcggtaggtggtattgtggcgtcgtcgtgggtcgagtttggcgaagcgttgtacgttcgagatcgcgtagtttggtgagtggtagcgtttggttttatattcgcgtttcggatatcgatggttatttttttacgttcgtgatttagtggttttttaatgtaggttgcggttttttagtttagaaggttttgggttttgg

SEQ ID NO: 12538 - DNA, 694 bp, Artificial Sequence
  chemically treated genomic DNA (Homo sapiens) CpG-island No: 12538
  misc_feature (265)..(266): n is either a, c, g or t
  misc_feature (403)..(403): n is either a, c, g or t
  misc_feature (515)..(515): n is either a, c, g or t
  misc_feature (517)..(517): n is either a, c, g or t
ccaaaacccaaaaccttctaaactaaaaaaccgcaacctacattaaaaaaccactaaatcacgaacgtaaaaaaataaccatcgatatccgaaacgcgaatataaaaccaaacgctaccactcaccaaactacgcgatctcgaacgtacaacgcttcgccaaactcgacccacgacgacgccacaataccacctaccgaccgaacgccctcgctcgcgcaccccgccctcctaactcgcgcaccccgccctcctcactcgcgcannccccgccctcctcactcgcgcaccccgccctcctcattaacgcacccaaccctcctcactcgcgcactcccccgccctcctcattaaaacactcccccgccttcgtcactcgccccctccccgaccctccttcctcnacgcactcccacaacctcctcactaatacacccctccctcctcactcgcgcactcccccgccctcctcactcgcgcactcccccgccctcctcactcgcgcactcccccgcncnctcctcactcgcgcaccccgccctcctcactcgcgcactcccccgccctcctcactcgcgcaccccgccctcctcactcgcgcaccccgcccgacaatacgacccgcacccgccccctcccgaacaccctaacgcgcacttaaccaatacctacgcgtacacctcgacgttcaacgc

SEQ ID NO: 12539 - DNA, 694 bp, Artificial Sequence
  chemically treated genomic DNA (Homo sapiens) CpG-island No: 12539
  misc_feature (265)..(266): n is either a, c, g or t
  misc_feature (403)..(403): n is either a, c, g or t
  misc_feature (515)..(515): n is either a, c, g or t
  misc_feature (517)..(517): n is either a, c, g or t
ttagaatttagggttttttgggttgagaggtcgtagtttgtattggaaggttattgagttacggacgtgggaagatgattatcggtgttcgagacgcgagtataaagttaggcgttgttatttattaagttgcgcgatttcgggcgtgtagcgtttcgttaggttcggtttacggcgacgttatagtgttatttgtcggtcggacgttttcgttcgcgtatttcgtttttttgattcgcgtatttcgttttttttattcgcgtanntttcgttttttttattcgcgtatttcgttttttttattggcgtatttagttttttttattcgcgtattttttcgttttttttattggagtattttttcgttttcgttattcgtttttttttcggttttttttttttngcgtatttttatagtttttttattagtgtatttttttttttttattcgcgtattttttcgttttttttattcgcgtattttttcgttttttttattcgcgtattttttcgtntnttttttattcgcgtatttcgttttttttattcgcgtattttttcgttttttttattcgcgtatttcgttttttttattcgcgtatttcgttcggtagtgcggttcgtattcgttttttttcgagtattttggcgcgtatttagttagtatttgcgcgtgtatttcggcgtttaacgt

SEQ ID NO: 12540 - DNA, 694 bp, Artificial Sequence
  chemically treated genomic DNA (Homo sapiens) CpG-island No: 12540
  misc_feature (178)..(178): n is either a, c, g or t
  misc_feature (180)..(180): n is either a, c, g or t
  misc_feature (292)..(292): n is either a, c, g or t
  misc_feature (429)..(430): n is either a, c, g or t
acgttaaacgccgaaatacacgcgcaaatactaactaaatacgcgccaaaatactcgaaaaaaaacgaatacgaaccgcactaccgaacgaaatacgcgaataaaaaaaacgaaatacgcgaataaaaaaaacgaaaaaatacgcgaataaaaaaaacgaaatacgcgaataaaaaananacgaaaaaatacgcgaataaaaaaaacgaaaaaatacgcgaataaaaaaaacgaaaaaatacgcgaataaaaaaaaaaaaatacactaataaaaaaactataaaaatacgcnaaaaaaaaaaaaccgaaaaaaaaacgaataacgaaaacgaaaaaatactccaataaaaaaaacgaaaaaatacgcgaataaaaaaaactaaatacgccaataaaaaaaacgaaatacgcgaataaaaaaaacgaaanntacgcgaataaaaaaaacgaaatacgcgaatcaaaaaaacgaaatacgcgaacgaaaacgtccgaccgacaaataacactataacgtcgccgtaaaccgaacctaacgaaacgctacacgcccgaaatcgcgcaacttaataaataacaacgcctaactttatactcgcgtctcgaacaccgataatcatcttcccacgtccgtaactcaataaccttccaatacaaactacgacctctcaacccaaaaaaccctaaattctaa

SEQ ID NO: 12541 - DNA, 628 bp, Artificial Sequence
  chemically treated genomic DNA (Homo sapiens) CpG-island No: 12541
gtttcggcgtttttttttttttaggattgtgcgttttttttaatgggcggggtcggaattggtcgagggttttcggttttgtgcgtgtcgggggcggagtttgaagaaggtttttatagtatggtcgtcggtattgtagttgttttagcgtttttgagttaggagagtcgaacgcgggtcgggggtgtcgggggtttacgggtttcggtttcggttattatggatagtttttttttcggtattagtgaagggagaggttgagggtggtattggggcggtaagaggtagggatgtgaggcgggaatgcggagggttttaaggcgtgggtgtgggcggagggttgtttcgttgttttcgtagacgagggggtttcgtacgtatagttaaagggggtggcgagatttttgttttagatgtgttgggcggggtacggtagagcgttttaggtgttttgagagaagagacggaggtggacgtgtaaatgattcgttcgtttaaggttatacgtgacggcgggttggtgatatttttcgttgtttagtttcgtatatacgtttaggtatatttattgttatttttattaggttgtgagtttttcggttatattcgtttttttatttttaaggta

SEQ ID NO: 12542 - DNA, 628 bp, Artificial Sequence
  chemically treated genomic DNA (Homo sapiens) CpG-island No: 12542
taccttaaaaataaaaaaacgaatataaccgaaaaactcacaacctaataaaaataacaataaatatacctaaacgtatatacgaaactaaacaacgaaaaatatcaccaacccgccgtcacgtataaccttaaacgaacgaatcatttacacgtccacctccgtctcttctctcaaaacacctaaaacgctctaccgtaccccgcccaacacatctaaaacaaaaatctcgccaccccctttaactatacgtacgaaaccccctcgtctacgaaaacaacgaaacaaccctccgcccacacccacgccttaaaaccctccgcattcccgcctcacatccctacctcttaccgccccaataccaccctcaacctctcccttcactaataccgaaaaaaaaactatccataataaccgaaaccgaaacccgtaaacccccgacacccccgacccgcgttcgactctcctaactcaaaaacgctaaaacaactacaataccgacgaccatactataaaaaccttcttcaaactccgcccccgacacgcacaaaaccgaaaaccctcgaccaattccgaccccgcccattaaaaaaaacgcacaatcctaaaaaaaaaaaaacgccgaaac

SEQ ID NO: 12543 - DNA, 628 bp, Artificial Sequence
  chemically treated genomic DNA (Homo sapiens) CpG-island No: 12543
tattttaaaggtgaaggagcgggtgtggtcggagagtttatagtttggtagaaataatagtgagtatgtttgagcgtgtgtacggggttgggtagcgggggatgttattaattcgtcgttacgtgtaattttgggcggacgggttatttatacgtttattttcgtttttttttttagaatatttgggacgttttgtcgtgtttcgtttaatatatttggggtagggatttcgttattttttttggttgtgcgtgcgaggttttttcgtttgcgggaatagcgaagtagtttttcgtttatatttacgttttgaaatttttcgtattttcgttttatatttttattttttatcgttttagtattatttttagtttttttttttattaatatcgaagaaaaaattgtttatagtgatcggggtcgggattcgtaggttttcgatattttcggttcgcgttcggtttttttgatttaaaaacgttaaggtagttgtagtatcggcggttatgttgtaagagttttttttaaatttcgttttcgatacgtataaagtcggggattttcggttagtttcggtttcgtttattaaaggagacgtatagttttggaaaagaaaaggcgtcgagat

SEQ ID NO: 12544 - DNA, 628 bp, Artificial Sequence
  chemically treated genomic DNA (Homo sapiens) CpG-island No: 12544
atctcgacgccttttcttttccaaaactatacgtctcctttaataaacgaaaccgaaactaaccgaaaatccccgactttatacgtatcgaaaacgaaatttaaaaaaaactcttacaacataaccgccgatactacaactaccttaacgtttttaaatcaaaaaaaccgaacgcgaaccgaaaatatcgaaaacctacgaatcccgaccccgatcactataaacaattttttcttcgatattaataaaaaaaaaaactaaaaataatactaaaacgataaaaaataaaaatataaaacgaaaatacgaaaaatttcaaaacgtaaatataaacgaaaaactacttcgctattcccgcaaacgaaaaaacctcgcacgcacaaccaaaaaaaataacgaaatccctaccccaaatatattaaacgaaacacgacaaaacgtcccaaatattctaaaaaaaaaaacgaaaataaacgtataaataacccgtccgcccaaaattacacgtaacgacgaattaataacatcccccgctacccaaccccgtacacacgctcaaacatactcactattatttctaccaaactataaactctccgaccacacccgctccttcacctttaaaata

SEQ ID NO: 12545 - DNA, 558 bp, Artificial Sequence
  chemically treated genomic DNA (Homo sapiens) CpG-island No: 12545
agttttttttgcggtgagataaaataaatagaaatagttatgagagtaggatcgagaggggattttgcgatggaagggagagaaggcggggatataggcgcggggagcgcgggggtataaaaaagcggggggagagtagagcggcgaaggcgggagtttagtttagtcggcggagaggtcgataggcgggagcgggagtagtcgtagcgatacggggtcgcggatgagatttaggcgagggcgggatagtaacgtcggataggggacgttggcgacgggcgttagaatagcgggcgacgataggtcggaagattcggggcggtagagatcgagggagggtcgggagacgggagaaaggatttgaggtacgggacgcgacggtagagcgcgcgaaaatagtgcgcgcggacgtcggcgagagggtatgacggatcgaggatggaaagagtaagcgagacgtagacgatataggaggtagaatatacgacggcgtagaaggacgagcggaacgaacgaggatcgtagggtgggacgcgagggagggagtagcgacggcgg

SEQ ID NO: 12546 - DNA, 558 bp, Artificial Sequence
  chemically treated genomic DNA (Homo sapiens) CpG-island No: 12546
ccgccgtcgctactccctccctcgcgtcccaccctacgatcctcgttcgttccgctcgtccttctacgccgtcgtatattctacctcctatatcgtctacgtctcgcttactctttccatcctcgatccgtcataccctctcgccgacgtccgcgcgcactattttcgcgcgctctaccgtcgcgtcccgtacctcaaatcctttctcccgtctcccgaccctccctcgatctctaccgccccgaatcttccgacctatcgtcgcccgctattctaacgcccgtcgccaacgtcccctatccgacgttactatcccgccctcgcctaaatctcatccgcgaccccgtatcgctacgactactcccgctcccgcctatcgacctctccgccgactaaactaaactcccgccttcgccgctctactctccccccgcttttttatacccccgcgctccccgcgcctatatccccgccttctctcccttccatcgcaaaatcccctctcgatcctactctcataactatttctatttattttatctcaccgcaaaaaaaact

SEQ ID NO: 12547 - DNA, 558 bp, Artificial Sequence
  chemically treated genomic DNA (Homo sapiens) CpG-island No: 12547
tcgtcgtcgttgttttttttttcgcgttttattttacggttttcgttcgtttcgttcgtttttttgcgtcgtcgtgtgttttgttttttgtgtcgtttgcgtttcgtttgttttttttattttcggttcgttatgttttttcgtcggcgttcgcgcgtattgttttcgcgcgttttgtcgtcgcgtttcgtgttttaggttttttttttcgtttttcggttttttttcggtttttgtcgtttcgggtttttcggtttgtcgtcgttcgttgttttggcgttcgtcgttagcgttttttgttcggcgttattgtttcgttttcgtttgggttttattcgcggtttcgtgtcgttgcggttgttttcgttttcgtttgtcggttttttcgtcgattaggttgggttttcgttttcgtcgttttgtttttttttcgtttttttatgttttcgcgtttttcgcgtttgtgttttcgtttttttttttttttatcgtagagttttttttcgattttgtttttataattgtttttatttgttttgttttatcgtagggggggtt

SEQ ID NO: 12548 - DNA, 558 bp, Artificial Sequence
  chemically treated genomic DNA (Homo sapiens) CpG-island No: 12548
aaccccccctacgataaaacaaaacaaataaaaacaattataaaaacaaaatcgaaaaaaaactctacgataaaaaaaaaaaaaaacgaaaacacaaacgcgaaaaacgcgaaaacataaaaaaacgaaaaaaaaacaaaacgacgaaaacgaaaacccaacctaatcgacgaaaaaaccgacaaacgaaaacgaaaacaaccgcaacgacacgaaaccgcgaataaaacccaaacgaaaacgaaacaataacgccgaacaaaaaacgctaacgacgaacgccaaaacaacgaacgacgacaaaccgaaaaacccgaaacgacaaaaaccgaaaaaaaaccgaaaaacgaaaaaaaaaacctaaaacacgaaacgcgacgacaaaacgcgcgaaaacaatacgcgcgaacgccgacgaaaaaacataacgaaccgaaaataaaaaaaacaaacgaaacgcaaacgacacaaaaaacaaaacacacgacgacgcaaaaaaacgaacgaaacgaacgaaaaccgtaaaataaaacgcgaaaaaaaaaacaacgacgacga

SEQ ID NO: 12549 - DNA, 650 bp, Artificial Sequence
  chemically treated genomic DNA (Homo sapiens) CpG-island No: 12549
ttcgttttatttaatatatatatttatttatacgcgcgcgcgtaaatatatatatatatattttaacgttttatttaggtttgggtttcgtttgattaagttttcggggttagataatcggtttttttgcggatgttgattacggggttagttagtaatcgggttttaatttaggttaagcgcggggtttttggaggtgtgggcgtattcgattttcgtatagattttcgtttacgttagtttcggttttttgtttacgtataatatcgatttagtttttcgcgtttcgtcgtttcggtagtcgtcggcgtcgtcgtcgtttttatttttcgcgggtttttaggacgtcgtcgttcgagtgtttattttttcgtcgttgcgtggtcggcgttaggtttaggtttattttttttgttcggagggattcgcgtttggtgttcgtttttttgtttcggcgttttttaatcgcgcggcgaggagtatgcgtagtgggatagttcggttcggcgggtatcgtcggcgaggggcgggaggggtcgaagattcgaggattgttgcgaggtcgggttgggtaattcgagaggagggttgggtaatttgagattagcgagggtgggattttagagttagtcgagattcgggtttatagt

SEQ ID NO: 12550 - DNA, 650 bp, Artificial Sequence
  chemically treated genomic DNA (Homo sapiens) CpG-island No: 12550
actataaacccgaatctcgactaactctaaaatcccaccctcgctaatctcaaattacccaaccctcctctcgaattacccaacccgacctcgcaacaatcctcgaatcttcgacccctcccgcccctcgccgacgatacccgccgaaccgaactatcccactacgcatactcctcgccgcgcgattaaaaaacgccgaaacaaaaaaacgaacaccaaacgcgaatccctccgaacaaaaaaaataaacctaaacctaacgccgaccacgcaacgacgaaaaaataaacactcgaacgacgacgtcctaaaaacccgcgaaaaataaaaacgacgacgacgccgacgactaccgaaacgacgaaacgcgaaaaactaaatcgatattatacgtaaacaaaaaaccgaaactaacgtaaacgaaaatctatacgaaaatcgaatacgcccacacctccaaaaaccccgcgcttaacctaaattaaaacccgattactaactaaccccgtaatcaacatccgcaaaaaaaccgattatctaaccccgaaaacttaatcaaacgaaacccaaacctaaataaaacgttaaaatatatatatatatatttacgcgcgcgcgtataaataaatatatatattaaataaaacgaa

SEQ ID NO: 12551 - DNA, 650 bp, Artificial Sequence
  chemically treated genomic DNA (Homo sapiens) CpG-island No: 12551
gttatgggttcgggtttcggttagttttaaggttttattttcgttgattttaggttatttaatttttttttcgggttatttaattcggtttcgtagtagttttcgggttttcggtttttttcgtttttcgtcggcggtgttcgtcgagtcgggttgttttattgcgtatgtttttcgtcgcgcggttggggagcgtcggggtagggaggcgggtattaggcgcgggttttttcgggtaggggaggtaggtttgggtttgacgtcggttacgtagcggcgggagagtgagtattcgggcggcggcgttttggagattcgcgagagatggaagcggcggcgacgtcggcggttgtcggggcggcgaggcgcgaggagttaggtcggtgttgtgcgtgggtagggagtcggggttgacgtgggcgggggtttgtgcgggagtcgggtgcgtttatatttttaggggtttcgcgtttggtttgagttgaggttcgattgttaattgatttcgtggttagtattcgtaaaggaatcggttatttgatttcgagaatttggttagacgaagtttaggtttgaatagggcgttaaaatatgtgtgtgtgtgtttgcgcgcgcgcgtgtgggtgagtgtgtgtgttgagtggggcggg

SEQ ID NO: 12552 - DNA, 650 bp, Artificial Sequence
  chemically treated genomic DNA (Homo sapiens) CpG-island No: 12552
cccgccccactcaacacacacactcacccacacgcgcgcgcgcaaacacacacacacatattttaacgccctattcaaacctaaacttcgtctaaccaaattctcgaaatcaaataaccgattcctttacgaatactaaccacgaaatcaattaacaatcgaacctcaactcaaaccaaacgcgaaacccctaaaaatataaacgcacccgactcccgcacaaacccccgcccacgtcaaccccgactccctacccacgcacaacaccgacctaactcctcgcgcctcgccgccccgacaaccgccgacgtcgccgccgcttccatctctcgcgaatctccaaaacgccgccgcccgaatactcactctcccgccgctacgtaaccgacgtcaaacccaaacctacctcccctacccgaaaaaacccgcgcctaatacccgcctccctaccccgacgctccccaaccgcgcgacgaaaaacatacgcaataaaacaacccgactcgacgaacaccgccgacgaaaaacgaaaaaaaccgaaaacccgaaaactactacgaaaccgaattaaataacccgaaaaaaaaattaaataacctaaaatcaacgaaaataaaaccttaaaactaaccgaaacccgaacccataac

SEQ ID NO: 12553 - DNA, 923 bp, Artificial Sequence
  chemically treated genomic DNA (Homo sapiens) CpG-island No: 12553
agacgtgaggtcgcgaggttgagggttgtgaaggcggtgggtacgtacggcgtgtcggggtcgtttggtttcgcggcgggggaggtaatattgcgatatttcgtagacgttgttagtcggggtcgcggtttcgcgtgcgttcgattatttgattgttggggagtgcgggggcgcgggagttaggcgagttagcgtaggcgcgcgttgtttttttcgtttttatcgagtttttagcgcgtgcgcggggtcgtggtcgaggtttgcgcgtcgttcggtcgtttgtattgcgcgcgcgtttatttcgcgtgggaggtagcgggaggggttcggagaggtgtggagcggcgcggcgggaggtttcgtgggcggttacgggagatagcgtcggcgggagcgcgtttttcggtttttttttcgcgttttcgcgtttttagtcggtcgtttcgagaggattcggaggaggtaggtgggtcgggggcgcgcggggttttttcgggtcgcgggttggtcggcggcggggttggggtcggggtgggcggttttgggggttcgcggggaggttagtggtttcgggagggtcgcgtagaggcgttgggggttgtggaagtttcgcggtcgtttttcgtgggtatcggtgtcgttggtcgcggggaggttttttcggggcggagcggtttattcggcggggatggggatttttcgtggcggtcgttgacggacggtttaattttaggttgaggggcgcggggtgtgcgggattcggcggcggagttgggttttgggttacgatcgttagtcgcggttgtttcgagagttttcgtacgcgtagtggttttttaacgcggtttttttttattttttatttgattttttttgcgtattaaattgtcgagaaatttttggttagtgggtttttaaagtta

SEQ ID NO: 12554 - DNA, 923 bp, Artificial Sequence
  chemically treated genomic DNA (Homo sapiens) CpG-island No: 12554
taactttaaaaacccactaaccaaaaatttctcgacaatttaatacgcaaaaaaaatcaaataaaaaataaaaaaaaaccgcgttaaaaaaccactacgcgtacgaaaactctcgaaacaaccgcgactaacgatcgtaacccaaaacccaactccgccgccgaatcccgcacaccccgcgcccctcaacctaaaattaaaccgtccgtcaacgaccgccacgaaaaatccccatccccgccgaataaaccgctccgccccgaaaaaacctccccgcgaccaacgacaccgatacccacgaaaaacgaccgcgaaacttccacaacccccaacgcctctacgcgaccctcccgaaaccactaacctccccgcgaacccccaaaaccgcccaccccgaccccaaccccgccgccgaccaacccgcgacccgaaaaaaccccgcgcgcccccgacccacctacctcctccgaatcctctcgaaacgaccgactaaaaacgcgaaaacgcgaaaaaaaaaccgaaaaacgcgctcccgccgacgctatctcccgtaaccgcccacgaaacctcccgccgcgccgctccacacctctccgaacccctcccgctacctcccacgcgaaataaacgcgcgcgcaatacaaacgaccgaacgacgcgcaaacctcgaccacgaccccgcgcacgcgctaaaaactcgataaaaacgaaaaaaacaacgcgcgcctacgctaactcgcctaactcccgcgcccccgcactccccaacaatcaaataatcgaacgcacgcgaaaccgcgaccccgactaacaacgtctacgaaatatcgcaatattacctcccccgccgcgaaaccaaacgaccccgacacgccgtacgtacccaccgccttcacaaccctcaacctcgcgacctcacgtct

SEQ ID NO: 12555 - DNA, 923 bp, Artificial Sequence
  chemically treated genomic DNA (Homo sapiens) CpG-island No: 12555
tagttttgaagatttattggttaaaggtttttcgataatttaatgcgtaaggggagttaagtgagaaatgggaagaggtcgcgttggaaagttattgcgcgtgcggggattttcggggtagtcgcggttggcggtcgtggtttagagtttagtttcgtcgtcgggtttcgtatatttcgcgttttttaatttaaagttgggtcgttcgttagcggtcgttacgaggagtttttattttcgtcgggtgggtcgtttcgtttcgagaaggttttttcgcggttagcgatatcggtgtttacgggaggcggtcgcggggtttttatagtttttagcgtttttgcgcgattttttcggggttattgattttttcgcgggtttttagggtcgtttatttcggttttaatttcgtcgtcggttagttcgcggttcgggggggtttcgcgcgttttcggtttatttgtttttttcgggttttttcggagcggtcggttggggacgcgggggcgcggaggaaaggtcgagaggcgcgttttcgtcggcgttgtttttcgtggtcgtttacggagtttttcgtcgcgtcgttttatattttttcgggtttttttcgttgttttttacgcggggtgggcgcgcgcgtagtgtaggcggtcgggcggcgcgtaggtttcggttacggtttcgcgtacgcgttggggattcggtggggacggaggaggtagcgcgcgtttgcgttggttcgtttggttttcgcgttttcgtattttttagtagttagatgatcgggcgtacgcggggtcgcgatttcggttgatagcgtttgcggggtgtcgtagtgttatttttttcgtcgcgaagttaggcggtttcggtacgtcgtgcgtgtttatcgtttttatagtttttagtttcgcggttttacgttt

SEQ ID NO: 12556 - DNA, 923 bp, Artificial Sequence
  chemically treated genomic DNA (Homo sapiens) CpG-island No: 12556
aaacgtaaaaccgcgaaactaaaaactataaaaacgataaacacgcacgacgtaccgaaaccgcctaacttcgcgacgaaaaaaataacactacgacaccccgcaaacgctatcaaccgaaatcgcgaccccgcgtacgcccgatcatctaactactaaaaaatacgaaaacgcgaaaaccaaacgaaccaacgcaaacgcgcgctacctcctccgtccccaccgaatccccaacgcgtacgcgaaaccgtaaccgaaacctacgcgccgcccgaccgcctacactacgcgcgcgcccaccccgcgtaaaaaacaacgaaaaaaacccgaaaaaatataaaacgacgcgacgaaaaactccgtaaacgaccacgaaaaacaacgccgacgaaaacgcgcctctcgacctttcctccgcgcccccgcgtccccaaccgaccgctccgaaaaaacccgaaaaaaacaaataaaccgaaaacgcgcgaaacccccccgaaccgcgaactaaccgacgacgaaattaaaaccgaaataaacgaccctaaaaacccgcgaaaaaatcaataaccccgaaaaaatcgcgcaaaaacgctaaaaactataaaaaccccgcgaccgcctcccgtaaacaccgatatcgctaaccgcgaaaaaaccttctcgaaacgaaacgacccacccgacgaaaataaaaactcctcgtaacgaccgctaacgaacgacccaactttaaattaaaaaacgcgaaatatacgaaacccgacgacgaaactaaactctaaaccacgaccgccaaccgcgactaccccgaaaatccccgcacgcgcaataactttccaacgcgacctcttcccatttctcacttaactccccttacgcattaaattatcgaaaaacctttaaccaataaatcttcaaaacta

SEQ ID NO: 12557 - DNA, 635 bp, Artificial Sequence
  chemically treated genomic DNA (Homo sapiens) CpG-island No: 12557
gtcgtggacgtattcggttagatggtgattgaggaatttttgtttgtgcgtttcggtatggcggcggtagtagtagaagtcgtattttcggtatattttttcggttttcggagtttcgtcgggttcgtattcgttatacgtgtcgtcgtgaggtagtttttcgaaggtcgcgtttattttagaggttatgtgggtgttgtgacgcggttaaggtttcggggtttcggggttcgtcgtttttttttcgcgcggttttatttttttttttcgtttcgggtttttttttagggagtcgtttttcgtttggatcgcgtcgcgtttcgaagcgggatttggggtcgcggtagtttttgttcgggcgtagtagtaaagatttttttcgtcggttcggattgtttcgttttgtttttgcgttttttttgtcgcgtaaggtattttcggcgcggttattcggcgttttcgtcggttttcgcgtcgcgtcgttcgtttagtttttcgttattagggagagatcgcggtagtcgtcggttttcgcgtcgtttcggttttatttttttttttttcgttaggaggtttttttttattttttgagttatttaaagtggtaatgatttttttttgtttttttcgcgggg

SEQ ID NO: 12558 - DNA, 635 bp, Artificial Sequence
  chemically treated genomic DNA (Homo sapiens) CpG-island No: 12558
ccccgcgaaaaaaacaaaaaaaaatcattaccactttaaataactcaaaaaataaaaaaaaacctcctaacgaaaaaaaaaaaaataaaaccgaaacgacgcgaaaaccgacgactaccgcgatctctccctaataacgaaaaactaaacgaacgacgcgacgcgaaaaccgacgaaaacgccgaataaccgcgccgaaaataccttacgcgacaaaaaaaacgcaaaaacaaaacgaaacaatccgaaccgacgaaaaaaatctttactactacgcccgaacaaaaactaccgcgaccccaaatcccgcttcgaaacgcgacgcgatccaaacgaaaaacgactccctaaaaaaaaacccgaaacgaaaaaaaaaaataaaaccgcgcgaaaaaaaaacgacgaaccccgaaaccccgaaaccttaaccgcgtcacaacacccacataacctctaaaataaacgcgaccttcgaaaaactacctcacgacgacacgtataacgaatacgaacccgacgaaactccgaaaaccgaaaaaatataccgaaaatacgacttctactactaccgccgccataccgaaacgcacaaacaaaaattcctcaatcaccatctaaccgaatacgtccacgac

SEQ ID NO: 12559 - DNA, 635 bp, Artificial Sequence
  chemically treated genomic DNA (Homo sapiens) CpG-island No: 12559
tttcgcgggaaaagtagaaaagggttattgttattttaaatgatttaggaagtaaaaggaggttttttgacggggaaagggaaagtggaatcggggcggcgcgggggtcggcggttgtcgcgatttttttttggtagcgggaggttgagcgggcggcgcgacgcgggggtcgacgggggcgtcgggtggtcgcgtcggaagtgttttgcgcggtagaagaagcgtagggatagagcggagtagttcgagtcggcggaaagggtttttgttgttgcgttcgggtaggggttgtcgcggttttaggtttcgtttcgagacgcggcgcggtttaggcgggaggcgattttttaggaagggattcggggcgggaggaggaagtgaggtcgcgcggaaggaaggcggcgagtttcggggtttcgaggttttggtcgcgttatagtatttatatggtttttggagtgggcgcggttttcgaggaattgttttacgacggtacgtgtgacgagtgcgagttcgacgaggtttcgggggtcgaggaagtgtgtcgagaatgcggtttttgttattgtcgtcgttatgtcgaggcgtataggtagaagttttttagttattatttggtcgaatacgtttacggt

SEQ ID NO: 12560 - DNA, 635 bp, Artificial Sequence
  chemically treated genomic DNA (Homo sapiens) CpG-island No: 12560
accgtaaacgtattcgaccaaataataactaaaaaacttctacctatacgcctcgacataacgacgacaataacaaaaaccgcattctcgacacacttcctcgacccccgaaacctcgtcgaactcgcactcgtcacacgtaccgtcgtaaaacaattcctcgaaaaccgcgcccactccaaaaaccatataaatactataacgcgaccaaaacctcgaaaccccgaaactcgccgccttccttccgcgcgacctcacttcctcctcccgccccgaatcccttcctaaaaaatcgcctcccgcctaaaccgcgccgcgtctcgaaacgaaacctaaaaccgcgacaacccctacccgaacgcaacaacaaaaaccctttccgccgactcgaactactccgctctatccctacgcttcttctaccgcgcaaaacacttccgacgcgaccacccgacgcccccgtcgacccccgcgtcgcgccgcccgctcaacctcccgctaccaaaaaaaaatcgcgacaaccgccgacccccgcgccgccccgattccactttccctttccccgtcaaaaaacctccttttacttcctaaatcatttaaaataacaataacccttttctacttttcccgcgaaa

SEQ ID NO: 12561 - DNA, 554 bp, Artificial Sequence
  chemically treated genomic DNA (Homo sapiens) CpG-island No: 12561
tcgtatggtcgttttcgggttttgtagtcgtgatttagttcgggaaggttggcgtttaggtttggagttcggggttgtgcgggtattaaataaagtagcgttcgtacgcgtttttttagggtcgcgttatatttgcggggtcgttttgttcgtttttttttaggagtcgcgttggttgttgcggggtaggttgggttcgttgttgttgtagttggtttcgcggtcgtttttagtcgtttttagtcgttttcgttcggtgagttattcgttttcggtcgcgtcgtcgttcggttcgtttttacgttttcgagtttgcgcgtatcgttcgtcgagttaggttttttcggtaaggggcgttcgatacgggcggggatttttagaggtcgcggttttttttggttgttagatagatagcgtttttaaggaggaaatttttgttttttcgtttcgtcgcgcgtacgggcggaaaggatatttaaattgttatcgttttgttattgtgttttttcgtttttttgatgttggttatatttttttgcgttggttttgtttcg

SEQ ID NO: 12562 - DNA, 554 bp, Artificial Sequence
  chemically treated genomic DNA (Homo sapiens) CpG-island No: 12562
cgaaacaaaaccaacgcaaaaaaatataaccaacatcaaaaaaacgaaaaaacacaataacaaaacgataacaatttaaatatcctttccgcccgtacgcgcgacgaaacgaaaaaacaaaaatttcctccttaaaaacgctatctatctaacaaccaaaaaaaaccgcgacctctaaaaatccccgcccgtatcgaacgccccttaccgaaaaaacctaactcgacgaacgatacgcgcaaactcgaaaacgtaaaaacgaaccgaacgacgacgcgaccgaaaacgaataactcaccgaacgaaaacgactaaaaacgactaaaaacgaccgcgaaaccaactacaacaacaacgaacccaacctaccccgcaacaaccaacgcgactcctaaaaaaaaacgaacaaaacgaccccgcaaatataacgcgaccctaaaaaaacgcgtacgaacgctactttatttaatacccgcacaaccccgaactccaaacctaaacgccaaccttcccgaactaaatcacgactacaaaacccgaaaacgaccatacga

SEQ ID NO: 12563 - DNA, 554 bp, Artificial Sequence
  chemically treated genomic DNA (Homo sapiens) CpG-island No: 12563
cgagatagagttagcgtaggagggtgtgattagtattagggaggcggggagatatagtgataggacggtgatagtttgggtgtttttttcgttcgtgcgcgcgacgggacggaggggtaggggttttttttttgggaacgttgtttgtttggtagttaaggaaggtcgcggtttttggggattttcgttcgtatcgagcgttttttgtcgagggaatttggttcggcgagcggtgcgcgtaggttcggaggcgtgagagcgggtcgggcggcggcgcggtcgggagcgggtgatttatcgggcgggggcggttgggggcggttaggggcggtcgcggagttaattgtagtagtagcgggtttagtttgtttcgtaatagttagcgcggtttttggagggaaacgagtaaggcggtttcgtaggtgtggcgcggttttgggagggcgcgtgcgagcgttgttttgtttggtgttcgtatagtttcgggttttaggtttgagcgttaattttttcgagttgagttacggttgtagagttcgagggcggttatacgg

SEQ ID NO: 12564 - DNA, 554 bp, Artificial Sequence
  chemically treated genomic DNA (Homo sapiens) CpG-island No: 12564
ccgtataaccgccctcgaactctacaaccgtaactcaactcgaaaaaattaacgctcaaacctaaaacccgaaactatacgaacaccaaacaaaacaacgctcgcacgcgccctcccaaaaccgcgccacacctacgaaaccgccttactcgtttccctccaaaaaccgcgctaactattacgaaacaaactaaacccgctactactacaattaactccgcgaccgcccctaaccgcccccaaccgcccccgcccgataaatcacccgctcccgaccgcgccgccgcccgacccgctctcacgcctccgaacctacgcgcaccgctcgccgaaccaaattccctcgacaaaaaacgctcgatacgaacgaaaatccccaaaaaccgcgaccttccttaactaccaaacaaacaacgttcccaaaaaaaaaacccctacccctccgtcccgtcgcgcgcacgaacgaaaaaaacacccaaactatcaccgtcctatcactatatctccccgcctccctaatactaatcacaccctcctacgctaactctatctcg

SEQ ID NO: 12565 - DNA, 551 bp, Artificial Sequence
  chemically treated genomic DNA (Homo sapiens) CpG-island No: 12565
ggatttgtggggtatgatcgaattttttcgcgtagtcggtaagtttcggtttttagtcgggtcgcgattagcgtgacgtcgcggtagggggattcggcgggcgcgcggtcgtttttaaagtttcggcgtcgtcgtcgttttcgcgcgcgcgcgcgagtagtacggttcgagggggcggtttttggggcgcggtttcggcggtagttgatgcgcgtttcgtcggtcgggaggcgggagttcgcgagtcgggagcgggagtagtagaggtttagtagtcgggcgtcgcgggtcgggggtttgaggaggttataggacgggcgttttttcggttagtggagttcggcgcggggttcgttgcggtcgtatcgtgaggggaggaggtcgaggaggacgtagcgtcggttgtcggcgggaggaagcgttttattagggttttcgacggtattcgtttaattatattcgcgtttttgttggaaacgtttgttggcgtttgttatcggttttttttattttgaaagggaaaaaggttttttttatttatttttttgttt

SEQ ID NO: 12566 - DNA, 551 bp, Artificial Sequence
  chemically treated genomic DNA (Homo sapiens) CpG-island No: 12566
aaacaaaaaaataaataaaaaaaacctttttccctttcaaaataaaaaaaaccgataacaaacgccaacaaacgtttccaacaaaaacgcgaatataattaaacgaataccgtcgaaaaccctaataaaacgcttcctcccgccgacaaccgacgctacgtcctcctcgacctcctcccctcacgatacgaccgcaacgaaccccgcgccgaactccactaaccgaaaaaacgcccgtcctataacctcctcaaacccccgacccgcgacgcccgactactaaacctctactactcccgctcccgactcgcgaactcccgcctcccgaccgacgaaacgcgcatcaactaccgccgaaaccgcgccccaaaaaccgccccctcgaaccgtactactcgcgcgcgcgcgcgaaaacgacgacgacgccgaaactttaaaaacgaccgcgcgcccgccgaatccccctaccgcgacgtcacgctaatcgcgacccgactaaaaaccgaaacttaccgactacgcgaaaaaattcgatcataccccacaaatcc

SEQ ID NO: 12567 - DNA, 551 bp, Artificial Sequence
  chemically treated genomic DNA (Homo sapiens) CpG-island No: 12567
gggtaggggaatgggtggggagagttttttttttttttaaaatggagggaatcggtgataggcgttagtaagcgtttttagtagaggcgcggatgtggttaaacgagtgtcgtcgggggttttggtggagcgttttttttcgtcggtagtcggcgttgcgtttttttcggttttttttttttacggtgcggtcgtagcgggtttcgcgtcgggttttattagtcgggaagacgttcgttttgtggtttttttaggttttcggttcgcggcgttcggttgttagatttttgttgttttcgttttcggttcgcggattttcgtttttcggtcggcggggcgcgtattagttgtcgtcggagtcgcgttttagaagtcgttttttcggatcgtattattcgcgcgcgcgcgcgggggcggcggcggcgtcggggttttgaagacggtcgcgcgttcgtcggatttttttatcgcggcgttacgttggtcgcggttcgattgagggtcggggtttgtcggttgcgcggggagattcggttatattttataggttt

SEQ ID NO: 12568 - DNA, 551 bp, Artificial Sequence
  chemically treated genomic DNA (Homo sapiens) CpG-island No: 12568
aaacctataaaatataaccgaatctccccgcgcaaccgacaaaccccgaccctcaatcgaaccgcgaccaacgtaacgccgcgataaaaaaatccgacgaacgcgcgaccgtcttcaaaaccccgacgccgccgccgcccccgcgcgcgcgcgcgaataatacgatccgaaaaaacgacttctaaaacgcgactccgacgacaactaatacgcgccccgccgaccgaaaaacgaaaatccgcgaaccgaaaacgaaaacaacaaaaatctaacaaccgaacgccgcgaaccgaaaacctaaaaaaaccacaaaacgaacgtcttcccgactaataaaacccgacgcgaaacccgctacgaccgcaccgtaaaaaaaaaaaaccgaaaaaaacgcaacgccgactaccgacgaaaaaaaacgctccaccaaaacccccgacgacactcgtttaaccacatccgcgcctctactaaaaacgcttactaacgcctatcaccgattccctccattttaaaaaaaaaaaaaactctccccacccattcccctaccc

SEQ ID NO: 12569 - DNA, 593 bp, Artificial Sequence
  chemically treated genomic DNA (Homo sapiens) CpG-island No: 12569
agttttaagatcgaatttcgtaaagggtttagtcgtatttttattcggaagcggttcgaattcggggtcggaagtgattttatttttgtgcgtcgagtttcgttttacgagtatttgttttcgagcggagagcgcgggtcgtttttttttttggtgtttcgtcgcggtttgggattcggtaagatgggtaagaagggtaagaaggagaagaagggtcgcggcgcggagaagacggtcgttaagatggagaagaaggtgtttaagcgttcgcggaaggaggaggtgagcgggttagatcgggtttagcggttcgacgtcgcggtcgtgtagtttcggtcgattttttgcgtttttcggggttacgggtcggtcgtgggagtcgcgtcggttttgcgggagagttggaggtcgtaggaattgtttcggcgtcgcgttcgggtagtttagacggggttcgtttttttttgagtttttacgtgtgtttgttcgtttttcggagttgttttttttaacgtgtttgttttttttagtgtggtgttacgggcgtttttttgcgttttttttttttttttttttttttttttatttttttt

SEQ ID NO: 12570 - DNA, 593 bp, Artificial Sequence
  chemically treated genomic DNA (Homo sapiens) CpG-island No: 12570
aaaaaaaataaaaaaaaaaaaaaaaaaaaaaaaaaaacgcaaaaaaacgcccgtaacaccacactaaaaaaaacaaacacgttaaaaaaaacaactccgaaaaacgaacaaacacacgtaaaaactcaaaaaaaaacgaaccccgtctaaactacccgaacgcgacgccgaaacaattcctacgacctccaactctcccgcaaaaccgacgcgactcccacgaccgacccgtaaccccgaaaaacgcaaaaaatcgaccgaaactacacgaccgcgacgtcgaaccgctaaacccgatctaacccgctcacctcctccttccgcgaacgcttaaacaccttcttctccatcttaacgaccgtcttctccgcgccgcgacccttcttctccttcttacccttcttacccatcttaccgaatcccaaaccgcgacgaaacaccaaaaaaaaaaacgacccgcgctctccgctcgaaaacaaatactcgtaaaacgaaactcgacgcacaaaaataaaatcacttccgaccccgaattcgaaccgcttccgaataaaaatacgactaaaccctttacgaaattcgatcttaaaact

SEQ ID NO: 12571 - DNA, 593 bp, Artificial Sequence
  chemically treated genomic DNA (Homo sapiens) CpG-island No: 12571
agggagggtggagggagaagggaggagggggaggaaacgtagaaaaacgttcgtgatattatattaagaaaagtaagtacgttaaagggggtagtttcgagaagcggatagatatacgtggagatttaggagggggcgggtttcgtttgggttgttcggacgcggcgtcggggtagtttttacggtttttagttttttcgtagggtcggcgcggtttttacggtcgattcgtaatttcggggggcgtagggagtcggtcgaggttgtacggtcgcgacgtcgggtcgttaagttcggtttgattcgtttatttttttttttcgcgagcgtttagatatttttttttttattttggcggtcgtttttttcgcgtcgcggtttttttttttttttttgttttttttgtttattttgtcgggttttaagtcgcgacgggatattaggaaagaaaacggttcgcgtttttcgttcggaaataggtgttcgtggggcggagttcggcgtatagaaatggagttattttcggtttcgagttcgagtcgttttcgggtagaggtgcggttgggttttttacgaggttcggttttggagtt

SEQ ID NO: 12572 - DNA, 593 bp, Artificial Sequence
  chemically treated genomic DNA (Homo sapiens) CpG-island No: 12572
aactccaaaaccgaacctcgtaaaaaacccaaccgcacctctacccgaaaacgactcgaactcgaaaccgaaaataactccatttctatacgccgaactccgccccacgaacacctatttccgaacgaaaaacgcgaaccgttttctttcctaatatcccgtcgcgacttaaaacccgacaaaataaacaaaaaaaacaaaaaaaaaaaaaaaaaccgcgacgcgaaaaaaacgaccgccaaaataaaaaaaaaaatatctaaacgctcgcgaaaaaaaaaaataaacgaatcaaaccgaacttaacgacccgacgtcgcgaccgtacaacctcgaccgactccctacgccccccgaaattacgaatcgaccgtaaaaaccgcgccgaccctacgaaaaaactaaaaaccgtaaaaactaccccgacgccgcgtccgaacaacccaaacgaaacccgccccctcctaaatctccacgtatatctatccgcttctcgaaactaccccctttaacgtacttacttttcttaatataatatcacgaacgtttttctacgtttcctccccctcctcccttctccctccaccctccct

SEQ ID NO: 12573 - DNA, 923 bp, Artificial Sequence
  chemically treated genomic DNA (Homo sapiens) CpG-island No: 12573
  misc_feature (441)..(441): n is either a, c, g or t
  misc_feature (464)..(464): n is either a, c, g or t
  misc_feature (592)..(592): n is either a, c, g or t
  misc_feature (598)..(598): n is either a, c, g or t
ataggtaaggcgtgggatcgggaaataggcgaggcgcggggtggggagacgggcgaggcgcggggtggggagacgggcgaggcgcggcgtggggagacgggcgaggcgcggggtggggagacgggcgaggcgcggcgtggggagacgggcgaggcgcggcgtggggagacgggcgaggcgcggggtggggagacgggcgaggcgcggcgtggggagacgggcgaggcgcggcgtggggagacgggcgaggcgcggggtggggagacgggcgaggcgcggggtggggagacgggcgaggcgcggggtggggagacgggcgaagcgcggcgtggggagacgggcgaagcgtcggggtgggagatcgtcgaggtcggcgtgggagacggcgaggttcgggtggggaaacggttaagttcgggtggggagatcgttaagttcggngtgggagacggttaagtttcgtntggggagacggttagcgtaagtcggggtggaaacgttaagtcgggtgggaacggtaaggcgcgggtgggaacgggtaggtcggggtgggaaacggtaaggcgcggcgtgggaaacgggtaggcgcggngtgggnaaacggcgaggcgcggcgtggggaaacgggcgaggcgcggggtgggaagacgggtaaggcgcggggtgggaagacgggcgaggcgcggggtgggaagacgggcgaggcgcggcgtgggaagacgggcgaggcgcggcgtcgggaaacggtcgaggcgcggcgtggggagacgggcgaggcgcggcgtggggagacggtcgaggcgcggcgtggggagacgggcgaggcgcggggtgggtagacgggtgagttgcggtttgggaaaataggcgttgttgtttgtggtttttttagttttatgaatattgaagtttttatatgggat

SEQ ID NO: 12574 - DNA, 923 bp, Artificial Sequence
  chemically treated genomic DNA (Homo sapiens) CpG-island No: 12574
  misc_feature (326)..(326): n is either a, c, g or t
  misc_feature (332)..(332): n is either a, c, g or t
  misc_feature (460)..(460): n is either a, c, g or t
  misc_feature (483)..(483): n is either a, c, g or t
atcccatataaaaacttcaatattcataaaactaaaaaaaccacaaacaacaacgcctattttcccaaaccgcaactcacccgtctacccaccccgcgcctcgcccgtctccccacgccgcgcctcgaccgtctccccacgccgcgcctcgcccgtctccccacgccgcgcctcgaccgtttcccgacgccgcgcctcgcccgtcttcccacgccgcgcctcgcccgtcttcccaccccgcgcctcgcccgtcttcccaccccgcgccttacccgtcttcccaccccgcgcctcgcccgtttccccacgccgcgcctcgccgtttncccacnccgcgcctacccgtttcccacgccgcgccttaccgtttcccaccccgacctacccgttcccacccgcgccttaccgttcccacccgacttaacgtttccaccccgacttacgctaaccgtctccccanacgaaacttaaccgtctcccacnccgaacttaacgatctccccacccgaacttaaccgtttccccacccgaacctcgccgtctcccacgccgacctcgacgatctcccaccccgacgcttcgcccgtctccccacgccgcgcttcgcccgtctccccaccccgcgcctcgcccgtctccccaccccgcgcctcgcccgtctccccaccccgcgcctcgcccgtctccccacgccgcgcctcgcccgtctccccacgccgcgcctcgcccgtctccccaccccgcgcctcgcccgtctccccacgccgcgcctcgcccgtctccccacgccgcgcctcgcccgtctccccaccccgcgcctcgcccgtctccccacgccgcgcctcgcccgtctccccaccccgcgcctcgcccgtctccccaccccgcgcctcgcctatttcccgatcccacgccttacctat

SEQ ID NO: 12575 - DNA, 923 bp, Artificial Sequence
  chemically treated genomic DNA (Homo sapiens) CpG-island No: 12575
  misc_feature (326)..(326): n is either a, c, g or t
  misc_feature (332)..(332): n is either a, c, g or t
  misc_feature (460)..(460): n is either a, c, g or t
  misc_feature (483)..(483): n is either a, c, g or t
attttatgtgaaagttttaatgtttatgaaattgaagagattatagatagtagcgtttatttttttaggtcgtaatttattcgtttgtttatttcgcgtttcgttcgtttttttacgtcgcgtttcggtcgtttttttacgtcgcgtttcgttcgtttttttacgtcgcgtttcggtcgtttttcgacgtcgcgtttcgttcgtttttttacgtcgcgtttcgttcgtttttttatttcgcgtttcgttcgtttttttatttcgcgttttgttcgtttttttatttcgcgtttcgttcgtttttttacgtcgcgtttcgtcgtttntttatntcgcgtttgttcgttttttacgtcgcgttttgtcgttttttatttcggtttgttcgtttttattcgcgttttgtcgtttttattcggtttggcgtttttatttcggtttgcgttggtcgtttttttangcggggtttggtcgttttttatntcgggtttggcggtttttttattcgggtttggtcgtttttttattcgggtttcgtcgttttttacgtcggtttcggcggttttttatttcggcgtttcgttcgtttttttacgtcgcgtttcgttcgtttttttatttcgcgtttcgttcgtttttttatttcgcgtttcgttcgtttttttatttcgcgtttcgttcgtttttttacgtcgcgtttcgttcgtttttttacgtcgcgtttcgttcgtttttttatttcgcgtttcgttcgtttttttacgtcgcgtttcgttcgtttttttacgtcgcgtttcgttcgtttttttatttcgcgtttcgttcgtttttttacgtcgcgtttcgttcgtttttttatttcgcgtttcgttcgtttttttatttcgcgtttcgtttgtttttcggttttacgttttgtttgt

SEQ ID NO: 12576 - DNA, 923 bp, Artificial Sequence
  chemically treated genomic DNA (Homo sapiens) CpG-island No: 12576
  misc_feature (441)..(441): n is either a, c, g or t
  misc_feature (464)..(464): n is either a, c, g or t
  misc_feature (592)..(592): n is either a, c, g or t
  misc_feature (598)..(598): n is either a, c, g or t
acaaacaaaacgtaaaaccgaaaaacaaacgaaacgcgaaataaaaaaacgaacgaaacgcgaaataaaaaaacgaacgaaacgcgacgtaaaaaaacgaacgaaacgcgaaataaaaaaacgaacgaaacgcgacgtaaaaaaacgaacgaaacgcgacgtaaaaaaacgaacgaaacgcgaaataaaaaaacgaacgaaacgcgacgtaaaaaaacgaacgaaacgcgacgtaaaaaaacgaacgaaacgcgaaataaaaaaacgaacgaaacgcgaaataaaaaaacgaacgaaacgcgaaataaaaaaacgaacgaaacgcgacgtaaaaaaacgaacgaaacgccgaaataaaaaaccgccgaaaccgacgtaaaaaacgacgaaacccgaataaaaaaacgaccaaacccgaataaaaaaaccgccaaacccganataaaaaacgaccaaaccccgcntaaaaaaacgaccaacgcaaaccgaaataaaaacgccaaaccgaataaaaacgacaaaacgcgaataaaaacgaacaaaccgaaataaaaaacgacaaaacgcgacgtaaaaaacgaacaaacgcganataaanaaacgacgaaacgcgacgtaaaaaaacgaacgaaacgcgaaataaaaaaacgaacaaaacgcgaaataaaaaaacgaacgaaacgcgaaataaaaaaacgaacgaaacgcgacgtaaaaaaacgaacgaaacgcgacgtcgaaaaacgaccgaaacgcgacgtaaaaaaacgaacgaaacgcgacgtaaaaaaacgaccgaaacgcgacgtaaaaaaacgaacgaaacgcgaaataaacaaacgaataaattacgacctaaaaaaataaacgctactatctataatctcttcaatttcataaacattaaaactttcacataaaat

SEQ ID NO: 12577 - DNA, 521 bp, Artificial Sequence
  chemically treated genomic DNA (Homo sapiens) CpG-island No: 12577
cggcggaaatagtagagtttcgtttttttaacggttaaattttagcgtaaaatagatatatcgattaaggtttatcgtgtgttagggttaggttgggttttttttaggtggttgcggcgggcgcgtttagtttgggtgtttcggaagtttcgagtagcgtaggtcgacggcgatcgtgcgggattcgtttagtcgcgttttcgtttcgtttttggttataggcgcgaattgcgcggtcgttgttattagggggtaggttagggtagcgggaggtagggcggggacgcggtgacgcgggtattgtcgggtttcgtgattgcgcgtttcgttcggagttttcgtcgtcgttatgtagttttcggcggtgttcgttatttttaggtgagttagattttcgcgttttatatcgtatagttcgtagttcggggcgttcgggcggagaggcggggggaggtcgtcgttttttaggttagggatttggtgtaggtttttttagcgttttcggtggtttattcgggttg

SEQ ID NO: 12578 - DNA, 521 bp, Artificial Sequence
  chemically treated genomic DNA (Homo sapiens) CpG-island No: 12578
caacccgaataaaccaccgaaaacgctaaaaaaacctacaccaaatccctaacctaaaaaacgacgacctccccccgcctctccgcccgaacgccccgaactacgaactatacgatataaaacgcgaaaatctaactcacctaaaaataacgaacaccgccgaaaactacataacgacgacgaaaactccgaacgaaacgcgcaatcacgaaacccgacaatacccgcgtcaccgcgtccccgccctacctcccgctaccctaacctaccccctaataacaacgaccgcgcaattcgcgcctataaccaaaaacgaaacgaaaacgcgactaaacgaatcccgcacgatcgccgtcgacctacgctactcgaaacttccgaaacacccaaactaaacgcgcccgccgcaaccacctaaaaaaaacccaacctaaccctaacacacgataaaccttaatcgatatatctattttacgctaaaatttaaccgttaaaaaaacgaaactctactatttccgccg

SEQ ID NO: 12579 - DNA, 521 bp, Artificial Sequence
  chemically treated genomic DNA (Homo sapiens) CpG-island No: 12579
tagttcggataagttatcgagggcgttggggagatttgtattaggtttttggtttaggaggcggcggttttttttcgttttttcgttcgggcgtttcggattgcgagttgtgcggtgtggggcgcgggggtttggtttatttggaggtgacgagtatcgtcggggattgtatgacggcggcggggatttcgggcggggcgcgtagttacgggattcggtagtgttcgcgttatcgcgttttcgttttgtttttcgttgttttggtttgttttttggtggtagcggtcgcgtagttcgcgtttgtggttagaggcggggcggaagcgcggttgggcgggtttcgtacggtcgtcgtcggtttgcgttgttcggagttttcggagtatttaggttgagcgcgttcgtcgtaattatttagaagaagtttagtttggttttggtatacggtgaattttaatcggtgtgtttgttttgcgttaaagtttagtcgttagagagacgggattttgttgttttcgtcg

SEQ ID NO: 12580 - DNA, 521 bp, Artificial Sequence
  chemically treated genomic DNA (Homo sapiens) CpG-island No: 12580
cgacgaaaacaacaaaatcccgtctctctaacgactaaactttaacgcaaaacaaacacaccgattaaaattcaccgtataccaaaaccaaactaaacttcttctaaataattacgacgaacgcgctcaacctaaatactccgaaaactccgaacaacgcaaaccgacgacgaccgtacgaaacccgcccaaccgcgcttccgccccgcctctaaccacaaacgcgaactacgcgaccgctaccaccaaaaaacaaaccaaaacaacgaaaaacaaaacgaaaacgcgataacgcgaacactaccgaatcccgtaactacgcgccccgcccgaaatccccgccgccgtcatacaatccccgacgatactcgtcacctccaaataaaccaaacccccgcgccccacaccgcacaactcgcaatccgaaacgcccgaacgaaaaaacgaaaaaaaaccgccgcctcctaaaccaaaaacctaatacaaatctccccaacgccctcgataacttatccgaacta

SEQ ID NO: 12581 - DNA, 1002 bp, Artificial Sequence
  chemically treated genomic DNA (Homo sapiens) CpG-island No: 12581
  misc_feature (593)..(593): n is either a, c, g or t
  misc_feature (598)..(598): n is either a, c, g or t
gggcgggtgcgcgcggtgtttcgagtttggaattacggagggcgcgttggttttgggcggatggagggggtgtcgtattgtcgcggggaggcgtgtcgggaggttggggttagtggtagtcgtttggcgagggtgggggcgtagcgttgcggtgggaggaggcggtttcggttttggtttttattttaggtcggggtggggggcgtatagcggtcgtcggagtttttagtagggggcgttgtttcgggcgttgggcgggggtggggtgggttaggagggggggtcgcggttgggcgatattttttttattattaaatattatgtttaaaaggcgtcgggggatttttcggagttacggagttcgcgtcgttcgatcgttcggtttacggagtttatggatttgagcgtcgcgtcgcgttgtgtttttggttgttgagcgtttgtcgtttcgcgacgggttggaagcggttcgtgttgcgagcggcgggggttgggtcggttcggagtttagggggcggcggcggcggcggcggcggcgggcggatttttgtttaggttgcgggtcgcggttgtttcggtcgtcgcgggtatgnttttntcgcggtcggcgcgcgcgcgggtttcggttttaggaacggttcggtggtgtcgtattattttatgatgtcgttttatcggagtttggtcgggagggtttcggtcggggtagtcgttgttttcgtttcgggttatggtcgcgcggatacgattatcggttttatagattaggcgatttaaggtatttacgttttttttgtgttcgtttatttcgttaggttttgggttgagattagtttcggagtcgtgtcgtagtttcgttatatttggagtcgcggttttatgcggtttatttttaggtgatagaaagaaatttcgtcgaggttaatattttttagttcgttgtatttggattgtggcgagagtcgcggtagttttcggggtttagttttagagggttgattg

SEQ ID NO: 12582 - DNA, 1002 bp, Artificial Sequence
  chemically treated genomic DNA (Homo sapiens) CpG-island No: 12582
  misc_feature (405)..(405): n is either a, c, g or t
  misc_feature (410)..(410): n is either a, c, g or t
caatcaaccctctaaaactaaaccccgaaaactaccgcgactctcgccacaatccaaatacaacgaactaaaaaatattaacctcgacgaaatttctttctatcacctaaaaataaaccgcataaaaccgcgactccaaatataacgaaactacgacacgactccgaaactaatctcaacccaaaacctaacgaaataaacgaacacaaaaaaaacgtaaataccttaaatcgcctaatctataaaaccgataatcgtatccgcgcgaccataacccgaaacgaaaacaacgactaccccgaccgaaaccctcccgaccaaactccgataaaacgacatcataaaataatacgacaccaccgaaccgttcctaaaaccgaaacccgcgcgcgcgccgaccgcganaaaancatacccgcgacgaccgaaacaaccgcgacccgcaacctaaacaaaaatccgcccgccgccgccgccgccgccgccgccccctaaactccgaaccgacccaacccccgccgctcgcaacacgaaccgcttccaacccgtcgcgaaacgacaaacgctcaacaaccaaaaacacaacgcgacgcgacgctcaaatccataaactccgtaaaccgaacgatcgaacgacgcgaactccgtaactccgaaaaatcccccgacgccttttaaacataatatttaataataaaaaaaatatcgcccaaccgcgaccccccctcctaacccaccccacccccgcccaacgcccgaaacaacgccccctactaaaaactccgacgaccgctatacgccccccaccccgacctaaaataaaaaccaaaaccgaaaccgcctcctcccaccgcaacgctacgcccccaccctcgccaaacgactaccactaaccccaacctcccgacacgcctccccgcgacaatacgacaccccctccatccgcccaaaaccaacgcgccctccgtaattccaaactcgaaacaccgcgcgcacccgccc

SEQ ID NO: 12583 - DNA, 1002 bp, Artificial Sequence
  chemically treated genomic DNA (Homo sapiens) CpG-island No: 12583
  misc_feature (405)..(405): n is either a, c, g or t
  misc_feature (410)..(410): n is either a, c, g or t
tagttagttttttgggattgggtttcgggagttgtcgcgattttcgttatagtttaggtgtagcgggttggagagtgttggtttcggcgaagtttttttttattatttgagggtgggtcgtatggggtcgcggttttaaatgtaacggagttgcggtacggtttcggggttggttttagtttaggatttgacgggatgggcgggtatagaagaggcgtaagtattttgggtcgtttggtttgtgaagtcggtgatcgtgttcgcgcgattatggttcgaggcggagatagcggttgtttcggtcggagttttttcggttaggtttcggtaaagcgatattatgaagtggtgcggtattatcgagtcgtttttgaagtcggagttcgcgcgcgcgtcggtcgcggnagaantatattcgcggcggtcgggatagtcgcgattcgtagtttgggtaagagttcgttcgtcgtcgtcgtcgtcgtcgtcgttttttgggtttcggatcggtttagttttcgtcgttcgtagtacgggtcgtttttagttcgtcgcggggcggtaggcgtttagtagttaaaggtatagcgcggcgcggcgtttaggtttatgggtttcgtgggtcgagcggtcgggcggcgcgggtttcgtggtttcgggaagtttttcggcgttttttgaatatagtgtttaataatgggggaagtgtcgtttagtcgcggtttttttttttggtttattttattttcgtttaacgttcggagtagcgttttttgttgaaagtttcggcggtcgttatgcgttttttatttcggtttagagtggagattagggtcggagtcgtttttttttatcgtagcgttacgtttttattttcgttaagcgattgttattggttttagtttttcgatacgttttttcgcggtagtgcgatattttttttattcgtttaagattaacgcgtttttcgtggttttaggttcggggtatcgcgcgtattcgttt

SEQ ID NO: 12584 - DNA, 1002 bp, Artificial Sequence
  chemically treated genomic DNA (Homo sapiens) CpG-island No: 12584
  misc_feature (593)..(593): n is either a, c, g or t
  misc_feature (598)..(598): n is either a, c, g or t
aaacgaatacgcgcgataccccgaacctaaaaccacgaaaaacgcgttaatcttaaacgaataaaaaaaatatcgcactaccgcgaaaaaacgtatcgaaaaactaaaaccaataacaatcgcttaacgaaaataaaaacgtaacgctacgataaaaaaaaacgactccgaccctaatctccactctaaaccgaaataaaaaacgcataacgaccgccgaaactttcaacaaaaaacgctactccgaacgttaaacgaaaataaaataaaccaaaaaaaaaaaccgcgactaaacgacacttcccccattattaaacactatattcaaaaaacgccgaaaaacttcccgaaaccacgaaacccgcgccgcccgaccgctcgacccacgaaacccataaacctaaacgccgcgccgcgctatacctttaactactaaacgcctaccgccccgcgacgaactaaaaacgacccgtactacgaacgacgaaaactaaaccgatccgaaacccaaaaaacgacgacgacgacgacgacgacgaacgaactcttacccaaactacgaatcgcgactatcccgaccgccgcgaatatanttctnccgcgaccgacgcgcgcgcgaactccgacttcaaaaacgactcgataataccgcaccacttcataatatcgctttaccgaaacctaaccgaaaaaactccgaccgaaacaaccgctatctccgcctcgaaccataatcgcgcgaacacgatcaccgacttcacaaaccaaacgacccaaaatacttacgcctcttctatacccgcccatcccgtcaaatcctaaactaaaaccaaccccgaaaccgtaccgcaactccgttacatttaaaaccgcgaccccatacgacccaccctcaaataataaaaaaaaacttcgccgaaaccaacactctccaacccgctacacctaaactataacgaaaatcgcgacaactcccgaaacccaatcccaaaaaactaacta

SEQ ID NO: 12585 - DNA, 1063 bp, Artificial Sequence
  chemically treated genomic DNA (Homo sapiens) CpG-island No: 12585
  misc_feature (708)..(708): n is either a, c, g or t
gaatcggtagtcgaaataggttagagttttttgttcgacgtgtttagttttaacgacgtagacgaggtggtgggtgtcgagttgcgcgtgttgcgtcggggatttttagagtcgggtttaggtagttggattttttcgtcgttgttgttgttgtttacgtgttcgggcgtcgttcgagcgttacgtttgttgtattcgcgggtagttgagtttttagtcggttagcgttgggaggcgttcgacgtggcggacgtatgagggtttatcgtcgtgaatcgcgtttttttcgcgcgttttgttttttgttgcgcgtagtggtaggttcggtgtcgagttcgttggtattgcggcggttgggtttcggttggtcgggcggagggggttttgcggtagaggagcgcgcggtgttagtcgttttttttcgtacgtagaggaaagagagtttatttcgggagattcgcgtttaggttcgcgcgttcggggtcgttttggttttagagtcgttgttcgatttaggaatcggtatcgcgtcgttaagggtagttattggcggtcgtagacggaggaggacggcgttggtcgggacgcggatagcgtagggtagcggcgggggcgcggtcggggttacgggcgtaggggtcggagtcgttgtagtcgtaagtcgttgtacgtggattttaaggagttcggttgggacgattggattantcgcgtcgttggattacgaggcgtattattgcgagggtttttgcgatttttttttgcgttcgtatttcgagtttattaattatgttattatttagacgttgtttaattttatggtattagacgcggcgtcggttttttgttgtgtgttagcgcgttttagttttattagtattttttatatcgacgtcgttaataacgttgtttataagtaatacgaggatatggtggtggagcgtgcggttgtaggtagcgcgagggtcggggagggggtagttacgcggtcgaggatttttagttgatgagtagtagcgggttattttgttatcgagcgtgggtgtatgttcgatgtgattta

SEQ ID NO: 12586 - DNA, 1063 bp, Artificial Sequence
  chemically treated genomic DNA (Homo sapiens) CpG-island No: 12586
  misc_feature (356)..(356): n is either a, c, g or t
taaatcacatcgaacatacacccacgctcgataacaaaataacccgctactactcatcaactaaaaatcctcgaccgcgtaactaccccctccccgaccctcgcgctacctacaaccgcacgctccaccaccatatcctcgtattacttataaacaacgttattaacgacgtcgatataaaaaatactaataaaactaaaacgcgctaacacacaacaaaaaaccgacgccgcgtctaataccataaaattaaacaacgtctaaataataacataattaataaactcgaaatacgaacgcaaaaaaaaatcgcaaaaaccctcgcaataatacgcctcgtaatccaacgacgcgantaatccaatcgtcccaaccgaactccttaaaatccacgtacaacgacttacgactacaacgactccgacccctacgcccgtaaccccgaccgcgcccccgccgctaccctacgctatccgcgtcccgaccaacgccgtcctcctccgtctacgaccgccaataactacccttaacgacgcgataccgattcctaaatcgaacaacgactctaaaaccaaaacgaccccgaacgcgcgaacctaaacgcgaatctcccgaaataaactctctttcctctacgtacgaaaaaaaacgactaacaccgcgcgctcctctaccgcaaaaccccctccgcccgaccaaccgaaacccaaccgccgcaataccaacgaactcgacaccgaacctaccactacgcgcaacaaaaaacaaaacgcgcgaaaaaaacgcgattcacgacgataaaccctcatacgtccgccacgtcgaacgcctcccaacgctaaccgactaaaaactcaactacccgcgaatacaacaaacgtaacgctcgaacgacgcccgaacacgtaaacaacaacaacaacgacgaaaaaatccaactacctaaacccgactctaaaaatccccgacgcaacacgcgcaactcgacacccaccacctcgtctacgtcgttaaaactaaacacgtcgaacaaaaaactctaacctatttcgactaccgattc

SEQ ID NO: 12587 - DNA, 1063 bp, Artificial Sequence
  chemically treated genomic DNA (Homo sapiens) CpG-island No: 12587
  misc_feature (356)..(356): n is either a, c, g or t
tgggttatatcggatatgtatttacgttcggtgatagggtggttcgttgttgtttattagttggggattttcggtcgcgtggttgtttttttttcggttttcgcgttatttgtagtcgtacgttttattattatgttttcgtattgtttgtagataacgttgttggcggcgtcgatgtagaggatgttgatggggttgaggcgcgttggtatatagtaggaggtcggcgtcgcgtttggtgttatggagttgagtagcgtttgaatgatggtatggttggtgggttcgaggtgcgaacgtaaagggaagtcgtaaaggttttcgtagtggtacgtttcgtagtttagcggcgcgantgatttagtcgttttagtcgagttttttgaagtttacgtgtaacggtttgcggttgtagcggtttcggtttttgcgttcgtggtttcggtcgcgttttcgtcgttgttttgcgttgttcgcgtttcggttaacgtcgttttttttcgtttgcggtcgttaatgattgtttttggcgacgcggtgtcggtttttgggtcgggtagcggttttgaggttagagcggtttcgagcgcgcgggtttgggcgcggatttttcggaataagtttttttttttttgcgtgcgggaggagacgattagtatcgcgcgtttttttgtcgtagagtttttttcgttcggttagtcgaagtttagtcgtcgtagtgttaacgggttcggtatcgggtttgttattgcgcgtagtaagaggtagaacgcgcggggggggcgcggtttacgacggtgggtttttatgcgttcgttacgtcgaacgttttttagcgttgatcgattaggggtttagttgttcgcgagtatagtaggcgtggcgttcgggcggcgttcgggtacgtggatagtagtagtaacggcggagaagtttagttgtttgggttcgattttggagattttcggcgtagtacgcgtagttcggtatttattatttcgtttgcgtcgttaaggttggatacgtcgaataggaagttttggtttgtttcggttgtcgattt

SEQ ID NO: 12588 - DNA, 1063 bp, Artificial Sequence
  chemically treated genomic DNA (Homo sapiens) CpG-island No: 12588
  misc_feature (708)..(708): n is either a, c, g or t
aaatcgacaaccgaaacaaaccaaaacttcctattcgacgtatccaaccttaacgacgcaaacgaaataataaataccgaactacgcgtactacgccgaaaatctccaaaatcgaacccaaacaactaaacttctccgccgttactactactatccacgtacccgaacgccgcccgaacgccacgcctactatactcgcgaacaactaaacccctaatcgatcaacgctaaaaaacgttcgacgtaacgaacgcataaaaacccaccgtcgtaaaccgcgccccccccgcgcgttctacctcttactacgcgcaataacaaacccgataccgaacccgttaacactacgacgactaaacttcgactaaccgaacgaaaaaaactctacgacaaaaaaacgcgcgatactaatcgtctcctcccgcacgcaaaaaaaaaaaaacttattccgaaaaatccgcgcccaaacccgcgcgctcgaaaccgctctaacctcaaaaccgctacccgacccaaaaaccgacaccgcgtcgccaaaaacaatcattaacgaccgcaaacgaaaaaaaacgacgttaaccgaaacgcgaacaacgcaaaacaacgacgaaaacgcgaccgaaaccacgaacgcaaaaaccgaaaccgctacaaccgcaaaccgttacacgtaaacttcaaaaaactcgactaaaacgactaaatcantcgcgccgctaaactacgaaacgtaccactacgaaaacctttacgacttccctttacgttcgcacctcgaacccaccaaccataccatcattcaaacgctactcaactccataacaccaaacgcgacgccgacctcctactatataccaacgcgcctcaaccccatcaacatcctctacatcgacgccgccaacaacgttatctacaaacaatacgaaaacataataataaaacgtacgactacaaataacgcgaaaaccgaaaaaaaaacaaccacgcgaccgaaaatccccaactaataaacaacaacgaaccaccctatcaccgaacgtaaatacatatccgatataaccca

SEQ ID NO: 12589 - DNA, 849 bp, Artificial Sequence
  chemically treated genomic DNA (Homo sapiens) CpG-island No: 12589
  misc_feature (771)..(771): n is either a, c, g or t
  misc_feature (807)..(807): n is either a, c, g or t
ggcgtggtttttgcgcgcggatattttggagagaaattacgcgtttcggtagttcgcggggcgagtgggcggagtcgggtcgggggcgggggtcgggcgtcgggcgagaggtggtattgtgtaggggagcgcggagttgtatttgtttgttttaggtgttagttaggtaggcgtacgtggtcggttagggttggaagtgttagcggcggtcgcgggttcggtagaaggtcgagtaggagggattacgcgtcgggggtcgcgatttttggtagggggcggtgtgttagcggagtattatgtatataggcgtttagcgttttaattatttttttcgaggaaaagaggtcggggtcgcgttggggcggcggagagtatgagggaggtcggggggcggttcggtttggagcgttgttagggagcggtgcgcgtcgtatattcgtttgggcgcggcggagggcggggagtcgggtaggtcgcgtttgcgggcggtagtcgatcgtcgggagttgttttgattttcgacgcgtacgttaggggttcggagtagttttcggttcgcgcgcgtcgtcgatatgggtaacgtagggagtatggattcgtagtagatcgattttagggcgtataacgtgtttttgaagttgtcgatgttagagttaggtgaattggaggagcgatttgttatcgtgttggtaagtgcgcggcggcggtcgggcgcggggattcggggtttcgggtcgggcggcgtagttgattttcgttttttttttttangtcgtgtcgggagcgattttttattttcgaggggangttttcgtttttttttttgtggttttttagtattttttttta

SEQ ID NO: 12590 - DNA, 849 bp, Artificial Sequence
  chemically treated genomic DNA (Homo sapiens) CpG-island No: 12590
  misc_feature (43)..(43): n is either a, c, g or t
  misc_feature (79)..(79): n is either a, c, g or t
taaaaaaaaatactaaaaaaccacaaaaaaaaaaacgaaaacntcccctcgaaaataaaaaatcgctcccgacacgacntaaaaaaaaaaaacgaaaatcaactacgccgcccgacccgaaaccccgaatccccgcgcccgaccgccgccgcgcacttaccaacacgataacaaatcgctcctccaattcacctaactctaacatcgacaacttcaaaaacacgttatacgccctaaaatcgatctactacgaatccatactccctacgttacccatatcgacgacgcgcgcgaaccgaaaactactccgaacccctaacgtacgcgtcgaaaatcaaaacaactcccgacgatcgactaccgcccgcaaacgcgacctacccgactccccgccctccgccgcgcccaaacgaatatacgacgcgcaccgctccctaacaacgctccaaaccgaaccgccccccgacctccctcatactctccgccgccccaacgcgaccccgacctcttttcctcgaaaaaaataattaaaacgctaaacgcctatatacataatactccgctaacacaccgccccctaccaaaaatcgcgacccccgacgcgtaatccctcctactcgaccttctaccgaacccgcgaccgccgctaacacttccaaccctaaccgaccacgtacgcctacctaactaacacctaaaacaaacaaatacaactccgcgctcccctacacaataccacctctcgcccgacgcccgacccccgcccccgacccgactccgcccactcgccccgcgaactaccgaaacgcgtaatttctctccaaaatatccgcgcgcaaaaaccacgcc

SEQ ID NO: 12591 - DNA, 849 bp, Artificial Sequence
  chemically treated genomic DNA (Homo sapiens) CpG-island No: 12591
  misc_feature (43)..(43): n is either a, c, g or t
  misc_feature (79)..(79): n is either a, c, g or t
tgaagaggagtgttggggggttataaaggggaaagcgggaatnttttttcgggaatggaggatcgttttcggtacggtntgaaggggaggggcgggggttagttgcgtcgttcggttcggggtttcgggttttcgcgttcgatcgtcgtcgcgtatttattagtacgatggtaaatcgtttttttagtttatttggttttggtatcggtagttttaaaggtacgttgtgcgttttgaaatcggtttgttgcgaatttatgttttttgcgttgtttatgtcggcggcgcgcgcgggtcgggggttgtttcgggtttttagcgtgcgcgtcggaaattagaatagttttcggcggtcggttgtcgttcgtaggcgcgatttgttcggtttttcgtttttcgtcgcgtttaggcgggtgtgcggcgcgtatcgttttttagtagcgttttaagtcgagtcgtttttcggttttttttatgtttttcgtcgttttagcgcggtttcggtttttttttttcgggaggggtagttggggcgttgggcgtttatgtgtatggtgtttcgttggtatatcgttttttgttagagatcgcggttttcggcgcgtggttttttttattcggttttttgtcgggttcgcggtcgtcgttgatatttttagttttagtcggttacgtgcgtttgtttggttagtatttggagtagataaatgtagtttcgcgtttttttatataatgttatttttcgttcggcgttcggttttcgttttcggttcggtttcgtttattcgtttcgcggattgtcgggacgcgtagtttttttttaaagtgttcgcgcgtagaaattacgtt

SEQ ID NO: 12592 - DNA, 849 bp, Artificial Sequence
  chemically treated genomic DNA (Homo sapiens) CpG-island No: 12592
  misc_feature (771)..(771): n is either a, c, g or t
  misc_feature (807)..(807): n is either a, c, g or t
aacgtaatttctacgcgcgaacactttaaaaaaaaactacgcgtcccgacaatccgcgaaacgaataaacgaaaccgaaccgaaaacgaaaaccgaacgccgaacgaaaaataacattatataaaaaaacgcgaaactacatttatctactccaaatactaaccaaacaaacgcacgtaaccgactaaaactaaaaatatcaacgacgaccgcgaacccgacaaaaaaccgaataaaaaaaaccacgcgccgaaaaccgcgatctctaacaaaaaacgatataccaacgaaacaccatacacataaacgcccaacgccccaactacccctcccgaaaaaaaaaaaccgaaaccgcgctaaaacgacgaaaaacataaaaaaaaccgaaaaacgactcgacttaaaacgctactaaaaaacgatacgcgccgcacacccgcctaaacgcgacgaaaaacgaaaaaccgaacaaatcgcgcctacgaacgacaaccgaccgccgaaaactattctaatttccgacgcgcacgctaaaaacccgaaacaacccccgacccgcgcgcgccgccgacataaacaacgcaaaaaacataaattcgcaacaaaccgatttcaaaacgcacaacgtacctttaaaactaccgataccaaaaccaaataaactaaaaaaacgatttaccatcgtactaataaatacgcgacgacgatcgaacgcgaaaacccgaaaccccgaaccgaacgacgcaactaacccccgcccctccccttcanaccgtaccgaaaacgatcctccattcccgaaaaaanattcccgctttcccctttataaccccccaacactcctcttca

SEQ ID NO: 12593 - DNA, 575 bp, Artificial Sequence
  chemically treated genomic DNA (Homo sapiens) CpG-island No: 12593
gattcggtacggagcgtaggggtattagggaggataggggcgtatttcgagttatttgtgtcggttttcgagtcggcgtgtaatagtttgattttcggtcgttgtttgtcgttattcggtttgcgttgtattatttgtcgtaggagtagtcgtatgcgtcgcgaggtcgggtcgtcgtggttttcgggtgtttcgaggagtagaagtcgggattgtatggcgtcgggggggttgtcggggacggcgagggggttcggggatcgagcggcgtttcgtgtaggtatcgtgaggtagcgcggagaaggggataggaagcggtatttagtcgagttcgtcggaaattttttttttcgcggcgcggtcggtttagtagatttagttcggttttattcggttttgtatggtttagacgggcggaaagagtttgcggagttttagtttatagagtcggtatcgtttcgggattgttcgtatcgcgtgggtgttttaatttcggtgttgggttttgaagcgtttgtagtcggagttgttgttatttgatgatagttttatcgttttttgttttcgatttaggg

SEQ ID NO: 12594 - DNA, 575 bp, Artificial Sequence
  chemically treated genomic DNA (Homo sapiens) CpG-island No: 12594
ccctaaatcgaaaacaaaaaacgataaaactatcatcaaataacaacaactccgactacaaacgcttcaaaacccaacaccgaaattaaaacacccacgcgatacgaacaatcccgaaacgataccgactctataaactaaaactccgcaaactctttccgcccgtctaaaccatacaaaaccgaataaaaccgaactaaatctactaaaccgaccgcgccgcgaaaaaaaaaatttccgacgaactcgactaaataccgcttcctatccccttctccgcgctacctcacgatacctacacgaaacgccgctcgatccccgaaccccctcgccgtccccgacaacccccccgacgccatacaatcccgacttctactcctcgaaacacccgaaaaccacgacgacccgacctcgcgacgcatacgactactcctacgacaaataatacaacgcaaaccgaataacgacaaacaacgaccgaaaatcaaactattacacgccgactcgaaaaccgacacaaataactcgaaatacgcccctatcctccctaatacccctacgctccgtaccgaatc

SEQ ID NO: 12595 - DNA, 575 bp, Artificial Sequence
  chemically treated genomic DNA (Homo sapiens) CpG-island No: 12595
ttttgaatcgggaataggaagcggtaaagttgttattaggtgatagtagtttcgattgtaggcgttttagagtttagtatcgaagttggagtatttacgcggtgcgggtagtttcgggacggtgtcggttttatgggttggagtttcgtaggtttttttcgttcgtttgggttatgtagggtcgggtagggtcgggttgagtttattgagtcggtcgcgtcgcgggggaaggagttttcggcggattcggttaggtgtcgttttttgttttttttttcgcgttgttttacggtgtttgtacgggacgtcgttcgattttcgagttttttcgtcgttttcgatagttttttcggcgttatgtaatttcggtttttatttttcggggtattcggaggttacggcggttcggtttcgcggcgtatgcggttgtttttgcggtaggtggtgtagcgtaggtcgggtggcgataggtagcggtcggaggttagattgttgtacgtcggttcgggggtcgatataggtaattcggggtgcgtttttgttttttttggtgtttttgcgtttcgtgtcgggtt

SEQ ID NO: 12596 - DNA, 575 bp, Artificial Sequence
  chemically treated genomic DNA (Homo sapiens) CpG-island No: 12596
aacccgacacgaaacgcaaaaacaccaaaaaaaacaaaaacgcaccccgaattacctatatcgacccccgaaccgacgtacaacaatctaacctccgaccgctacctatcgccacccgacctacgctacaccacctaccgcaaaaacaaccgcatacgccgcgaaaccgaaccgccgtaacctccgaataccccgaaaaataaaaaccgaaattacataacgccgaaaaaactatcgaaaacgacgaaaaaactcgaaaatcgaacgacgtcccgtacaaacaccgtaaaacaacgcgaaaaaaaaaacaaaaaacgacacctaaccgaatccgccgaaaactccttcccccgcgacgcgaccgactcaataaactcaacccgaccctacccgaccctacataacccaaacgaacgaaaaaaacctacgaaactccaacccataaaaccgacaccgtcccgaaactacccgcaccgcgtaaatactccaacttcgatactaaactctaaaacgcctacaatcgaaactactatcacctaataacaactttaccgcttcctattcccgattcaaaa

SEQ ID NO: 12597 - DNA, 548 bp, Artificial Sequence
  chemically treated genomic DNA (Homo sapiens) CpG-island No: 12597
ttttcgtggacgcggtggttatttagtttttttggatcgtgtttttagggaagaacggcgttttttgagaatcggaagtgtttttttttattttcggggttgggtttttggacgttgttttgtagtggtcgcgggtttgatatacgtatttaagttgtttgcgtttcgcgaagttttacgtcgaggtttaagtagtaggcgtttcgtttcgcgatttttttcgaggtttatcgtttgtgtttagggcggcgcgggtagagtggaagtttttttgtagtttcggagtttttcgcgtagttgttcgcgttttcgtagagaggttcgcgtgtcgaggagattttggattttcgttttgagttttttattttttcgggtttttttttacggttgcgtgtttgtttttttagtttttttttttaggatattgtgcgattttcgtttttcgttttttttcggagtttttattacgtatcgttcgtttttttttcggatttgatttttggttttgttgggtttttattgagcggtagaggtttttttagttttgt

SEQ ID NO: 12598 - DNA, 548 bp, Artificial Sequence
  chemically treated genomic DNA (Homo sapiens) CpG-island No: 12598
acaaaactaaaaaaacctctaccgctcaataaaaacccaacaaaaccaaaaatcaaatccgaaaaaaaaacgaacgatacgtaataaaaactccgaaaaaaaacgaaaaacgaaaatcgcacaatatcctaaaaaaaaaaactaaaaaaacaaacacgcaaccgtaaaaaaaaacccgaaaaaataaaaaactcaaaacgaaaatccaaaatctcctcgacacgcgaacctctctacgaaaacgcgaacaactacgcgaaaaactccgaaactacaaaaaaacttccactctacccgcgccgccctaaacacaaacgataaacctcgaaaaaaatcgcgaaacgaaacgcctactacttaaacctcgacgtaaaacttcgcgaaacgcaaacaacttaaatacgtatatcaaacccgcgaccactacaaaacaacgtccaaaaacccaaccccgaaaataaaaaaaaacacttccgattctcaaaaaacgccgttcttccctaaaaacacgatccaaaaaaactaaataaccaccgcgtccacgaaaa

SEQ ID NO: 12599 - DNA, 548 bp, Artificial Sequence
  chemically treated genomic DNA (Homo sapiens) CpG-island No: 12599
gtagggttggaaaggtttttgtcgtttagtggggatttagtaaagttaaaaattaggttcgggggaagagcgaacggtgcgtgatggaggtttcgagggggagcgagaggcggaggtcgtatagtgttttgaggggggagattggaaaagtagatacgtaatcgtgggaagaaattcgaaggagtaaagaatttagagcgaaagtttaaaattttttcggtacgcgggtttttttgcgggggcgcgggtagttgcgcggggagtttcggagttgtagagaagtttttattttgttcgcgtcgttttgagtataggcgatgggtttcggagggagtcgcggagcgggacgtttgttgtttggatttcggcgtgagatttcgcgggacgtagataatttgaatgcgtgtgttagattcgcgattattataagataacgtttagagatttagtttcggaaatgaagaaagatattttcggtttttagagggcgtcgtttttttttgagaatacggtttagggaggttggatggttatcgcgtttacggaga

SEQ ID NO: 12600 - DNA, 548 bp, Artificial Sequence
  chemically treated genomic DNA (Homo sapiens) CpG-island No: 12600
tctccgtaaacgcgataaccatccaacctccctaaaccgtattctcaaaaaaaaacgacgccctctaaaaaccgaaaatatctttcttcatttccgaaactaaatctctaaacgttatcttataataatcgcgaatctaacacacgcattcaaattatctacgtcccgcgaaatctcacgccgaaatccaaacaacaaacgtcccgctccgcgactccctccgaaacccatcgcctatactcaaaacgacgcgaacaaaataaaaacttctctacaactccgaaactccccgcgcaactacccgcgcccccgcaaaaaaacccgcgtaccgaaaaaattttaaactttcgctctaaattctttactccttcgaatttcttcccacgattacgtatctacttttccaatctcccccctcaaaacactatacgacctccgcctctcgctccccctcgaaacctccatcacgcaccgttcgctcttcccccgaacctaatttttaactttactaaatccccactaaacgacaaaaacctttccaaccctac

SEQ ID NO: 12601 - DNA, 1047 bp, Artificial Sequence
  chemically treated genomic DNA (Homo sapiens) CpG-island No: 12601
gttcggcggggttatttatggttatttacggttttcggtacgcgtatttagtttagcgtcgtcgtatttcggggtttcgcgcggggttttcgtttttcggttgattcgttcgtcgttgcgatttcgggtagtttcgttagttttttatcgttgttttttcggtttatttttttcgtattgtttttttaatcggtaaaattttttatttttttaaatattgtcgtgcgcgcgcgcgtgtatatatatatatttatatatatatatttatatatattgacgttttttgcgtattttttgtattagagggagggagattcgttcgtatatcgatagagggagaggagatcgcgggggagcgcgggttggcgggcggcgagcgagcggtagtcgagagcggggatcggggagcgcggagggcgttcggcgtttaggaggtggggtcgcgttgagtcgtagtttttgtttcgtcgtcgcgttgcgatcgttcggtcgtggtttgcgttttcgagtcggatcgcggtcgttcggatttcgagttcgcgcggatgtgagatttcgggtttttggcgtttttcgatcgtcggtttcggcgcggcgttgtttcgtttaggaggcggcggtttcggttggtcgtggggtttgtggatttttaaaaatttggtttcgaggaggattattttttttcgatatgtattttttcggatagattgaatattttttcgtttattttttcgtttcgcgcggttagaggtaggcgttgagtgtgcgaagaggattcgggttgaaatttgttttttcggttttcgttttcgtttcgttttatcgttttatttttttttcggagtcgaaatttttcgggattatgtttcggaaaggtaggtaagcgtcggcgcggcgttcgttttttcgtagttcggagtcggagagttagcgaggcggcgaggtagttttcgcggtttgtagcggagtcgatagttcgtttttttttttggaggtgtagttggtggtcggggggagagatttgttttaaatacggatattttttag

SEQ ID NO: 12602 - DNA, 1047 bp, Artificial Sequence
  chemically treated genomic DNA (Homo sapiens) CpG-island No: 12602
ctaaaaaatatccgtatttaaaacaaatctctccccccgaccaccaactacacctccaaaaaaaaaaacgaactatcgactccgctacaaaccgcgaaaactacctcgccgcctcgctaactctccgactccgaactacgaaaaaacgaacgccgcgccgacgcttacctacctttccgaaacataatcccgaaaaatttcgactccgaaaaaaaaataaaacgataaaacgaaacgaaaacgaaaaccgaaaaaacaaatttcaacccgaatcctcttcgcacactcaacgcctacctctaaccgcgcgaaacgaaaaaataaacgaaaaaatattcaatctatccgaaaaaatacatatcgaaaaaaaataatcctcctcgaaaccaaatttttaaaaatccacaaaccccacgaccaaccgaaaccgccgcctcctaaacgaaacaacgccgcgccgaaaccgacgatcgaaaaacgccaaaaacccgaaatctcacatccgcgcgaactcgaaatccgaacgaccgcgatccgactcgaaaacgcaaaccacgaccgaacgatcgcaacgcgacgacgaaacaaaaactacgactcaacgcgaccccacctcctaaacgccgaacgccctccgcgctccccgatccccgctctcgactaccgctcgctcgccgcccgccaacccgcgctcccccgcgatctcctctccctctatcgatatacgaacgaatctccctccctctaatacaaaaaatacgcaaaaaacgtcaatatatataaatatatatatataaatatatatatatacacgcgcgcgcgcacgacaatatttaaaaaaataaaaaattttaccgattaaaaaaacaatacgaaaaaaataaaccgaaaaaacaacgataaaaaactaacgaaactacccgaaatcgcaacgacgaacgaatcaaccgaaaaacgaaaaccccgcgcgaaaccccgaaatacgacgacgctaaactaaatacgcgtaccgaaaaccgtaaataaccataaataaccccgccgaac

SEQ ID NO: 12603 - DNA, 1047 bp, Artificial Sequence
  chemically treated genomic DNA (Homo sapiens) CpG-island No: 12603
ttgggggatgttcgtgtttggagtaagttttttttttcgattattagttgtatttttagaagagaagacgagttgtcggtttcgttgtaagtcgcgggggttgtttcgtcgtttcgttggtttttcggtttcggattgcgggaaagcgggcgtcgcgtcggcgtttatttattttttcgaaatataatttcgggaaatttcgatttcgggagggggatggggcggtgggacggggcggggacgagaatcgggggagtagattttaattcggatttttttcgtatatttagcgtttgtttttgatcgcgcggggcgggggggtgaacggagggatgtttagtttattcggagggatgtatgtcgagaggaaatggtttttttcggagttaaatttttaaaaatttataagttttacggttagtcggggtcgtcgttttttgggcgaagtagcgtcgcgtcggagtcggcgatcgggaggcgttaggagttcggaattttatattcgcgcgggttcggagttcgggcggtcgcgattcggttcgggggcgtaggttacgatcgggcggtcgtagcgcggcggcggggtagggattgcgatttagcgcggttttattttttgggcgtcggacgtttttcgcgtttttcggttttcgttttcggttgtcgttcgttcgtcgttcgttagttcgcgttttttcgcggttttttttttttttgtcggtgtgcgagcgagtttttttttttttaatgtaggaaatgcgtaaaagacgttagtgtgtgtgagtgtgtgtgtgtgagtgtgtgtgtgtgtacgcgcgcgcgtacggtagtgtttggggaaatagaaagttttgtcggttgggggagtaatacggaaaaagtgagtcgaggagataacggtggagagttggcgaggttgttcggggtcgtagcggcgggcgggttagtcggggggcggggatttcgcgcgggatttcggggtgcggcggcgttgggttggatgcgcgtgtcgggggtcgtggatggttatggatggtttcgtcgggt

SEQ ID NO: 12604 - DNA, 1047 bp, Artificial Sequence
  chemically treated genomic DNA (Homo sapiens) CpG-island No: 12604
acccgacgaaaccatccataaccatccacgacccccgacacgcgcatccaacccaacgccgccgcaccccgaaatcccgcgcgaaatccccgccccccgactaacccgcccgccgctacgaccccgaacaacctcgccaactctccaccgttatctcctcgactcactttttccgtattactcccccaaccgacaaaactttctatttccccaaacactaccgtacgcgcgcgcgtacacacacacacactcacacacacacactcacacacactaacgtcttttacgcatttcctacattaaaaaaaaaaaaactcgctcgcacaccgacaaaaaaaaaaaaaaccgcgaaaaaacgcgaactaacgaacgacgaacgaacgacaaccgaaaacgaaaaccgaaaaacgcgaaaaacgtccgacgcccaaaaaataaaaccgcgctaaatcgcaatccctaccccgccgccgcgctacgaccgcccgatcgtaacctacgcccccgaaccgaatcgcgaccgcccgaactccgaacccgcgcgaatataaaattccgaactcctaacgcctcccgatcgccgactccgacgcgacgctacttcgcccaaaaaacgacgaccccgactaaccgtaaaacttataaatttttaaaaatttaactccgaaaaaaaccatttcctctcgacatacatccctccgaataaactaaacatccctccgttcacccccccgccccgcgcgatcaaaaacaaacgctaaatatacgaaaaaaatccgaattaaaatctactcccccgattctcgtccccgccccgtcccaccgccccatccccctcccgaaatcgaaatttcccgaaattatatttcgaaaaaataaataaacgccgacgcgacgcccgctttcccgcaatccgaaaccgaaaaaccaacgaaacgacgaaacaacccccgcgacttacaacgaaaccgacaactcgtcttctcttctaaaaatacaactaataatcgaaaaaaaaaacttactccaaacacgaacatcccccaa

SEQ ID NO: 12605 - DNA, 661 bp, Artificial Sequence
  chemically treated genomic DNA (Homo sapiens) CpG-island No: 12605
aatcgttcgcgttagggcgtaacgttataaggtgtagggagtgtgcggggtggggcgaaaggggatttaagagtttttgtggttcggagtgtcgggtcgtcggttttttatttttgttttcggggtagacggagtgatttcggtttttatttttcgtttcgattatggtagtgtttaatggtttttttaagattaaaatttgcgaggtcgtgagtttgaagtttatagtttggtcgttgcgttatgcggtgggatttcggtcgtagattttttttttcgatttttatattgtttttaatgtggacgattcgcgtatcggttaaacggttattaagtagaagattaatagttcggtttggtacgacgagttcgttatcgatgtgtgtaacggacgtaagatcgagttggttgttttttacgatgtttttataggttacgacgatttcgtggttaattgtattatttagtttgaggagttgttgtagaacgggagtcgttatttcgaggattgggtgagtgcggcgttttttcgtcgtttcgggaattcggttgtggggtttcggggaaagattcgttggttttgatcgtagggtttcgggatttattgacgattggggtgtgtgtgtttgtaagttttagtttttttggggaggtatatttt

SEQ ID NO: 12606 - DNA, 661 bp, Artificial Sequence
  chemically treated genomic DNA (Homo sapiens) CpG-island No: 12606
aaaatatacctccccaaaaaaactaaaacttacaaacacacacaccccaatcgtcaataaatcccgaaaccctacgatcaaaaccaacgaatctttccccgaaaccccacaaccgaattcccgaaacgacgaaaaaacgccgcactcacccaatcctcgaaataacgactcccgttctacaacaactcctcaaactaaataatacaattaaccacgaaatcgtcgtaacctataaaaacatcgtaaaaaacaaccaactcgatcttacgtccgttacacacatcgataacgaactcgtcgtaccaaaccgaactattaatcttctacttaataaccgtttaaccgatacgcgaatcgtccacattaaaaacaatataaaaatcgaaaaaaaaaatctacgaccgaaatcccaccgcataacgcaacgaccaaactataaacttcaaactcacgacctcgcaaattttaatcttaaaaaaaccattaaacactaccataatcgaaacgaaaaataaaaaccgaaatcactccgtctaccccgaaaacaaaaataaaaaaccgacgacccgacactccgaaccacaaaaactcttaaatcccctttcgccccaccccgcacactccctacaccttataacgttacgccctaacgcgaacgatt

SEQ ID NO: 12607 - DNA, 661 bp, Artificial Sequence
  chemically treated genomic DNA (Homo sapiens) CpG-island No: 12607
gaagtgtatttttttaaggaaattgagatttataggtatatatattttagtcgttaataagtttcggagttttacgattaagattagcgagttttttttcgggattttataatcgggttttcggaacgacggggaggcgtcgtatttatttagttttcgaagtggcggttttcgttttgtagtagttttttaaattggatggtgtagttggttacgaagtcgtcgtagtttatgggggtatcgtgaaagatagttagttcgattttgcgttcgttgtatatatcggtgacgaattcgtcgtgttaggtcgggttgttggttttttgtttggtggtcgtttggtcgatgcgcgagtcgtttatattgagggtaatgtaggggtcgagaaggaaagtttgcggtcggggttttatcgtatggcgtagcgattaggttgtgggttttaagtttacggtttcgtagattttgattttaagaaggttattgaatattattatggtcggggcggggagtgggggtcggggttatttcgtttgtttcgagggtaggaatgaagaatcgacggttcggtatttcgagttatagggatttttgggttttttttcgttttatttcgtatattttttatattttgtggcgttgcgttttggcgcgggcgatt

SEQ ID NO: 12608 - DNA, 661 bp, Artificial Sequence
  chemically treated genomic DNA (Homo sapiens) CpG-island No: 12608
aatcgcccgcgccaaaacgcaacgccacaaaatataaaaaatatacgaaataaaacgaaaaaaaacccaaaaatccctataactcgaaataccgaaccgtcgattcttcattcctaccctcgaaacaaacgaaataaccccgacccccactccccgccccgaccataataatattcaataaccttcttaaaatcaaaatctacgaaaccgtaaacttaaaacccacaacctaatcgctacgccatacgataaaaccccgaccgcaaactttccttctcgacccctacattaccctcaatataaacgactcgcgcatcgaccaaacgaccaccaaacaaaaaaccaacaacccgacctaacacgacgaattcgtcaccgatatatacaacgaacgcaaaatcgaactaactatctttcacgatacccccataaactacgacgacttcgtaaccaactacaccatccaatttaaaaaactactacaaaacgaaaaccgccacttcgaaaactaaataaatacgacgcctccccgtcgttccgaaaacccgattataaaatcccgaaaaaaaactcgctaatcttaatcgtaaaactccgaaacttattaacgactaaaatatatatacctataaatctcaatttccttaaaaaaatacacttc

SEQ ID NO: 12609 - DNA, 571 bp, Artificial Sequence
  chemically treated genomic DNA (Homo sapiens) CpG-island No: 12609
tttcgtttgttgcgttgtcgttttgttttttttttcgttttttttttttcgttttcgtttttttttttcgttttttttttttcgttttttttcgttttttttttttcgttttcgtttttttttttttttttttttttcgttttcgttcgcgttcgttcgttttttcgtttttgttcgttggcgttttttcgttttcgcgcgcgttttcgttcgcggttcgttttcgttcgttttttcgttttttcgttcgtttttttttttcgttttttttcggcgtcgttttcgtcgttttttttttttttttgttttttcgtttttcgttttgtttttttgtttttttttttttcgtttttttttttttcgttttttttttttttttttttttttttgtttttcgttttttttcgcgtcgcgtttttcgttcgcgtcgtgtcgtttgggttgttttcggcgggtgcgcggcggcgcgtcgtcggttcgcgtcgttttttttttgtcggggtcggtttcgggttcgcggtcgttacgttttcgttcgttttttgttgtcggttcgcgggtcggtggtttt

SEQ ID NO: 12610 - DNA, 571 bp, Artificial Sequence
  chemically treated genomic DNA (Homo sapiens) CpG-island No: 12610
aaaaccaccgacccgcgaaccgacaacaaaaaacgaacgaaaacgtaacgaccgcgaacccgaaaccgaccccgacaaaaaaaaaacgacgcgaaccgacgacgcgccgccgcgcacccgccgaaaacaacccaaacgacacgacgcgaacgaaaaacgcgacgcgaaaaaaaacgaaaaacaaaaaaaaaaaaaaaaaaaaaaaaaacgaaaaaaaaaaaaacgaaaaaaaaaaaaacaaaaaaacaaaacgaaaaacgaaaaaacaaaaaaaaaaaaaaaacgacgaaaacgacgccgaaaaaaaacgaaaaaaaaaaacgaacgaaaaaacgaaaaaacgaacgaaaacgaaccgcgaacgaaaacgcgcgcgaaaacgaaaaaacgccaacgaacaaaaacgaaaaaacgaacgaacgcgaacgaaaacgaaaaaaaaaaaaaaaaaaaaaaacgaaaacgaaaaaaaaaaaacgaaaaaaaacgaaaaaaaaaaaacgaaaaaaaaaaacgaaaacgaaaaaaaaaaaacgaaaaaaaaaacaaaacgacaacgcaacaaacgaaa

SEQ ID NO: 12611 - DNA, 571 bp, Artificial Sequence
  chemically treated genomic DNA (Homo sapiens) CpG-island No: 12611
gagattatcgattcgcgagtcggtagtaggaaacgggcggaggcgtggcggtcgcggattcggggtcggtttcggtagagggagagcggcgcggatcgacgacgcgtcgtcgcgtattcgtcggaagtagtttaggcggtacggcgcgggcgagaggcgcggcgcggaggagagcgggaggtaggagggggggagaggggggggaggacgagggaaagagaggcggagggggaggagatagggaagtagggcggagggcgggggggtaggggggggggggaggcggcggagacggcgtcggggggggacgggggggggaggcgggcggggaggcgggggggcgggcgagggcgggtcgcgggcgagagcgcgcgcgagaacggagagacgttagcgggtaggggcgagaggacgggcgggcgcgggcgagggcgaggagagggaggggggagggagacgaagacggggaggggggggcgggggggggcgggaggggaggagcggggagggggggcgagggcgaggggggggaggcgggggggagggtagagcggtagcgtagtaggcggag

SEQ ID NO: 12612 - DNA, 571 bp, Artificial Sequence
  chemically treated genomic DNA (Homo sapiens) CpG-island No: 12612
ctccgcctactacgctaccgctctaccctcccccccgcctcccccccctcgccctcgccccccctccccgctcctcccctcccgcccccccccgcccccccctccccgtcttcgtctccctcccccctccctctcctcgccctcgcccgcgcccgcccgtcctctcgcccctacccgctaacgtctctccgttctcgcgcgcgctctcgcccgcgacccgccctcgcccgcccccccgcctccccgcccgcctcccccccccgtccccccccgacgccgtctccgccgcctcccccccccccctacccccccgccctccgccctacttccctatctcctccccctccgcctctctttccctcgtcctcccccccctctccccccctcctacctcccgctctcctccgcgccgcgcctctcgcccgcgccgtaccgcctaaactacttccgacgaatacgcgacgacgcgtcgtcgatccgcgccgctctccctctaccgaaaccgaccccgaatccgcgaccgccacgcctccgcccgtttcctactaccgactcgcgaatcgataatctc

SEQ ID NO: 12613 - DNA, 605 bp, Artificial Sequence
  chemically treated genomic DNA (Homo sapiens) CpG-island No: 12613
ttacgttcggggcgttgttttttttttcggaagtttggttttgtttttgcgtttatttgtgcgggaattcggttatcgcgtgtttcgggacggttttcgcgcgggttggggcgggagagttcggcgcgttcgagggttgtttttcgtagagtcgcgtcgtttcggtagcgtttcggggttcggtcggagcgcgatttttcgtcgttaggttcgggattcgatcgggagaggcgtagggttgttttttagtattcgcgggcgttcggtcgtagggggaaggaggaggcggcgacgagggttgggagattcgtgggcgtcggtttagcgcgtcgcgttttggggttgaggtttaggggtaggggtcgtgcgggggtcggtaggcgcgggcggcggcgagcgcggtttttcggattttttttttgtatcgcggcggcggcggttgttaggggcgcgcgcggggttttttacggcgggagcgcggtcgagttcggggaagttcgttagtattttttcgttcgttcgcgtcgagtcgagttatgtcgagttcgggttcggcgtgttgtatagttatttttcgcgcggcgtcggcggtttcggggttacgt

SEQ ID NO: 12614 - DNA, 605 bp, Artificial Sequence
  chemically treated genomic DNA (Homo sapiens) CpG-island No: 12614
acgtaaccccgaaaccgccgacgccgcgcgaaaaataactatacaacacgccgaacccgaactcgacataactcgactcgacgcgaacgaacgaaaaaatactaacgaacttccccgaactcgaccgcgctcccgccgtaaaaaaccccgcgcgcgcccctaacaaccgccgccgccgcgatacaaaaaaaaaatccgaaaaaccgcgctcgccgccgcccgcgcctaccgacccccgcacgacccctacccctaaacctcaaccccaaaacgcgacgcgctaaaccgacgcccacgaatctcccaaccctcgtcgccgcctcctccttccccctacgaccgaacgcccgcgaatactaaaaaacaaccctacgcctctcccgatcgaatcccgaacctaacgacgaaaaatcgcgctccgaccgaaccccgaaacgctaccgaaacgacgcgactctacgaaaaacaaccctcgaacgcgccgaactctcccgccccaacccgcgcgaaaaccgtcccgaaacacgcgataaccgaattcccgcacaaataaacgcaaaaacaaaaccaaacttccgaaaaaaaaaacaacgccccgaacgtaa

SEQ ID NO: 12615 - DNA, 605 bp, Artificial Sequence
  chemically treated genomic DNA (Homo sapiens) CpG-island No: 12615
gcgtggtttcggagtcgtcggcgtcgcgcgaggaatagttgtgtagtacgtcgagttcggattcggtatggttcggttcggcgcgggcgggcgagaggatgttggcgggttttttcgggttcggtcgcgttttcgtcgtggagggtttcgcgcgcgtttttagtagtcgtcgtcgtcgcggtgtaggggaggggttcggagagtcgcgttcgtcgtcgttcgcgtttgtcggttttcgtacggtttttgtttttgagttttagttttagggcgcggcgcgttgggtcggcgtttacggattttttagttttcgtcgtcgttttttttttttttttgcggtcgggcgttcgcggatgttgaggggtagttttgcgtttttttcggtcggatttcgggtttgacggcgggagatcgcgtttcggtcgggtttcgaggcgttgtcggggcggcgcggttttgcggggagtagttttcgggcgcgtcgagttttttcgttttagttcgcgcggggatcgtttcggagtacgcggtggtcgagttttcgtataggtaaacgtaggggtagggttaggttttcgggggggaagatagcgtttcgagcgtgg

SEQ ID NO: 12616 - DNA, 605 bp, Artificial Sequence
  chemically treated genomic DNA (Homo sapiens) CpG-island No: 12616
ccacgctcgaaacgctatcttcccccccgaaaacctaaccctacccctacgtttacctatacgaaaactcgaccaccgcgtactccgaaacgatccccgcgcgaactaaaacgaaaaaactcgacgcgcccgaaaactactccccgcaaaaccgcgccgccccgacaacgcctcgaaacccgaccgaaacgcgatctcccgccgtcaaacccgaaatccgaccgaaaaaaacgcaaaactacccctcaacatccgcgaacgcccgaccgcaaaaaaaaaaaaaaaacgacgacgaaaactaaaaaatccgtaaacgccgacccaacgcgccgcgccctaaaactaaaactcaaaaacaaaaaccgtacgaaaaccgacaaacgcgaacgacgacgaacgcgactctccgaacccctcccctacaccgcgacgacgacgactactaaaaacgcgcgcgaaaccctccacgacgaaaacgcgaccgaacccgaaaaaacccgccaacatcctctcgcccgcccgcgccgaaccgaaccataccgaatccgaactcgacgtactacacaactattcctcgcgcgacgccgacgactccgaaaccacgc

SEQ ID NO: 12617 - DNA, 587 bp, Artificial Sequence
  chemically treated genomic DNA (Homo sapiens) CpG-island No: 12617
  misc_feature (27)..(32): n is either a, c, g or t
cgttagttaggtaagaaggataatttnnnnnnttcgcgatttcgtatttcgattcgcgttcgtttttttttttcgtcgtatttgttagcgttttaatacgtttcgtcgcgagcgattttttcgatttcgtatacgtttcggcgtatgggagggaggagtagcggagagtaggagggcggaagacgaggatacgtgggagtcgggagagagaaagagatttagatattattgcggggggggcggtgggagcgtaagggtaggagggaggcgggaaaggcgaggaaagaagagcggacgtggggggagcgaagaagggaagggagaagtgagaaagaggaatgtaaatgtagagggggttgtgagaggggagagataggaagtagaggttacgggggaggagggtgagatggagacgtttgggaggggataggaatggtagtaggtggatggtgaaggagggtggggttggagggtagaagggaggagggcgagcgaggggatggggatggtaggtacgtgttatagatatgcgcgtatatacgtatatatatatatatatatatatatagtttgtgtttttttttttg

SEQ ID NO: 12618 - DNA, 587 bp, Artificial Sequence
  chemically treated genomic DNA (Homo sapiens) CpG-island No: 12618
  misc_feature (556)..(561): n is either a, c, g or t
caaaaaaaaaaacacaaactatatatatatatatatatatatatacgtatatacgcgcatatctataacacgtacctaccatccccatcccctcgctcgccctcctcccttctaccctccaaccccaccctccttcaccatccacctactaccattcctatcccctcccaaacgtctccatctcaccctcctcccccgtaacctctacttcctatctctcccctctcacaaccccctctacatttacattcctctttctcacttctcccttcccttcttcgctccccccacgtccgctcttctttcctcgcctttcccgcctccctcctacccttacgctcccaccgccccccccgcaataatatctaaatctctttctctctcccgactcccacgtatcctcgtcttccgccctcctactctccgctactcctccctcccatacgccgaaacgtatacgaaatcgaaaaaatcgctcgcgacgaaacgtattaaaacgctaacaaatacgacgaaaaaaaaaaacgaacgcgaatcgaaatacgaaatcgcgaannnnnnaaattatccttcttacctaactaacg

SEQ ID NO: 12619 - DNA, 587 bp, Artificial Sequence
  chemically treated genomic DNA (Homo sapiens) CpG-island No: 12619
  misc_feature (556)..(561): n is either a, c, g or t
tagagaaagagatatagattgtgtgtgtgtgtgtgtgtgtgtgtgcgtgtgtgcgcgtatgtttgtgatacgtgtttattatttttattttttcgttcgttttttttttttttattttttaattttatttttttttattatttatttattattatttttatttttttttagacgtttttattttatttttttttttcgtaatttttattttttatttttttttttttataattttttttatatttatattttttttttttattttttttttttttttttcgttttttttacgttcgttttttttttttcgtttttttcgttttttttttgtttttgcgtttttatcgtttttttcgtaatgatatttaaatttttttttttttttcggtttttacgtgttttcgtttttcgtttttttgtttttcgttgttttttttttttatacgtcgaggcgtgtgcgaggtcggggaggtcgttcgcggcgagacgtgttggggcgttggtaggtgcggcggggggggggggcgggcgcgagtcggggtgcggagtcgcgggnnnnnngagttgttttttttgtttagttagcg

SEQ ID NO: 12620 - DNA, 587 bp, Artificial Sequence
  chemically treated genomic DNA (Homo sapiens) CpG-island No: 12620
  misc_feature (27)..(32): n is either a, c, g or t
cgctaactaaacaaaaaaaacaactcnnnnnncccgcgactccgcaccccgactcgcgcccgccccccccccccgccgcacctaccaacgccccaacacgtctcgccgcgaacgacctccccgacctcgcacacgcctcgacgtataaaaaaaaaaaacaacgaaaaacaaaaaaacgaaaaacgaaaacacgtaaaaaccgaaaaaaaaaaaaaaatttaaatatcattacgaaaaaaacgataaaaacgcaaaaacaaaaaaaaaacgaaaaaaacgaaaaaaaaaaaacgaacgtaaaaaaaacgaaaaaaaaaaaaaaaaaataaaaaaaaaaaatataaatataaaaaaaattataaaaaaaaaaaaataaaaaataaaaattacgaaaaaaaaaaataaaataaaaacgtctaaaaaaaaataaaaataataataaataaataataaaaaaaaataaaattaaaaaataaaaaaaaaaaaaacgaacgaaaaaataaaaataataaacacgtatcacaaacatacgcgcacacacgcacacacacacacacacacacacacaatctatatctctttctcta

SEQ ID NO: 12621 - DNA, 913 bp, Artificial Sequence
  chemically treated genomic DNA (Homo sapiens) CpG-island No: 12621
agacggagcgcggggggcggggcggggttcgcgttaagggagcgcggaagggcgggataggtcgtgggcggggtttgggtggggcggacggttgggggtggggaaaggggcgtaatcgggagaatttttcgaggcggaggacgtaggggggcggggaaggcgggttatggggcgggggcggtggggcgagttatggggcggggacggggcggggcgtagtcgggagggttttttcgaggcggaattgcgtggggggcggggcgggtcgtgggacgggcggaggcgttcgagtttcgttttttcggcgtttttttatttcgagttcgatttagttcgcggttatttgcgtttcgtttttgtcggtcgcgttcgagtttagcgtcgcgagtcgtttttcggcgggttggtttttggtttcggaagcgcgagcgtttatttagcggcgagtggtttcgttttcgcggatagagcgcgcgttttttggttcggttcgcgaggggttttcggcgcggttttcgagtatttttcgtcgggtggagcgggtcgagcgcgtaggatgattagtttcgcgtcgtttaaagtcgggagatcgattgtttgagttcggaagcgtagaagttggtaagaggaaagcgttttcgaaattttttttcgtgattgcggcggggttttaggggtttttagttcgtttcgaggttaatggtaggcgtaggtgttcgggaggcgtggggtgggttttggcgggattttagcgcggtgggagcgggcgtagtgggcgcgggttcgtgagtggttcggcgagcggcgttttttatgcgttaggaagtacgttttattgtgggacgttatttttaaggacgaaaaggtatatggttttttttcgttcgaggtgatgggttgtagataggttttg

SEQ ID NO: 12622 - DNA, 913 bp, Artificial Sequence
  chemically treated genomic DNA (Homo sapiens) CpG-island No: 12622
caaaacctatctacaacccatcacctcgaacgaaaaaaaaccatataccttttcgtccttaaaaataacgtcccacaataaaacgtacttcctaacgcataaaaaacgccgctcgccgaaccactcacgaacccgcgcccactacgcccgctcccaccgcgctaaaatcccgccaaaacccaccccacgcctcccgaacacctacgcctaccattaacctcgaaacgaactaaaaacccctaaaaccccgccgcaatcacgaaaaaaaatttcgaaaacgctttcctcttaccaacttctacgcttccgaactcaaacaatcgatctcccgactttaaacgacgcgaaactaatcatcctacgcgctcgacccgctccacccgacgaaaaatactcgaaaaccgcgccgaaaacccctcgcgaaccgaaccaaaaaacgcgcgctctatccgcgaaaacgaaaccactcgccgctaaataaacgctcgcgcttccgaaaccaaaaaccaacccgccgaaaaacgactcgcgacgctaaactcgaacgcgaccgacaaaaacgaaacgcaaataaccgcgaactaaatcgaactcgaaataaaaaaacgccgaaaaaacgaaactcgaacgcctccgcccgtcccacgacccgccccgccccccacgcaattccgcctcgaaaaaaccctcccgactacgccccgccccgtccccgccccataactcgccccaccgcccccgccccataacccgccttccccgcccccctacgtcctccgcctcgaaaaattctcccgattacgcccctttccccacccccaaccgtccgccccacccaaaccccgcccacgacctatcccgcccttccgcgctcccttaacgcgaaccccgccccgccccccgcgctccgtct

SEQ ID NO: 12623 - DNA, 913 bp, Artificial Sequence
  chemically treated genomic DNA (Homo sapiens) CpG-island No: 12623
tagagtttgtttgtagtttattatttcgggcggggagagattatgtgttttttcgtttttggaggtggcgttttataataaagcgtgttttttagcgtatgagggacgtcgttcgtcgggttatttacggattcgcgtttattgcgttcgtttttatcgcgttggggtttcgttagagtttattttacgtttttcgggtatttgcgtttgttattgatttcggaacgagttggaagtttttgaaatttcgtcgtagttacgaaagaaagtttcggaagcgttttttttttattagtttttgcgttttcgggtttaaatagtcgatttttcggttttgagcggcgcggggttggttattttgcgcgttcggttcgttttattcggcgggaaatgttcggggatcgcgtcgggagtttttcgcgggtcgggttagggggcgcgcgttttgttcgcggagacggagttattcgtcgttaagtgaacgttcgcgttttcggggttaggagttagttcgtcggggagcggttcgcggcgttgggttcgggcgcggtcgataggggcggggcgtaggtggtcgcgggttgagtcgggttcggggtggaagggcgtcggggaagcgggattcgggcgttttcgttcgttttacggttcgtttcgttttttacgtagtttcgtttcggaggggttttttcggttacgtttcgtttcgttttcgttttatgattcgttttatcgttttcgttttatgattcgtttttttcgtttttttgcgtttttcgtttcggagggttttttcggttacgtttttttttttatttttaatcgttcgttttatttaggtttcgtttacggtttgtttcgttttttcgcgtttttttaacgcgagtttcgtttcgtttttcgcgtttcgttt

SEQ ID NO: 12624 - DNA, 913 bp, Artificial Sequence
  chemically treated genomic DNA (Homo sapiens) CpG-island No: 12624
aaacgaaacgcgaaaaacgaaacgaaactcgcgttaaaaaaacgcgaaaaaacgaaacaaaccgtaaacgaaacctaaataaaacgaacgattaaaaataaaaaaaaaaacgtaaccgaaaaaaccctccgaaacgaaaaacgcaaaaaaacgaaaaaaacgaatcataaaacgaaaacgataaaacgaatcataaaacgaaaacgaaacgaaacgtaaccgaaaaaacccctccgaaacgaaactacgtaaaaaacgaaacgaaccgtaaaacgaacgaaaacgcccgaatcccgcttccccgacgcccttccaccccgaacccgactcaacccgcgaccacctacgccccgcccctatcgaccgcgcccgaacccaacgccgcgaaccgctccccgacgaactaactcctaaccccgaaaacgcgaacgttcacttaacgacgaataactccgtctccgcgaacaaaacgcgcgccccctaacccgacccgcgaaaaactcccgacgcgatccccgaacatttcccgccgaataaaacgaaccgaacgcgcaaaataaccaaccccgcgccgctcaaaaccgaaaaatcgactatttaaacccgaaaacgcaaaaactaataaaaaaaaaacgcttccgaaactttctttcgtaactacgacgaaatttcaaaaacttccaactcgttccgaaatcaataacaaacgcaaatacccgaaaaacgtaaaataaactctaacgaaaccccaacgcgataaaaacgaacgcaataaacgcgaatccgtaaataacccgacgaacgacgtccctcatacgctaaaaaacacgctttattataaaacgccacctccaaaaacgaaaaaacacataatctctccccgcccgaaataataaactacaaacaaactcta

SEQ ID NO: 12625 - DNA, 689 bp, Artificial Sequence
  chemically treated genomic DNA (Homo sapiens) CpG-island No: 12625
  misc_feature (96)..(97): n is either a, c, g or t
gggatacgttttaaaggtttacgaggttttttttatattatttatggtttttaggattagttgtaattcgttaacgttattcggcgatataatgtnnttgtcgtaaacgcgttgtttatattggtgattacgggtttagatatagtgtggggagtggggtggcggggggcgttggaagttattttgattaattgtgacgtatagtatttgcgagaatgtcgtttacgatattcgtcgatgatacgttatcgcgttatcgattattgtacgtttgaggatttttttgatcgtatagattggatagttttgcgacgttcgttcgcgtttatatatggggtgggtgggtgggtgcggttgacgacggatgtgtttcgtgttgagtatattacggggtttatcgggtattgatattattcgtagatttaaagtatacgtgagttgtttgggtcggtttgtcgtttatggtcgtttggtttgttgttgttgtttatttgttgataggtgcggcggtttgtatcgtttttttattttatcgatgttttataggatttgttgtaaattcgttttcgataatttacgatgtttttatgtcgcgatcgcgatgattatttaaggtgttacgggttttgatatagtaggggaagtggggggaattttggtttataatttttatttattgtatttgttgg

SEQ ID NO: 12626 - DNA, 689 bp, Artificial Sequence
  chemically treated genomic DNA (Homo sapiens) CpG-island No: 12626
  misc_feature (593)..(594): n is either a, c, g or t
ccaacaaatacaataaataaaaattataaaccaaaattccccccacttcccctactatatcaaaacccgtaacaccttaaataatcatcgcgatcgcgacataaaaacatcgtaaattatcgaaaacgaatttacaacaaatcctataaaacatcgataaaataaaaaaacgatacaaaccgccgcacctatcaacaaataaacaacaacaacaaaccaaacgaccataaacgacaaaccgacccaaacaactcacgtatactttaaatctacgaataatatcaatacccgataaaccccgtaatatactcaacacgaaacacatccgtcgtcaaccgcacccacccacccaccccatatataaacgcgaacgaacgtcgcaaaactatccaatctatacgatcaaaaaaatcctcaaacgtacaataatcgataacgcgataacgtatcatcgacgaatatcgtaaacgacattctcgcaaatactatacgtcacaattaatcaaaataacttccaacgccccccgccaccccactccccacactatatctaaacccgtaatcaccaatataaacaacgcgtttacgacaannacattatatcgccgaataacgttaacgaattacaactaatcctaaaaaccataaataatataaaaaaaacctcgtaaacctttaaaacgtatccc

SEQ ID NO: 12627 - DNA, 689 bp, Artificial Sequence
  chemically treated genomic DNA (Homo sapiens) CpG-island No: 12627
  misc_feature (593)..(594): n is either a, c, g or t
ttagtaaatgtagtaagtgggagttgtgagttaagattttttttattttttttattatattaaaattcgtggtattttaggtaattatcgcgatcgcggtatggggatatcgtaggttgtcgaaggcgggtttatagtaaattttgtaagatatcggtgaagtgggaaggcggtataagtcgtcgtatttgttagtaggtaagtagtagtaataagttaagcggttataggcgataagtcggtttaagtaatttacgtatattttaaatttacgggtaatattagtgttcggtaaatttcgtggtgtgtttaatacggaatatattcgtcgttagtcgtatttatttatttattttatatgtaaacgcgagcgaacgtcgtaaagttatttagtttatacggttaaaaagatttttaagcgtgtagtagtcgatggcgcggtagcgtattatcggcgggtgtcgtaggcggtattttcgtaaatgttgtacgttatagttggttagggtagtttttaacgtttttcgttattttattttttatattatgtttaaattcgtggttattagtgtaagtaacgcgtttgcggtaanngtattatatcgtcgggtggcgttggcgggttatagttaattttgaaagttataggtggtgtgggaagggtttcgtgaatttttagggcgtatttt

SEQ ID NO: 12628 - DNA, 689 bp, Artificial Sequence
  chemically treated genomic DNA (Homo sapiens) CpG-island No: 12628
  misc_feature (96)..(97): n is either a, c, g or t
aaaatacgccctaaaaattcacgaaacccttcccacaccacctataactttcaaaattaactataacccgccaacgccacccgacgatataatacnnttaccgcaaacgcgttacttacactaataaccacgaatttaaacataatataaaaaataaaataacgaaaaacgttaaaaactaccctaaccaactataacgtacaacatttacgaaaataccgcctacgacacccgccgataatacgctaccgcgccatcgactactacacgcttaaaaatctttttaaccgtataaactaaataactttacgacgttcgctcgcgtttacatataaaataaataaataaatacgactaacgacgaatatattccgtattaaacacaccacgaaatttaccgaacactaatattacccgtaaatttaaaatatacgtaaattacttaaaccgacttatcgcctataaccgcttaacttattactactacttacctactaacaaatacgacgacttataccgccttcccacttcaccgatatcttacaaaatttactataaacccgccttcgacaacctacgatatccccataccgcgatcgcgataattacctaaaataccacgaattttaatataataaaaaaaataaaaaaaatcttaactcacaactcccacttactacatttactaa

SEQ ID NO: 12629 - DNA, 586 bp, Artificial Sequence
  chemically treated genomic DNA (Homo sapiens) CpG-island No: 12629
ttgtcggttcggtatcgtcgttatcgttgatatattttttattacgtagtgttagtattagagaattgaatatcgttttgtcgaagaatttcggcgcgttgatgtcgtgtagtacggagagacgttgcgcgacggtgcggttttttttttttagcgtatcgcggttgatcgacgggttggtatttaataattagaaggtgatggtataacgttgtagcgtttcgcgcgcgtttgcggttagtagttgtagcgtgcgagaatgcgtcgggttgatatgtaatttattattttgtagggtaattagtttttgacgttgtattttatttgttagcgtattaataacgttcggtaattcgtcgcgattttagcgtaggaatagtttcgtttttagtattgggtaaagtatattgacgtgttttattaatacgtcgcgggagatgtggcgatgttgggtgacgattgtcgttattagcgaaggtagtattaatatatgcgtaatggttgttgcgatagtaggttattagtatcgtttgttcgcgcggtagaatgatgatgtcgtcgattgtgtttttttcgattttaaatt

SEQ ID NO: 12630 - DNA, 586 bp, Artificial Sequence
  chemically treated genomic DNA (Homo sapiens) CpG-island No: 12630
aatttaaaatcgaaaaaaacacaatcgacgacatcatcattctaccgcgcgaacaaacgatactaataacctactatcgcaacaaccattacgcatatattaatactaccttcgctaataacgacaatcgtcacccaacatcgccacatctcccgcgacgtattaataaaacacgtcaatatactttacccaatactaaaaacgaaactattcctacgctaaaatcgcgacgaattaccgaacgttattaatacgctaacaaataaaatacaacgtcaaaaactaattaccctacaaaataataaattacatatcaacccgacgcattctcgcacgctacaactactaaccgcaaacgcgcgcgaaacgctacaacgttataccatcaccttctaattattaaataccaacccgtcgatcaaccgcgatacgctaaaaaaaaaaaaccgcaccgtcgcgcaacgtctctccgtactacacgacatcaacgcgccgaaattcttcgacaaaacgatattcaattctctaatactaacactacgtaataaaaaatatatcaacgataacgacgataccgaaccgacaa

SEQ ID NO: 12631 - DNA, 586 bp, Artificial Sequence
  chemically treated genomic DNA (Homo sapiens) CpG-island No: 12631
agtttgaagtcgagaaagatataatcggcgatattattattttgtcgcgcgagtaagcggtgttgatgatttattatcgtaataattattgcgtatatgttggtgttgttttcgttgatggcggtaatcgttatttagtatcgttatatttttcgcgacgtattgatggagtacgttaatgtgttttatttaatgttgaaagcggagttgtttttgcgttgggatcgcgacgagttgtcggacgttattgatgcgttggtaaatgagatgtaacgttaggggttgattattttgtaagatgatgagttgtatattaattcggcgtattttcgtacgttatagttgttggtcgtaggcgcgcgcgaaacgttgtaacgttatgttattattttttggttgttgagtgttaattcgtcgattaatcgcggtacgttggagaaagagagtcgtatcgtcgcgtaacgttttttcgtgttgtacggtattaacgcgtcggagtttttcgataaggcggtgtttagttttttggtgttgatattgcgtgatgaagggtatattagcgatagcggcgatgtcgaatcggtag

SEQ ID NO: 12632 - DNA, 586 bp, Artificial Sequence
  chemically treated genomic DNA (Homo sapiens) CpG-island No: 12632
ctaccgattcgacatcgccgctatcgctaatatacccttcatcacgcaatatcaacaccaaaaaactaaacaccgccttatcgaaaaactccgacgcgttaataccgtacaacacgaaaaaacgttacgcgacgatacgactctctttctccaacgtaccgcgattaatcgacgaattaacactcaacaaccaaaaaataataacataacgttacaacgtttcgcgcgcgcctacgaccaacaactataacgtacgaaaatacgccgaattaatatacaactcatcatcttacaaaataatcaacccctaacgttacatctcatttaccaacgcatcaataacgtccgacaactcgtcgcgatcccaacgcaaaaacaactccgctttcaacattaaataaaacacattaacgtactccatcaatacgtcgcgaaaaatataacgatactaaataacgattaccgccatcaacgaaaacaacaccaacatatacgcaataattattacgataataaatcatcaacaccgcttactcgcgcgacaaaataataatatcgccgattatatctttctcgacttcaaact

SEQ ID NO: 12633 - DNA, 531 bp, Artificial Sequence
  chemically treated genomic DNA (Homo sapiens) CpG-island No: 12633
ttcgtcgaacgcgtttagtatattcgcgatcgtatgagcgcggatgggattaagtaaagtttggtggtgtcgaacgtaggttagataaggcgtttacgtcgtatttgtatgattggtatatttgttattttgtgcgtattgtcggatgcgatgttggcgtattttattcggtttacgggtgtcgaacgtaggtcggataaggcgtttacgtcgtattcgatattaatggtacgttttattcgtgcgtatcgtatttggtgtttattcgttttttttcgtcgtttgaatatatagtatttttagcgttagcgttgtcgttgttagagtagtgattttcgattgatcgtatgtcggagttatttttattacgtttattttaataatgttgagattttttaggtcgcgtattagtttaatagcgcgatcggaggttaggtcgttaattattggcgtatcggtgtttggtgtaaaagtaggatttagggtagtcgatattaaaagttagggtaattcgggtatattattttataa

SEQ ID NO: 12634 - DNA, 531 bp, Artificial Sequence
  chemically treated genomic DNA (Homo sapiens) CpG-island No: 12634
ttataaaataatatacccgaattaccctaacttttaatatcgactaccctaaatcctacttttacaccaaacaccgatacgccaataattaacgacctaacctccgatcgcgctattaaactaatacgcgacctaaaaaatctcaacattattaaaataaacgtaataaaaataactccgacatacgatcaatcgaaaatcactactctaacaacgacaacgctaacgctaaaaatactatatattcaaacgacgaaaaaaaacgaataaacaccaaatacgatacgcacgaataaaacgtaccattaatatcgaatacgacgtaaacgccttatccgacctacgttcgacacccgtaaaccgaataaaatacgccaacatcgcatccgacaatacgcacaaaataacaaatataccaatcatacaaatacgacgtaaacgccttatctaacctacgttcgacaccaccaaactttacttaatcccatccgcgctcatacgatcgcgaatatactaaacgcgttcgacgaa

SEQ ID NO: 12635 - DNA, 531 bp, Artificial Sequence
  chemically treated genomic DNA (Homo sapiens) CpG-island No: 12635
ttgtggggtgatatgttcgggttattttgatttttgatatcgattgttttggattttgtttttgtattaggtatcggtacgttagtgattggcggtttgattttcgatcgcgttattaaattggtacgcggtttgaaagattttaatattgttgggatggacgtagtggaagtggtttcggtatacgattagtcggaaattattgttttggtagcggtaacgttggcgttggaaatgttgtatatttaggcggcgaaaaagggcgagtaagtattagatgcgatgcgtacgggtaaaacgtgttattaatgtcggatgcggcgtgaacgttttattcgatttacgttcggtattcgtaggtcggataagatgcgttagtatcgtattcggtaatgcgtataaggtaataaatgtgttaattatgtagatgcggcgtgaacgttttatttgatttacgttcgatattattaggttttatttaattttattcgcgtttatgcgatcgcgaatatgttgggcgcgttcggcgga

SEQ ID NO: 12636 - DNA, 531 bp, Artificial Sequence
  chemically treated genomic DNA (Homo sapiens) CpG-island No: 12636
tccgccgaacgcgcccaacatattcgcgatcgcataaacgcgaataaaattaaataaaacctaataatatcgaacgtaaatcaaataaaacgttcacgccgcatctacataattaacacatttattaccttatacgcattaccgaatacgatactaacgcatcttatccgacctacgaataccgaacgtaaatcgaataaaacgttcacgccgcatccgacattaataacacgttttacccgtacgcatcgcatctaatacttactcgccctttttcgccgcctaaatatacaacatttccaacgccaacgttaccgctaccaaaacaataatttccgactaatcgtataccgaaaccacttccactacgtccatcccaacaatattaaaatctttcaaaccgcgtaccaatttaataacgcgatcgaaaatcaaaccgccaatcactaacgtaccgatacctaatacaaaaacaaaatccaaaacaatcgatatcaaaaatcaaaataacccgaacatatcaccccacaa

SEQ ID NO: 12637 - DNA, 525 bp, Artificial Sequence
  chemically treated genomic DNA (Homo sapiens) CpG-island No: 12637
gtgggcgtcggtcgttcgtttttttatcgtggcgttttttattcggttattcggggtacggttaggggttttatcgagtttcgggtttatcgtggtcgcggtcgtcggtcgtcgggagttcggagtcgggacgcgagggttgggggttggggatgggttttagtgtcgcgcgggagtttaaagttcggtattggtacggggtttcgtcgtcgtagtcgttggagttttgggtttttcgtcgcggggagagcggggggagggcgtttgtttcggagtgattcggcggcggaggaagggcgggtcgtaggcggcgggttcgggggattttgagcgggcgggcgaggagcgggtgagatcgaggtcgatagagtgggggttttacgaggttcgcgtttggtcgggaagagagtaggagattttttcgcgagtttagattcggtattgagggaagagatatttcgagttttgcgtttttaagttttgttttaatgtttttgatattgaatgtatgtgtggcgtttattt

SEQ ID NO: 12638 - DNA, 525 bp, Artificial Sequence
  chemically treated genomic DNA (Homo sapiens) CpG-island No: 12638
aaataaacgccacacatacattcaatatcaaaaacattaaaacaaaacttaaaaacgcaaaactcgaaatatctcttccctcaataccgaatctaaactcgcgaaaaaatctcctactctcttcccgaccaaacgcgaacctcgtaaaacccccactctatcgacctcgatctcacccgctcctcgcccgcccgctcaaaatcccccgaacccgccgcctacgacccgcccttcctccgccgccgaatcactccgaaacaaacgccctccccccgctctccccgcgacgaaaaacccaaaactccaacgactacgacgacgaaaccccgtaccaataccgaactttaaactcccgcgcgacactaaaacccatccccaacccccaaccctcgcgtcccgactccgaactcccgacgaccgacgaccgcgaccacgataaacccgaaactcgataaaacccctaaccgtaccccgaataaccgaataaaaaacgccacgataaaaaaacgaacgaccgacgcccac

SEQ ID NO: 12639 - DNA, 525 bp, Artificial Sequence
  chemically treated genomic DNA (Homo sapiens) CpG-island No: 12639
ggatagacgttatatatgtatttaatgttaagggtattggagtaaaatttggagacgtaggattcggagtgtttttttttttagtgtcgggtttgagttcgcgggggaattttttatttttttttcgattaggcgcgggtttcgtggggtttttattttgtcgatttcggttttattcgtttttcgttcgttcgtttaaggtttttcgggttcgtcgtttgcggttcgtttttttttcgtcgtcgggttatttcgggataggcgtttttttttcgtttttttcgcggcggggagtttaaggttttagcggttgcggcggcggagtttcgtgttagtgtcgggttttgaattttcgcgcgatattgggatttatttttaatttttaattttcgcgtttcggtttcgggttttcggcgatcggcggtcgcgattacggtggattcggggttcggtgaagtttttggtcgtgtttcgggtggtcgagtaaagggcgttacggtgaggagacggacggtcggcgtttat

SEQ ID NO: 12640 - DNA, 525 bp, Artificial Sequence
  chemically treated genomic DNA (Homo sapiens) CpG-island No: 12640
ataaacgccgaccgtccgtctcctcaccgtaacgccctttactcgaccacccgaaacacgaccaaaaacttcaccgaaccccgaatccaccgtaatcgcgaccgccgatcgccgaaaacccgaaaccgaaacgcgaaaattaaaaattaaaaataaatcccaatatcgcgcgaaaattcaaaacccgacactaacacgaaactccgccgccgcaaccgctaaaaccttaaactccccgccgcgaaaaaaacgaaaaaaaaacgcctatcccgaaataacccgacgacgaaaaaaaaacgaaccgcaaacgacgaacccgaaaaaccttaaacgaacgaacgaaaaacgaataaaaccgaaatcgacaaaataaaaaccccacgaaacccgcgcctaatcgaaaaaaaaataaaaaattcccccgcgaactcaaacccgacactaaaaaaaaaaacactccgaatcctacgtctccaaattttactccaatacccttaacattaaatacatatataacgtctatcc

SEQ ID NO: 12641 - DNA, 633 bp, Artificial Sequence
  chemically treated genomic DNA (Homo sapiens) CpG-island No: 12641
  misc_feature (124)..(124): n is either a, c, g or t
  misc_feature (287)..(287): n is either a, c, g or t
  misc_feature (303)..(303): n is either a, c, g or t
  misc_feature (322)..(322): n is either a, c, g or t
gtattggcggcggattttatcgtttcgacgggattcgtttcgaggaaattcgttttcgtatcggtaagttgtcgagtcgtaatattatcgttttgttggtaatcgacgatggcgatttttggtnttgtttttatgacggttagatcgcgcgtcgacgcggtcgttttcggggagttcggcgggcgtcggcgcgttttttttatttttattttacgtttcgtcgcgcgcgcgttcgttgggggcggggagcggtcgggcggcggcggtcggcgggcggcggggcgggngcggttcgtttttcgntttattttttcggtttcgntcgtttttcgggttttttttttttttcgcgcgcggcggtcggcggcggcgtcggtcggcggcggcggggtcgcgggttcggttttttcgtcgggttttttttcggggtttcggttttcgtcgggggtttgtttcggtcggcgttttttcgttcgttgtgtttttgggcggtttcggggttttcggttgttttttggcgcgcgtgttttcgggtgggtttcgcgtttttgtggtgcgtttcgttgggttgttgcggtttcggggttgtggggtggggcgggtgggcggtttgttcgtcggtttcggcgggtt

SEQ ID NO: 12642 - DNA, 633 bp, Artificial Sequence
  chemically treated genomic DNA (Homo sapiens) CpG-island No: 12642
  misc_feature (312)..(312): n is either a, c, g or t
  misc_feature (331)..(331): n is either a, c, g or t
  misc_feature (347)..(347): n is either a, c, g or t
  misc_feature (510)..(510): n is either a, c, g or t
aacccgccgaaaccgacgaacaaaccgcccacccgccccaccccacaaccccgaaaccgcaacaacccaacgaaacgcaccacaaaaacgcgaaacccacccgaaaacacgcgcgccaaaaaacaaccgaaaaccccgaaaccgcccaaaaacacaacgaacgaaaaaacgccgaccgaaacaaacccccgacgaaaaccgaaaccccgaaaaaaaacccgacgaaaaaaccgaacccgcgaccccgccgccgccgaccgacgccgccgccgaccgccgcgcgcgaaaaaaaaaaaaaacccgaaaaacgancgaaaccgaaaaaataaancgaaaaacgaaccgcncccgccccgccgcccgccgaccgccgccgcccgaccgctccccgcccccaacgaacgcgcgcgcgacgaaacgtaaaataaaaataaaaaaaacgcgccgacgcccgccgaactccccgaaaacgaccgcgtcgacgcgcgatctaaccgtcataaaaacaanaccaaaaatcgccatcgtcgattaccaacaaaacgataatattacgactcgacaacttaccgatacgaaaacgaatttcctcgaaacgaatcccgtcgaaacgataaaatccgccgccaatac

SEQ ID NO: 12643 - DNA, 633 bp, Artificial Sequence
  chemically treated genomic DNA (Homo sapiens) CpG-island No: 12643
  misc_feature (312)..(312): n is either a, c, g or t
  misc_feature (331)..(331): n is either a, c, g or t
  misc_feature (347)..(347): n is either a, c, g or t
  misc_feature (510)..(510): n is either a, c, g or t
agttcgtcggggtcggcgaataagtcgtttattcgttttattttatagtttcggggtcgtagtagtttaacggggcgtattataggagcgcgaggtttattcgagagtacgcgcgttaaaaggtagtcgaaaatttcggggtcgtttaagggtatagcgagcgagaaggcgtcggtcgaggtaagttttcggcggaaatcgaggtttcgggaagggattcggcgggggggtcgggttcgcggtttcgtcgtcgtcggtcggcgtcgtcgtcggtcgtcgcgcgcggaggaggaggggggttcggggggcggncggggtcgggggggtaggncgggggacgaatcgtnttcgtttcgtcgttcgtcgatcgtcgtcgttcgatcgtttttcgtttttagcggacgcgcgcgcgacgagacgtggggtgggggtggggggggcgcgtcggcgttcgtcgggtttttcgggggcggtcgcgtcgacgcgcgatttggtcgttataggagtagngttagagatcgttatcgtcggttgttagtaaggcggtgatgttgcggttcggtagtttgtcgatgcggggacgaattttttcgaagcggatttcgtcgaagcgatagagttcgtcgttagtgt

SEQ ID NO: 12644 - DNA, 633 bp, Artificial Sequence
  chemically treated genomic DNA (Homo sapiens) CpG-island No: 12644
  misc_feature (124)..(124): n is either a, c, g or t
  misc_feature (287)..(287): n is either a, c, g or t
  misc_feature (303)..(303): n is either a, c, g or t
  misc_feature (322)..(322): n is either a, c, g or t
acactaacgacgaactctatcgcttcgacgaaatccgcttcgaaaaaattcgtccccgcatcgacaaactaccgaaccgcaacatcaccgccttactaacaaccgacgataacgatctctaacnctactcctataacgaccaaatcgcgcgtcgacgcgaccgcccccgaaaaacccgacgaacgccgacgcgccccccccacccccaccccacgtctcgtcgcgcgcgcgtccgctaaaaacgaaaaacgatcgaacgacgacgatcgacgaacgacgaaacgaanacgattcgtcccccgncctacccccccgaccccgnccgccccccgaacccccctcctcctccgcgcgcgacgaccgacgacgacgccgaccgacgacgacgaaaccgcgaacccgacccccccgccgaatcccttcccgaaacctcgatttccgccgaaaacttacctcgaccgacgccttctcgctcgctatacccttaaacgaccccgaaattttcgactaccttttaacgcgcgtactctcgaataaacctcgcgctcctataatacgccccgttaaactactacgaccccgaaactataaaataaaacgaataaacgacttattcgccgaccccgacgaact

SEQ ID NO: 12645 - DNA, 505 bp, Artificial Sequence
  chemically treated genomic DNA (Homo sapiens) CpG-island No: 12645
tcgtcggtttgaattttgggttcgtcgcgtgggggcgttggcgtgtagattcggcggagttatggggttcgggacgcgtaatttttttaaagttttattgtaaaataattcggcggtggagtttcgcggttttttgaatttaaagtcgcgagttcgttttttcgtttcgtggttttgttcgtcgcgttcgcgttttttcgtatttaggcgaaggggtttaggaagggattttaggattaaggcgggatcgcgggcggggacgtagggtcgggggtcgtagggaggttgttagcgttcgggttcggatattcgttttaaatttcgtttggtttcggcgttattcgggtcgattcgtttttgtgtcggtttttaggttggtttcgagtttttgtgttcgtttttttcgtttgaataagatttttcgtgagttcgcggtttttaaatcgtttgtttttgtgggttttttaggttgtcgcgtgggttttaaggtgaaggtttggagggt

SEQ ID NO: 12646 - DNA, 505 bp, Artificial Sequence
  chemically treated genomic DNA (Homo sapiens) CpG-island No: 12646
accctccaaaccttcaccttaaaacccacgcgacaacctaaaaaacccacaaaaacaaacgatttaaaaaccgcgaactcacgaaaaatcttattcaaacgaaaaaaacgaacacaaaaactcgaaaccaacctaaaaaccgacacaaaaacgaatcgacccgaataacgccgaaaccaaacgaaatttaaaacgaatatccgaacccgaacgctaacaacctccctacgacccccgaccctacgtccccgcccgcgatcccgccttaatcctaaaatcccttcctaaaccccttcgcctaaatacgaaaaaacgcgaacgcgacgaacaaaaccacgaaacgaaaaaacgaactcgcgactttaaattcaaaaaaccgcgaaactccaccgccgaattattttacaataaaactttaaaaaaattacgcgtcccgaaccccataactccgccgaatctacacgccaacgcccccacgcgacgaacccaaaattcaaaccgacga

SEQ ID NO: 12647 - DNA, 505 bp, Artificial Sequence
  chemically treated genomic DNA (Homo sapiens) CpG-island No: 12647
gttttttaggtttttattttgagatttacgcggtagtttggagggtttataagagtaaacggtttagaggtcgcgggtttacgagggattttgtttaaacgaaaagaacgagtataggggttcggggttagtttggaggtcggtatagaggcgagtcggttcgggtggcgtcgggattaggcgggatttggggcgggtattcgggttcgggcgttggtagtttttttgcgattttcggttttgcgttttcgttcgcggtttcgttttagttttggagtttttttttgggttttttcgtttgggtgcggaggggcgcgggcgcggcgggtagggttacggggcgaggggacgggttcgcggttttgggtttagggagtcgcggagttttatcgtcgggttgttttgtaatggggttttggagaggttgcgcgtttcgggttttatggtttcgtcgggtttgtacgttagcgtttttacgcggcgggtttagagtttaggtcggcgg

SEQ ID NO: 12648 - DNA, 505 bp, Artificial Sequence
  chemically treated genomic DNA (Homo sapiens) CpG-island No: 12648
ccgccgacctaaactctaaacccgccgcgtaaaaacgctaacgtacaaacccgacgaaaccataaaacccgaaacgcgcaacctctccaaaaccccattacaaaacaacccgacgataaaactccgcgactccctaaacccaaaaccgcgaacccgtcccctcgccccgtaaccctacccgccgcgcccgcgcccctccgcacccaaacgaaaaaacccaaaaaaaaactccaaaactaaaacgaaaccgcgaacgaaaacgcaaaaccgaaaatcgcaaaaaaactaccaacgcccgaacccgaatacccgccccaaatcccgcctaatcccgacgccacccgaaccgactcgcctctataccgacctccaaactaaccccgaacccctatactcgttcttttcgtttaaacaaaatccctcgtaaacccgcgacctctaaaccgtttactcttataaaccctccaaactaccgcgtaaatctcaaaataaaaacctaaaaaac

SEQ ID NO: 12649 - DNA, 556 bp, Artificial Sequence
  chemically treated genomic DNA (Homo sapiens) CpG-island No: 12649
ggcgcgggcgacgtcgcggttcgcgcggttttaagagtgcgatcgttcggagtttagcgttttttaattttgttcgggttcggaacgtcgcggggcgtgtttttcgatatagagaattcgtgtgagtcgattggtttcgttttgatttgttttttttaggataatacggaaaatcgttggtgtagggtttgcgagtagttggttgcgttcgtcgggattcgatagatcggtaggtacgaggggtaggtggggaggtatcggagttttagcgtagtttcgttcggtattatttgttcgtttttaacgaaatacgtcgtttaggtttagagaatttcgggattgtttggggaacgcgttaggtttatgtcggttggggcgttcggagttgggagagggcggagagtttttatttaggtcggagtattttagagttcgaggtgcggagtagtatggagcgttcgaggcgggcggcgttagggttagagtttatttaggggatttttgtcgtttttataggttggaaaaataaagattaaaaataaatcgaaaaaaaaaa

SEQ ID NO: 12650 - DNA, 556 bp, Artificial Sequence
  chemically treated genomic DNA (Homo sapiens) CpG-island No: 12650
ttttttttttcgatttatttttaatctttatttttccaacctataaaaacgacaaaaatcccctaaataaactctaaccctaacgccgcccgcctcgaacgctccatactactccgcacctcgaactctaaaatactccgacctaaataaaaactctccgccctctcccaactccgaacgccccaaccgacataaacctaacgcgttccccaaacaatcccgaaattctctaaacctaaacgacgtatttcgttaaaaacgaacaaataataccgaacgaaactacgctaaaactccgatacctccccacctacccctcgtacctaccgatctatcgaatcccgacgaacgcaaccaactactcgcaaaccctacaccaacgattttccgtattatcctaaaaaaaacaaatcaaaacgaaaccaatcgactcacacgaattctctatatcgaaaaacacgccccgcgacgttccgaacccgaacaaaattaaaaaacgctaaactccgaacgatcgcactcttaaaaccgcgcgaaccgcgacgtcgcccgcgcc

SEQ ID NO: 12651 - DNA, 556 bp, Artificial Sequence
  chemically treated genomic DNA (Homo sapiens) CpG-island No: 12651
ttttttttttcggtttgtttttgatttttatttttttagtttataaaggcggtagaaattttttgggtagattttggttttggcgtcgttcgtttcgggcgttttatgttgtttcgtatttcgggttttgggatgtttcggtttggatggaggtttttcgtttttttttagtttcgagcgttttagtcgatatgggtttggcgcgttttttagatagtttcggagttttttgggtttgggcgacgtgtttcgttgaaagcgggtaggtggtgtcgggcggggttgcgttgaggtttcggtgtttttttatttgtttttcgtatttgtcggtttgtcgggtttcggcggacgtaattagttattcgtaaattttgtattagcggtttttcgtgttgttttaagaggggtaggttagggcgaggttagtcggtttatacgaattttttgtgtcggagaatacgtttcgcgacgtttcgagttcgggtaaggttgagaggcgttgggtttcgggcggtcgtatttttggaatcgcgcgaatcgcggcgtcgttcgcgtt

SEQ ID NO: 12652 - DNA, 556 bp, Artificial Sequence
  chemically treated genomic DNA (Homo sapiens) CpG-island No: 12652
aacgcgaacgacgccgcgattcgcgcgattccaaaaatacgaccgcccgaaacccaacgcctctcaaccttacccgaactcgaaacgtcgcgaaacgtattctccgacacaaaaaattcgtataaaccgactaacctcgccctaacctacccctcttaaaacaacacgaaaaaccgctaatacaaaatttacgaataactaattacgtccgccgaaacccgacaaaccgacaaatacgaaaaacaaataaaaaaacaccgaaacctcaacgcaaccccgcccgacaccacctacccgctttcaacgaaacacgtcgcccaaacccaaaaaactccgaaactatctaaaaaacgcgccaaacccatatcgactaaaacgctcgaaactaaaaaaaaacgaaaaacctccatccaaaccgaaacatcccaaaacccgaaatacgaaacaacataaaacgcccgaaacgaacgacgccaaaaccaaaatctacccaaaaaatttctaccgcctttataaactaaaaaaataaaaatcaaaaacaaaccgaaaaaaaaaa

SEQ ID NO: 12653 - DNA, 1378 bp, Artificial Sequence
  chemically treated genomic DNA (Homo sapiens) CpG-island No: 12653
tcgatttattttttttcgttttcgttcgtttttttcgtttttttgttttttttttttttttttttttgggtattcgtttcgttaattttcgtcgtcgtcggttttaattcggttttttttcgttttttaggtttttagagcgttttaggttttagtagagtcgtttttagttttgcgcggagcggggcgatttgttagcggagtcggtcggggggagtcgttcggttcgtcgaggttcgggttattagtgattgatagcgtttttatggcgaataatttgatttcgattattgtttggcgttggtaggtttcgggttagataatcggattaattagggcgcgggtcgtcgcgttttatgttcgtttagaataatattattaagaaagttgagagttagttagacgggagggagaacgagtgagaagcgagcgagggaacggcgggcgggcgcggagtatgcggagcggcgtttcgggcggttttcgggtttgggcgagggtttgggttaggcgcgcgggtcgttggggttcggagtttcgtgggattcgcggtcggcgcggggacgtacggtagtgattcggggtttatcgggggttagtgtcgggttagggggttagtttcgttcgcgtttcggttcggacggttcggcgaggaagtttttatgcgggatcgcgcggttcggtgagggcgcgcgcgggcgggcggggacgtagtcggtattatgtttatgttgtttattttcggttttacgtaggagtaagtggcgtgcgtgtgcgaggtgttgtagtagggcggtaatatcgagcggttgggtcgttttttgtggtcgttgttcgtttgcgagtatttttataagaatgaaagcgtgtttaaggttaaggtcgtggtggttttttatcgcggtaattttcgcgagttttataagattttggagagttattagttttcgtcgtataattacgttaagttgtagtagttgtggtttaaggtatattatatcgaggcggagaagttgcgcggtcgatttttgggcgtcgtgggtaaatatcgcgtgcgtcgtaaattttcgttgtcgcgttttatttgggacggcgaggagattagttattgttttaaggaaaagagtcgtagcgtgttgcgcgagtggtacgcgtataatttttattttttatttcgcgagaagcgtgagttggcggaggttacgggttttattattatataggttagtaattggtttaagaatcggcggtagcgcgatcgggcggtcgaggttaaggaaaggtacgagtaagtagatttttttcggcgttagtttttcggggtttaagggaggggttcgtagggtttttgtcggtttttcggagaggtttaaattgg

SEQ ID NO: 12654 - DNA, 1378 bp, Artificial Sequence
  chemically treated genomic DNA (Homo sapiens) CpG-island No: 12654
ccaatttaaacctctccgaaaaaccgacaaaaaccctacgaacccctcccttaaaccccgaaaaactaacgccgaaaaaaatctacttactcgtacctttccttaacctcgaccgcccgatcgcgctaccgccgattcttaaaccaattactaacctatataataataaaacccgtaacctccgccaactcacgcttctcgcgaaataaaaaataaaaattatacgcgtaccactcgcgcaacacgctacgactcttttccttaaaacaataactaatctcctcgccgtcccaaataaaacgcgacaacgaaaatttacgacgcacgcgatatttacccacgacgcccaaaaatcgaccgcgcaacttctccgcctcgatataatataccttaaaccacaactactacaacttaacgtaattatacgacgaaaactaataactctccaaaatcttataaaactcgcgaaaattaccgcgataaaaaaccaccacgaccttaaccttaaacacgctttcattcttataaaaatactcgcaaacgaacaacgaccacaaaaaacgacccaaccgctcgatattaccgccctactacaacacctcgcacacgcacgccacttactcctacgtaaaaccgaaaataaacaacataaacataataccgactacgtccccgcccgcccgcgcgcgccctcaccgaaccgcgcgatcccgcataaaaacttcctcgccgaaccgtccgaaccgaaacgcgaacgaaactaaccccctaacccgacactaacccccgataaaccccgaatcactaccgtacgtccccgcgccgaccgcgaatcccacgaaactccgaaccccaacgacccgcgcgcctaacccaaaccctcgcccaaacccgaaaaccgcccgaaacgccgctccgcatactccgcgcccgcccgccgttccctcgctcgcttctcactcgttctccctcccgtctaactaactctcaactttcttaataatattattctaaacgaacataaaacgcgacgacccgcgccctaattaatccgattatctaacccgaaacctaccaacgccaaacaataatcgaaatcaaattattcgccataaaaacgctatcaatcactaataacccgaacctcgacgaaccgaacgactccccccgaccgactccgctaacaaatcgccccgctccgcgcaaaactaaaaacgactctactaaaacctaaaacgctctaaaaacctaaaaaacgaaaaaaaaccgaattaaaaccgacgacgacgaaaattaacgaaacgaatacccaaaaaaaaaaaaaaaaaaaaaacaaaaaaacgaaaaaaacgaacgaaaacgaaaaaaaataaatcga

SEQ ID NO: 12655 - DNA, 1378 bp, Artificial Sequence
  chemically treated genomic DNA (Homo sapiens) CpG-island No: 12655
ttagtttaggttttttcgggggatcggtagaagttttgcgaattttttttttgggtttcggggagttggcgtcgaagaaggtttatttattcgtatttttttttggtttcggtcgttcggtcgcgttgtcgtcggtttttgaattagttgttgatttgtgtggtggtgaggttcgtggttttcgttagtttacgtttttcgcggggtgaagggtaggggttgtgcgcgtattattcgcgtagtacgttgcgatttttttttttgaagtagtagttggttttttcgtcgttttagatggagcgcggtagcgggaatttgcggcgtacgcggtatttgtttacggcgtttaggggtcggtcgcgtagttttttcgtttcgatgtagtgtgttttgagttatagttgttgtagtttggcgtggttgtgcggcgagaattggtggttttttaggattttgtagagttcgcggaagttgtcgcggtggaaggttattacggttttggttttgagtacgtttttatttttgtgaaggtgttcgtaggcgggtagcgattataggaagcggtttagtcgttcgatgttgtcgttttgttgtagtatttcgtatacgtacgttatttgtttttgcgtgaagtcgaaggtgggtagtatggatatggtgtcggttgcgttttcgttcgttcgcgcgcgtttttatcgggtcgcgcggtttcgtatgggagttttttcgtcgggtcgttcgggtcgagacgcgggcggggttggttttttggttcggtattggttttcggtgagtttcgagttattgtcgtacgttttcgcgtcggtcgcgggttttacgaagtttcgaattttaacggttcgcgcgtttggtttaagttttcgtttaagttcgggggtcgttcggggcgtcgtttcgtatgtttcgcgttcgttcgtcgttttttcgttcgttttttattcgttttttttttcgtttagttggtttttagtttttttaataatattattttaagcgggtatgaggcgcggcggttcgcgttttgattggttcggttatttgattcggggtttgttagcgttagataatagtcggagttaaattattcgttatggagacgttgttagttattggtaattcgagtttcggcgggtcgggcggtttttttcggtcggtttcgttgatagatcgtttcgtttcgcgtagaattgagggcggttttattggagtttggggcgttttgagagtttgggaggcggagaggggtcgggttggggtcggcggcggcggagattgacggggcggatgtttaaagagggagggaggaggaggataggagagcggggggagcgggcgaagacgaaaaggggtggatcga

SEQ ID NO: 12656 - DNA, 1378 bp, Artificial Sequence
  chemically treated genomic DNA (Homo sapiens) CpG-island No: 12656
tcgatccaccccttttcgtcttcgcccgctccccccgctctcctatcctcctcctccctccctctttaaacatccgccccgtcaatctccgccgccgccgaccccaacccgacccctctccgcctcccaaactctcaaaacgccccaaactccaataaaaccgccctcaattctacgcgaaacgaaacgatctatcaacgaaaccgaccgaaaaaaaccgcccgacccgccgaaactcgaattaccaataactaacaacgtctccataacgaataatttaactccgactattatctaacgctaacaaaccccgaatcaaataaccgaaccaatcaaaacgcgaaccgccgcgcctcatacccgcttaaaataatattattaaaaaaactaaaaaccaactaaacgaaaaaaaaaacgaataaaaaacgaacgaaaaaacgacgaacgaacgcgaaacatacgaaacgacgccccgaacgacccccgaacttaaacgaaaacttaaaccaaacgcgcgaaccgttaaaattcgaaacttcgtaaaacccgcgaccgacgcgaaaacgtacgacaataactcgaaactcaccgaaaaccaataccgaaccaaaaaaccaaccccgcccgcgtctcgacccgaacgacccgacgaaaaaactcccatacgaaaccgcgcgacccgataaaaacgcgcgcgaacgaacgaaaacgcaaccgacaccatatccatactacccaccttcgacttcacgcaaaaacaaataacgtacgtatacgaaatactacaacaaaacgacaacatcgaacgactaaaccgcttcctataatcgctacccgcctacgaacaccttcacaaaaataaaaacgtactcaaaaccaaaaccgtaataaccttccaccgcgacaacttccgcgaactctacaaaatcctaaaaaaccaccaattctcgccgcacaaccacgccaaactacaacaactataactcaaaacacactacatcgaaacgaaaaaactacgcgaccgacccctaaacgccgtaaacaaataccgcgtacgccgcaaattcccgctaccgcgctccatctaaaacgacgaaaaaaccaactactacttcaaaaaaaaaaatcgcaacgtactacgcgaataatacgcgcacaacccctacccttcaccccgcgaaaaacgtaaactaacgaaaaccacgaacctcaccaccacacaaatcaacaactaattcaaaaaccgacgacaacgcgaccgaacgaccgaaaccaaaaaaaaatacgaataaataaaccttcttcgacgccaactccccgaaacccaaaaaaaaaattcgcaaaacttctaccgatcccccgaaaaaacctaaactaa

SEQ ID NO: 12657 - DNA, 891 bp, Artificial Sequence
  chemically treated genomic DNA (Homo sapiens) CpG-island No: 12657
cgtttaggtatttaacggagatacggcgtgaatattttattattttttgggaatttagaggcggtcggcgtggcggcgcgaatttgtttagcgcgtgcgcgcggcgcgtagggaggcggtttggaatcgagggagcgcgcgttttttacgtgattcgattcgcgggcggcgacgtacgcgtcgcgtcgcgtcgtttacgtggttcgtttttagtttcgtcgtcggcggaggcgggcgcgggcgcgtttttgtggttagttattcggaggagttggtcgtataattatgaaagattcggtttttgttgttagcgtcggagttgagttagttttgagaaggtttttttgggcgttttttgttcggcggtttttgttgtcgttttcggagacgtttttcgatagatggttataggtcgcggaggaggaggaggtggagttgttgttttttcggagttcgtttcgtgaggagaatggtattggatttacgtaggttcgggcggggaatggttttggggttgcgggcggtaaaggagagatttggtaggtaagtgtgtggggagtcgcgttttatgcggcgaaggattttcgaattgttttgaggttttcggatttgttttttcgggacgggtgtgtagttcgttttggggtgaggggcgggagtaggtagtaagttagaggcgatattttttcgcgggaattttttgagtcgagattcggtttttagcgagggtttttttaggcggtagaggcgcgagttcgggattatttggttgggtttagttgagcggttttagcgcgttcgacgtagggtttagtttataagtttcgtattttttgggagtacggtttttttggcgttagttgttggtagataagggaattaaatgttttg

SEQ ID NO: 12658 - DNA, 891 bp, Artificial Sequence
  chemically treated genomic DNA (Homo sapiens) CpG-island No: 12658
caaaacatttaattcccttatctaccaacaactaacgccaaaaaaaccgtactcccaaaaaatacgaaacttataaactaaaccctacgtcgaacgcgctaaaaccgctcaactaaacccaaccaaataatcccgaactcgcgcctctaccgcctaaaaaaaccctcgctaaaaaccgaatctcgactcaaaaaattcccgcgaaaaaatatcgcctctaacttactacctactcccgcccctcaccccaaaacgaactacacacccgtcccgaaaaaacaaatccgaaaacctcaaaacaattcgaaaatccttcgccgcataaaacgcgactccccacacacttacctaccaaatctctcctttaccgcccgcaaccccaaaaccattccccgcccgaacctacgtaaatccaataccattctcctcacgaaacgaactccgaaaaaacaacaactccacctcctcctcctccgcgacctataaccatctatcgaaaaacgtctccgaaaacgacaacaaaaaccgccgaacaaaaaacgcccaaaaaaaccttctcaaaactaactcaactccgacgctaacaacaaaaaccgaatctttcataattatacgaccaactcctccgaataactaaccacaaaaacgcgcccgcgcccgcctccgccgacgacgaaactaaaaacgaaccacgtaaacgacgcgacgcgacgcgtacgtcgccgcccgcgaatcgaatcacgtaaaaaacgcgcgctccctcgattccaaaccgcctccctacgcgccgcgcgcacgcgctaaacaaattcgcgccgccacgccgaccgcctctaaattcccaaaaaataataaaatattcacgccgtatctccgttaaatacctaaacg

SEQ ID NO: 12659 - DNA, 891 bp, Artificial Sequence
  chemically treated genomic DNA (Homo sapiens) CpG-island No: 12659
tagagtatttggtttttttatttgttagtaattggcgttaggaggatcgtgtttttaggagatgcggagtttgtaggttgagttttgcgtcgggcgcgttgaggtcgtttagttgagtttagttaggtagtttcgggttcgcgtttttgtcgtttggagaggttttcgttgggagtcgagtttcggtttaggggattttcgcgaagaggtgtcgtttttaatttgttatttgttttcgttttttattttagaacgaattgtatattcgtttcgagaggataaattcggaagttttaaggtaattcgagggtttttcgtcgtatggaacgcggttttttatatatttgtttgttaagttttttttttatcgttcgtaattttagaattatttttcgttcgggtttgcgtgggtttagtattattttttttacggggcggatttcggaagggtagtaattttatttttttttttttcgcggtttgtagttatttatcgggaagcgttttcggaggcggtagtagaggtcgtcggataaggaacgtttagggaaatttttttagaattaatttagtttcggcgttagtagtagaagtcgagttttttataattgtgcgattaattttttcgggtgattggttatagggacgcgttcgcgttcgttttcgtcggcgacggggttggggacggattacgtgagcggcgcggcgcggcgcgtgcgtcgtcgttcgcgggtcgggttacgtgaagggcgcgcgttttttcgattttaggtcgtttttttgcgcgtcgcgcgtacgcgttgggtaggttcgcgtcgttacgtcgatcgtttttgggtttttagaaagtggtggggtgtttacgtcgtattttcgttgggtatttaggcg

SEQ ID NO: 12660 - DNA, 891 bp, Artificial Sequence
  chemically treated genomic DNA (Homo sapiens) CpG-island No: 12660
cgcctaaatacccaacgaaaatacgacgtaaacaccccaccactttctaaaaacccaaaaacgatcgacgtaacgacgcgaacctacccaacgcgtacgcgcgacgcgcaaaaaaacgacctaaaatcgaaaaaacgcgcgcccttcacgtaacccgacccgcgaacgacgacgcacgcgccgcgccgcgccgctcacgtaatccgtccccaaccccgtcgccgacgaaaacgaacgcgaacgcgtccctataaccaatcacccgaaaaaattaatcgcacaattataaaaaactcgacttctactactaacgccgaaactaaattaattctaaaaaaatttccctaaacgttccttatccgacgacctctactaccgcctccgaaaacgcttcccgataaataactacaaaccgcgaaaaaaaaaaaaataaaattactacccttccgaaatccgccccgtaaaaaaaataatactaaacccacgcaaacccgaacgaaaaataattctaaaattacgaacgataaaaaaaaaacttaacaaacaaatatataaaaaaccgcgttccatacgacgaaaaaccctcgaattaccttaaaacttccgaatttatcctctcgaaacgaatatacaattcgttctaaaataaaaaacgaaaacaaataacaaattaaaaacgacacctcttcgcgaaaatcccctaaaccgaaactcgactcccaacgaaaacctctccaaacgacaaaaacgcgaacccgaaactacctaactaaactcaactaaacgacctcaacgcgcccgacgcaaaactcaacctacaaactccgcatctcctaaaaacacgatcctcctaacgccaattactaacaaataaaaaaaccaaatactcta

SEQ ID NO: 12661 - DNA, 532 bp, Artificial Sequence
  chemically treated genomic DNA (Homo sapiens) CpG-island No: 12661
ggatatacggggacggtttttttttaaggaggttcggggtcgtttttgcgtcgggatagtttgggaagtcgcgtaggtttggtcgattttttttttttagtttcgttgcgttttgcggggttttgtcggcggtgggggttgcggattcgggagcgcgcggtcgcgttgtacgtgtagggatcggtaggcgtcggggttagcgttagcgtttgatgtgcggcggggagcgggtcgagtttcgggaggtcgtttcgtattttttagtgtgttcgggttgagcgcgaggttaggaggggacgtagagtttacggcgaagacggatcgcgggggttcgtttcgttcgggttgcgcgtagcgggggtcgcgtgatggatgggtcgggtcgggtattcgggaattcgcgagcgcggggttgggttttgggttgcgttcgggggtttcgatttggttattgatcggtttaagcgtaggagaattgattttataatgtatcgtttgattaggaaaagtgtttgtttttgtgggagtaaaa

SEQ ID NO: 12662 - DNA, 532 bp, Artificial Sequence
  chemically treated genomic DNA (Homo sapiens) CpG-island No: 12662
ttttactcccacaaaaacaaacacttttcctaatcaaacgatacattataaaatcaattctcctacgcttaaaccgatcaataaccaaatcgaaacccccgaacgcaacccaaaacccaaccccgcgctcgcgaattcccgaatacccgacccgacccatccatcacgcgacccccgctacgcgcaacccgaacgaaacgaacccccgcgatccgtcttcgccgtaaactctacgtcccctcctaacctcgcgctcaacccgaacacactaaaaaatacgaaacgacctcccgaaactcgacccgctccccgccgcacatcaaacgctaacgctaaccccgacgcctaccgatccctacacgtacaacgcgaccgcgcgctcccgaatccgcaacccccaccgccgacaaaaccccgcaaaacgcaacgaaactaaaaaaaaaaaatcgaccaaacctacgcgacttcccaaactatcccgacgcaaaaacgaccccgaacctccttaaaaaaaaaccgtccccgtatatcc

SEQ ID NO: 12663 - DNA, 532 bp, Artificial Sequence
  chemically treated genomic DNA (Homo sapiens) CpG-island No: 12663
ttttgtttttataaaagtaaatattttttttggttaggcgatgtattatagagttagtttttttgcgtttgggtcgattaataattaagtcggggttttcggacgtagtttagagtttagtttcgcgttcgcgggttttcgggtgttcggttcggtttatttattacgcggttttcgttgcgcgtaattcgggcgggacgagttttcgcgattcgttttcgtcgtgaattttgcgtttttttttgatttcgcgtttaattcggatatattgggaggtgcgaagcggtttttcggggttcggttcgtttttcgtcgtatattaaacgttggcgttgatttcggcgtttatcggtttttgtacgtgtagcgcggtcgcgcgttttcgggttcgtagtttttatcgtcgatagggtttcgtagggcgtagcggggttgggaaggggaagtcggttaggtttgcgcggttttttaggttgtttcggcgtagaggcggtttcgggtttttttggaaaggaatcgttttcgtgtattt

SEQ ID NO: 12664 - DNA, 532 bp, Artificial Sequence
  chemically treated genomic DNA (Homo sapiens) CpG-island No: 12664
aaatacacgaaaacgattcctttccaaaaaaacccgaaaccgcctctacgccgaaacaacctaaaaaaccgcgcaaacctaaccgacttccccttcccaaccccgctacgccctacgaaaccctatcgacgataaaaactacgaacccgaaaacgcgcgaccgcgctacacgtacaaaaaccgataaacgccgaaatcaacgccaacgtttaatatacgacgaaaaacgaaccgaaccccgaaaaaccgcttcgcacctcccaatatatccgaattaaacgcgaaatcaaaaaaaaacgcaaaattcacgacgaaaacgaatcgcgaaaactcgtcccgcccgaattacgcgcaacgaaaaccgcgtaataaataaaccgaaccgaacacccgaaaacccgcgaacgcgaaactaaactctaaactacgtccgaaaaccccgacttaattattaatcgacccaaacgcaaaaaaactaactctataatacatcgcctaaccaaaaaaaatatttacttttataaaaacaaaa

SEQ ID NO: 12665 - DNA, 746 bp, Artificial Sequence
  chemically treated genomic DNA (Homo sapiens) CpG-island No: 12665
ttcgttttcggtttcgtttattcgtcgcggtatcggtttcgttcgttaatttaggtcgcggtaggtttcgtttttcgtcgcggtgttcggtttcgtttattttttttgggtcgtcgtcgcggtcgggggcggggcggggcggtcgggggcggggcggggcggtcgggggcggggcggggcggtcgggggcggggcggggcgggaggagtcgcgtttttaagcgggagggagattcgtcgcggagttacgggaaagttggttcgagtttttagagtttttttttgtggtgttttaggttcggtcggtcggtgtttcggtttttttttttttttcggttttcgtcgtttattaggtttttttttttgttttcggtcgttatggagtagtcgtcggcgtttaagaggtaacgaatcggggagcgggaagaaggagggaagcggcgtcggcggtcgcggggcgggggtggttaggttaggttttgttgcgagttttttttcgttcgtcgggtttcgagtcgggcgcgttgaggtcgggaggcgggttcgagtgtttcgtcgcgtttgtttacgggcgaggggatttgaggggagcgggagtcggagttttttttgcggtcggtaggtttggcgcgtggaaagtcgggtgggtagcgtcgggttttttgcggtttgatttttcggggcgggaggaattaaatattaatagttatatagtttgtaaaatattgtggatgtgttgttttgata

SEQ ID NO: 12666 - DNA, 746 bp, Artificial Sequence
  chemically treated genomic DNA (Homo sapiens) CpG-island No: 12666
tatcaaaacaacacatccacaatattttacaaactatataactattaatatttaattcctcccgccccgaaaaatcaaaccgcaaaaaacccgacgctacccacccgactttccacgcgccaaacctaccgaccgcaaaaaaaactccgactcccgctcccctcaaatcccctcgcccgtaaacaaacgcgacgaaacactcgaacccgcctcccgacctcaacgcgcccgactcgaaacccgacgaacgaaaaaaaactcgcaacaaaacctaacctaaccacccccgccccgcgaccgccgacgccgcttccctccttcttcccgctccccgattcgttacctcttaaacgccgacgactactccataacgaccgaaaacaaaaaaaaaaacctaataaacgacgaaaaccgaaaaaaaaaaaaaaaccgaaacaccgaccgaccgaacctaaaacaccacaaaaaaaaactctaaaaactcgaaccaactttcccgtaactccgcgacgaatctccctcccgcttaaaaacgcgactcctcccgccccgccccgcccccgaccgccccgccccgcccccgaccgccccgccccgcccccgaccgccccgccccgcccccgaccgcgacgacgacccaaaaaaaataaacgaaaccgaacaccgcgacgaaaaacgaaacctaccgcgacctaaattaacgaacgaaaccgataccgcgacgaataaacgaaaccgaaaacgaa

SEQ ID NO: 12667 - DNA, 746 bp, Artificial Sequence
  chemically treated genomic DNA (Homo sapiens) CpG-island No: 12667
tgttagagtagtatatttataatgttttatagattgtgtagttattaatatttaatttttttcgtttcgggaggttaggtcgtagggagttcggcgttgtttattcgattttttacgcgttaggtttgtcggtcgtaggggaggtttcggttttcgttttttttaggttttttcgttcgtggatagacgcggcgggatattcggattcgtttttcgattttagcgcgttcggttcggggttcggcgggcggggagaggttcgtagtagggtttggtttagttattttcgtttcgcggtcgtcggcgtcgttttttttttttttttcgtttttcgattcgttattttttaggcgtcggcggttgttttatggcggtcggggatagagagagggatttggtggacggcgaaggtcgaaaggaggaaaggagtcggggtatcggtcggtcgagtttagggtattatagagggaaattttgggaattcggattaattttttcgtaatttcgcggcggatttttttttcgtttaggagcgcggtttttttcgtttcgtttcgttttcggtcgtttcgtttcgttttcggtcgtttcgtttcgttttcggtcgtttcgtttcgttttcggtcgcggcggcggtttagagaaggtggacggagtcgggtatcgcggcggggggcggagtttgtcgcggtttgggttggcgggcggggtcggtgtcgcggcgggtgggcggggtcggggacgaa

SEQ ID NO: 12668 - DNA, 746 bp, Artificial Sequence
  chemically treated genomic DNA (Homo sapiens) CpG-island No: 12668
ttcgtccccgaccccgcccacccgccgcgacaccgaccccgcccgccaacccaaaccgcgacaaactccgccccccgccgcgatacccgactccgtccaccttctctaaaccgccgccgcgaccgaaaacgaaacgaaacgaccgaaaacgaaacgaaacgaccgaaaacgaaacgaaacgaccgaaaacgaaacgaaacgaaaaaaaccgcgctcctaaacgaaaaaaaaatccgccgcgaaattacgaaaaaattaatccgaattcccaaaatttccctctataataccctaaactcgaccgaccgataccccgactcctttcctcctttcgaccttcgccgtccaccaaatccctctctctatccccgaccgccataaaacaaccgccgacgcctaaaaaataacgaatcgaaaaacgaaaaaaaaaaaaaaaacgacgccgacgaccgcgaaacgaaaataactaaaccaaaccctactacgaacctctccccgcccgccgaaccccgaaccgaacgcgctaaaatcgaaaaacgaatccgaatatcccgccgcgtctatccacgaacgaaaaaacctaaaaaaaacgaaaaccgaaacctcccctacgaccgacaaacctaacgcgtaaaaaatcgaataaacaacgccgaactccctacgacctaacctcccgaaacgaaaaaaattaaatattaataactacacaatctataaaacattataaatatactactctaaca

SEQ ID NO: 12669 - DNA, 588 bp, Artificial Sequence
  chemically treated genomic DNA (Homo sapiens) CpG-island No: 12669
cgcggtagttcgtacggaagtagttggggagtatttagttcgattttttttataggtttagggtcgggatatcgagggaaggcgcggcgcgcgcggtaaggttaggggcgcggggttgggttcggtcggtataagtgttcggatcgcggagcgttttcggtgaggcgttcggtatggattgggtaggagcggttttgggcgatgggtttgacgtcggtgggcgtagttgaggttattgtaaggtcgttggatttcggattcgtattcgagacggagcgggggttatacgggataatcgagggggcgaacgggagtttcgggttttcgtttttttttcgggtgggggataggtcgtcgagttcgaggtcgggcgcgaaggttattcgtattttttcgtttttcgcgagtaatttaggggttttgcgggaggaggagagggtttcgggagttcgtttttttttgcgttttcgggatcggtaggaggcgttgcgcgggcgaattaaaagaaaaggaaaagttcgtagtggaggtgttatcgtattttgtttttggacgttatttttagttgagtgattcgattcggatttt

SEQ ID NO: 12670 - DNA, 588 bp, Artificial Sequence
  chemically treated genomic DNA (Homo sapiens) CpG-island No: 12670
aaaatccgaatcgaatcactcaactaaaaataacgtccaaaaacaaaatacgataacacctccactacgaacttttccttttcttttaattcgcccgcgcaacgcctcctaccgatcccgaaaacgcaaaaaaaaacgaactcccgaaaccctctcctcctcccgcaaaacccctaaattactcgcgaaaaacgaaaaaatacgaataaccttcgcgcccgacctcgaactcgacgacctatcccccacccgaaaaaaaaacgaaaacccgaaactcccgttcgccccctcgattatcccgtataacccccgctccgtctcgaatacgaatccgaaatccaacgaccttacaataacctcaactacgcccaccgacgtcaaacccatcgcccaaaaccgctcctacccaatccataccgaacgcctcaccgaaaacgctccgcgatccgaacacttataccgaccgaacccaaccccgcgcccctaaccttaccgcgcgcgccgcgccttccctcgatatcccgaccctaaacctataaaaaaaatcgaactaaatactccccaactacttccgtacgaactaccgcg

SEQ ID NO: 12671 - DNA, 588 bp, Artificial Sequence
  chemically treated genomic DNA (Homo sapiens) CpG-island No: 12671
aaggttcgaatcgggttatttaattaagagtagcgtttaaaggtaggatgcggtaatatttttattacgagttttttttttttttttaattcgttcgcgtagcgttttttgtcggtttcgaaggcgtagggaagggcggattttcgggattttttttttttttcgtagggtttttgggttgttcgcggaaggcgggaaaatgcgagtggttttcgcgttcgatttcggattcggcgatttgttttttattcggagagggagcggaggttcgaaattttcgttcgttttttcggttatttcgtgtggttttcgtttcgtttcgggtgcggattcgggatttagcggttttgtagtggttttaattgcgtttatcgacgttaggtttatcgtttagggtcgtttttatttaatttatatcgaacgttttatcgaggacgtttcgcggttcgagtatttgtgtcggtcgagtttagtttcgcgtttttggttttgtcgcgcgcgtcgcgttttttttcggtgtttcgattttgggtttgtggggagggtcgagttggatgttttttagttgttttcgtgcggattgtcgcg

SEQ ID NO: 12672 - DNA, 588 bp, Artificial Sequence
  chemically treated genomic DNA (Homo sapiens) CpG-island No: 12672
cgcgacaatccgcacgaaaacaactaaaaaacatccaactcgaccctccccacaaacccaaaatcgaaacaccgaaaaaaaacgcgacgcgcgcgacaaaaccaaaaacgcgaaactaaactcgaccgacacaaatactcgaaccgcgaaacgtcctcgataaaacgttcgatataaattaaataaaaacgaccctaaacgataaacctaacgtcgataaacgcaattaaaaccactacaaaaccgctaaatcccgaatccgcacccgaaacgaaacgaaaaccacacgaaataaccgaaaaaacgaacgaaaatttcgaacctccgctccctctccgaataaaaaacaaatcgccgaatccgaaatcgaacgcgaaaaccactcgcattttcccgccttccgcgaacaacccaaaaaccctacgaaaaaaaaaaaaaatcccgaaaatccgcccttccctacgccttcgaaaccgacaaaaaacgctacgcgaacgaattaaaaaaaaaaaaaaaactcgtaataaaaatattaccgcatcctacctttaaacgctactcttaattaaataacccgattcgaacctt

SEQ ID NO: 12673 - DNA, 845 bp, Artificial Sequence
  chemically treated genomic DNA (Homo sapiens) CpG-island No: 12673
cgggtcgattttttttttagtttttttcgttttgtcgtcgtttattgcgtgttgttttcgttcgtttttttttttttcgttttttttttttttttttttgttttcgcgtcgtttcgcgtttttcgttcgttgtagtcggcgaggagcgtcgtacgttggtttcggcgcgaggagttttcgggttttcgggcgggtattggagtaaggagttgcgagcgtagttcgaggcggggtacggcggaaggcgcggcgagagcggggtttttgcgagcgtagtcggaagggcgtttaggagaagggggacgtcgttttcgtttttgtacggtgttcggttttttcgggtttcgcgcgcggttataattcggattgggcgcgttttcggtatttcgtatttttgcgcgcgttttatatttcgtattcggtattttagcggtcgggtatgtagtagcggtagtaacggcggaatatgggcgggaattatttttataagtttttcgtgtttgacgagaatgaggaaggtaagagagcgagaggtgcgaattttcgtttcgcggggtattttttttttttattattttcggtcgagttttgcggggtatcgtatgttgttcggcgcggggatttaggtatggttatttcgtttagcgaatgtagtgtgtgttcgattcgtgttaggcgcggcgtttttgttgaggtaatttttaggtatttagtgtcgtttagtagtcgggacggtgtttagcgcgggattggggaggcggttttagagagttgaattcgaaatttgtatttgggggtgtggaagggaggagttgatttcggaggttagtcgggatggttttagg

SEQ ID NO: 12674 - DNA, 845 bp, Artificial Sequence
  chemically treated genomic DNA (Homo sapiens) CpG-island No: 12674
cctaaaaccatcccgactaacctccgaaatcaactcctcccttccacacccccaaatacaaatttcgaattcaactctctaaaaccgcctccccaatcccgcgctaaacaccgtcccgactactaaacgacactaaatacctaaaaattacctcaacaaaaacgccgcgcctaacacgaatcgaacacacactacattcgctaaacgaaataaccatacctaaatccccgcgccgaacaacatacgataccccgcaaaactcgaccgaaaataataaaaaaaaaaaataccccgcgaaacgaaaattcgcacctctcgctctcttaccttcctcattctcgtcaaacacgaaaaacttataaaaataattcccgcccatattccgccgttactaccgctactacatacccgaccgctaaaataccgaatacgaaatataaaacgcgcgcaaaaatacgaaataccgaaaacgcgcccaatccgaattataaccgcgcgcgaaacccgaaaaaaccgaacaccgtacaaaaacgaaaacgacgtcccccttctcctaaacgcccttccgactacgctcgcaaaaaccccgctctcgccgcgccttccgccgtaccccgcctcgaactacgctcgcaactccttactccaatacccgcccgaaaacccgaaaactcctcgcgccgaaaccaacgtacgacgctcctcgccgactacaacgaacgaaaaacgcgaaacgacgcgaaaacaaaaaaaaaaaaaaaaaaaacgaaaaaaaaaaaaacgaacgaaaacaacacgcaataaacgacgacaaaacgaaaaaaactaaaaaaaaaatcgacccg

SEQ ID NO: 12675 - DNA, 845 bp, Artificial Sequence
  chemically treated genomic DNA (Homo sapiens) CpG-island No: 12675
tttagaattatttcgattggttttcgaagttaattttttttttttatatttttaagtgtaggtttcgggtttaattttttgaagtcgtttttttagtttcgcgttaggtatcgtttcgattattaaacggtattgggtatttaggagttgttttagtagaagcgtcgcgtttggtacgggtcgggtatatattgtattcgttgggcgaagtggttatgtttgggttttcgcgtcgggtagtatgcggtgtttcgtagggttcggtcgagggtggtggaggaaggggatgtttcgcgaagcgggaattcgtatttttcgtttttttattttttttattttcgttaaatacggggggtttgtgggagtggttttcgtttatatttcgtcgttgttgtcgttgttatatgttcggtcgttgggatgtcggatgcgggatgtgggacgcgcgtagagatgcgggatgtcgggggcgcgtttagttcgggttgtagtcgcgcgcggagttcgagggggtcgagtatcgtgtaggggcggggacggcgtttttttttttttggacgttttttcgattgcgttcgtagggatttcgttttcgtcgcgtttttcgtcgtgtttcgtttcgggttgcgttcgtagttttttattttagtgttcgttcgggaattcgggagtttttcgcgtcggggttaacgtgcggcgtttttcgtcggttatagcgggcgggagacgcgaggcggcgcgggagtaggggaaggaggggaaggagcgggggaggaggggacggacgaaggtagtacgtagtgggcggcggtagggcggaaggagttgagaaagggatcggttcg

SEQ ID NO: 12676 - DNA, 845 bp, Artificial Sequence
  chemically treated genomic DNA (Homo sapiens) CpG-island No: 12676
cgaaccgatccctttctcaactccttccgccctaccgccgcccactacgtactaccttcgtccgtcccctcctcccccgctccttcccctccttcccctactcccgcgccgcctcgcgtctcccgcccgctataaccgacgaaaaacgccgcacgttaaccccgacgcgaaaaactcccgaattcccgaacgaacactaaaataaaaaactacgaacgcaacccgaaacgaaacacgacgaaaaacgcgacgaaaacgaaatccctacgaacgcaatcgaaaaaacgtccaaaaaaaaaaaaacgccgtccccgcccctacacgatactcgaccccctcgaactccgcgcgcgactacaacccgaactaaacgcgcccccgacatcccgcatctctacgcgcgtcccacatcccgcatccgacatcccaacgaccgaacatataacaacgacaacaacgacgaaatataaacgaaaaccactcccacaaaccccccgtatttaacgaaaataaaaaaaataaaaaaacgaaaaatacgaattcccgcttcgcgaaacatccccttcctccaccaccctcgaccgaaccctacgaaacaccgcatactacccgacgcgaaaacccaaacataaccacttcgcccaacgaatacaatatatacccgacccgtaccaaacgcgacgcttctactaaaacaactcctaaatacccaataccgtttaataatcgaaacgatacctaacgcgaaactaaaaaaacgacttcaaaaaattaaacccgaaacctacacttaaaaatataaaaaaaaaaaattaacttcgaaaaccaatcgaaataattctaaa

SEQ ID NO: 12677 - DNA, 749 bp, Artificial Sequence
  chemically treated genomic DNA (Homo sapiens) CpG-island No: 12677
gggcgtcgggggcgtcggtcggggcgcgggggatttttttttcgggcggtagcggtagcggcgattcgatttcgcgggttgcgtcgttcgggttgttaagcgcggggggcgggcgggaggaaggggtggaggtgcgaggggaggagggttggtatcggagcgtcgcggcgtcggtgtaataaaaatgtatcgtatggaattgttcgtggagaaggacgggacggagtcggggtagttagaagaggtgggaaaagcggaggaggacgtttaggaggaggcggcggcggcggtcgggaagtgaaaggtttcgtaaagtttagcggcggttgcgggcgttcgagtttcgggttagcggtagacgagttcgtagggtcgtttcgcggggtagcgtagttaggtcggttatggtttcggggttttcgtcgttttttaggtgttcgggattcgttaggtcggtgcgcgagggttattttattttttcgcgcggtttcggtttttggtttttagttgtcggcgatcgttgatcgagttcggcgttttaggaggaggaagaaattagggtttcgttttttttcgaggacggcggcgttttatttcgtagtttagaggtttcggtttttttcggtattcgttcggttcggttgttttcggtttttttcggttatggggagttgcgcgcggttgttgttgttttgggtttgtttttttattataaatttttataaatataatttttaggttaaaaggta

SEQ ID NO: 12678 - DNA, 749 bp, Artificial Sequence
  chemically treated genomic DNA (Homo sapiens) CpG-island No: 12678
taccttttaacctaaaaattatatttataaaaatttataataaaaaaacaaacccaaaacaacaacaaccgcgcgcaactccccataaccgaaaaaaaccgaaaacaaccgaaccgaacgaataccgaaaaaaaccgaaacctctaaactacgaaataaaacgccgccgtcctcgaaaaaaaacgaaaccctaatttcttcctcctcctaaaacgccgaactcgatcaacgatcgccgacaactaaaaaccaaaaaccgaaaccgcgcgaaaaaataaaataaccctcgcgcaccgacctaacgaatcccgaacacctaaaaaacgacgaaaaccccgaaaccataaccgacctaactacgctaccccgcgaaacgaccctacgaactcgtctaccgctaacccgaaactcgaacgcccgcaaccgccgctaaactttacgaaacctttcacttcccgaccgccgccgccgcctcctcctaaacgtcctcctccgcttttcccacctcttctaactaccccgactccgtcccgtccttctccacgaacaattccatacgatacatttttattacaccgacgccgcgacgctccgataccaaccctcctcccctcgcacctccaccccttcctcccgcccgccccccgcgcttaacaacccgaacgacgcaacccgcgaaatcgaatcgccgctaccgctaccgcccgaaaaaaaaatcccccgcgccccgaccgacgcccccgacgccc

SEQ ID NO: 12679 - DNA, 749 bp, Artificial Sequence
  chemically treated genomic DNA (Homo sapiens) CpG-island No: 12679
tgttttttaatttaggaattatatttgtaagaatttatggtaaagaagtaggtttagagtagtagtagtcgcgcgtagttttttatggtcgggaggagtcgggagtagtcgggtcgggcgggtgtcggagggagtcgagatttttgggttgcgggatgaagcgtcgtcgttttcgggagggaacggggttttggtttttttttttttttggggcgtcgggttcggttagcggtcgtcggtagttgggagttaggggtcgggatcgcgcggggaggtggggtgattttcgcgtatcggtttggcgggtttcgggtatttggggggcggcgggagtttcgggattatagtcggtttggttgcgttgtttcgcggagcggttttgcgggttcgtttgtcgttagttcggggttcgggcgttcgtagtcgtcgttgaattttgcgagattttttatttttcggtcgtcgtcgtcgtttttttttgggcgttttttttcgttttttttattttttttggttgtttcggtttcgtttcgtttttttttacgggtagttttatgcgatgtatttttattgtatcgacgtcgcggcgtttcggtgttagttttttttttttcgtatttttatttttttttttcgttcgtttttcgcgtttgatagttcgggcggcgtagttcgcgggatcggatcgtcgttgtcgttgtcgttcggggggggggtttttcgcgtttcgatcgacgttttcgacgttt

SEQ ID NO: 12680 - DNA, 749 bp, Artificial Sequence
  chemically treated genomic DNA (Homo sapiens) CpG-island No: 12680
aaacgtcgaaaacgtcgatcgaaacgcgaaaaaccccccccccgaacgacaacgacaacgacgatccgatcccgcgaactacgccgcccgaactatcaaacgcgaaaaacgaacgaaaaaaaaaaataaaaatacgaaaaaaaaaaaactaacaccgaaacgccgcgacgtcgatacaataaaaatacatcgcataaaactacccgtaaaaaaaaacgaaacgaaaccgaaacaaccaaaaaaaataaaaaaaacgaaaaaaaacgcccaaaaaaaaacgacgacgacgaccgaaaaataaaaaatctcgcaaaattcaacgacgactacgaacgcccgaaccccgaactaacgacaaacgaacccgcaaaaccgctccgcgaaacaacgcaaccaaaccgactataatcccgaaactcccgccgccccccaaatacccgaaacccgccaaaccgatacgcgaaaatcaccccacctccccgcgcgatcccgacccctaactcccaactaccgacgaccgctaaccgaacccgacgccccaaaaaaaaaaaaaaaccaaaaccccgttccctcccgaaaacgacgacgcttcatcccgcaacccaaaaatctcgactccctccgacacccgcccgacccgactactcccgactcctcccgaccataaaaaactacgcgcgactactactactctaaacctacttctttaccataaattcttacaaatataattcctaaattaaaaaaca

SEQ ID NO: 12681 - DNA, 568 bp, Artificial Sequence
  chemically treated genomic DNA (Homo sapiens) CpG-island No: 12681
cgtagttcggattgtagggcggggagcgttcgggggtttcgttatttcgggtggtaacggcgtttggcgtgttcgttatgtttttggacgagaggtgagtagtgtcggttcgtaggcgaaggagagcgtaggaacggttttattttcgtttcgtttattttttttttttttcgatcgggattttttaggttttttttttcgtttcgtcgttttttcgacgatatcggttcggattttgttgttttttgagggtacgtagagtcgtagggtttgcgtgaaggggcgggtagtttttttgagtaatatcggttcggtttcgtgcgtttcggatatgagttatatttagtttcgggatcggttttttgtggtcgtttgtttgtttttgggggagcgggtcgcggggatttcgtttgttgcggaagagttttcgtagtcgttgcgtatcgcgatagtaggcggcgttcgagtttcgggtcgtgggttgtttttaggtggcgaggcggggagttggggatttttgggttgcgttttcgtcgatggtttcgagatatttttttatttgttaagt

SEQ ID NO: 12682 - DNA, 568 bp, Artificial Sequence
  chemically treated genomic DNA (Homo sapiens) CpG-island No: 12682
acttaacaaataaaaaaatatctcgaaaccatcgacgaaaacgcaacccaaaaatccccaactccccgcctcgccacctaaaaacaacccacgacccgaaactcgaacgccgcctactatcgcgatacgcaacgactacgaaaactcttccgcaacaaacgaaatccccgcgacccgctcccccaaaaacaaacaaacgaccacaaaaaaccgatcccgaaactaaatataactcatatccgaaacgcacgaaaccgaaccgatattactcaaaaaaactacccgccccttcacgcaaaccctacgactctacgtaccctcaaaaaacaacaaaatccgaaccgatatcgtcgaaaaaacgacgaaacgaaaaaaaaaacctaaaaaatcccgatcgaaaaaaaaaaaaaataaacgaaacgaaaataaaaccgttcctacgctctccttcgcctacgaaccgacactactcacctctcgtccaaaaacataacgaacacgccaaacgccgttaccacccgaaataacgaaacccccgaacgctccccgccctacaatccgaactacg

SEQ ID NO: 12683 - DNA, 568 bp, Artificial Sequence
  chemically treated genomic DNA (Homo sapiens) CpG-island No: 12683
atttaatagatgaggaagtgtttcggggttatcggcggaggcgtagtttaggggtttttagtttttcgtttcgttatttggggatagtttacggttcggggttcgggcgtcgtttgttgtcgcggtgcgtagcgattacgggaattttttcgtagtagacggggttttcgcggttcgtttttttaggggtaagtaagcgattataggggatcggtttcggggttggatgtggtttatgttcgaagcgtacggagtcgagtcggtgttgtttagggaggttgttcgtttttttacgtagattttgcggttttgcgtgtttttagggaatagtaaggttcgagtcggtgtcgtcgagggggcgacgggacggagggaggagtttgaggggtttcggtcgagggaggggaggagtgggcggggcgggggtggggtcgtttttgcgttttttttcgtttgcgggtcggtattgtttatttttcgtttagggatatgacgggtacgttaggcgtcgttgttattcgggatggcgaggttttcgagcgtttttcgttttgtagttcgagttacg

SEQ ID NO: 12684 - DNA, 568 bp, Artificial Sequence
  chemically treated genomic DNA (Homo sapiens) CpG-island No: 12684
cgtaactcgaactacaaaacgaaaaacgctcgaaaacctcgccatcccgaataacaacgacgcctaacgtacccgtcatatccctaaacgaaaaataaacaataccgacccgcaaacgaaaaaaaacgcaaaaacgaccccacccccgccccgcccactcctcccctccctcgaccgaaacccctcaaactcctccctccgtcccgtcgccccctcgacgacaccgactcgaaccttactattccctaaaaacacgcaaaaccgcaaaatctacgtaaaaaaacgaacaacctccctaaacaacaccgactcgactccgtacgcttcgaacataaaccacatccaaccccgaaaccgatcccctataatcgcttacttacccctaaaaaaacgaaccgcgaaaaccccgtctactacgaaaaaattcccgtaatcgctacgcaccgcgacaacaaacgacgcccgaaccccgaaccgtaaactatccccaaataacgaaacgaaaaactaaaaacccctaaactacgcctccgccgataaccccgaaacacttcctcatctattaaat

SEQ ID NO: 12685 - DNA, 621 bp, Artificial Sequence
  chemically treated genomic DNA (Homo sapiens) CpG-island No: 12685
cggcgggtttattcgtttagaatcgggaattcggcgagtttcgtttttgttattttagcgtcggtcgttcggtaataaatatttttattttttgagcgttagttttcgttcgtcgcggggcgtcgcgtcgagcgtaggtttcgtttcgcgcgtttttaatggtcggcgtcgtttattcggtcggagcgtttaggtttgtagttttttattggttcgcggaggtttttatttttagcgcggtttcgttttcggggtaaggagtcggggcggattttgggacgtttagacgtcgcgcggggcggggattggtttgtggttttttttcggtttttcgcggttcgcggcggtcgacggtttttgggatatttgtttgtttggttcgttcggcggtttagggtttttttgttgcgttttcggttcgttggacgggaagaagggttgggtcgtttcgtttcgtttttatcggaattttaagtcgcgtcgttgattcgtcgtagggcgagatgagcgcggacgtagcggtcggggcgtttttgtttcggttttgttgtttggagaagggttcgaacggttacggtttttatttgtacggggagaagggtaagttgggttagtatattt

SEQ ID NO: 12686 - DNA, 621 bp, Artificial Sequence
  chemically treated genomic DNA (Homo sapiens) CpG-island No: 12686
aaatatactaacccaacttacccttctccccgtacaaataaaaaccgtaaccgttcgaacccttctccaaacaacaaaaccgaaacaaaaacgccccgaccgctacgtccgcgctcatctcgccctacgacgaatcaacgacgcgacttaaaattccgataaaaacgaaacgaaacgacccaacccttcttcccgtccaacgaaccgaaaacgcaacaaaaaaaccctaaaccgccgaacgaaccaaacaaacaaatatcccaaaaaccgtcgaccgccgcgaaccgcgaaaaaccgaaaaaaaaccacaaaccaatccccgccccgcgcgacgtctaaacgtcccaaaatccgccccgactccttaccccgaaaacgaaaccgcgctaaaaataaaaacctccgcgaaccaataaaaaactacaaacctaaacgctccgaccgaataaacgacgccgaccattaaaaacgcgcgaaacgaaacctacgctcgacgcgacgccccgcgacgaacgaaaactaacgctcaaaaaataaaaatatttattaccgaacgaccgacgctaaaataacaaaaacgaaactcgccgaattcccgattctaaacgaataaacccgccg

SEQ ID NO: 12687 - DNA, 621 bp, Artificial Sequence
  chemically treated genomic DNA (Homo sapiens) CpG-island No: 12687
ggatgtattggtttaatttgttttttttttcgtgtaggtggaagtcgtagtcgttcggatttttttttaggtagtagagtcggggtaggggcgtttcggtcgttgcgttcgcgtttatttcgttttgcgacgggttagcggcgcgatttggggtttcgatggggacgggacgggacggtttagttttttttttcgtttagcgaatcgggagcgtagtagagaagttttgagtcgtcggacgggttaagtaagtaggtgttttaggaatcgtcggtcgtcgcgagtcgcgaggagtcgagagaggattatagattaattttcgtttcgcgcggcgtttgagcgttttagagttcgtttcggttttttatttcgggggcggggtcgcgttgagggtggggattttcgcgggttaatagggggttgtaggtttgggcgtttcggtcgggtgaacggcgtcggttattgggaacgcgcggggcggggtttgcgttcggcgcggcgtttcgcggcgggcgaagattagcgtttaggaagtggaagtgtttgttatcgagcggtcggcgttggggtggtaggggcggggttcgtcgaattttcggttttgggcgggtgggttcgtcg

SEQ ID NO: 12688 - DNA, 621 bp, Artificial Sequence
  chemically treated genomic DNA (Homo sapiens) CpG-island No: 12688
cgacgaacccacccgcccaaaaccgaaaattcgacgaaccccgcccctaccaccccaacgccgaccgctcgataacaaacacttccacttcctaaacgctaatcttcgcccgccgcgaaacgccgcgccgaacgcaaaccccgccccgcgcgttcccaataaccgacgccgttcacccgaccgaaacgcccaaacctacaaccccctattaacccgcgaaaatccccaccctcaacgcgaccccgcccccgaaataaaaaaccgaaacgaactctaaaacgctcaaacgccgcgcgaaacgaaaattaatctataatcctctctcgactcctcgcgactcgcgacgaccgacgattcctaaaacacctacttacttaacccgtccgacgactcaaaacttctctactacgctcccgattcgctaaacgaaaaaaaaaactaaaccgtcccgtcccgtccccatcgaaaccccaaatcgcgccgctaacccgtcgcaaaacgaaataaacgcgaacgcaacgaccgaaacgcccctaccccgactctactacctaaaaaaaaatccgaacgactacgacttccacctacacgaaaaaaaaaacaaattaaaccaatacatcc

SEQ ID NO: 12689 - DNA, 657 bp, Artificial Sequence
  chemically treated genomic DNA (Homo sapiens) CpG-island No: 12689
ggacgttaggggacgaattacgttgatttcgttagatacgcgatttcggggtcggcgttggcgtttgtattcgcgcgatttcgtcgttttttttgggagcgtcgtttaatcgttttcggcgacgattttttagagcgtcggggagttagtgtttacgcggggtagagttgcggcgcggttcgcgggtcgggttttttttttttaacgtcgggcggggttcgcggttttcgattcggtcgtttcgtcgtcgttttttttcgcgtttatttgttcgttttttttcggtcgttgttcgcgtcgtcgcgggttcgtttcgggattttattcggtttttgtcgtttttcgtttcgttagcgcgttttcgttttcgtcgcgtttttcgtcgtcgtcgtttcgtagtagtttttcggttgagtatatttcgtagttaatttttatcgtttcggatagtcgtcggaggattacgtcgcgacgtattaggtagcgtcgtcgttcgaaggttgttttgggattcgtcgtattcgtcgttgataggagtcgtcggagcgcgtttcgtcggtttgggcgtttgaagtattagttcggttttttttgttattggttcgtttaattttcggtcgtcggggcggagtcgtataggggaggggttaagatagg

SEQ ID NO: 12690 - DNA, 657 bp, Artificial Sequence
  chemically treated genomic DNA (Homo sapiens) CpG-island No: 12690
cctatcttaacccctcccctatacgactccgccccgacgaccgaaaattaaacgaaccaataacaaaaaaaaccgaactaatacttcaaacgcccaaaccgacgaaacgcgctccgacgactcctatcaacgacgaatacgacgaatcccaaaacaaccttcgaacgacgacgctacctaatacgtcgcgacgtaatcctccgacgactatccgaaacgataaaaattaactacgaaatatactcaaccgaaaaactactacgaaacgacgacgacgaaaaacgcgacgaaaacgaaaacgcgctaacgaaacgaaaaacgacaaaaaccgaataaaatcccgaaacgaacccgcgacgacgcgaacaacgaccgaaaaaaaacgaacaaataaacgcgaaaaaaaacgacgacgaaacgaccgaatcgaaaaccgcgaaccccgcccgacgttaaaaaaaaaaaacccgacccgcgaaccgcgccgcaactctaccccgcgtaaacactaactccccgacgctctaaaaaatcgtcgccgaaaacgattaaacgacgctcccaaaaaaaacgacgaaatcgcgcgaatacaaacgccaacgccgaccccgaaatcgcgtatctaacgaaatcaacgtaattcgtcccctaacgtcc

SEQ ID NO: 12691 - DNA, 657 bp, Artificial Sequence
  chemically treated genomic DNA (Homo sapiens) CpG-island No: 12691
tttgttttggttttttttttgtacggtttcgtttcgacggtcgggggttgggcgagttagtgataggaggggtcgggttggtattttaggcgtttaggtcggcggggcgcgtttcggcggtttttgttagcggcgggtgcggcggattttagggtagttttcgggcggcggcgttgtttggtgcgtcgcggcgtggtttttcggcggttgttcggggcggtaggagttggttgcgggatgtgtttagtcggggagttgttgcggggcggcgacggcggggaacgcgacgaggacggggacgcgttggcggagcgggaggcggtagggatcgggtgggatttcggggcgagttcgcggcggcgcggatagcggtcgaaggagagcgagtaggtgagcgcggggaggggcggcggcgaagcggtcgggtcgggggtcgcgagtttcgttcggcgttggagggaaggggttcggttcgcgggtcgcgtcgtagttttgtttcgcgtgggtattggtttttcggcgttttgggaagtcgtcgtcgggagcggttagacggcgtttttaggaggagcggcggggtcgcgcgagtgtagacgttagcgtcggtttcggggtcgcgtgtttggcggggttagcgtggttcgttttttggcgttt

SEQ ID NO: 12692 - DNA, 657 bp, Artificial Sequence
  chemically treated genomic DNA (Homo sapiens) CpG-island No: 12692
aaacgccaaaaaacgaaccacgctaaccccgccaaacacgcgaccccgaaaccgacgctaacgtctacactcgcgcgaccccgccgctcctcctaaaaacgccgtctaaccgctcccgacgacgacttcccaaaacgccgaaaaaccaatacccacgcgaaacaaaactacgacgcgacccgcgaaccgaaccccttccctccaacgccgaacgaaactcgcgacccccgacccgaccgcttcgccgccgcccctccccgcgctcacctactcgctctccttcgaccgctatccgcgccgccgcgaactcgccccgaaatcccacccgatccctaccgcctcccgctccgccaacgcgtccccgtcctcgtcgcgttccccgccgtcgccgccccgcaacaactccccgactaaacacatcccgcaaccaactcctaccgccccgaacaaccgccgaaaaaccacgccgcgacgcaccaaacaacgccgccgcccgaaaactaccctaaaatccgccgcacccgccgctaacaaaaaccgccgaaacgcgccccgccgacctaaacgcctaaaataccaacccgacccctcctatcactaactcgcccaacccccgaccgtcgaaacgaaaccgtacaaaaaaaaaaccaaaacaaa

SEQ ID NO: 12693 - DNA, 772 bp, Artificial Sequence
  chemically treated genomic DNA (Homo sapiens) CpG-island No: 12693
gaaattggcgtgggggaggggagggttgtttattcgagtaggacgcggttgtttatttagtcggaggtgaggaacgatttttttatttcgttgtcgggtttaagcggggttcgagagtcgtcggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggtcgggggcgcgcggcgtttttagcgggagggcgtttggattaggggtttcgtttttttttagcgtattttcgtttttttttagcgtattttcgtttcgcgttaggtttattcgtagggttttttttagtacgttcgcggtcgtagtagttagtttagtatttattttcgaagttcgaaatgattttatttagttgcgcgttgatcgcggggttcgatatgatggttggtgggtagcgggtcgcgcggagggtagcggcgaggaagcgttttcggcggggttcgggttttgcgcgttggttggggcgtcgcgttcgcgtttttgtagtgtagagttagtcgtcggaggagtttttaggttttttggtttagttgaatgaatgggggaggaaggcgggcgtcggttttt

SEQ ID NO: 12694 - DNA, 772 bp, Artificial Sequence
  chemically treated genomic DNA (Homo sapiens) CpG-island No: 12694
aaaaaccgacgcccgccttcctcccccattcattcaactaaaccaaaaaacctaaaaactcctccgacgactaactctacactacaaaaacgcgaacgcgacgccccaaccaacgcgcaaaacccgaaccccgccgaaaacgcttcctcgccgctaccctccgcgcgacccgctacccaccaaccatcatatcgaaccccgcgatcaacgcgcaactaaataaaatcatttcgaacttcgaaaataaatactaaactaactactacgaccgcgaacgtactaaaaaaaaccctacgaataaacctaacgcgaaacgaaaatacgctaaaaaaaaacgaaaatacgctaaaaaaaaacgaaacccctaatccaaacgccctcccgctaaaaacgccgcgcgcccccgaccccgtacccgcgccgcctacgtaaaaaaccctattaaaaacacccgcgtaaaccctacgcgccctcacaaaaccctatactcgttctacgcactaccgcctaaatttccttccttttattattatttatatttaccaaacgacaacgacctcctcgaaaactcgcgaaactacctcgaaactctccaaaacgcacaatttcactctaaaaaatccatcgatcccctccctttaactctccccgacgactctcgaaccccgcttaaacccgacaacgaaataaaaaaatcgttcctcacctccgactaaataaacaaccgcgtcctactcgaataaacaaccctcccctcccccacgccaatttc

SEQ ID NO: 12695 - DNA, 772 bp, Artificial Sequence
  chemically treated genomic DNA (Homo sapiens) CpG-island No: 12695
aggggtcggcgttcgttttttttttttatttatttagttgagttagggggtttaggggttttttcggcggttagttttgtattgtaggagcgcgggcgcggcgttttagttagcgcgtagggttcgggtttcgtcgggggcgttttttcgtcgttgtttttcgcgcgattcgttgtttattagttattatgtcggatttcgcggttaacgcgtagttggatgggattatttcggatttcgaaggtgggtgttgggttggttgttgcggtcgcggacgtgttggagaggattttgcgggtgggtttggcgcgggacgggggtgcgttgaggggagacgggagtgcgttgaggggagacgggatttttaatttaggcgttttttcgttgagagcgtcgcgcgttttcggtttcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggtttttttcggcggttttcgggtttcgtttggattcggtaacgggatagggaggtcgttttttattttcgattgagtggatagtcgcgttttgttcgggtggatagttttttttttttttacgttagtttt

SEQ ID NO: 12696 - DNA, 772 bp, Artificial Sequence
  chemically treated genomic DNA (Homo sapiens) CpG-island No: 12696
aaaactaacgtaaaaaaaaaaaaaactatccacccgaacaaaacgcgactatccactcaatcgaaaataaaaaacgacctccctatcccgttaccgaatccaaacgaaacccgaaaaccgccgaaaaaaaccaaaaaaaaaaaaccgataaatttcccaaaataaaactatacgtcctaaaaaattccgaaacaacctcgcgaaccctcgaaaaaatcgctatcgcttaacaaacacaaacaacaataaaaaaaaaaaaacccaaacgacaatacgcaaaacgaacacaaaatcctataaaaacgcgcaaaatctacgcgaatacccctaacaaaatcccccacgtaaacgacgcgaacacgaaaccgaaaacgcgcgacgctctcaacgaaaaaacgcctaaattaaaaatcccgtctcccctcaacgcactcccgtctcccctcaacgcacccccgtcccgcgccaaacccacccgcaaaatcctctccaacacgtccgcgaccgcaacaaccaacccaacacccaccttcgaaatccgaaataatcccatccaactacgcgttaaccgcgaaatccgacataataactaataaacaacgaatcgcgcgaaaaacaacgacgaaaaaacgcccccgacgaaacccgaaccctacgcgctaactaaaacgccgcgcccgcgctcctacaatacaaaactaaccgccgaaaaaacccctaaaccccctaactcaactaaataaataaaaaaaaaaaacgaacgccgacccct

SEQ ID NO: 12697 - DNA, 729 bp, Artificial Sequence
  chemically treated genomic DNA (Homo sapiens) CpG-island No: 12697
ggtattcgttttcgtcgttcgggtcgtttcgttcggtttcgtagagcgtcgcgtttaggttgcgattttttttttttattttgttcggttgcgtagtgcgtttttcgtttagtttgtagagttcgcgtcgcggtagtttagtcgttcggtttcgtcgcgttcgtagaggtcgttatgggatcgcgcgttggttcgcgttgggtagttttttcgttttggttgggttgttggaaggtcggttcgtgggcgaggaggaagtcggttttggcgaatgtgataagtttttttacgtcgggatttcgtttgcggggttggcggtcgatttttacgtgaagatttgttagcgcgcggagggtgttgagcgtttcgttattttttatagtattcgggatcgtattttcgtgtatttcgcgtttcggtttcgcgtttgtcgtcggcggcgtcgagtagcgatggttggtggagtcgtaggtaagcgaagtggttttcgagtcgggttgcgggcgtcggagatcgtgtcgttggatttgtttttagttgtagttatcgcgaggggcgggtcgggaatagtaatttttacgttttcggtgttttgggttaagaaattcgggttttaggtttattttgttgcgttttcggagtttagtttgtttcgttttttgtcgaggttataataagagtttggcgatttgcgagtttttattttatgagttgtaggggcgggaggtt

SEQ ID NO: 12698 - DNA, 729 bp, Artificial Sequence
  chemically treated genomic DNA (Homo sapiens) CpG-island No: 12698
aacctcccgcccctacaactcataaaataaaaactcgcaaatcgccaaactcttattataacctcgacaaaaaacgaaacaaactaaactccgaaaacgcaacaaaataaacctaaaacccgaatttcttaacccaaaacaccgaaaacgtaaaaattactattcccgacccgcccctcgcgataactacaactaaaaacaaatccaacgacacgatctccgacgcccgcaacccgactcgaaaaccacttcgcttacctacgactccaccaaccatcgctactcgacgccgccgacgacaaacgcgaaaccgaaacgcgaaatacacgaaaatacgatcccgaatactataaaaaataacgaaacgctcaacaccctccgcgcgctaacaaatcttcacgtaaaaatcgaccgccaaccccgcaaacgaaatcccgacgtaaaaaaacttatcacattcgccaaaaccgacttcctcctcgcccacgaaccgaccttccaacaacccaaccaaaacgaaaaaactacccaacgcgaaccaacgcgcgatcccataacgacctctacgaacgcgacgaaaccgaacgactaaactaccgcgacgcgaactctacaaactaaacgaaaaacgcactacgcaaccgaacaaaataaaaaaaaaaaatcgcaacctaaacgcgacgctctacgaaaccgaacgaaacgacccgaacgacgaaaacgaatacc

SEQ ID NO: 12699 - DNA, 729 bp, Artificial Sequence
  chemically treated genomic DNA (Homo sapiens) CpG-island No: 12699
gatttttcgtttttgtagtttatgaagtgaaggttcgtagatcgttaggtttttattgtagtttcgatagggggcgaggtaggttaaatttcggggacgtaatagggtggatttggaattcgggttttttggtttaaggtatcgaaggcgtagggattgttgttttcggttcgtttttcgcggtagttgtaattgggggtaagtttagcggtacggttttcggcgttcgtagttcggttcgggaattatttcgtttatttgcggttttattagttatcgttgttcggcgtcgtcggcggtaggcgcggggtcggaacgcggagtatacggggatgcggtttcgggtgttgtagagggtggcgaagcgtttagtatttttcgcgcgttgatagatttttacgtgggaatcggtcgttagtttcgtaggcggggtttcggcgtagaagaatttgttatattcgttaaagtcggtttttttttcgtttacgagtcggttttttagtagtttagttagggcgaagaggttgtttagcgcgagttagcgcgcggttttatggcggtttttgcgagcgcggcggggtcgagcggttgggttgtcgcggcgcgagttttgtaggttgggcggggagcgtattacgtagtcgagtagggtagggaagggaagtcgtagtttaggcgcggcgttttgcggagtcgggcggggcggttcgggcggcgggggcgggtatt

SEQ ID NO: 12700 - DNA, 729 bp, Artificial Sequence
  chemically treated genomic DNA (Homo sapiens) CpG-island No: 12700
aatacccgcccccgccgcccgaaccgccccgcccgactccgcaaaacgccgcgcctaaactacgacttcccttccctaccctactcgactacgtaatacgctccccgcccaacctacaaaactcgcgccgcgacaacccaaccgctcgaccccgccgcgctcgcaaaaaccgccataaaaccgcgcgctaactcgcgctaaacaacctcttcgccctaactaaactactaaaaaaccgactcgtaaacgaaaaaaaaaccgactttaacgaatataacaaattcttctacgccgaaaccccgcctacgaaactaacgaccgattcccacgtaaaaatctatcaacgcgcgaaaaatactaaacgcttcgccaccctctacaacacccgaaaccgcatccccgtatactccgcgttccgaccccgcgcctaccgccgacgacgccgaacaacgataactaataaaaccgcaaataaacgaaataattcccgaaccgaactacgaacgccgaaaaccgtaccgctaaacttacccccaattacaactaccgcgaaaaacgaaccgaaaacaacaatccctacgccttcgataccttaaaccaaaaaacccgaattccaaatccaccctattacgtccccgaaatttaacctacctcgccccctatcgaaactacaataaaaacctaacgatctacgaaccttcacttcataaactacaaaaacgaaaaatc

SEQ ID NO: 12701 - DNA, 944 bp, Artificial Sequence
  chemically treated genomic DNA (Homo sapiens) CpG-island No: 12701
cgttcgttttttcgttcggtttttttcggcgtttttacgcgggcgtaatcgcgagaaagaaacgtaggtcgtatcgttagcgtttagagtagcgttagttttcgggttcgggttgttttcggagttatgagttgcggtcgtttttttttcgacgtggacggtatgattatttttaaggtggataatttgatttatcgtatttttttcgatagtttgaggcgcgtgttcgagaagtacgggcgcgtgggcgacgtgtatatttcgcgggagttttatattaaggcgtttcggggtttcgttttcgttcgtttttacgatcggcgcgacgtttaagacgtcgaggtcgttatggacggggcggagttggacggacgcgagttgcgggtgtaggtggcgcgttatggtcgtcgggatttgtttcgtagtcgttagggagagttacgcggtaggtttagaggcggcggttacggacggcggagtcgtagttacgggcggcggagtcgtagttttaggcggcgatatcgtagtcgatttcggggttttagttgttttaggtttcgtagtcgatttcgttataggggttttcgttatagtcggtttttttatagtcgatttttttatagtcggtcgcgttatagtcgttttttttatagtagatttcgttatagggaatttcgttacggcggattttattatagtttatttggttatagtaattttcgttatagtcgatattatagtagtcggttttattcgaagtttgggttttttattagttttcgttttgtattaatttttaaatcgagttttgcgcgacgatttaagtttttttcggtttttaggtttcgttcgcggtttaggtttttatttatgattaggagtttttttcgggtatttaagaggaaatttaagttaaggtcgcgatttaagaggttttttaagtt

SEQ ID NO: 12702 - DNA, 944 bp, Artificial Sequence
  chemically treated genomic DNA (Homo sapiens) CpG-island No: 12702
aacttaaaaaacctcttaaatcgcgaccttaacttaaatttcctcttaaatacccgaaaaaaactcctaatcataaataaaaacctaaaccgcgaacgaaacctaaaaaccgaaaaaaacttaaatcgtcgcgcaaaactcgatttaaaaattaatacaaaacgaaaactaataaaaaacccaaacttcgaataaaaccgactactataatatcgactataacgaaaattactataaccaaataaactataataaaatccgccgtaacgaaattccctataacgaaatctactataaaaaaaacgactataacgcgaccgactataaaaaaatcgactataaaaaaaccgactataacgaaaacccctataacgaaatcgactacgaaacctaaaacaactaaaaccccgaaatcgactacgatatcgccgcctaaaactacgactccgccgcccgtaactacgactccgccgtccgtaaccgccgcctctaaacctaccgcgtaactctccctaacgactacgaaacaaatcccgacgaccataacgcgccacctacacccgcaactcgcgtccgtccaactccgccccgtccataacgacctcgacgtcttaaacgtcgcgccgatcgtaaaaacgaacgaaaacgaaaccccgaaacgccttaatataaaactcccgcgaaatatacacgtcgcccacgcgcccgtacttctcgaacacgcgcctcaaactatcgaaaaaaatacgataaatcaaattatccaccttaaaaataatcataccgtccacgtcgaaaaaaaaacgaccgcaactcataactccgaaaacaacccgaacccgaaaactaacgctactctaaacgctaacgatacgacctacgtttctttctcgcgattacgcccgcgtaaaaacgccgaaaaaaaccgaacgaaaaaacgaacg

SEQ ID NO: 12703 - DNA, 944 bp, Artificial Sequence
  chemically treated genomic DNA (Homo sapiens) CpG-island No: 12703
gatttggggggttttttggatcgcgattttgatttggatttttttttggatattcggggaggatttttggttatagatgaagatttggatcgcgagcgagatttggagatcgaggaggatttggatcgtcgcgtagagttcgatttggaggttgatgtagagcgagagttagtggaggatttagatttcgagtgagatcggttgttgtgatatcggttgtagcgagagttattgtaattagatgagttgtagtgagattcgtcgtagcgagattttttgtagcgagatttgttgtagggagagcggttgtagcgcgatcggttgtaaggagatcggttgtagggagatcggttatagcgagaatttttatagcgagatcggttgcgggatttggagtagttgggatttcgggatcggttgcggtgtcgtcgtttggggttgcggtttcgtcgttcgtagttgcggtttcgtcgttcgtagtcgtcgtttttggatttgtcgcgtggttttttttggcggttgcggggtaggtttcggcggttatagcgcgttatttgtattcgtagttcgcgttcgtttagtttcgtttcgtttatggcggtttcggcgttttgggcgtcgcgtcggtcgtgaaagcggacgaaagcgaagtttcggggcgttttggtgtggggttttcgcgggatgtatacgtcgtttacgcgttcgtatttttcgaatacgcgttttaagttgtcgggagaggtgcggtaggttaggttgtttattttgagggtgattatgtcgtttacgtcgggaggggggcggtcgtagtttatggtttcgagagtagttcgggttcggaaattggcgttgttttgggcgttgacggtgcgatttgcgtttttttttcgcggttgcgttcgcgtggggacgtcgggaaaggtcgggcggagaggcgggcg

SEQ ID NO: 12704 - DNA, 944 bp, Artificial Sequence
  chemically treated genomic DNA (Homo sapiens) CpG-island No: 12704
cgcccgcctctccgcccgacctttcccgacgtccccacgcgaacgcaaccgcgaaaaaaaaacgcaaatcgcaccgtcaacgcccaaaacaacgccaatttccgaacccgaactactctcgaaaccataaactacgaccgcccccctcccgacgtaaacgacataatcaccctcaaaataaacaacctaacctaccgcacctctcccgacaacttaaaacgcgtattcgaaaaatacgaacgcgtaaacgacgtatacatcccgcgaaaaccccacaccaaaacgccccgaaacttcgctttcgtccgctttcacgaccgacgcgacgcccaaaacgccgaaaccgccataaacgaaacgaaactaaacgaacgcgaactacgaatacaaataacgcgctataaccgccgaaacctaccccgcaaccgccaaaaaaaaccacgcgacaaatccaaaaacgacgactacgaacgacgaaaccgcaactacgaacgacgaaaccgcaaccccaaacgacgacaccgcaaccgatcccgaaatcccaactactccaaatcccgcaaccgatctcgctataaaaattctcgctataaccgatctccctacaaccgatctccttacaaccgatcgcgctacaaccgctctccctacaacaaatctcgctacaaaaaatctcgctacgacgaatctcactacaactcatctaattacaataactctcgctacaaccgatatcacaacaaccgatctcactcgaaatctaaatcctccactaactctcgctctacatcaacctccaaatcgaactctacgcgacgatccaaatcctcctcgatctccaaatctcgctcgcgatccaaatcttcatctataaccaaaaatcctccccgaatatccaaaaaaaaatccaaatcaaaatcgcgatccaaaaaaccccccaaatc

SEQ ID NO: 12705 - DNA, 808 bp, Artificial Sequence
  chemically treated genomic DNA (Homo sapiens) CpG-island No: 12705
  misc_feature (497)..(497): n is either a, c, g or t
cggacgtttcggatttgttggtgtcgatcgtgtattaggatattaaggtggcgatttcgggattcgtttttaagcgttcgttatgtgagcgattcgtggttcggtttgttgagttcgcgttttttaataagcgttattgttttagtttcgattttttggaggcgttggatcggtcgattacggagattttgtcggagttatcgttttcggagttcgttgtgtcgcgcgttcggattcgcgaggtcgagttacgtcgtcgcgttcgttttaagagcgcgttttcgggtttgacgttcgcgttcgttttgtcgttcgtgttgtttcgtcgagggcgggaggtttagcgtgcggcgcgggtcgaggtatcgtcgcgtttttgttaattagttgcgttttattaagttgtagtcgtagttgggtggttaggtttatatcgcgttatgtgcgtcgtcgcgggtcgtcgcgtatttttcgagttattcgcgggtttttatttntacgtgcgtttttttcggatattaagttagacgacgtagtgttttagtacgtcgtatggggtttacggttatgcgggttcgtcgaggtagcgttatgggttcgttttcgtttcgtagttttacggttttacggtgttcgggtttcgttatatggcgttgtcgtatatttcgacgttaagcgatttatattgtgcggattttcgggcgttttattgcgacgggtttttgtatgggtttcgggattacgttaagcgtcgtagtttgttttttattattttttcgggttttatttagtttttttatatagagga

SEQ ID NO: 12706 - DNA, 808 bp, Artificial Sequence
  chemically treated genomic DNA (Homo sapiens) CpG-island No: 12706
  misc_feature (312)..(312): n is either a, c, g or t
tcctctatataaaaaaactaaataaaacccgaaaaaataataaaaaacaaactacgacgcttaacgtaatcccgaaacccatacaaaaacccgtcgcaataaaacgcccgaaaatccgcacaatataaatcgcttaacgtcgaaatatacgacaacgccatataacgaaacccgaacaccgtaaaaccgtaaaactacgaaacgaaaacgaacccataacgctacctcgacgaacccgcataaccgtaaaccccatacgacgtactaaaacactacgtcgtctaacttaatatccgaaaaaaacgcacgtanaaataaaaacccgcgaataactcgaaaaatacgcgacgacccgcgacgacgcacataacgcgatataaacctaaccacccaactacgactacaacttaataaaacgcaactaattaacaaaaacgcgacgatacctcgacccgcgccgcacgctaaacctcccgccctcgacgaaacaacacgaacgacaaaacgaacgcgaacgtcaaacccgaaaacgcgctcttaaaacgaacgcgacgacgtaactcgacctcgcgaatccgaacgcgcgacacaacgaactccgaaaacgataactccgacaaaatctccgtaatcgaccgatccaacgcctccaaaaaatcgaaactaaaacaataacgcttattaaaaaacgcgaactcaacaaaccgaaccacgaatcgctcacataacgaacgcttaaaaacgaatcccgaaatcgccaccttaatatcctaatacacgatcgacaccaacaaatccgaaacgtccg

SEQ ID NO: 12707 - DNA, 808 bp, Artificial Sequence
  chemically treated genomic DNA (Homo sapiens) CpG-island No: 12707
  misc_feature (312)..(312): n is either a, c, g or t
ttttttgtatagaagaattgggtggggttcggaggggtgatgaagggtagattgcggcgtttggcgtagtttcggggtttatgtaggggttcgtcgtagtagaacgttcggggattcgtatagtatgagtcgtttggcgtcggggtgtgcgatagcgttatatggcggggttcgggtatcgtgaggtcgtggaattgcggggcgggggcgggtttatggcgttgtttcggcgggttcgtatgatcgtgagttttatgcggcgtgttggagtattgcgtcgtttggtttgatgttcggaaggagcgtacgtanggatagggattcgcgggtggttcgggaagtgcgcggcggttcgcggcggcgtatatggcgcgatgtgggtttggttatttagttgcggttgtaatttgatgggacgtagttagttggtaagggcgcggcgatgtttcggttcgcgtcgtacgttgggtttttcgttttcggcggggtaatacgggcggtaaggcgggcgcgggcgttaggttcgggggcgcgtttttggagcgggcgcggcggcgtggttcggtttcgcgggttcgggcgcgcggtatagcgggtttcgggggcggtggtttcggtagggttttcgtggtcggtcggtttagcgtttttaggaagtcgaagttggggtagtggcgtttgttgaaaggcgcgggtttagtaggtcgggttacggatcgtttatatggcgagcgtttggaagcgggtttcggggtcgttattttgatgttttggtatacggtcgatattagtaggttcggagcgttcg

SEQ ID NO: 12708 - DNA, 808 bp, Artificial Sequence
  chemically treated genomic DNA (Homo sapiens) CpG-island No: 12708
  misc_feature (497)..(497): n is either a, c, g or t
cgaacgctccgaacctactaatatcgaccgtataccaaaacatcaaaataacgaccccgaaacccgcttccaaacgctcgccatataaacgatccgtaacccgacctactaaacccgcgcctttcaacaaacgccactaccccaacttcgacttcctaaaaacgctaaaccgaccgaccacgaaaaccctaccgaaaccaccgcccccgaaacccgctataccgcgcgcccgaacccgcgaaaccgaaccacgccgccgcgcccgctccaaaaacgcgcccccgaacctaacgcccgcgcccgccttaccgcccgtattaccccgccgaaaacgaaaaacccaacgtacgacgcgaaccgaaacatcgccgcgcccttaccaactaactacgtcccatcaaattacaaccgcaactaaataaccaaacccacatcgcgccatatacgccgccgcgaaccgccgcgcacttcccgaaccacccgcgaatccctatccntacgtacgctccttccgaacatcaaaccaaacgacgcaatactccaacacgccgcataaaactcacgatcatacgaacccgccgaaacaacgccataaacccgcccccgccccgcaattccacgacctcacgatacccgaaccccgccatataacgctatcgcacaccccgacgccaaacgactcatactatacgaatccccgaacgttctactacgacgaacccctacataaaccccgaaactacgccaaacgccgcaatctacccttcatcacccctccgaaccccacccaattcttctatacaaaaaa

SEQ ID NO: 12709 - DNA, 555 bp, Artificial Sequence
  chemically treated genomic DNA (Homo sapiens) CpG-island No: 12709
cgatgggtcgtgggtttgttgtttaattttttgagatcggcgggttgaatagagtttcgaagtgtagcgttattttgagtagaggaaggggcgttcgaaggtcgcgtagcgggcggtagggcgggaggaagtagtagttgttgtttttcgtttatttttttcgcgtgtgttttttcgttttattgttcgtcggtgagttaggtggcgcgagagcggaggggagaaaagatagcggttgtaggagtcgaaggtcgcggttcgaggtggggtaggggcgggtacgcgagcgtgcgtgcgtgggcgcggtttatagtacgtcgcgcgcggggcggatgttcgggtcggttgggtcggggtcgcggaggagatggcggaaggtggaggttgtcgtgagcgatcggatgcggagatttagaagttcgagtttggatttttaatgaggattatattttaacgcggggcgtagtggtgagttttcggttcgttttttttttatgtagaattaggggtcgagaaaaaggggttttttttttttcggttagagtaggggttggg

SEQ ID NO: 12710 - DNA, 555 bp, Artificial Sequence
  chemically treated genomic DNA (Homo sapiens) CpG-island No: 12710
cccaacccctactctaaccgaaaaaaaaaaaacccctttttctcgacccctaattctacataaaaaaaaaacgaaccgaaaactcaccactacgccccgcgttaaaatataatcctcattaaaaatccaaactcgaacttctaaatctccgcatccgatcgctcacgacaacctccaccttccgccatctcctccgcgaccccgacccaaccgacccgaacatccgccccgcgcgcgacgtactataaaccgcgcccacgcacgcacgctcgcgtacccgcccctaccccacctcgaaccgcgaccttcgactcctacaaccgctatcttttctcccctccgctctcgcgccacctaactcaccgacgaacaataaaacgaaaaaacacacgcgaaaaaaataaacgaaaaacaacaactactacttcctcccgccctaccgcccgctacgcgaccttcgaacgccccttcctctactcaaaataacgctacacttcgaaactctattcaacccgccgatctcaaaaaattaaacaacaaacccacgacccatcg

SEQ ID NO: 12711 - DNA, 555 bp, Artificial Sequence
  chemically treated genomic DNA (Homo sapiens) CpG-island No: 12711
tttagtttttattttagtcgagaaaaaggaggtttttttttttcggtttttggttttgtatagaggaagagcgagtcgggagtttattattgcgtttcgcgttggagtgtggtttttattaagggtttaagttcggatttttgagttttcgtattcggtcgtttacggtagtttttatttttcgttatttttttcgcggtttcggtttagtcggttcggatattcgtttcgcgcgcggcgtgttatagatcgcgtttacgtacgtacgttcgcgtgttcgtttttgttttatttcgagtcgcggttttcggtttttgtagtcgttgttttttttttttttcgttttcgcgttatttagtttatcggcgaatagtggagcggaaaggtatacgcgagaggggtgggcggggagtagtagttgttattttttttcgttttgtcgttcgttacgcggttttcgggcgtttttttttttgtttaggatggcgttatatttcgaagttttgtttagttcgtcgattttagggagttaggtagtaagtttacgatttatcg

SEQ ID NO: 12712 - DNA, 555 bp, Artificial Sequence
  chemically treated genomic DNA (Homo sapiens) CpG-island No: 12712
cgataaatcgtaaacttactacctaactccctaaaatcgacgaactaaacaaaacttcgaaatataacgccatcctaaacaaaaaaaaaaacgcccgaaaaccgcgtaacgaacgacaaaacgaaaaaaaataacaactactactccccgcccacccctctcgcgtatacctttccgctccactattcgccgataaactaaataacgcgaaaacgaaaaaaaaaaaaaacaacgactacaaaaaccgaaaaccgcgactcgaaataaaacaaaaacgaacacgcgaacgtacgtacgtaaacgcgatctataacacgccgcgcgcgaaacgaatatccgaaccgactaaaccgaaaccgcgaaaaaaataacgaaaaataaaaactaccgtaaacgaccgaatacgaaaactcaaaaatccgaacttaaacccttaataaaaaccacactccaacgcgaaacgcaataataaactcccgactcgctcttcctctatacaaaaccaaaaaccgaaaaaaaaaaacctcctttttctcgactaaaataaaaactaaa

SEQ ID NO: 12713 - DNA, 688 bp, Artificial Sequence
  chemically treated genomic DNA (Homo sapiens) CpG-island No: 12713
attaatttagacgttgtgtgtcgcgagcgttcgaggtattttttttattatggtgacggtcgtagagtcgttaggagtagtcgttggagtgcgaaaacgtttttaattttcgggttttaaagatttataagtttatattacgtaggtcgggataggaaagagttattttttaaaacggtcgagtgaagagtaagaattacgtagcggtttcgagtttttgtttttcgtttttagttaggaggacggaagttgttggtaggcggtatttggtcggtatatcgtcggaagtgtggaggtgtggttgttcgaggcggtagagcggagaaagtttatttttttttcgtttagatatattgttttttgtttaggttggcgtcgagatttgaggtcgttgtagattttggcgcggttcgcgttttttgttttaagagtttagcggtgagagttggtttgcggtacgcggtttaatgttaggtgagtattgtttcgagttgtgagatatcgcgcgtttgtgattttgttatagcgttgggtatcgttgattttttaggttgcgacggatatagttagttacggaagaggataatagggttttcggatttttttcggtgttcgtttagtatggaagtttttttttattattcggcgaagtcgatttatttttgtttcggttattttgtgtaatgtg

SEQ ID NO: 12714 - DNA, 688 bp, Artificial Sequence
  chemically treated genomic DNA (Homo sapiens) CpG-island No: 12714
cacattacacaaaataaccgaaacaaaaataaatcgacttcgccgaataataaaaaaaaacttccatactaaacgaacaccgaaaaaaatccgaaaaccctattatcctcttccgtaactaactatatccgtcgcaacctaaaaaatcaacgatacccaacgctataacaaaatcacaaacgcgcgatatctcacaactcgaaacaatactcacctaacattaaaccgcgtaccgcaaaccaactctcaccgctaaactcttaaaacaaaaaacgcgaaccgcgccaaaatctacaacgacctcaaatctcgacgccaacctaaacaaaaaacaatatatctaaacgaaaaaaaaataaactttctccgctctaccgcctcgaacaaccacacctccacacttccgacgatataccgaccaaataccgcctaccaacaacttccgtcctcctaactaaaaacgaaaaacaaaaactcgaaaccgctacgtaattcttactcttcactcgaccgttttaaaaaataactctttcctatcccgacctacgtaatataaacttataaatctttaaaacccgaaaattaaaaacgttttcgcactccaacgactactcctaacgactctacgaccgtcaccataataaaaaaaatacctcgaacgctcgcgacacacaacgtctaaattaat

SEQ ID NO: 12715 - DNA, 688 bp, Artificial Sequence
  chemically treated genomic DNA (Homo sapiens) CpG-island No: 12715
tatattatatagagtgatcggaataaagatgagtcgatttcgtcgaatgatagagaaaaatttttatattgagcgaatatcgaggggagttcggaggttttgttgttttttttcgtggttggttgtgttcgtcgtagtttgaaaggttagcggtatttagcgttgtgatagggttataggcgcgcgatgttttatagttcggagtagtatttatttggtattaggtcgcgtgtcgtaggttagtttttatcgttgggtttttgaagtaggaggcgcgagtcgcgttaaagtttgtaacggttttaagtttcgacgttagtttaggtaaaaggtaatgtatttaaacgaaaagaaaataggtttttttcgttttatcgtttcgggtagttatatttttatattttcggcggtgtatcggttaaatgtcgtttgttagtaattttcgtttttttagttaaaagcggaaaatagaggttcggaatcgttgcgtggtttttgttttttattcggtcgttttaaagggtgatttttttttgtttcggtttgcgtggtgtgggtttgtgggtttttgagattcgaaaattgagagcgttttcgtattttagcggttgtttttggcggttttgcggtcgttattatggtaaggaggatgtttcggacgttcgcgatatatagcgtttgagttagt

SEQ ID NO: 12716 - DNA, 688 bp, Artificial Sequence
  chemically treated genomic DNA (Homo sapiens) CpG-island No: 12716
actaactcaaacgctatatatcgcgaacgtccgaaacatcctccttaccataataacgaccgcaaaaccgccaaaaacaaccgctaaaatacgaaaacgctctcaattttcgaatctcaaaaacccacaaacccacaccacgcaaaccgaaacaaaaaaaaatcaccctttaaaacgaccgaataaaaaacaaaaaccacgcaacgattccgaacctctattttccgcttttaactaaaaaaacgaaaattactaacaaacgacatttaaccgatacaccgccgaaaatataaaaatataactacccgaaacgataaaacgaaaaaaacctattttcttttcgtttaaatacattaccttttacctaaactaacgtcgaaacttaaaaccgttacaaactttaacgcgactcgcgcctcctacttcaaaaacccaacgataaaaactaacctacgacacgcgacctaataccaaataaatactactccgaactataaaacatcgcgcgcctataaccctatcacaacgctaaataccgctaacctttcaaactacgacgaacacaaccaaccacgaaaaaaaacaacaaaacctccgaactcccctcgatattcgctcaatataaaaatttttctctatcattcgacgaaatcgactcatctttattccgatcactctatataatata

SEQ ID NO: 12717 - DNA, 512 bp, Artificial Sequence
  chemically treated genomic DNA (Homo sapiens) CpG-island No: 12717
tcgcgtcgcgtttattttttttcgggtttttaggtatcgttgtagcgtttgttgggtgagttcgtcgacgcgtagttggttttttttgtagggtattacgatgttcgttttgtcgaagtatacggttatttttattttggttttcggcgattacgtcgggtcgggtcgaataggtgtttgatttcgcggcgtagtttttattttcggaggacgttcggggcgggtgggtttagagattcggggcgtcgtttttcggaatattttgaggttcggaggttcgcgtagcgttttttttatttggttaggcggtaggtggcgggaatcggggaggggcggtcgcggaaaggggttattttttaggtgttcggcggttcgggacgcggtagttcgcggttcggtttttttttttttttttttcgtttttatttttgttcggtttaggcggttgtttcgcgtttattaaagcgaaattgtcggttttgttttgtcgttggttttggttttggttttgg

SEQ ID NO: 12718 - DNA, 512 bp, Artificial Sequence
  chemically treated genomic DNA (Homo sapiens) CpG-island No: 12718
ccaaaaccaaaaccaaaaccaacgacaaaacaaaaccgacaatttcgctttaataaacgcgaaacaaccgcctaaaccgaacaaaaataaaaacgaaaaaaaaaaaaaaaaaaaccgaaccgcgaactaccgcgtcccgaaccgccgaacacctaaaaaataacccctttccgcgaccgcccctccccgattcccgccacctaccgcctaaccaaataaaaaaaacgctacgcgaacctccgaacctcaaaatattccgaaaaacgacgccccgaatctctaaacccacccgccccgaacgtcctccgaaaataaaaactacgccgcgaaatcaaacacctattcgacccgacccgacgtaatcgccgaaaaccaaaataaaaataaccgtatacttcgacaaaacgaacatcgtaataccctacaaaaaaaaccaactacgcgtcgacgaactcacccaacaaacgctacaacgatacctaaaaacccgaaaaaaaataaacgcgacgcga

SEQ ID NO: 12719 - DNA, 512 bp, Artificial Sequence
  chemically treated genomic DNA (Homo sapiens) CpG-island No: 12719
ttagggttagggttaggattagcgatagggtagggtcggtagtttcgttttggtgggcgcggagtagtcgtttgggtcgggtaggagtaggagcgggaggaggaggaggaggagtcgggtcgcggattgtcgcgtttcgggtcgtcgggtatttgggaggtaattttttttcgcggtcgttttttttcgattttcgttatttgtcgtttggttaggtggaaggggcgttgcgcgagttttcgggttttagggtgtttcggggagcggcgtttcgggtttttgggtttattcgtttcgggcgtttttcgagagtgggggttgcgtcgcggggttagatatttgttcggttcggttcggcgtggtcgtcgggggttaggatgaaagtgatcgtgtgtttcggtaggacgggtatcgtggtgttttgtaaggagggttagttgcgcgtcggcgagtttatttagtaggcgttgtagcggtatttgaagattcgggagaaggtgagcgcggcgcgg

SEQ ID NO: 12720 - DNA, 512 bp, Artificial Sequence
  chemically treated genomic DNA (Homo sapiens) CpG-island No: 12720
ccgcgccgcgctcaccttctcccgaatcttcaaataccgctacaacgcctactaaataaactcgccgacgcgcaactaaccctccttacaaaacaccacgatacccgtcctaccgaaacacacgatcactttcatcctaacccccgacgaccacgccgaaccgaaccgaacaaatatctaaccccgcgacgcaacccccactctcgaaaaacgcccgaaacgaataaacccaaaaacccgaaacgccgctccccgaaacaccctaaaacccgaaaactcgcgcaacgccccttccacctaaccaaacgacaaataacgaaaatcgaaaaaaaacgaccgcgaaaaaaaattacctcccaaatacccgacgacccgaaacgcgacaatccgcgacccgactcctcctcctcctcctcccgctcctactcctacccgacccaaacgactactccgcgcccaccaaaacgaaactaccgaccctaccctatcgctaatcctaaccctaaccctaa

SEQ ID NO: 12721 - DNA, 587 bp, Artificial Sequence
  chemically treated genomic DNA (Homo sapiens) CpG-island No: 12721
gttttttcgttgtttttgagtagggggtcgtggggggagttggtcggcggtcggtatggggtttttattttttttttttaacggtcgcgggtgtaggtgtcgcgggtcgagtttcgtaggcggggcggattttgtggatacgttttcgtggcgaggtcgggttgttttgagggaggaagcgttagagcggcggtcggtttcgcgcggagttcggcgtttttttagttcgagttaggacgtcgtcggtttcggtttcggtttcgggtacgtagcgagttagggatgtgagcggcgtttcgcggtatggtagttttaggtgggtaggtaggcgtcgcgggttttcgggttttcggtttttttttcgtatttcgtattttttgaggcgcgttttttcgtttgtttttgtttgcgttttttgtgcggggattttgttttttttttgtttttttttatgttttttgtcgtaaattttttattttaatttttttacgtttttcgttttagtttgtggcgcgattttttttagtttttgtttggttcgatttttttttatttttttagggtttttttcgttttttttatttttg

SEQ ID NO: 12722 - DNA, 587 bp, Artificial Sequence
  chemically treated genomic DNA (Homo sapiens) CpG-island No: 12722
caaaaataaaaaaaacgaaaaaaaccctaaaaaaataaaaaaaaatcgaaccaaacaaaaactaaaaaaaatcgcgccacaaactaaaacgaaaaacgtaaaaaaattaaaataaaaaatttacgacaaaaaacataaaaaaaaacaaaaaaaaaacaaaatccccgcacaaaaaacgcaaacaaaaacaaacgaaaaaacgcgcctcaaaaaatacgaaatacgaaaaaaaaaccgaaaacccgaaaacccgcgacgcctacctacccacctaaaactaccataccgcgaaacgccgctcacatccctaactcgctacgtacccgaaaccgaaaccgaaaccgacgacgtcctaactcgaactaaaaaaacgccgaactccgcgcgaaaccgaccgccgctctaacgcttcctccctcaaaacaacccgacctcgccacgaaaacgtatccacaaaatccgccccgcctacgaaactcgacccgcgacacctacacccgcgaccgttaaaaaaaaaaaataaaaaccccataccgaccgccgaccaactccccccacgaccccctactcaaaaacaacgaaaaaac

SEQ ID NO: 12723 - DNA, 587 bp, Artificial Sequence
  chemically treated genomic DNA (Homo sapiens) CpG-island No: 12723
tagaggtggagggagcgaaggagattttgaagaagtgggagggggtcgggttaggtaggggttgaagagaatcgcgttataggttgggacgggaaacgtgggaaagttggagtgggaagtttgcgatagggaatatagaaaagagtagaaagagggtaagattttcgtatagaggacgtaaatagaagtaagcgggggagcgcgttttaagggatgcggggtacgagagaggggtcgggagttcggggattcgcggcgtttgtttatttatttgaggttgttatgtcgcggggcgtcgtttatatttttggttcgttgcgtgttcggggtcgggatcggggtcggcggcgttttggttcgggttggaggggcgtcgggtttcgcgcgggatcggtcgtcgttttggcgtttttttttttagggtagttcggtttcgttacgagggcgtgtttatagagttcgtttcgtttgcgggattcggttcgcggtatttgtattcgcggtcgttggggaggggaagtgagaattttatgtcggtcgtcggttagttttttttacggttttttgtttaggggtagcgagaaggt

SEQ ID NO: 12724 - DNA, 587 bp, Artificial Sequence
  chemically treated genomic DNA (Homo sapiens) CpG-island No: 12724
accttctcgctacccctaaacaaaaaaccgtaaaaaaaactaaccgacgaccgacataaaattctcacttcccctccccaacgaccgcgaatacaaataccgcgaaccgaatcccgcaaacgaaacgaactctataaacacgccctcgtaacgaaaccgaactaccctaaaaaaaaaaacgccaaaacgacgaccgatcccgcgcgaaacccgacgcccctccaacccgaaccaaaacgccgccgaccccgatcccgaccccgaacacgcaacgaaccaaaaatataaacgacgccccgcgacataacaacctcaaataaataaacaaacgccgcgaatccccgaactcccgacccctctctcgtaccccgcatcccttaaaacgcgctcccccgcttacttctatttacgtcctctatacgaaaatcttaccctctttctactcttttctatattccctatcgcaaacttcccactccaactttcccacgtttcccgtcccaacctataacgcgattctcttcaacccctacctaacccgaccccctcccacttcttcaaaatctccttcgctccctccacctcta

SEQ ID NO: 12725 - DNA, 839 bp, Artificial Sequence
  chemically treated genomic DNA (Homo sapiens) CpG-island No: 12725
gaatcgagtttaatgaaatttttagacgtataaagtatagggtgtcggtttatcgagttgcgtttttttttcgggggtgttcgagagagagtacgcgagttcggcgtagttaaattcgggtaggggtgggtttttatcgcgtgtgcgtgtgttagtttgggagtgtcggcgcgagcgtggcgggtgcgtgtcggtgtgtgtgcgtgatagcgcgcgcgtggtagggagttcgcgcgttagggtgcgcgtgttagcgcgggtgtgcgagggagtgcgcgcgggtgggagcgttaggggttggcggggttcgcgttttgggacgagtttttcgtgtttcggttttgcgttttcgtagcgtttacgtagtcgagaggagtgggtgatgatttcgtgattttaacgttttttttcgtttttcgatatgttttcgcgtttgaaaggtgtagaaaattttttttatcgttttggacgagattgagttaggcgtcgagggcgggcgtcgtcgtagatcggagttcgggttcgttggtcgtttaggcgtagcggtgtggagggaacggacgcgcggtaaggcgattcgttttgggtaacgcgggcgtagttgtttcgacgtaaggtattagttggtcgggggttcgggcgagtcggggtcggcgtgttcggggcgtgcgttttttcggtaggcgagcgtcgggtttcgcggaggtttttgcgtttattgtttgttttttcgttcggcgattcggagtttttaggttgcggtgcgttaggttagatttgatcgagggcggaagattcgagcggtagggaggtagaaagaaaagaggtagtaagtttta

SEQ ID NO: 12726 - DNA, 839 bp, Artificial Sequence
  chemically treated genomic DNA (Homo sapiens) CpG-island No: 12726
taaaacttactacctcttttctttctacctccctaccgctcgaatcttccgccctcgatcaaatctaacctaacgcaccgcaacctaaaaactccgaatcgccgaacgaaaaaacaaacaataaacgcaaaaacctccgcgaaacccgacgctcgcctaccgaaaaaacgcacgccccgaacacgccgaccccgactcgcccgaacccccgaccaactaataccttacgtcgaaacaactacgcccgcgttacccaaaacgaatcgccttaccgcgcgtccgttccctccacaccgctacgcctaaacgaccaacgaacccgaactccgatctacgacgacgcccgccctcgacgcctaactcaatctcgtccaaaacgataaaaaaaattttctacacctttcaaacgcgaaaacatatcgaaaaacgaaaaaaaacgttaaaatcacgaaatcatcacccactcctctcgactacgtaaacgctacgaaaacgcaaaaccgaaacacgaaaaactcgtcccaaaacgcgaaccccgccaacccctaacgctcccacccgcgcgcactccctcgcacacccgcgctaacacgcgcaccctaacgcgcgaactccctaccacgcgcgcgctatcacgcacacacaccgacacgcacccgccacgctcgcgccgacactcccaaactaacacacgcacacgcgataaaaacccacccctacccgaatttaactacgccgaactcgcgtactctctctcgaacacccccgaaaaaaaaacgcaactcgataaaccgacaccctatactttatacgtctaaaaatttcattaaactcgattc

SEQ ID NO: 12727 - DNA, 839 bp, Artificial Sequence
  chemically treated genomic DNA (Homo sapiens) CpG-island No: 12727
tggggtttgttattttttttttttttgtttttttgtcgttcgggtttttcgttttcggttaggtttggtttggcgtatcgtagtttggggatttcgggtcgtcgggcggagaagtaggtagtgggcgtagggattttcgcggagttcggcgttcgtttgtcgagagagcgtacgtttcgggtacgtcggtttcggttcgttcgagttttcgattagttagtgttttgcgtcggggtagttgcgttcgcgttgtttagagcgggtcgttttgtcgcgcgttcgttttttttatatcgttgcgtttgagcggttagcgagttcgagtttcggtttgcggcggcgttcgttttcgacgtttagtttagtttcgtttagagcggtggggggagttttttgtattttttaggcgcgggaatatgtcgagggacgggggaggacgttgaggttacgaagttattatttatttttttcggttgcgtgggcgttgcgggagcgtagagtcggagtacgaggggttcgttttagggcgcgggtttcgttagtttttggcgtttttattcgcgcgtattttttcgtatattcgcgttggtacgcgtattttggcgcgcgaattttttgttacgcgcgcgttgttacgtatatatatcggtacgtattcgttacgttcgcgtcgatatttttaggttggtatacgtatacgcggtggggatttatttttgttcgggtttggttgcgtcgggttcgcgtgttttttttcgggtattttcgggaagggagcgtagttcggtgggtcggtattttgtgttttatgcgtttgaggattttattgaattcggttt

SEQ ID NO: 12728 - DNA, 839 bp, Artificial Sequence
  chemically treated genomic DNA (Homo sapiens) CpG-island No: 12728
aaaccgaattcaataaaatcctcaaacgcataaaacacaaaataccgacccaccgaactacgctcccttcccgaaaatacccgaaaaaaaacacgcgaacccgacgcaaccaaacccgaacaaaaataaatccccaccgcgtatacgtataccaacctaaaaatatcgacgcgaacgtaacgaatacgtaccgatatatatacgtaacaacgcgcgcgtaacaaaaaattcgcgcgccaaaatacgcgtaccaacgcgaatatacgaaaaaatacgcgcgaataaaaacgccaaaaactaacgaaacccgcgccctaaaacgaacccctcgtactccgactctacgctcccgcaacgcccacgcaaccgaaaaaaataaataataacttcgtaacctcaacgtcctcccccgtccctcgacatattcccgcgcctaaaaaatacaaaaaactccccccaccgctctaaacgaaactaaactaaacgtcgaaaacgaacgccgccgcaaaccgaaactcgaactcgctaaccgctcaaacgcaacgatataaaaaaaacgaacgcgcgacaaaacgacccgctctaaacaacgcgaacgcaactaccccgacgcaaaacactaactaatcgaaaactcgaacgaaccgaaaccgacgtacccgaaacgtacgctctctcgacaaacgaacgccgaactccgcgaaaatccctacgcccactacctacttctccgcccgacgacccgaaatccccaaactacgatacgccaaaccaaacctaaccgaaaacgaaaaacccgaacgacaaaaaaacaaaaaaaaaaaaaataacaaacccca

SEQ ID NO: 12729 - DNA, 517 bp, Artificial Sequence
  chemically treated genomic DNA (Homo sapiens) CpG-island No: 12729
gtttggaagttaattcgaaatagttttcggattttggtttacgtttggcggaaattaaagcgtaaattttgattgtttgggggcgtaacgatcgttttgtgtcgatggatgcgggtttgcgtttgttgttcggtattgtcggttttgaattgtatatttttcgcgattgtggttattgggcgtagtgggaatatgtcgacgtttttaattaattggtgttgaattttttcgtacgtttttaaggaatggttatgacgaagtatatttttgagtaattggcggcggatttacgtcgcgtcgtagagtagggcgaagcgattgtatcgttgcgcgatttgattggtatcgataacgttgaagcggtttacgttatttagtatataaatgtgtaatatgacgttgcgtaggggcgtcgcgtggtagggcgtaaagtgggtttgatatattcgaaagtgtattaataattgggcgttgatggggtttgagggttaatggaacgagaacgtacgtttatggt

SEQ ID NO: 12730 - DNA, 517 bp, Artificial Sequence
  chemically treated genomic DNA (Homo sapiens) CpG-island No: 12730
accataaacgtacgttctcgttccattaaccctcaaaccccatcaacgcccaattattaatacactttcgaatatatcaaacccactttacgccctaccacgcgacgcccctacgcaacgtcatattacacatttatatactaaataacgtaaaccgcttcaacgttatcgataccaatcaaatcgcgcaacgatacaatcgcttcgccctactctacgacgcgacgtaaatccgccgccaattactcaaaaatatacttcgtcataaccattccttaaaaacgtacgaaaaaattcaacaccaattaattaaaaacgtcgacatattcccactacgcccaataaccacaatcgcgaaaaatatacaattcaaaaccgacaataccgaacaacaaacgcaaacccgcatccatcgacacaaaacgatcgttacgcccccaaacaatcaaaatttacgctttaatttccgccaaacgtaaaccaaaatccgaaaactatttcgaattaacttccaaac

SEQ ID NO: 12731 - DNA, 517 bp, Artificial Sequence
  chemically treated genomic DNA (Homo sapiens) CpG-island No: 12731
attataaacgtacgttttcgttttattggtttttaaattttattaacgtttagttgttgatgtattttcggatgtgttaggtttattttacgttttattacgcgacgtttttgcgtaacgttatgttgtatatttatgtgttgaatggcgtaagtcgttttagcgttatcgatattaattagatcgcgtagcggtgtaatcgtttcgttttgttttgcggcgcggcgtaaattcgtcgttagttgtttaagagtatgtttcgttatgattattttttaagggcgtgcgaggaaatttagtattagttgattgaaagcgtcggtatgtttttattgcgtttagtgattatagtcgcggaagatatgtagtttagaatcggtaatgtcggatagtagacgtagattcgtatttatcggtataaagcggtcgttgcgtttttagataattagggtttgcgttttgattttcgttagacgtgggttaaaattcgggaattgtttcggattagtttttaggt

SEQ ID NO: 12732 - DNA, 517 bp, Artificial Sequence
  chemically treated genomic DNA (Homo sapiens) CpG-island No: 12732
acctaaaaactaatccgaaacaattcccgaattttaacccacgtctaacgaaaatcaaaacgcaaaccctaattatctaaaaacgcaacgaccgctttataccgataaatacgaatctacgtctactatccgacattaccgattctaaactacatatcttccgcgactataatcactaaacgcaataaaaacataccgacgctttcaatcaactaatactaaatttcctcgcacgcccttaaaaaataatcataacgaaacatactcttaaacaactaacgacgaatttacgccgcgccgcaaaacaaaacgaaacgattacaccgctacgcgatctaattaatatcgataacgctaaaacgacttacgccattcaacacataaatatacaacataacgttacgcaaaaacgtcgcgtaataaaacgtaaaataaacctaacacatccgaaaatacatcaacaactaaacgttaataaaatttaaaaaccaataaaacgaaaacgtacgtttataat

SEQ ID NO: 12733 - DNA, 656 bp, Artificial Sequence
  chemically treated genomic DNA (Homo sapiens) CpG-island No: 12733
gcgcggcgggggttaaggtgggcgttcgcgtttcgcgtttcgcgttttttcgtcgggatgagagcgtagttcgcgtcgttagttcgttcgttcgtttcgaggcggtatcgggagaaagtggcggttagggatggagttgttgttatgataatttcggcggtcggggttcgcgcgcgtcggggttgttttcgggaggaaggcggcgcggaggtcgggggcggtcgttgagtttggcgttcgcgcggtttcggtgcgggttgcgtcgcgttttttttagcgagttatcgagtttggggtcgtcgcggttcgttttcgtcgttcggttttttttttttcggttatcgtcgtagtttttgtttcgtcgagtttcgtcggatagcggcggtcgtagcgcgtatttgggtttcgaggaagttgatcgaggcggttgtcgtaggatttcgggttcggatcgtacgaagttcgcgcggtcgtttttttcgcgcgttatttttgcgtttttcgcgagttttattttttatttgttattgttttcgattgtttttcggtggcgagttcggtttcgaaatttataaagtgttggatgtttttcgttcgaattgagggattgtagatcgtttttgggtagttggatgaagtttatttcgttttttttt

SEQ ID NO: 12734 - DNA, 656 bp, Artificial Sequence
  chemically treated genomic DNA (Homo sapiens) CpG-island No: 12734
aaaaaaaaacgaaataaacttcatccaactacccaaaaacgatctacaatccctcaattcgaacgaaaaacatccaacactttataaatttcgaaaccgaactcgccaccgaaaaacaatcgaaaacaataacaaataaaaaataaaactcgcgaaaaacgcaaaaataacgcgcgaaaaaaacgaccgcgcgaacttcgtacgatccgaacccgaaatcctacgacaaccgcctcgatcaacttcctcgaaacccaaatacgcgctacgaccgccgctatccgacgaaactcgacgaaacaaaaactacgacgataaccgaaaaaaaaaaaaccgaacgacgaaaacgaaccgcgacgaccccaaactcgataactcgctaaaaaaaacgcgacgcaacccgcaccgaaaccgcgcgaacgccaaactcaacgaccgcccccgacctccgcgccgccttcctcccgaaaacaaccccgacgcgcgcgaaccccgaccgccgaaattatcataacaacaactccatccctaaccgccactttctcccgataccgcctcgaaacgaacgaacgaactaacgacgcgaactacgctctcatcccgacgaaaaaacgcgaaacgcgaaacgcgaacgcccaccttaacccccgccgcgc

SEQ ID NO: 12735 - DNA, 656 bp, Artificial Sequence
  chemically treated genomic DNA (Homo sapiens) CpG-island No: 12735
agaaggggacggggtgggttttatttagttatttagaggcggtttgtagttttttagttcgaacgggggatatttaatattttgtaagtttcggagtcgggttcgttatcggaaaataatcggaaataatagtagatgggaagtggagttcgcgggaggcgtaggggtggcgcgcggaggagacggtcgcgcgggtttcgtgcgattcgggttcgggattttgcggtagtcgtttcggttaattttttcggagtttaaatgcgcgttgcggtcgtcgttgttcggcggggttcggcggggtaggggttgcggcggtggtcgaggagggagaggtcgggcggcgggagcggatcgcggcggttttaagttcggtagttcgttggggaaggcgcggcgtagttcgtatcggagtcgcgcggacgttaagtttagcggtcgttttcggttttcgcgtcgtttttttttcgggagtagtttcgacgcgcgcgggtttcgatcgtcggggttgttatggtagtagttttatttttgatcgttattttttttcggtgtcgtttcggagcgagcgggcgggttggcggcgcggattgcgtttttatttcggcgggagggcgcggggcgcggggcgcgggcgtttattttaattttcgtcgcgt

SEQ ID NO: 12736 - DNA, 656 bp, Artificial Sequence
  chemically treated genomic DNA (Homo sapiens) CpG-island No: 12736
acgcgacgaaaattaaaataaacgcccgcgccccgcgccccgcgccctcccgccgaaataaaaacgcaatccgcgccgccaacccgcccgctcgctccgaaacgacaccgaaaaaaaataacgatcaaaaataaaactactaccataacaaccccgacgatcgaaacccgcgcgcgtcgaaactactcccgaaaaaaaaacgacgcgaaaaccgaaaacgaccgctaaacttaacgtccgcgcgactccgatacgaactacgccgcgccttccccaacgaactaccgaacttaaaaccgccgcgatccgctcccgccgcccgacctctccctcctcgaccaccgccgcaacccctaccccgccgaaccccgccgaacaacgacgaccgcaacgcgcatttaaactccgaaaaaattaaccgaaacgactaccgcaaaatcccgaacccgaatcgcacgaaacccgcgcgaccgtctcctccgcgcgccacccctacgcctcccgcgaactccacttcccatctactattatttccgattattttccgataacgaacccgactccgaaacttacaaaatattaaatatcccccgttcgaactaaaaaactacaaaccgcctctaaataactaaataaaacccaccccgtccccttct

SEQ ID NO: 12737 - DNA, 1294 bp, Artificial Sequence
  chemically treated genomic DNA (Homo sapiens) CpG-island No: 12737
tcgtgataggtaatttcgcgtaggggagagtgcgcgaggcggaggatgcggaggaggagggggggcggtttggtagtagcggcgggttgtttcgtcgggttggaagtatttttggtttcggttttttttatcgtcgtatttagtttcggagcggcggggacgggtgcgggtgcgcgtgcgttgcgggggtcgtgcgggaagtcggcgcgttattgttatagagttgtagggttgttgcggcggcggcgtgacgggtagtttcgggcgcgaagtgatagtcgtagtaagtgggattgatggtttcgttcgtcgttgtcgtcgtcgtagtcgtcgttttgtatttggagtatagcgggtttacgaagtacgaatttattggggcgttacggcggtcggttcggcggggcggggcgcgttaagtagttatagagcgagtttcgatttggtcgtattgtcgcgggggtttgtggggcgttgttttcgtcgtcgggatcgtcgggttacgtcgttcgtgtcgttttagttacgttcgcgcgtcgtttttgagagtataggatagtcgcggtgcgttttagattatttgggcgattatatcgttcgcgtttttatgcgtatcgacgatattcggtttagcgatcgatattttttttgcgggagtcgcggggtttacgttatagtttatacgcgcgtcgtcgttttttcggtttttttcggcgcgtttcggttcggtcgtaatataatcgtcgacgttttaggtgatttgtttcgttgtttttattgtttttttttaggtattagtgattgagcgtattcggataagaaaaaagtgcgttcggtttacggggatattttggtttcggtttataaattttagttttggagggaaaagaaaaaaaatattttttgttcgtcgttattttttatcgcgtttttttcgcgtttttttttcgttaatttcgttttcgtcgtcgaggttgtcgattcggtgcgtatcggcgaggtattttcgtattatagtattgtacggaaagttagcgtgacggggacgaggagtttcgcggagggattcgcgcgtagtttagtcgttacggtcgacggacggagcgtcgcgttcggttcgagatgttttcgtcggttttaaagggggtttataaagacgtattgttaagggtttcgtgtgtttcggggtcgcgggaatgcggatcgtagtcggtagggaggggtcgcggcggagttttagatttgggggagttaaggaggttatttttaggaggttgcggagtaaatgattgtt

SEQ ID NO: 12738 - DNA, 1294 bp, Artificial Sequence
  chemically treated genomic DNA (Homo sapiens) CpG-island No: 12738
aacaatcatttactccgcaacctcctaaaaataacctccttaactcccccaaatctaaaactccgccgcgacccctccctaccgactacgatccgcattcccgcgaccccgaaacacacgaaacccttaacaatacgtctttataaaccccctttaaaaccgacgaaaacatctcgaaccgaacgcgacgctccgtccgtcgaccgtaacgactaaactacgcgcgaatccctccgcgaaactcctcgtccccgtcacgctaactttccgtacaatactataatacgaaaatacctcgccgatacgcaccgaatcgacaacctcgacgacgaaaacgaaattaacgaaaaaaaaacgcgaaaaaaacgcgataaaaaataacgacgaacaaaaaatattttttttcttttccctccaaaactaaaatttataaaccgaaaccaaaatatccccgtaaaccgaacgcacttttttcttatccgaatacgctcaatcactaatacctaaaaaaaaacaataaaaacaacgaaacaaatcacctaaaacgtcgacgattatattacgaccgaaccgaaacgcgccgaaaaaaaccgaaaaaacgacgacgcgcgtataaactataacgtaaaccccgcgactcccgcaaaaaaaatatcgatcgctaaaccgaatatcgtcgatacgcataaaaacgcgaacgatataatcgcccaaataatctaaaacgcaccgcgactatcctatactctcaaaaacgacgcgcgaacgtaactaaaacgacacgaacgacgtaacccgacgatcccgacgacgaaaacaacgccccacaaacccccgcgacaatacgaccaaatcgaaactcgctctataactacttaacgcgccccgccccgccgaaccgaccgccgtaacgccccaataaattcgtacttcgtaaacccgctatactccaaatacaaaacgacgactacgacgacgacaacgacgaacgaaaccatcaatcccacttactacgactatcacttcgcgcccgaaactacccgtcacgccgccgccgcaacaaccctacaactctataacaataacgcgccgacttcccgcacgacccccgcaacgcacgcgcacccgcacccgtccccgccgctccgaaactaaatacgacgataaaaaaaaccgaaaccaaaaatacttccaacccgacgaaacaacccgccgctactaccaaaccgccccccctcctcctccgcatcctccgcctcgcgcactctcccctacgcgaaattacctatcacga

SEQ ID NO: 12739 - DNA, 1294 bp, Artificial Sequence
  chemically treated genomic DNA (Homo sapiens) CpG-island No: 12739
ggtagttatttgtttcgtagttttttgggagtggtttttttggtttttttaagtttaaggtttcgtcgcggtttttttttgtcggttgcgattcgtattttcgcggtttcggggtatacggagtttttggtagtgcgtttttatgggttttttttaaggtcggcggaggtatttcgggtcgggcgcggcgtttcgttcgtcggtcgtagcgattgaattgcgcgcggattttttcgcggggtttttcgttttcgttacgttgatttttcgtgtagtgttgtggtgcgaaaatgtttcgtcggtgcgtatcgggtcggtagtttcggcggcgggggcgagattggcgggaggggggcgcggggggggcgcggtaagaggtggcggcgggtagagggtgtttttttttttttttttttagagttggggtttgtaaatcgaggttagagtgttttcgtgggtcgagcgtattttttttttgttcgggtgcgtttagttattggtgtttgagaggaaatagtggaggtagcggggtaggttatttggggcgtcggcgattatattgcggtcgagtcggggcgcgtcgggaaaggtcgggagggcggcggcgcgcgtgtgggttgtggcgtaggtttcgcgattttcgtagagggagtgtcggtcgttgaatcgagtgtcgtcggtgcgtatagaagcgcgggcgatgtagtcgtttagatagtttagagcgtatcgcggttgttttgtgtttttagaagcgacgcgcgagcgtggttgaggcggtacgagcgacgtagttcggcggtttcggcggcgagagtagcgttttataggttttcgcggtagtgcggttaagtcgaggttcgttttatggttgtttagcgcgtttcgtttcgtcgggtcggtcgtcgtgacgttttaatgagttcgtatttcgtgaattcgttgtattttaagtataaggcggcggttgcggcggcggtagcggcgggcgaggttattaattttatttattacgattgttatttcgcgttcgaggttgttcgttacgtcgtcgtcgtagtagttttgtagttttatggtaatagcgcgtcggtttttcgtacggttttcgtagcgtacgcgtattcgtattcgttttcgtcgtttcgggattgggtgcggcggtagggaaggtcggggttaggagtatttttagttcggcggggtagttcgtcgttgttattaggtcgtttttttttttttttcgtatttttcgtttcgcgtatttttttttgcgcgggattgtttgttacgg

SEQ ID NO: 12740 - DNA, 1294 bp, Artificial Sequence
  chemically treated genomic DNA (Homo sapiens) CpG-island No: 12740
ccgtaacaaacaatcccgcgcaaaaaaaaatacgcgaaacgaaaaatacgaaaaaaaaaaaaaaacgacctaataacaacgacgaactaccccgccgaactaaaaatactcctaaccccgaccttccctaccgccgcacccaatcccgaaacgacgaaaacgaatacgaatacgcgtacgctacgaaaaccgtacgaaaaaccgacgcgctattaccataaaactacaaaactactacgacgacgacgtaacgaacaacctcgaacgcgaaataacaatcgtaataaataaaattaataacctcgcccgccgctaccgccgccgcaaccgccgccttatacttaaaatacaacgaattcacgaaatacgaactcattaaaacgtcacgacgaccgacccgacgaaacgaaacgcgctaaacaaccataaaacgaacctcgacttaaccgcactaccgcgaaaacctataaaacgctactctcgccgccgaaaccgccgaactacgtcgctcgtaccgcctcaaccacgctcgcgcgtcgcttctaaaaacacaaaacaaccgcgatacgctctaaactatctaaacgactacatcgcccgcgcttctatacgcaccgacgacactcgattcaacgaccgacactccctctacgaaaatcgcgaaacctacgccacaacccacacgcgcgccgccgccctcccgacctttcccgacgcgccccgactcgaccgcaatataatcgccgacgccccaaataacctaccccgctacctccactatttcctctcaaacaccaataactaaacgcacccgaacaaaaaaaaaatacgctcgacccacgaaaacactctaacctcgatttacaaaccccaactctaaaaaaaaaaaaaaaaaaacaccctctacccgccgccacctcttaccgcgccccccccgcgcccccctcccgccaatctcgcccccgccgccgaaactaccgacccgatacgcaccgacgaaacattttcgcaccacaacactacacgaaaaatcaacgtaacgaaaacgaaaaaccccgcgaaaaaatccgcgcgcaattcaatcgctacgaccgacgaacgaaacgccgcgcccgacccgaaatacctccgccgaccttaaaaaaaacccataaaaacgcactaccaaaaactccgtataccccgaaaccgcgaaaatacgaatcgcaaccgacaaaaaaaaaccgcgacgaaaccttaaacttaaaaaaaccaaaaaaaccactcccaaaaaactacgaaacaaataactacc

SEQ ID NO: 12741 - DNA, 662 bp, Artificial Sequence
  chemically treated genomic DNA (Homo sapiens) CpG-island No: 12741
ttgtagtttgcgaattagtcggtggttcgggcgtcggcggggagttgttcggcggcggatagtgtaatgttgggtgggagtgcgggacgttttaaaatgttttttagtggtatttttagtaattattacgtggattcgtttataggttatgagggcgacgaggtgttcgcggcgcgtttcgggtcgtcggggttaggcgcgtagggtcggtttgtaggtgtggttgatggttcggtcgttatcgtcgtcgagttcgtttcgtgtagttttgtttttagatcggtcgtgttttttgtttcgtggttcgcggtgtttttttagttttcggtagcggcggcgatgagcggtttttattattcgtacgttttttcgtcgtttttggtcgtttttgttttcgagttcggtcgttacgtgcgtttttggatggagtcgttgttcggtttttcgggcggtgcgggcggtggcggtggtggtggaggcggcggttcgggtcgcggttttagttttggttttagcggtttagttaacgggcgttattacgggattaagtttgaaattcgagcggtttcggttttcgttacggtagtttttattattttttttttttttatttttttattttttttttttaaacggattgagtgtttcgtggttcgggagtt

SEQ ID NO: 12742 - DNA, 662 bp, Artificial Sequence
  chemically treated genomic DNA (Homo sapiens) CpG-island No: 12742
aactcccgaaccacgaaacactcaatccgtttaaaaaaaaaaaataaaaaaataaaaaaaaaaaaaataataaaaactaccgtaacgaaaaccgaaaccgctcgaatttcaaacttaatcccgtaataacgcccgttaactaaaccgctaaaaccaaaactaaaaccgcgacccgaaccgccgcctccaccaccaccgccaccgcccgcaccgcccgaaaaaccgaacaacgactccatccaaaaacgcacgtaacgaccgaactcgaaaacaaaaacgaccaaaaacgacgaaaaaacgtacgaataataaaaaccgctcatcgccgccgctaccgaaaactaaaaaaacaccgcgaaccacgaaacaaaaaacacgaccgatctaaaaacaaaactacacgaaacgaactcgacgacgataacgaccgaaccatcaaccacacctacaaaccgaccctacgcgcctaaccccgacgacccgaaacgcgccgcgaacacctcgtcgccctcataacctataaacgaatccacgtaataattactaaaaataccactaaaaaacattttaaaacgtcccgcactcccacccaacattacactatccgccgccgaacaactccccgccgacgcccgaaccaccgactaattcgcaaactacaa

SEQ ID NO: 12743 - DNA, 662 bp, Artificial Sequence
  chemically treated genomic DNA (Homo sapiens) CpG-island No: 12743
gattttcgggttacggagtatttagttcgtttggaggaggaggataaggaagtggaggaggaggaggtggtggaggttgtcgtggcgggggtcggggtcgttcgggttttaggtttaatttcgtagtggcgttcgttggttgggtcgttggggttagggttgggatcgcggttcggatcgtcgtttttattattatcgttatcgttcgtatcgttcgggaagtcgggtagcggttttatttaggagcgtacgtagcggtcgggttcggaggtagaggcggttaggggcggcgggggaacgtacgggtggtagaggtcgtttatcgtcgtcgttgtcgggggttgggagggtatcgcggattacgaggtagagaatacggtcgatttgggggtaaaattatacgaggcgaattcggcggcggtggcggtcgggttattagttatatttgtaggtcggttttgcgcgtttggtttcggcggttcgaagcgcgtcgcgaatatttcgtcgtttttatggtttataagcgagtttacgtagtagttgttgagggtgttattggaagatattttgaggcgtttcgtatttttatttaatattatattgttcgtcgtcgagtagtttttcgtcggcgttcgagttatcgattagttcgtaggttgtag

SEQ ID NO: 12744 - DNA, 662 bp, Artificial Sequence
  chemically treated genomic DNA (Homo sapiens) CpG-island No: 12744
ctacaacctacgaactaatcgataactcgaacgccgacgaaaaactactcgacgacgaacaatataatattaaataaaaatacgaaacgcctcaaaatatcttccaataacaccctcaacaactactacgtaaactcgcttataaaccataaaaacgacgaaatattcgcgacgcgcttcgaaccgccgaaaccaaacgcgcaaaaccgacctacaaatataactaataacccgaccgccaccgccgccgaattcgcctcgtataattttacccccaaatcgaccgtattctctacctcgtaatccgcgataccctcccaacccccgacaacgacgacgataaacgacctctaccacccgtacgttcccccgccgcccctaaccgcctctacctccgaacccgaccgctacgtacgctcctaaataaaaccgctacccgacttcccgaacgatacgaacgataacgataataataaaaacgacgatccgaaccgcgatcccaaccctaaccccaacgacccaaccaacgaacgccactacgaaattaaacctaaaacccgaacgaccccgacccccgccacgacaacctccaccacctcctcctcctccacttccttatcctcctcctccaaacgaactaaatactccgtaacccgaaaatc

SEQ ID NO: 12745 - DNA, 654 bp, Artificial Sequence
  chemically treated genomic DNA (Homo sapiens) CpG-island No: 12745
tacgtaatggtacgcggcgggggtttcggggcggaggcgtttttcgatcggttaggtttttttttaatttgaatttcgtttttataaacgtttcgcgatgagttaatttgttggagggtaggcgggcggaggcgggaggtttatagagggagagagggttagaggaagagggcgggagcgagcgaattagagagaaaggagaggagggaggaggcgcgcgttatggtgttttgcgcgggtatagggtagggcggggtcgggttaggtcgggttatgagtcgcgtcggagttgggatatggacgggttgcgggtaagaacgcggcggggtggcgtttcggttttttttttttttttatcggtggcggcggcggcggcgttaggttagtgtcgcggtttttttttcgcgtttgtgttcgtcgggacgtattcggggcgggcggcgcggttgtacgcggttcggcggcggtagcggtagtttttcggttttgcgtatttcgggatttttgagcgtacgggttttttttcgtcgtcgtttttttttgtcgttgtagtcgcgttcggagtttttttagttaaagagtgtttagtattacgtttgtagcggtttgtaggttcgagtttagcgttgggttacggttattattttggtaacg

SEQ ID NO: 12746 - DNA, 654 bp, Artificial Sequence
  chemically treated genomic DNA (Homo sapiens) CpG-island No: 12746
cgttaccaaaataataaccgtaacccaacgctaaactcgaacctacaaaccgctacaaacgtaatactaaacactctttaactaaaaaaactccgaacgcgactacaacgacaaaaaaaaacgacgacgaaaaaaaacccgtacgctcaaaaatcccgaaatacgcaaaaccgaaaaactaccgctaccgccgccgaaccgcgtacaaccgcgccgcccgccccgaatacgtcccgacgaacacaaacgcgaaaaaaaaaccgcgacactaacctaacgccgccgccgccgccaccgataaaaaaaaaaaaaaaaccgaaacgccaccccgccgcgttcttacccgcaacccgtccatatcccaactccgacgcgactcataacccgacctaacccgaccccgccctaccctatacccgcgcaaaacaccataacgcgcgcctcctccctcctctcctttctctctaattcgctcgctcccgccctcttcctctaaccctctctccctctataaacctcccgcctccgcccgcctaccctccaacaaattaactcatcgcgaaacgtttataaaaacgaaattcaaattaaaaaaaaacctaaccgatcgaaaaacgcctccgccccgaaacccccgccgcgtaccattacgta

SEQ ID NO: 12747 - DNA, 654 bp, Artificial Sequence
  chemically treated genomic DNA (Homo sapiens) CpG-island No: 12747
cgttgttaaagtggtagtcgtagtttagcgttggattcgggtttgtaggtcgttgtaggcgtggtgttgggtattttttggttgggggagtttcgggcgcggttataacggtagaagaggacgacgacgaggaagagttcgtgcgtttagaggtttcggggtacgtaaagtcggaaggttgtcgttgtcgtcgtcgagtcgcgtgtagtcgcgtcgttcgtttcgaatgcgtttcggcgaatataggcgcggagagaaagtcgcggtattggtttgacgtcgtcgtcgtcgttatcgatgaggaggaggaagaggtcggggcgttatttcgtcgcgtttttgttcgtagttcgtttatgttttagtttcggcgcggtttatggttcggtttggttcggtttcgttttgttttgtgttcgcgtaggatattatggcgcgcgttttttttttttttttttttttttttggttcgttcgttttcgttttttttttttagttttttttttttttgtgagtttttcgttttcgttcgtttgttttttaataggttagtttatcgcgggacgtttataaaaacgaagtttaggttgggagggggtttggtcggtcggggggcgttttcgtttcgaggttttcgtcgcgtgttattgcgtg

SEQ ID NO: 12748 - DNA, 654 bp, Artificial Sequence
  chemically treated genomic DNA (Homo sapiens) CpG-island No: 12748
cacgcaataacacgcgacgaaaacctcgaaacgaaaacgccccccgaccgaccaaaccccctcccaacctaaacttcgtttttataaacgtcccgcgataaactaacctattaaaaaacaaacgaacgaaaacgaaaaactcacaaaaaaaaaaaaaactaaaaaaaaaaaacgaaaacgaacgaaccaaaaaaaaaaaaaaaaaaaaaaaaaacgcgcgccataatatcctacgcgaacacaaaacaaaacgaaaccgaaccaaaccgaaccataaaccgcgccgaaactaaaacataaacgaactacgaacaaaaacgcgacgaaataacgccccgacctcttcctcctcctcatcgataacgacgacgacgacgtcaaaccaataccgcgactttctctccgcgcctatattcgccgaaacgcattcgaaacgaacgacgcgactacacgcgactcgacgacgacaacgacaaccttccgactttacgtaccccgaaacctctaaacgcacgaactcttcctcgtcgtcgtcctcttctaccgttataaccgcgcccgaaactcccccaaccaaaaaatacccaacaccacgcctacaacgacctacaaacccgaatccaacgctaaactacgactaccactttaacaacg

SEQ ID NO: 12749 - DNA, 739 bp, Artificial Sequence
  chemically treated genomic DNA (Homo sapiens) CpG-island No: 12749
ggtttaggttgttgcgcggggagcggttagaggttgtttgggcgtacgtcgcggagttatgaacgattttgacgagtgcggttagagcgtagttagtatgtatttgtcgggttgcgtttattatgtggtttcgtttgatttcgttagtaagttttcgttttttttttaatcgtcgttttgttagatgatttttttttatttttttaatttggtttttacgtttagttcgtgcgcgaagtggtttttcgcgattacggtttggagcgcgttaagtggtcgtatcgcggcggcggcggcggcggtagcgcggggggcggtagtagcgggggcgttcggcgggcggtcggtgggggggggttacgttttttattacgcggcggcgcggcgcggttgcgtcggcgtaggaggcgtttatgtaacgcgagttttttttcgtcgcggtcgtcggtcggacgtgttttttaaggcgtttgagcggttgtgcgttgcgtcggggtcgtcgtacggtcgggcgtcgtttttaatttttatagcgcggtgggtcgtaatggtattttgttatagggtttcgattagttttacgaggtagcgttcgggttttcgttcgtcgggtcgtagtttcgtcgttattcgcgtcgttatagttcgagggcgtagtcgataagggcgattttaggatcggggttggtggcggcgggggtagtttttgtattaaggcgatttttggttcggagtttaa

SEQ ID NO: 12750 - DNA, 739 bp, Artificial Sequence
  chemically treated genomic DNA (Homo sapiens) CpG-island No: 12750
ttaaactccgaaccaaaaatcgccttaatacaaaaactacccccgccgccaccaaccccgatcctaaaatcgcccttatcgactacgccctcgaactataacgacgcgaataacgacgaaactacgacccgacgaacgaaaacccgaacgctacctcgtaaaactaatcgaaaccctataacaaaataccattacgacccaccgcgctataaaaattaaaaacgacgcccgaccgtacgacgaccccgacgcaacgcacaaccgctcaaacgccttaaaaaacacgtccgaccgacgaccgcgacgaaaaaaaactcgcgttacataaacgcctcctacgccgacgcaaccgcgccgcgccgccgcgtaataaaaaacgtaacccccccccaccgaccgcccgccgaacgcccccgctactaccgccccccgcgctaccgccgccgccgccgccgcgatacgaccacttaacgcgctccaaaccgtaatcgcgaaaaaccacttcgcgcacgaactaaacgtaaaaaccaaattaaaaaaataaaaaaaaatcatctaacaaaacgacgattaaaaaaaaaacgaaaacttactaacgaaatcaaacgaaaccacataataaacgcaacccgacaaatacatactaactacgctctaaccgcactcgtcaaaatcgttcataactccgcgacgtacgcccaaacaacctctaaccgctccccgcgcaacaacctaaacc

SEQ ID NO: 12751 - DNA, 739 bp, Artificial Sequence
  chemically treated genomic DNA (Homo sapiens) CpG-island No: 12751
ttgggtttcgagttaggggtcgttttggtgtagggattgttttcgtcgttattagtttcggttttggggtcgtttttgtcggttgcgttttcgggttgtggcggcgcgggtggcggcggggttgcggttcggcgaacgggggttcgggcgttgtttcgtagaattggtcgaagttttgtggtaagatgttattgcggtttatcgcgttgtagaagttggaggcggcgttcggtcgtgcggcggtttcggcgtagcgtataatcgtttaggcgttttgaagagtacgttcggtcggcggtcgcggcggaagaaagttcgcgttgtatgagcgttttttgcgtcggcgtagtcgcgtcgcgtcgtcgcgtagtagggagcgtagtttttttttatcgatcgttcgtcgggcgttttcgttgttgtcgtttttcgcgttgtcgtcgtcgtcgtcgtcgcggtacggttatttggcgcgttttaggtcgtagtcgcggaaggttatttcgcgtacgggttggacgtgggagttaggttggaagagtaggggaaagttatttggtaggacgacggttgggaaaggaacgaaggtttgttagcgaagttagacggggttatatagtaggcgtagttcggtaggtatatgttggttgcgttttggtcgtattcgttaaagtcgtttatgatttcgcggcgtgcgtttaggtagtttttggtcgtttttcgcgtagtaatttgagtt

SEQ ID NO: 12752 - DNA, 739 bp, Artificial Sequence
  chemically treated genomic DNA (Homo sapiens) CpG-island No: 12752
aactcaaattactacgcgaaaaacgaccaaaaactacctaaacgcacgccgcgaaatcataaacgactttaacgaatacgaccaaaacgcaaccaacatatacctaccgaactacgcctactatataaccccgtctaacttcgctaacaaaccttcgttcctttcccaaccgtcgtcctaccaaataactttcccctactcttccaacctaactcccacgtccaacccgtacgcgaaataaccttccgcgactacgacctaaaacgcgccaaataaccgtaccgcgacgacgacgacgacgacaacgcgaaaaacgacaacaacgaaaacgcccgacgaacgatcgataaaaaaaaactacgctccctactacgcgacgacgcgacgcgactacgccgacgcaaaaaacgctcatacaacgcgaactttcttccgccgcgaccgccgaccgaacgtactcttcaaaacgcctaaacgattatacgctacgccgaaaccgccgcacgaccgaacgccgcctccaacttctacaacgcgataaaccgcaataacatcttaccacaaaacttcgaccaattctacgaaacaacgcccgaacccccgttcgccgaaccgcaaccccgccgccacccgcgccgccacaacccgaaaacgcaaccgacaaaaacgaccccaaaaccgaaactaataacgacgaaaacaatccctacaccaaaacgacccctaactcgaaacccaa

SEQ ID NO: 12753 - DNA, 734 bp, Artificial Sequence
  chemically treated genomic DNA (Homo sapiens) CpG-island No: 12753
ttgtttaatatgtattcgtattttttgattgcggtgagttcgatgtagacggtacggggaggcgcggcggttattttttcgggaggcgcggcgggttattttttcgggaggcgcggcggttattttttcgggtttcgcgattttttcgtaaagttttaagttttggttaaggtaggagcgcgtcgtaggcgggggtcggggtagggatcgggcggaggcgacgttttatggacgtttggggtcgggttcgttcgttggtagggtcggttgggggtgtgattttttttggcggtcgtttttatcgtttcgttttcgcgggttttaagttcgtttggttcgttacgaagattgtagattgcgtagtttgttttgtttcgttttagttgtatgcgggttgtaggttcggggatttttacgggattttttaaagttacgtgattttttttgggtcgggttgcgaagtgcgtttagtcggtcgttagagggcgtagggggcgaggggcgcgcgcggttttcgttcgatcgggtttgcgggtttcgtttcgttttttttttttgtttcgtttcgttgtttcgtttcgttcggtttttgtaggcgttcggagaaattttttcgtttcgtttcggggtgttttcgcgtgagttatttgggtatttcggaagttggggttacgttatatttatgtggaaatcgcggtgatgggaattggaaatgaaataggttttttttcgta

SEQ ID NO: 12754 - DNA, 734 bp, Artificial Sequence
  chemically treated genomic DNA (Homo sapiens) CpG-island No: 12754
tacgaaaaaaaacctatttcatttccaattcccatcaccgcgatttccacataaatataacgtaaccccaacttccgaaatacccaaataactcacgcgaaaacaccccgaaacgaaacgaaaaaatttctccgaacgcctacaaaaaccgaacgaaacgaaacaacgaaacgaaacaaaaaaaaaaaacgaaacgaaacccgcaaacccgatcgaacgaaaaccgcgcgcgcccctcgccccctacgccctctaacgaccgactaaacgcacttcgcaacccgacccaaaaaaaatcacgtaactttaaaaaatcccgtaaaaatccccgaacctacaacccgcatacaactaaaacgaaacaaaacaaactacgcaatctacaatcttcgtaacgaaccaaacgaacttaaaacccgcgaaaacgaaacgataaaaacgaccgccaaaaaaaatcacacccccaaccgaccctaccaacgaacgaacccgaccccaaacgtccataaaacgtcgcctccgcccgatccctaccccgacccccgcctacgacgcgctcctaccttaaccaaaacttaaaactttacgaaaaaatcgcgaaacccgaaaaaataaccgccgcgcctcccgaaaaaataacccgccgcgcctcccgaaaaaataaccgccgcgcctccccgtaccgtctacatcgaactcaccgcaatcaaaaaatacgaatacatattaaacaa

SEQ ID NO: 12755 - DNA, 734 bp, Artificial Sequence
  chemically treated genomic DNA (Homo sapiens) CpG-island No: 12755
tgcgaaaaagaatttattttatttttagtttttattatcgcgatttttatatggatgtgacgtgattttagttttcgaaatgtttaggtgatttacgcggggatatttcggggcggggcgagggagttttttcgggcgtttgtagggatcgggcggggcggggtagcggggcggggtagggaaagggggcggggcggggttcgtaggttcggtcgggcggaggtcgcgcgcgtttttcgttttttgcgttttttggcggtcggttggacgtatttcgtagttcgatttagagagagttacgtgattttggaaagtttcgtggaaattttcgggtttataattcgtatataattgaaacggggtaaagtagattgcgtagtttgtagttttcgtggcgggttaagcgagtttggagttcgcgggggcggagcggtgagagcggtcgttaagagagattatatttttagtcgattttgttagcgagcgagttcgattttaggcgtttatggagcgtcgttttcgttcggtttttgtttcgattttcgtttgcggcgcgtttttgttttgattaggatttgggattttgcgaaaggatcgcggggttcggagaggtaatcgtcgcgtttttcggagaggtaattcgtcgcgtttttcggagaggtaatcgtcgcgttttttcgtgtcgtttgtatcgggtttatcgtagttaagggatgcgggtgtatgttgggtag

SEQ ID NO: 12756 - DNA, 734 bp, Artificial Sequence
  chemically treated genomic DNA (Homo sapiens) CpG-island No: 12756
ctacccaacatacacccgcatcccttaactacgataaacccgatacaaacgacacgaaaaaacgcgacgattacctctccgaaaaacgcgacgaattacctctccgaaaaacgcgacgattacctctccgaaccccgcgatcctttcgcaaaatcccaaatcctaatcaaaacaaaaacgcgccgcaaacgaaaatcgaaacaaaaaccgaacgaaaacgacgctccataaacgcctaaaatcgaactcgctcgctaacaaaatcgactaaaaatataatctctcttaacgaccgctctcaccgctccgcccccgcgaactccaaactcgcttaacccgccacgaaaactacaaactacgcaatctactttaccccgtttcaattatatacgaattataaacccgaaaatttccacgaaactttccaaaatcacgtaactctctctaaatcgaactacgaaatacgtccaaccgaccgccaaaaaacgcaaaaaacgaaaaacgcgcgcgacctccgcccgaccgaacctacgaaccccgccccgccccctttccctaccccgccccgctaccccgccccgcccgatccctacaaacgcccgaaaaaactccctcgccccgccccgaaatatccccgcgtaaatcacctaaacatttcgaaaactaaaatcacgtcacatccatataaaaatcgcgataataaaaactaaaaataaaataaattctttttcgca

SEQ ID NO: 12757 - DNA, 1259 bp, Artificial Sequence
  chemically treated genomic DNA (Homo sapiens) CpG-island No: 12757
ttcgttcgcgaatttcgcgcgcgtaaggttagggattttgcgcggtggttgtaatttcgagtttcggttcggcgttcgcgcggagtttttacggcggttattttcgttcgttcggagttcgtcgttgtcgtcgttgtcgtcgttgtcgtcgttttattttcgtcgttatcggagcgtttaggttaggaagtcgttcgttcggtcgttggcgttgttcgggtgtttattgtttcggttgtcgtcgtcgttgttgttgttttcggggtcgcgtcgtatgttagttcggagtcgtcgcgtttcgtcgtacgcggcgttcggtttcgtttcggttcgtttcggttcgtttttcgtagttttcgttttttgtttcgttttcgtcgttcgggcgggggtcgtttattgacgtcgttttgacgttagagcgacgcgcggtcgagcgtcgggcggagggagagcgggagatcgggcggttgttaagagattggcggttttgacgcgcgcgggatgaggtcgttgttttggcgatcgcgggtcggtgacgttaggggcgttcgtcgttcgaggttcgttcgtttgcgtttcgtcgggcgttttttttcgggcgttgggggtattgcgggcggttttatcgtcgagggcgcgttcgtttttttacgttcgggtattcgggtcgggtttcgcgggcgttttgtgttcgttttttttaggaggggacggttttcgggtaggggtcgtcggtttttttacgcggtttgcgttcgtttagatttagagtttcgggacgtgcgggggttcgggggtttcgcgggttcgcgcgtggggttggcggcgcggatgttttggggcgttgtagatttcgagaggtcgtttgttcgcggggacgttagtcgtttttgttgttaaaatttgaaatgtttagtaagttagaaatttgaaatttaaggaagcgtgatcggtcgttttggaagttttcgtcgcgcggtcggtttcggtttcggtttttagcggcgttggcgtttgcgcgtttcggggttgttttcgtagtatgtggggttgggatttttttttcgcgcgggtttcgggcggacgttgcgggcggtgacggagttaggtcggtcgtttgggtaggggacgggggcgcgggattatttgtttgttcgtggtcgatgttttattcgaacggaaaacgttttttttaggggagatagaggttgtgggcgaaggtattttttaagtttgaggatttatttgggagttag

SEQ ID NO: 12758 - DNA, 1259 bp, Artificial Sequence
  chemically treated genomic DNA (Homo sapiens) CpG-island No: 12758
ctaactcccaaataaatcctcaaacttaaaaaataccttcgcccacaacctctatctcccctaaaaaaaacgttttccgttcgaataaaacatcgaccacgaacaaacaaataatcccgcgcccccgtcccctacccaaacgaccgacctaactccgtcaccgcccgcaacgtccgcccgaaacccgcgcgaaaaaaaaatcccaaccccacatactacgaaaacaaccccgaaacgcgcaaacgccaacgccgctaaaaaccgaaaccgaaaccgaccgcgcgacgaaaacttccaaaacgaccgatcacgcttccttaaatttcaaatttctaacttactaaacatttcaaattttaacaacaaaaacgactaacgtccccgcgaacaaacgacctctcgaaatctacaacgccccaaaacatccgcgccgccaaccccacgcgcgaacccgcgaaacccccgaacccccgcacgtcccgaaactctaaatctaaacgaacgcaaaccgcgtaaaaaaaccgacgacccctacccgaaaaccgtcccctcctaaaaaaaacgaacacaaaacgcccgcgaaacccgacccgaatacccgaacgtaaaaaaacgaacgcgccctcgacgataaaaccgcccgcaatacccccaacgcccgaaaaaaaacgcccgacgaaacgcaaacgaacgaacctcgaacgacgaacgcccctaacgtcaccgacccgcgatcgccaaaacaacgacctcatcccgcgcgcgtcaaaaccgccaatctcttaacaaccgcccgatctcccgctctccctccgcccgacgctcgaccgcgcgtcgctctaacgtcaaaacgacgtcaataaacgacccccgcccgaacgacgaaaacgaaacaaaaaacgaaaactacgaaaaacgaaccgaaacgaaccgaaacgaaaccgaacgccgcgtacgacgaaacgcgacgactccgaactaacatacgacgcgaccccgaaaacaacaacaacgacgacgacaaccgaaacaataaacacccgaacaacgccaacgaccgaacgaacgacttcctaacctaaacgctccgataacgacgaaaataaaacgacgacaacgacgacaacgacgacaacgacgaactccgaacgaacgaaaataaccgccgtaaaaactccgcgcgaacgccgaaccgaaactcgaaattacaaccaccgcgcaaaatccctaaccttacgcgcgcgaaattcgcgaacgaa

SEQ ID NO: 12759 - DNA, 1259 bp, Artificial Sequence
  chemically treated genomic DNA (Homo sapiens) CpG-island No: 12759
ttaatttttaaatgggtttttaggtttaaaaaatattttcgtttatagtttttgttttttttgaagaaaacgtttttcgttcggatgaggtatcggttacgggtaagtaagtggtttcgcgttttcgttttttatttaggcggtcggtttggtttcgttatcgttcgtagcgttcgttcggggttcgcgcgggaagagggttttagttttatatgttgcgggggtagtttcgggacgcgtagacgttagcgtcgttgagggtcggggtcgggatcggtcgcgcggcgggggtttttagagcggtcggttacgtttttttaggttttaagtttttaatttgttgaatattttagattttaatagtaaaagcggttgacgttttcgcgggtaagcggtttttcggggtttgtagcgttttagggtattcgcgtcgttagttttacgcgcgagttcgcgaggttttcgggttttcgtacgtttcgaggttttgagtttggacgaacgtaggtcgcgtggaggggtcggcgatttttgttcgagagtcgtttttttttggagggagcgagtataaggcgttcgcgggattcggttcgagtgttcgagcgtggaggggcgggcgcgttttcggcggtggggtcgttcgtagtgtttttagcgttcgggagggggcgttcggcggagcgtaggcgggcgggtttcgggcggcgggcgtttttgacgttatcggttcgcggtcgttagggtaacggttttatttcgcgcgcgttagagtcgttagttttttggtaatcgttcgatttttcgtttttttttcgttcggcgttcggtcgcgcgtcgttttggcgttaaagcgacgttaatgggcggttttcgttcgggcggcgggggcggggtagggggcggggattacggggggcgggtcggggcgggtcggggcggggtcgggcgtcgcgtgcggcggagcgcggcggtttcgggttgatatgcggcgcggtttcggaggtagtagtagcggcggcggtagtcggagtagtaggtattcgagtagcgttagcggtcgagcgggcggttttttggtttgggcgtttcggtggcggcggaggtgaggcggcggtagcggcggtagcggcggtagcggcgggtttcgggcgggcggaggtggtcgtcgtgggggtttcgcgcgggcgtcgggtcggggttcggggttgtagttatcgcgtagggtttttggttttgcgcgcgcggggttcgcgggcggg

SEQ ID NO: 12760 - DNA, 1259 bp, Artificial Sequence
  chemically treated genomic DNA (Homo sapiens) CpG-island No: 12760
cccgcccgcgaaccccgcgcgcgcaaaaccaaaaaccctacgcgataactacaaccccgaaccccgacccgacgcccgcgcgaaacccccacgacgaccacctccgcccgcccgaaacccgccgctaccgccgctaccgccgctaccgccgcctcacctccgccgccaccgaaacgcccaaaccaaaaaaccgcccgctcgaccgctaacgctactcgaatacctactactccgactaccgccgccgctactactacctccgaaaccgcgccgcatatcaacccgaaaccgccgcgctccgccgcacgcgacgcccgaccccgccccgacccgccccgacccgccccccgtaatccccgccccctaccccgcccccgccgcccgaacgaaaaccgcccattaacgtcgctttaacgccaaaacgacgcgcgaccgaacgccgaacgaaaaaaaaacgaaaaatcgaacgattaccaaaaaactaacgactctaacgcgcgcgaaataaaaccgttaccctaacgaccgcgaaccgataacgtcaaaaacgcccgccgcccgaaacccgcccgcctacgctccgccgaacgccccctcccgaacgctaaaaacactacgaacgaccccaccgccgaaaacgcgcccgcccctccacgctcgaacactcgaaccgaatcccgcgaacgccttatactcgctccctccaaaaaaaaacgactctcgaacaaaaatcgccgacccctccacgcgacctacgttcgtccaaactcaaaacctcgaaacgtacgaaaacccgaaaacctcgcgaactcgcgcgtaaaactaacgacgcgaataccctaaaacgctacaaaccccgaaaaaccgcttacccgcgaaaacgtcaaccgcttttactattaaaatctaaaatattcaacaaattaaaaacttaaaacctaaaaaaacgtaaccgaccgctctaaaaacccccgccgcgcgaccgatcccgaccccgaccctcaacgacgctaacgtctacgcgtcccgaaactacccccgcaacatataaaactaaaaccctcttcccgcgcgaaccccgaacgaacgctacgaacgataacgaaaccaaaccgaccgcctaaataaaaaacgaaaacgcgaaaccacttacttacccgtaaccgatacctcatccgaacgaaaaacgttttcttcaaaaaaaacaaaaactataaacgaaaatattttttaaacctaaaaacccatttaaaaattaa

SEQ ID NO: 12761 - DNA, 617 bp, Artificial Sequence
  chemically treated genomic DNA (Homo sapiens) CpG-island No: 12761
ttatttagcgtatggtgcgaaatagttttcgtagtttaggaggcgtagatacggaagagttttcgtgtgttattagtcgttatgatgagttggtgatggtattaatgtttcggtgtggagaattggagacgcggttcgttatgttattatcgtcgtcgtcgtcgtcgtcgtttaatgcgaatattattgtcgttaatgttttttagatgttttaggttgtatttatcgttgtttcgcggattattaaggttcgtgagacgtggttagcggtggtgaagtgcgacgattttgcgttatcggggaaagttatagtcgaaaaggtgcggacgatggttgtattttttttcggagttagagtatacgaggtacgtgagtttcgtcgaggtggtggtgcgattattcgtattttttcggttggagagttgtagaaggtgatggtatcgaaaagattcgtagaatttggattgaatgtggtacggaacgcggtcgagaagtcgaaggttatagtttatgacgtcgatatagttatcggtttagaagagtttatgtaggagttttacgagaataatttcgatagtgaaatgattttggtttagtttaaaaagtcggtgtatttg

SEQ ID NO: 12762 - DNA, 617 bp, Artificial Sequence
  chemically treated genomic DNA (Homo sapiens) CpG-island No: 12762
caaatacaccgactttttaaactaaaccaaaatcatttcactatcgaaattattctcgtaaaactcctacataaactcttctaaaccgataactatatcgacgtcataaactataaccttcgacttctcgaccgcgttccgtaccacattcaatccaaattctacgaatcttttcgataccatcaccttctacaactctccaaccgaaaaaatacgaataatcgcaccaccacctcgacgaaactcacgtacctcgtatactctaactccgaaaaaaaatacaaccatcgtccgcaccttttcgactataactttccccgataacgcaaaatcgtcgcacttcaccaccgctaaccacgtctcacgaaccttaataatccgcgaaacaacgataaatacaacctaaaacatctaaaaaacattaacgacaataatattcgcattaaacgacgacgacgacgacgacgataataacataacgaaccgcgtctccaattctccacaccgaaacattaataccatcaccaactcatcataacgactaataacacacgaaaactcttccgtatctacgcctcctaaactacgaaaactatttcgcaccatacgctaaataa

SEQ ID NO: 12763 - DNA, 617 bp, Artificial Sequence
  chemically treated genomic DNA (Homo sapiens) CpG-island No: 12763
taggtgtatcgattttttgaattgggttagagttattttattgtcgaagttgttttcgtgaagtttttgtatgaatttttttgggtcgatggttgtgtcgacgttatagattatgattttcggtttttcggtcgcgtttcgtgttatatttagtttaagttttgcgaattttttcgatgttattattttttgtagttttttaatcgaaggagtacgaatgatcgtattattatttcgacggagtttacgtatttcgtgtattttgatttcgagggagggtgtaattatcgttcgtattttttcggttatggtttttttcgatagcgtagggtcgtcgtattttattatcgttgattacgttttacgaattttggtggttcgcggggtagcgatgggtgtaatttgaggtatttggggagtattggcggtagtagtgttcgtattggacggcggcggcggcggcggcggtggtggtatagcgagtcgcgtttttagttttttatatcggagtattaatgttattattagtttattatagcggttgatggtatacgagagttttttcgtgtttacgttttttaggttgcggaaattgtttcgtattatgcgttgggtgg

SEQ ID NO: 12764 - DNA, 617 bp, Artificial Sequence
  chemically treated genomic DNA (Homo sapiens) CpG-island No: 12764
ccacccaacgcataatacgaaacaatttccgcaacctaaaaaacgtaaacacgaaaaaactctcgtataccatcaaccgctataataaactaataataacattaatactccgatataaaaaactaaaaacgcgactcgctataccaccaccgccgccgccgccgccgccgtccaatacgaacactactaccgccaatactccccaaatacctcaaattacacccatcgctaccccgcgaaccaccaaaattcgtaaaacgtaatcaacgataataaaatacgacgaccctacgctatcgaaaaaaaccataaccgaaaaaatacgaacgataattacaccctccctcgaaatcaaaatacacgaaatacgtaaactccgtcgaaataataatacgatcattcgtactccttcgattaaaaaactacaaaaaataataacatcgaaaaaattcgcaaaacttaaactaaatataacacgaaacgcgaccgaaaaaccgaaaatcataatctataacgtcgacacaaccatcgacccaaaaaaattcatacaaaaacttcacgaaaacaacttcgacaataaaataactctaacccaattcaaaaaatcgatacaccta

SEQ ID NO: 12765 - DNA, 624 bp, Artificial Sequence
  chemically treated genomic DNA (Homo sapiens) CpG-island No: 12765
gcggcgtcgcgatttcgggtcgttgggcggcgttgtgggtttggcggcggagtggaaattttaggttttagggagcgttgcggacggaagtagggaaattgtgagggcggtatcggaagtggcgagtagtttgcgcgcggatggtcgtagcggcgatggcggtagcggtaggtggaggggttggcgcggttcgttttttttcgcgttttcgaggttgtttggttggcgcgttgttcggggattgcgtgggttttttttacgaggtttacgatatcgtcgatttgacgttagttttgcgttatgtttagagtttggagtcggatttcggtacgttcgggagtgagcggataggtgggcggggtcgggcgtaagttagaggtcgtgcgggagggaggtcgaaggggcgcggagttttcgggggcgacgggtcgggggtgcgcggggatgaggttgtcgagggtatcggggttagagtcggatgattcgtagatagtttgagtttagcgagtgttagtgcgattttcggttttatagacgtttcgtttcgaatatttcgtgttcggggcgtggtagtatcggggttttaatcgtgtagggtgtggataaatttatcgtaagttgaaa

SEQ ID NO: 12766 - DNA, 624 bp, Artificial Sequence
  chemically treated genomic DNA (Homo sapiens) CpG-island No: 12766
tttcaacttacgataaatttatccacaccctacacgattaaaaccccgatactaccacgccccgaacacgaaatattcgaaacgaaacgtctataaaaccgaaaatcgcactaacactcgctaaactcaaactatctacgaatcatccgactctaaccccgataccctcgacaacctcatccccgcgcacccccgacccgtcgcccccgaaaactccgcgccccttcgacctccctcccgcacgacctctaacttacgcccgaccccgcccacctatccgctcactcccgaacgtaccgaaatccgactccaaactctaaacataacgcaaaactaacgtcaaatcgacgatatcgtaaacctcgtaaaaaaaacccacgcaatccccgaacaacgcgccaaccaaacaacctcgaaaacgcgaaaaaaaacgaaccgcgccaacccctccacctaccgctaccgccatcgccgctacgaccatccgcgcgcaaactactcgccacttccgataccgccctcacaatttccctacttccgtccgcaacgctccctaaaacctaaaatttccactccgccgccaaacccacaacgccgcccaacgacccgaaatcgcgacgccgc

SEQ ID NO: 12767 - DNA, 624 bp, Artificial Sequence
  chemically treated genomic DNA (Homo sapiens) CpG-island No: 12767
ttttaatttacgatgggtttatttatattttgtacggttgaggtttcggtgttgttacgtttcgagtacgggatgttcggggcgagacgtttataaggtcggagatcgtattggtattcgttgagtttaagttgtttgcgggttattcggttttggtttcggtgttttcggtagttttattttcgcgtattttcgattcgtcgttttcggaggtttcgcgttttttcggtttttttttcgtacggtttttgatttgcgttcggtttcgtttatttgttcgtttattttcgggcgtgtcggggttcggttttagattttggatatgacgtaggattgacgttaggtcgacggtgtcgtgggtttcgtagaaggagtttacgtagttttcgagtagcgcgttagttaggtagtttcggaagcgcgagagggagcgggtcgcgttagtttttttatttgtcgttgtcgttatcgtcgttgcggttattcgcgcgtagattgttcgttattttcggtgtcgtttttatagtttttttattttcgttcgtagcgttttttggggtttagagtttttatttcgtcgttaggtttatagcgtcgtttagcggttcggagtcgcggcgtcgt

SEQ ID NO: 12768 - DNA, 624 bp, Artificial Sequence
  chemically treated genomic DNA (Homo sapiens) CpG-island No: 12768
acgacgccgcgactccgaaccgctaaacgacgctataaacctaacgacgaaataaaaactctaaaccccaaaaaacgctacgaacgaaaataaaaaaactataaaaacgacaccgaaaataacgaacaatctacgcgcgaataaccgcaacgacgataacgacaacgacaaataaaaaaactaacgcgacccgctccctctcgcgcttccgaaactacctaactaacgcgctactcgaaaactacgtaaactccttctacgaaacccacgacaccgtcgacctaacgtcaatcctacgtcatatccaaaatctaaaaccgaaccccgacacgcccgaaaataaacgaacaaataaacgaaaccgaacgcaaatcaaaaaccgtacgaaaaaaaaaccgaaaaaacgcgaaacctccgaaaacgacgaatcgaaaatacgcgaaaataaaactaccgaaaacaccgaaaccaaaaccgaataacccgcaaacaacttaaactcaacgaataccaatacgatctccgaccttataaacgtctcgccccgaacatcccgtactcgaaacgtaacaacaccgaaacctcaaccgtacaaaatataaataaacccatcgtaaattaaaa

SEQ ID NO: 12769 - DNA, 522 bp, Artificial Sequence
  chemically treated genomic DNA (Homo sapiens) CpG-island No: 12769
cgtacgtttttgtaaattcgatgttagtggcgaaggtataagatagaagaggggattttaataggtattatggtttcgattaaagtgggtttcggaagttagaaggcgcggaagtttagcgggttcgtagtagagcgcgcggggtaattgggtatggcgcgcgggggtgtacggggcggacgcgtagttttgggggcgtacggttttggattttgtttatttacgcggtttttttttcgttttcgatttcgtcgtagtttggatcggttttcgcggtttttcgatagttaacgatggtttataaatatatatgtatttcgttgaaggatgtttgggtaatttcgtttttcgttcggcgtttttggcgacgttttgtattaggatttgtttcgaggttacgtagaaaagataaaagggtagtcgggtcgtcgtagtcgggtagaaatatttattagttagtatttcggcgaggaattttaagaggttaagtggaggatgagagttgttgcgaagattgagtgg

SEQ ID NO: 12770 - DNA, 522 bp, Artificial Sequence
  chemically treated genomic DNA (Homo sapiens) CpG-island No: 12770
ccactcaatcttcgcaacaactctcatcctccacttaacctcttaaaattcctcgccgaaatactaactaataaatatttctacccgactacgacgacccgactacccttttatcttttctacgtaacctcgaaacaaatcctaatacaaaacgtcgccaaaaacgccgaacgaaaaacgaaattacccaaacatccttcaacgaaatacatatatatttataaaccatcgttaactatcgaaaaaccgcgaaaaccgatccaaactacgacgaaatcgaaaacgaaaaaaaaaccgcgtaaataaacaaaatccaaaaccgtacgcccccaaaactacgcgtccgccccgtacacccccgcgcgccatacccaattaccccgcgcgctctactacgaacccgctaaacttccgcgccttctaacttccgaaacccactttaatcgaaaccataatacctattaaaatcccctcttctatcttataccttcgccactaacatcgaatttacaaaaacgtacg

SEQ ID NO: 12771 - DNA, 522 bp, Artificial Sequence
  chemically treated genomic DNA (Homo sapiens) CpG-island No: 12771
ttatttagttttcgtagtagtttttattttttatttggttttttggagtttttcgtcggagtgttgattagtggatatttttgttcggttgcggcggttcgattgtttttttgttttttttgcgtgatttcggggtaggttttggtgtagagcgtcgttaaggacgtcgagcgggaggcgggattgtttagatattttttagcgaagtgtatgtgtgtttgtaaattatcgttggttgtcgggagatcgcgaggatcggtttaggttgcggcggagtcgagggcgagggagaggtcgcgtgagtgagtagagtttagagtcgtgcgtttttagaattgcgcgttcgtttcgtgtattttcgcgcgttatgtttagttgtttcgcgcgttttgttacgggttcgttgggttttcgcgttttttagttttcggagtttattttgatcggggttataatatttattgagatttttttttttgttttgtattttcgttattggtatcggatttgtagaagcgtgcg

SEQ ID NO: 12772 - DNA, 522 bp, Artificial Sequence
  chemically treated genomic DNA (Homo sapiens) CpG-island No: 12772
cgcacgcttctacaaatccgataccaataacgaaaatacaaaacaaaaaaaaaaatctcaataaatattataaccccgatcaaaataaactccgaaaactaaaaaacgcgaaaacccaacgaacccgtaacaaaacgcgcgaaacaactaaacataacgcgcgaaaatacacgaaacgaacgcgcaattctaaaaacgcacgactctaaactctactcactcacgcgacctctccctcgccctcgactccgccgcaacctaaaccgatcctcgcgatctcccgacaaccaacgataatttacaaacacacatacacttcgctaaaaaatatctaaacaatcccgcctcccgctcgacgtccttaacgacgctctacaccaaaacctaccccgaaatcacgcaaaaaaaacaaaaaaacaatcgaaccgccgcaaccgaacaaaaatatccactaatcaacactccgacgaaaaactccaaaaaaccaaataaaaaataaaaactactacgaaaactaaataa

SEQ ID NO: 12773 - DNA, 546 bp, Artificial Sequence
  chemically treated genomic DNA (Homo sapiens) CpG-island No: 12773
cggggattcggtggttttgtcgatttcggagtttttggtaagtgtttaaataataggacggacgtagtagtttaagtttcgtttgtttggaaggaaggtgggttgttgtcgtaattggagttgttcgttggggttgattggcgtttagcgtagttaaataaaaattcggttcgcgttttcggagtcggttgcgggttttcggcgtttttttttttgtttagtattttcgtcgtgtttagaaagcgcggtagtttcggtttgcgtttgggcgtttcggcgtttttatgtttcgtagttgttttcgttttcgtcgtcgtcgtcgtcgtcgtttttttttttttaattatagtttgcggtagttattattatcgtcgtcgttaagtttcgtcgttcgggcgttttttaaataaataatattaagttcgaagttgagtcggcgcgggttttatatagtcgttcgagttttcgttttttgatttcgtttttcgaggtttaggttcgttttttggtttcgttttgggagttcgtatttcgttggggagaggg

SEQ ID NO: 12774 - DNA, 546 bp, Artificial Sequence
  chemically treated genomic DNA (Homo sapiens) CpG-island No: 12774
ccctctccccaacgaaatacgaactcccaaaacgaaaccaaaaaacgaacctaaacctcgaaaaacgaaatcaaaaaacgaaaactcgaacgactatataaaacccgcgccgactcaacttcgaacttaatattatttatttaaaaaacgcccgaacgacgaaacttaacgacgacgataataataactaccgcaaactataattaaaaaaaaaaaaacgacgacgacgacgacgacgaaaacgaaaacaactacgaaacataaaaacgccgaaacgcccaaacgcaaaccgaaactaccgcgctttctaaacacgacgaaaatactaaacaaaaaaaaaaacgccgaaaacccgcaaccgactccgaaaacgcgaaccgaatttttatttaactacgctaaacgccaatcaaccccaacgaacaactccaattacgacaacaacccaccttccttccaaacaaacgaaacttaaactactacgtccgtcctattatttaaacacttaccaaaaactccgaaatcgacaaaaccaccgaatccccg

SEQ ID NO: 12775 - DNA, 546 bp, Artificial Sequence
  chemically treated genomic DNA (Homo sapiens) CpG-island No: 12775
ttttttttttagcgaggtgcgggtttttagagcggagttagggggcgggtttgggtttcgaggggcggggttagggggcggaggttcgggcggttatataaggttcgcgtcggtttaatttcggatttggtgttatttatttgggaagcgttcggacggcggagtttggcggcggcggtggtggtggttgtcgtagattgtggttaaaaaaaagaaggcggcggcggcggcggcggcggaggcggaggtagttgcgaggtatgggagcgtcgaagcgtttaggcgtaggtcgaagttgtcgcgttttttgggtacggcgggagtgttgagtagaaaggggagcgtcgggggttcgtagtcggtttcggaggcgcgggtcgggtttttgtttggttacgttgagcgttagttagttttagcgaataattttagttacgataataatttattttttttttagataagcgagatttgggttgttgcgttcgttttattgtttagatatttgttaggggtttcggagtcggtagagttatcgagttttcg

SEQ ID NO: 12776 - DNA, 546 bp, Artificial Sequence
  chemically treated genomic DNA (Homo sapiens) CpG-island No: 12776
cgaaaactcgataactctaccgactccgaaacccctaacaaatatctaaacaataaaacgaacgcaacaacccaaatctcgcttatctaaaaaaaaaataaattattatcgtaactaaaattattcgctaaaactaactaacgctcaacgtaaccaaacaaaaacccgacccgcgcctccgaaaccgactacgaacccccgacgctcccctttctactcaacactcccgccgtacccaaaaaacgcgacaacttcgacctacgcctaaacgcttcgacgctcccatacctcgcaactacctccgcctccgccgccgccgccgccgccgccttcttttttttaaccacaatctacgacaaccaccaccaccgccgccgccaaactccgccgtccgaacgcttcccaaataaataacaccaaatccgaaattaaaccgacgcgaaccttatataaccgcccgaacctccgccccctaaccccgcccctcgaaacccaaacccgccccctaactccgctctaaaaacccgcacctcgctaaaaaaaaaa

SEQ ID NO: 12777 - DNA, 502 bp, Artificial Sequence
  chemically treated genomic DNA (Homo sapiens) CpG-island No: 12777
acgcgacgtaacgtaggtagcgtagcgcgggtattacgggtaatttaaatttttttttatatataatcgcggagttgtttgttaggtttgtttattgtagagtcgtcgttgtttgcgggacgggtaaaagttaagtcgttaggtggatttcggggaagtcgtcgttaatatttattttataggattaggaggttttatcggggcgttgtcgcgaatcgcgttatttatagtttttattttaggggtaggtttgcgtttgcgtaggtcgtagtttcggtttttaatttttagaatttttttcgtcgtcggttttcgttcgcggattttggtttaggcgcgtgggcgttgtcgagaggttgggagttcgggaatcggtttttggatttgagcggagcgagaaagagcgcgtcgtttgtacgattggattggagcggtcgggtgttttggaggtttttgggaattgtagtttttgcgtaggtggagagtgagtttttgtaagcgg

SEQ ID NO: 12778 - DNA, 502 bp, Artificial Sequence
  chemically treated genomic DNA (Homo sapiens) CpG-island No: 12778
ccgcttacaaaaactcactctccacctacgcaaaaactacaattcccaaaaacctccaaaacacccgaccgctccaatccaatcgtacaaacgacgcgctctttctcgctccgctcaaatccaaaaaccgattcccgaactcccaacctctcgacaacgcccacgcgcctaaaccaaaatccgcgaacgaaaaccgacgacgaaaaaaattctaaaaattaaaaaccgaaactacgacctacgcaaacgcaaacctacccctaaaataaaaactataaataacgcgattcgcgacaacgccccgataaaacctcctaatcctataaaataaatattaacgacgacttccccgaaatccacctaacgacttaacttttacccgtcccgcaaacaacgacgactctacaataaacaaacctaacaaacaactccgcgattatatataaaaaaaaatttaaattacccgtaatacccgcgctacgctacctacgttacgtcgcgt

SEQ ID NO: 12779 - DNA, 502 bp, Artificial Sequence
  chemically treated genomic DNA (Homo sapiens) CpG-island No: 12779
tcgtttataagggtttattttttatttgcgtaaggattgtaatttttaggggtttttagggtattcggtcgttttagtttagtcgtgtaggcggcgcgttttttttcgtttcgtttaagtttaggaatcggttttcgggtttttagtttttcggtagcgtttacgcgtttgggttaaagttcgcgaacggaagtcggcggcgaggaggattttgggagttggaggtcgaggttgcgatttgcgtaggcgtaaatttgtttttggggtgagggttgtaagtggcgcgattcgcggtagcgtttcgatggaattttttggttttgtgaggtgagtgttggcggcggttttttcgaggtttatttggcggtttggtttttgttcgtttcgtaggtagcggcggttttgtagtgagtaggtttggtaggtagtttcgcggttgtgtgtggagaggggtttgggttgttcgtggtgttcgcgttgcgttatttgcgttgcgtcgcgt

SEQ ID NO: 12780 - DNA, 502 bp, Artificial Sequence
  chemically treated genomic DNA (Homo sapiens) CpG-island No: 12780
acgcgacgcaacgcaaataacgcaacgcgaacaccacgaacaacccaaacccctctccacacacaaccgcgaaactacctaccaaacctactcactacaaaaccgccgctacctacgaaacgaacaaaaaccaaaccgccaaataaacctcgaaaaaaccgccgccaacactcacctcacaaaaccaaaaaattccatcgaaacgctaccgcgaatcgcgccacttacaaccctcaccccaaaaacaaatttacgcctacgcaaatcgcaacctcgacctccaactcccaaaatcctcctcgccgccgacttccgttcgcgaactttaacccaaacgcgtaaacgctaccgaaaaactaaaaacccgaaaaccgattcctaaacttaaacgaaacgaaaaaaaacgcgccgcctacacgactaaactaaaacgaccgaataccctaaaaacccctaaaaattacaatccttacgcaaataaaaaataaacccttataaacga

SEQ ID NO: 12781 - DNA, 688 bp, Artificial Sequence
  chemically treated genomic DNA (Homo sapiens) CpG-island No: 12781
ggattggcggtttagtttttcggggatatagttcgggcgtatttcgcgtcgtttttggttattgaggcggttttcgaggcgtcgggttagggaaagttttttcggtcgttaaggttgggatagcgtcgggggatcggggcggggtgcgtgcgtcgaaagggttttaaagttgtagggttggacggtataaaggggcgtaaggtacggaggttaggtagaggggatagttagcggcgcggcgggacgggcgggtttcgacgtttagttttaaatgcgtggtcgttgtgggagttcgtttttaggcgtttattagttttttttttattcgacgttattttggcggtcgcgtttatgttgttttcgttttaattagtagttaggaggggtcgcgggtagcgttcgagacgtttattgagaggatttttcgtttgcgggttttttgttcgacgttattttcggtttcgtttcgggcggttttttttattattttcggtttcgttttcggcggttcgttttattattttcggtttttcggggtttaggttcgtattatcgagtcgaatcgagtttttatgtttttttagataagtcgttgggggagaggggcggggttttgggcgttttcggaggtttttttcgtgtgttttcggggggggttcgggggggtatttgggggtaaattaatggg

SEQ ID NO: 12782 - DNA, 688 bp, Artificial Sequence
  chemically treated genomic DNA (Homo sapiens) CpG-island No: 12782
cccattaatttacccccaaatacccccccgaaccccccccgaaaacacacgaaaaaaacctccgaaaacgcccaaaaccccgcccctctcccccaacgacttatctaaaaaaacataaaaactcgattcgactcgataatacgaacctaaaccccgaaaaaccgaaaataataaaacgaaccgccgaaaacgaaaccgaaaataataaaaaaaaccgcccgaaacgaaaccgaaaataacgtcgaacaaaaaacccgcaaacgaaaaatcctctcaataaacgtctcgaacgctacccgcgacccctcctaactactaattaaaacgaaaacaacataaacgcgaccgccaaaataacgtcgaataaaaaaaaaactaataaacgcctaaaaacgaactcccacaacgaccacgcatttaaaactaaacgtcgaaacccgcccgtcccgccgcgccgctaactatcccctctacctaacctccgtaccttacgcccctttataccgtccaaccctacaactttaaaaccctttcgacgcacgcaccccgccccgatcccccgacgctatcccaaccttaacgaccgaaaaaactttccctaacccgacgcctcgaaaaccgcctcaataaccaaaaacgacgcgaaatacgcccgaactatatccccgaaaaactaaaccgccaatcc

SEQ ID NO: 12783 - DNA, 688 bp, Artificial Sequence
  chemically treated genomic DNA (Homo sapiens) CpG-island No: 12783
tttattgatttgtttttaaatgttttttcgaatttttttcggaaatatacggggggagttttcggggacgtttaaaatttcgttttttttttttagcggtttgtttaggaaaatatgaggattcggttcgattcgatggtgcgggtttaagtttcgggaagtcgggagtggtgaggcgggtcgtcgggagcggggtcgggagtggtgaggggggtcgttcggagcggggtcgggagtggcgtcgagtagagagttcgtaggcgggaagtttttttaatgagcgtttcgagcgttgttcgcggttttttttgattgttagttggagcggggatagtatgggcgcggtcgttaaggtagcgtcgagtgaggggaagattgatgggcgtttggagacgagtttttatagcggttacgtatttggagttgggcgtcggggttcgttcgtttcgtcgcgtcgttagttgttttttttgtttggttttcgtgttttgcgtttttttgtgtcgtttagttttatagttttgaggttttttcggcgtacgtatttcgtttcgatttttcggcgttattttagttttgacggtcggggaggttttttttagttcggcgtttcgaggatcgttttagtggttaaaggcggcgcggggtgcgttcgggttgtgttttcgggaggttggatcgttagttt

SEQ ID NO: 12784 - DNA, 688 bp, Artificial Sequence
  chemically treated genomic DNA (Homo sapiens) CpG-island No: 12784
aaactaacgatccaacctcccgaaaacacaacccgaacgcaccccgcgccgcctttaaccactaaaacgatcctcgaaacgccgaactaaaaaaaacctccccgaccgtcaaaactaaaataacgccgaaaaatcgaaacgaaatacgtacgccgaaaaaacctcaaaactataaaactaaacgacacaaaaaaacgcaaaacacgaaaaccaaacaaaaaaaacaactaacgacgcgacgaaacgaacgaaccccgacgcccaactccaaatacgtaaccgctataaaaactcgtctccaaacgcccatcaatcttcccctcactcgacgctaccttaacgaccgcgcccatactatccccgctccaactaacaatcaaaaaaaaccgcgaacaacgctcgaaacgctcattaaaaaaacttcccgcctacgaactctctactcgacgccactcccgaccccgctccgaacgacccccctcaccactcccgaccccgctcccgacgacccgcctcaccactcccgacttcccgaaacttaaacccgcaccatcgaatcgaaccgaatcctcatattttcctaaacaaaccgctaaaaaaaaaaaacgaaattttaaacgtccccgaaaactccccccgtatatttccgaaaaaaattcgaaaaaacatttaaaaacaaatcaataaa

SEQ ID NO: 12785 - DNA, 665 bp, Artificial Sequence
  chemically treated genomic DNA (Homo sapiens) CpG-island No: 12785
ggtcgcgtaaacggttttcgcgggaatgcgaagcggattttcgagtttttgagtttagagtaatgtttggggagcgatacgagggcgtagagcggtagatcgcggagcgggaagtttattttcggagtcgttttaggaaattcggaggatttaggtcgttaatgatttcggggttgaagtgggtatcgacgggtgtattttgttgttttagggaagtcgttcggtaggcggcggcgacgtggaatttgggttagggttagaatcggcgaaaagtaagtcggaaaaggtaagggggcgtcggtgcgttgattatttgtttttttagcggagtgcgacgcgcgtcgattggttggagtgtcgttcgggtattcggaagtggtcgatgttcgtcgttagtgatatcgggataatagttgcgggttttgtgcgagcggtttagtagcgcggagttttagcggagtgagcgagcgcggggtagtagcggtttgcggtgagattttatttcgtcgcggttgtgggggtaggcgggggttgggtttttagttttttagagagtcgagcggaaattttacgtttaggttcgttttgatcggggttcgttgtgtgattttgaagtttatgtttttttttatttttttcgtttttaggtttttatttttatttgt

SEQ ID NO: 12786 - DNA, 665 bp, Artificial Sequence
  chemically treated genomic DNA (Homo sapiens) CpG-island No: 12786
acaaataaaaataaaaacctaaaaacgaaaaaaataaaaaaaaacataaacttcaaaatcacacaacgaaccccgatcaaaacgaacctaaacgtaaaatttccgctcgactctctaaaaaactaaaaacccaacccccgcctacccccacaaccgcgacgaaataaaatctcaccgcaaaccgctactaccccgcgctcgctcactccgctaaaactccgcgctactaaaccgctcgcacaaaacccgcaactattatcccgatatcactaacgacgaacatcgaccacttccgaatacccgaacgacactccaaccaatcgacgcgcgtcgcactccgctaaaaaaacaaataatcaacgcaccgacgcccccttaccttttccgacttacttttcgccgattctaaccctaacccaaattccacgtcgccgccgcctaccgaacgacttccctaaaacaacaaaatacacccgtcgatacccacttcaaccccgaaatcattaacgacctaaatcctccgaatttcctaaaacgactccgaaaataaacttcccgctccgcgatctaccgctctacgccctcgtatcgctccccaaacattactctaaactcaaaaactcgaaaatccgcttcgcattcccgcgaaaaccgtttacgcgacc

SEQ ID NO: 12787 - DNA, 665 bp, Artificial Sequence
  chemically treated genomic DNA (Homo sapiens) CpG-island No: 12787
gtaggtggaaatgaaggtttgggggcggggggaatggagggaggtataaattttaaggttatatagcgaatttcggttagaacgggtttaaacgtagggttttcgttcggttttttagggagttgggagtttagttttcgtttatttttatagtcgcgacggaatgaggttttatcgtaggtcgttattgtttcgcgttcgtttatttcgttgaggtttcgcgttgttgggtcgttcgtatagagttcgtagttgttgtttcggtgttattggcgacgggtatcggttattttcgggtattcgggcggtattttagttaatcggcgcgcgtcgtatttcgttggaggaataggtggttagcgtatcgacgtttttttgtttttttcggtttgtttttcgtcggttttagttttagtttaagttttacgtcgtcgtcgtttgtcgagcggtttttttggaatagtaaagtgtattcgtcgatgtttattttagtttcggaattattgacgatttgagtttttcgggttttttagaacggtttcggggatgaatttttcgtttcgcgatttgtcgttttgcgttttcgtgtcgttttttaagtattgttttaggtttaagaattcgagaattcgtttcgtattttcgcggggatcgtttgcgcgatt

SEQ ID NO: 12788 - DNA, 665 bp, Artificial Sequence
  chemically treated genomic DNA (Homo sapiens) CpG-island No: 12788
aatcgcgcaaacgatccccgcgaaaatacgaaacgaattctcgaattcttaaacctaaaacaatacttaaaaaacgacacgaaaacgcaaaacgacaaatcgcgaaacgaaaaattcatccccgaaaccgttctaaaaaacccgaaaaactcaaatcgtcaataattccgaaactaaaataaacatcgacgaatacactttactattccaaaaaaaccgctcgacaaacgacgacgacgtaaaacttaaactaaaactaaaaccgacgaaaaacaaaccgaaaaaaacaaaaaaacgtcgatacgctaaccacctattcctccaacgaaatacgacgcgcgccgattaactaaaataccgcccgaatacccgaaaataaccgatacccgtcgccaataacaccgaaacaacaactacgaactctatacgaacgacccaacaacgcgaaacctcaacgaaataaacgaacgcgaaacaataacgacctacgataaaacctcattccgtcgcgactataaaaataaacgaaaactaaactcccaactccctaaaaaaccgaacgaaaaccctacgtttaaacccgttctaaccgaaattcgctatataaccttaaaatttatacctccctccattccccccgcccccaaaccttcatttccacctac

SEQ ID NO: 12789 - DNA, 650 bp, Artificial Sequence
  chemically treated genomic DNA (Homo sapiens) CpG-island No: 12789
tcgttttcgagaggtgggttgcgggcgttcgaggtttagtcgtcgtcgtcgtcgtcgtcgtcgtcgttcgcgttcgtcgtcggttcgtcgttcgtttagaggcggttttttatcggaagtgaaatcgaaacggagttgagcgtttgattgaggtcgaattttcggttcgttgcgggtgtaatattgaaattacgttacgtgattaacgttgtttttttttttcgcgggtttagtttttcggtttcgtttttttttttaagtggtttgggagcgcgcgtatgcgcgttgttgggaatcggtcggggtgtcgggtcgaaagatagacgcgcgggtcgggcgtgcgcgggtttggtggagggcgggaaggttgaagggcggtgataggtcgtattgtttcgcgagggttagaacgttatttttgtagaggtgtatttagtggcgtgggaaattaaatgtattcggttattttagttcggtttttttgggatttcgcgggagggggtgtttggtttggtttggtttggtttggtttggtttggtttggttcggtttaaagtagcgtagtttgattgagcgggaggtggagtggaaggcgagaataggggtgaaggattagatagaagaagattttgaattaggaatagtggtaa

SEQ ID NO: 12790 - DNA, 650 bp, Artificial Sequence
  chemically treated genomic DNA (Homo sapiens) CpG-island No: 12790
ttaccactattcctaattcaaaatcttcttctatctaatccttcacccctattctcgccttccactccacctcccgctcaatcaaactacgctactttaaaccgaaccaaaccaaaccaaaccaaaccaaaccaaaccaaaccaaacaccccctcccgcgaaatcccaaaaaaaccgaactaaaataaccgaatacatttaatttcccacgccactaaatacacctctacaaaaataacgttctaaccctcgcgaaacaatacgacctatcaccgcccttcaaccttcccgccctccaccaaacccgcgcacgcccgacccgcgcgtctatctttcgacccgacaccccgaccgattcccaacaacgcgcatacgcgcgctcccaaaccacttaaaaaaaaaaacgaaaccgaaaaactaaacccgcgaaaaaaaaaaacaacgttaatcacgtaacgtaatttcaatattacacccgcaacgaaccgaaaattcgacctcaatcaaacgctcaactccgtttcgatttcacttccgataaaaaaccgcctctaaacgaacgacgaaccgacgacgaacgcgaacgacgacgacgacgacgacgacgacgactaaacctcgaacgcccgcaacccacctctcgaaaacga

SEQ ID NO: 12791 - DNA, 650 bp, Artificial Sequence
  chemically treated genomic DNA (Homo sapiens) CpG-island No: 12791
ttgttattgtttttagtttaaagtttttttttgtttaattttttatttttattttcgttttttattttatttttcgtttagttagattgcgttattttgaatcggattaaattaaattaaattaaattaaattaaattagattagatattttttttcgcggaattttagagaggtcgaattgggataatcgaatgtatttgattttttacgttattgagtgtatttttgtagaaatgacgttttggttttcgcgaggtagtgcgatttgttatcgttttttagttttttcgttttttattaagttcgcgtacgttcggttcgcgcgtttgtttttcgattcggtatttcggtcggtttttagtagcgcgtatgcgcgcgtttttaggttatttaagagagagggcggggtcgaggggttgagttcgcggggggagggaatagcgttgattacgtgacgtggttttagtgttatattcgtagcgggtcgggggttcggttttagttaggcgtttagtttcgtttcggttttattttcggtggagggtcgtttttgagcgggcggcgggtcgacggcgagcgcgggcggcggcggcggcggcggcggcggcggttgggtttcgagcgttcgtagtttatttttcgggggcgg

SEQ ID NO: 12792 - DNA, 650 bp, Artificial Sequence
  chemically treated genomic DNA (Homo sapiens) CpG-island No: 12792
ccgcccccgaaaaataaactacgaacgctcgaaacccaaccgccgccgccgccgccgccgccgccgcccgcgctcgccgtcgacccgccgcccgctcaaaaacgaccctccaccgaaaataaaaccgaaacgaaactaaacgcctaactaaaaccgaacccccgacccgctacgaatataacactaaaaccacgtcacgtaatcaacgctattccctccccccgcgaactcaacccctcgaccccgccctctctcttaaataacctaaaaacgcgcgcatacgcgctactaaaaaccgaccgaaataccgaatcgaaaaacaaacgcgcgaaccgaacgtacgcgaacttaataaaaaacgaaaaaactaaaaaacgataacaaatcgcactacctcgcgaaaaccaaaacgtcatttctacaaaaatacactcaataacgtaaaaaatcaaatacattcgattatcccaattcgacctctctaaaattccgcgaaaaaaaatatctaatctaatttaatttaatttaatttaatttaatttaatccgattcaaaataacgcaatctaactaaacgaaaaataaaataaaaaacgaaaataaaaataaaaaattaaacaaaaaaaaactttaaactaaaaacaataacaa

SEQ ID NO: 12793 - DNA, 608 bp, Artificial Sequence
  chemically treated genomic DNA (Homo sapiens) CpG-island No: 12793
  misc_feature (289)..(289): n is either a, c, g or t
  misc_feature (303)..(303): n is either a, c, g or t
  misc_feature (328)..(328): n is either a, c, g or t
  misc_feature (336)..(337): n is either a, c, g or t
  misc_feature (478)..(478): n is either a, c, g or t
  misc_feature (491)..(491): n is either a, c, g or t
  misc_feature (587)..(588): n is either a, c, g or t
  misc_feature (591)..(597): n is either a, c, g or t
attttgggttacggtcgttagtatcgttttcgttcggtagcggggaagttatttgttaggttcgagttttatttggtaggaaagaggaagcgattgttcggtagttcgttcgacgcgagggcggtgagcgtggaattcgttttttttgttgtagcggttagattttcgtcggtacgtgggttttatttaggtttcggtagttttgataggcgggtcgttcgcggatttcggttcgtcgtttcgcgtaggttttcggggtaggattttcgtttttttcgtaattattttngtcgagcgggcgtnttagcggtttatatcgtcggttcgntttggttnntttttttttttgacggcgcgatttcgttttgtagttttttatttatttggttacggagtttgaggaaagttatggcggtcgtttttttttttattttaggttttttttttttcggcggtgacgttgtcgtcgtcgattcgntttattgtttttngttttaatagttttaggtcgttgttcgggattaatcgtgttcggcgggtcgaatgcgatggaaaagatcgaagataaggggtgtaaatattatttnntannnnnnntttttttttat

SEQ ID NO: 12794 - DNA, 608 bp, Artificial Sequence
  chemically treated genomic DNA (Homo sapiens) CpG-island No: 12794
  misc_feature (12)..(18): n is either a, c, g or t
  misc_feature (21)..(22): n is either a, c, g or t
  misc_feature (118)..(118): n is either a, c, g or t
  misc_feature (131)..(131): n is either a, c, g or t
  misc_feature (272)..(273): n is either a, c, g or t
  misc_feature (281)..(281): n is either a, c, g or t
  misc_feature (306)..(306): n is either a, c, g or t
  misc_feature (320)..(320): n is either a, c, g or t
ataaaaaaaaannnnnnntannaaataatatttacaccccttatcttcgatcttttccatcgcattcgacccgccgaacacgattaatcccgaacaacgacctaaaactattaaaacnaaaaacaataaancgaatcgacgacgacaacgtcaccgccgaaaaaaaaaaaacctaaaataaaaaaaaaaacgaccgccataactttcctcaaactccgtaaccaaataaataaaaaactacaaaacgaaatcgcgccgtcaaaaaaaaaaannaaccaaancgaaccgacgatataaaccgctaanacgcccgctcgacnaaaataattacgaaaaaaacgaaaatcctaccccgaaaacctacgcgaaacgacgaaccgaaatccgcgaacgacccgcctatcaaaactaccgaaacctaaataaaacccacgtaccgacgaaaatctaaccgctacaacaaaaaaaacgaattccacgctcaccgccctcgcgtcgaacgaactaccgaacaatcgcttcctctttcctaccaaataaaactcgaacctaacaaataacttccccgctaccgaacgaaaacgatactaacgaccgtaacccaaaat

SEQ ID NO: 12795 - DNA, 608 bp, Artificial Sequence
  chemically treated genomic DNA (Homo sapiens) CpG-island No: 12795
  misc_feature (12)..(18): n is either a, c, g or t
  misc_feature (21)..(22): n is either a, c, g or t
  misc_feature (118)..(118): n is either a, c, g or t
  misc_feature (131)..(131): n is either a, c, g or t
  misc_feature (272)..(273): n is either a, c, g or t
  misc_feature (281)..(281): n is either a, c, g or t
  misc_feature (306)..(306): n is either a, c, g or t
  misc_feature (320)..(320): n is either a, c, g or t
gtgagagagaannnnnnntgnngaatgatatttgtattttttgttttcggttttttttatcgtattcggttcgtcggatacggttggtttcgggtaacggtttaaggttattggggtngaaaataatgggncgggtcggcggcggtaacgttatcgtcggaggaggagaagtttggagtggggggagaggcgatcgttatggttttttttaaatttcgtgattaggtaggtgaggggttgtagggcgggatcgcgtcgttagggaaggaagnnaattaggncggatcggcggtgtgggtcgttggnacgttcgttcggtnggggtggttgcgagggaaacgggggttttgtttcggggatttgcgcgagacggcgggtcggggttcgcgggcgattcgtttgttagagttgtcggggtttgggtgaagtttacgtgtcgacgggggtttagtcgttgtagtaagaggggcgggttttacgtttatcgttttcgcgtcgggcgagttgtcgggtaatcgtttttttttttttgttaggtgaggttcgggtttaataggtggttttttcgttgtcgggcgggagcggtattggcggtcgtgatttagggt

SEQ ID NO: 12796 - DNA, 608 bp, Artificial Sequence
  chemically treated genomic DNA (Homo sapiens) CpG-island No: 12796
  misc_feature (289)..(289): n is either a, c, g or t
  misc_feature (303)..(303): n is either a, c, g or t
  misc_feature (328)..(328): n is either a, c, g or t
  misc_feature (336)..(337): n is either a, c, g or t
  misc_feature (478)..(478): n is either a, c, g or t
  misc_feature (491)..(491): n is either a, c, g or t
  misc_feature (587)..(588): n is either a, c, g or t
  misc_feature (591)..(597): n is either a, c, g or t
accctaaatcacgaccgccaataccgctcccgcccgacaacgaaaaaaccacctattaaacccgaacctcacctaacaaaaaaaaaaaaacgattacccgacaactcgcccgacgcgaaaacgataaacgtaaaacccgcccctcttactacaacgactaaacccccgtcgacacgtaaacttcacccaaaccccgacaactctaacaaacgaatcgcccgcgaaccccgacccgccgtctcgcgcaaatccccgaaacaaaacccccgtttccctcgcaaccaccccnaccgaacgaacgtnccaacgacccacaccgccgatccgncctaattnncttccttccctaacgacgcgatcccgccctacaacccctcacctacctaatcacgaaatttaaaaaaaaccataacgatcgcctctccccccactccaaacttctcctcctccgacgataacgttaccgccgccgacccgncccattattttcnaccccaataaccttaaaccgttacccgaaaccaaccgtatccgacgaaccgaatacgataaaaaaaaccgaaaacaaaaaatacaaatatcattcnncannnnnnnttctctctcac

SEQ ID NO: 12797 - DNA, 851 bp, Artificial Sequence
  chemically treated genomic DNA (Homo sapiens) CpG-island No: 12797
atgacgaggggatatcgatttcgggtttcgtcgtttcgggtttggtttttttatattagcggaaaagggagttggcgggatttttaaattcgaggttgagtttggggtatatagggaattcggttatgatgtagcgcggtaattgtagttcggtgaaggcgggcgggttgcgttttattttgtatttaatatcgtcgatttgtagtatcgcgtcgttttgttaggtatttacgttgagtacgtttttagttattgttttttttcggtagtatagttttattacgggttcgtagaatatagtcggtttaggtttcggttttgaataggtcgtatcgtcgttagtattcggtcggttttttttgttttttttggcggcggtcgttttagcgtgattttttagggtattggtagcgatgcggttgaggattcgatttagcggttcgttttggtcgcgttgtatgtttttgtggttattattagttaaagcgaatgataggtttagtttgggtttcgaaggtacgtagcgtattatagcgcgttttatcgttttcgtcgttgtttggtttttcgttttagttcggtttagtttttttatcgtcgttcggattattcgaagcgcggcgcgggcgtttgggagtttttatatgaatttggtggtttagcggtcgataagattcgcggtcgattagcggtttattgttaggtggagttgaggagtcgaggtcgtcggttttgatttatttagatttcgcgattttcggttagcgaagagagggaatgaagtgttttcgattcgtattttcgtttagcgcgtgggtacgtatgtttgtaatattttgaagattaatttt

SEQ ID NO: 12798 - DNA, 851 bp, Artificial Sequence
  chemically treated genomic DNA (Homo sapiens) CpG-island No: 12798
aaaattaatcttcaaaatattacaaacatacgtacccacgcgctaaacgaaaatacgaatcgaaaacacttcattccctctcttcgctaaccgaaaatcgcgaaatctaaataaatcaaaaccgacgacctcgactcctcaactccacctaacaataaaccgctaatcgaccgcgaatcttatcgaccgctaaaccaccaaattcatataaaaactcccaaacgcccgcgccgcgcttcgaataatccgaacgacgataaaaaaactaaaccgaactaaaacgaaaaaccaaacaacgacgaaaacgataaaacgcgctataatacgctacgtaccttcgaaacccaaactaaacctatcattcgctttaactaataataaccacaaaaacatacaacgcgaccaaaacgaaccgctaaatcgaatcctcaaccgcatcgctaccaataccctaaaaaatcacgctaaaacgaccgccgccaaaaaaaacaaaaaaaaccgaccgaatactaacgacgatacgacctattcaaaaccgaaacctaaaccgactatattctacgaacccgtaataaaactatactaccgaaaaaaaacaataactaaaaacgtactcaacgtaaatacctaacaaaacgacgcgatactacaaatcgacgatattaaatacaaaataaaacgcaacccgcccgccttcaccgaactacaattaccgcgctacatcataaccgaattccctatataccccaaactcaacctcgaatttaaaaatcccgccaactcccttttccgctaatataaaaaaaccaaacccgaaacgacgaaacccgaaatcgatatcccctcgtcat

SEQ ID NO: 12799 - DNA, 851 bp, Artificial Sequence
  chemically treated genomic DNA (Homo sapiens) CpG-island No: 12799
aaaattaatttttagagtattatagatatgcgtgtttacgcgttaggcgaaagtgcgagtcggaagtattttatttttttttttcgttagtcggaagtcgcgagatttgaatgagttaaagtcggcggtttcggttttttagttttatttgatagtaggtcgttgatcggtcgcgggttttgtcgatcgttaggttattaggtttatgtggaggtttttaggcgttcgcgtcgcgtttcgggtgattcggacggcggtggagaagttgagtcgggttgaagcggggagttagatagcggcgggagcgatggagcgcgttgtagtgcgttgcgtattttcggaatttaagttgagtttgttattcgttttggttgatggtagttataagaatatgtagcgcgattagagcgagtcgttgggtcgagtttttagtcgtatcgttattaatgttttaaagggttacgttaaggcggtcgtcgttaagaagagtaggaagagtcggtcgaatgttagcggcggtgcggtttgtttagggtcggggtttgagtcggttgtgttttgcgagttcgtggtgaagttgtattatcgggaagaggtagtggttgaggacgtgtttaacgtggatgtttggtaagacggcgcggtgttgtagatcggcgatgttaagtataaggtggagcgtaattcgttcgtttttatcgaattgtagttgtcgcgttatattatggtcgggttttttgtgtgttttaaatttagtttcgaatttggggatttcgttagttttttttttcgttggtataaggaagttaagttcggagcggcggagttcgaggtcggtgttttttcgttat

SEQ ID NO: 12800 - DNA, 851 bp, Artificial Sequence
  chemically treated genomic DNA (Homo sapiens) CpG-island No: 12800
ataacgaaaaaacaccgacctcgaactccgccgctccgaacttaacttccttataccaacgaaaaaaaaaactaacgaaatccccaaattcgaaactaaatttaaaacacacaaaaaacccgaccataatataacgcgacaactacaattcgataaaaacgaacgaattacgctccaccttatacttaacatcgccgatctacaacaccgcgccgtcttaccaaacatccacgttaaacacgtcctcaaccactacctcttcccgataatacaacttcaccacgaactcgcaaaacacaaccgactcaaaccccgaccctaaacaaaccgcaccgccgctaacattcgaccgactcttcctactcttcttaacgacgaccgccttaacgtaaccctttaaaacattaataacgatacgactaaaaactcgacccaacgactcgctctaatcgcgctacatattcttataactaccatcaaccaaaacgaataacaaactcaacttaaattccgaaaatacgcaacgcactacaacgcgctccatcgctcccgccgctatctaactccccgcttcaacccgactcaacttctccaccgccgtccgaatcacccgaaacgcgacgcgaacgcctaaaaacctccacataaacctaataacctaacgatcgacaaaacccgcgaccgatcaacgacctactatcaaataaaactaaaaaaccgaaaccgccgactttaactcattcaaatctcgcgacttccgactaacgaaaaaaaaaaataaaatacttccgactcgcactttcgcctaacgcgtaaacacgcatatctataatactctaaaaattaatttt

SEQ ID NO: 12801 - DNA, 582 bp, Artificial Sequence
  chemically treated genomic DNA (Homo sapiens) CpG-island No: 12801
gaagaacgcgatgaggaggtaacgtgtgagcgaggaaaattaagcgtttttgtgggttacggcgtttttgatttttttttcggaattgtagggcgatcggtagtattaagaaggagcgtgttggggcgtttacgtcggttgatttttgcgggggcgacggttggtttttaggcgagggcgcggcgttcgaggatttttatttcggagagttgttttttttgcggtcgtttcggtttttcggttttagagcgttcgtattttcgggagaggcgatgtgggggttcgggttttgtttagttacgtagaaagtagtcggggtcgcggcggcggtagaaaggggacgtttagggtcgtttttcgggagttcgaggggtgttttgcgtgttcgtttagttttcgtcgttcggcgaaggatttcgcggggcggggatttttagtgcgtttgcgcgagcgcggcgggcggaggtagacgttcgcggaggttacgttttttaaggttcggtcgagtttaggaggagtcggagttggttcggggttgtttttattcgttagcgtcggttgtttagtttggtagtggatcgg

SEQ ID NO: 12802 - DNA, 582 bp, Artificial Sequence
  chemically treated genomic DNA (Homo sapiens) CpG-island No: 12802
ccgatccactaccaaactaaacaaccgacgctaacgaataaaaacaaccccgaaccaactccgactcctcctaaactcgaccgaaccttaaaaaacgtaacctccgcgaacgtctacctccgcccgccgcgctcgcgcaaacgcactaaaaatccccgccccgcgaaatccttcgccgaacgacgaaaactaaacgaacacgcaaaacacccctcgaactcccgaaaaacgaccctaaacgtcccctttctaccgccgccgcgaccccgactactttctacgtaactaaacaaaacccgaacccccacatcgcctctcccgaaaatacgaacgctctaaaaccgaaaaaccgaaacgaccgcaaaaaaaacaactctccgaaataaaaatcctcgaacgccgcgccctcgcctaaaaaccaaccgtcgcccccgcaaaaatcaaccgacgtaaacgccccaacacgctccttcttaatactaccgatcgccctacaattccgaaaaaaaaatcaaaaacgccgtaacccacaaaaacgcttaattttcctcgctcacacgttacctcctcatcgcgttcttc

SEQ ID NO: 12803 - DNA, 582 bp, Artificial Sequence
  chemically treated genomic DNA (Homo sapiens) CpG-island No: 12803
tcggtttattgttaggttgggtagtcggcgttggcgggtgggagtagtttcgagttagtttcggttttttttaggttcggtcgagttttaggaggcgtggttttcgcgagcgtttgttttcgttcgtcgcgttcgcgtaggcgtattaggggttttcgtttcgcgaggtttttcgtcgggcggcgggagttagacgagtacgtagggtatttttcgggttttcgggaggcggttttgggcgttttttttttgtcgtcgtcgcggtttcggttgttttttgcgtagttgggtagggttcgggtttttatatcgtttttttcgggaatgcgggcgttttggagtcggggagtcggggcgatcgtagggagggtagtttttcggggtggaggttttcgggcgtcgcgttttcgtttggaaattagtcgtcgttttcgtaggagttagtcggcgtggacgttttagtacgtttttttttggtgttgtcggtcgttttgtaatttcgagaagaaagttagagacgtcgtggtttatagaggcgtttagtttttttcgtttatacgttgtttttttatcgcgtttttt

SEQ ID NO: 12804 - DNA, 582 bp, Artificial Sequence
  chemically treated genomic DNA (Homo sapiens) CpG-island No: 12804
aaaaaacgcgataaaaaaacaacgtataaacgaaaaaaactaaacgcctctataaaccacgacgtctctaactttcttctcgaaattacaaaacgaccgacaacaccaaaaaaaaacgtactaaaacgtccacgccgactaactcctacgaaaacgacgactaatttccaaacgaaaacgcgacgcccgaaaacctccaccccgaaaaactaccctccctacgatcgccccgactccccgactccaaaacgcccgcattcccgaaaaaaacgatataaaaacccgaaccctacccaactacgcaaaaaacaaccgaaaccgcgacgacgacaaaaaaaaaacgcccaaaaccgcctcccgaaaacccgaaaaataccctacgtactcgtctaactcccgccgcccgacgaaaaacctcgcgaaacgaaaacccctaatacgcctacgcgaacgcgacgaacgaaaacaaacgctcgcgaaaaccacgcctcctaaaactcgaccgaacctaaaaaaaaccgaaactaactcgaaactactcccacccgccaacgccgactacccaacctaacaataaaccga

SEQ ID NO: 12805 - DNA, 566 bp, Artificial Sequence
  chemically treated genomic DNA (Homo sapiens) CpG-island No: 12805
ttttaggtcgggagatcggcgtgggtttaaggcggttgttttggggtttcgtcgttattttggacgcgattcggggtgggattttgcgtgggtcgttttagcgtcgcgatcggattttaggaatatagacgtttacgttgatagggtcggtagttgattcgagacgcggtaagcgcgaaggtagttttttcgatttaagtttgaagtttgattaatttatatcgtttttttcggcgtatttagtgcgcggttatttgttaatgtaggcgtcgtttcgtcgtattttttcgcgcgtcgtcgcgttcggcgttcgttcgttgggttcgttttttattttttttcgcgcgtcgttgtcgtgtttattgcgtaagcgcgaggtttcgtattatcgagatttggcggatttcgttgttagagaaatagattgcggtttaagcgtttgagaaaatttaggttggggtcgagagttcgtaatagtggtatttggagttagatttatcgttttttggtgtcgcgttttttaattcgggggggtaggaagttttttgttgtttcgtataattgtg

SEQ ID NO: 12806 - DNA, 566 bp, Artificial Sequence
  chemically treated genomic DNA (Homo sapiens) CpG-island No: 12806
cacaattatacgaaacaacaaaaaacttcctacccccccgaattaaaaaacgcgacaccaaaaaacgataaatctaactccaaataccactattacgaactctcgaccccaacctaaattttctcaaacgcttaaaccgcaatctatttctctaacaacgaaatccgccaaatctcgataatacgaaacctcgcgcttacgcaataaacacgacaacgacgcgcgaaaaaaaataaaaaacgaacccaacgaacgaacgccgaacgcgacgacgcgcgaaaaaatacgacgaaacgacgcctacattaacaaataaccgcgcactaaatacgccgaaaaaaacgatataaattaatcaaacttcaaacttaaatcgaaaaaactaccttcgcgcttaccgcgtctcgaatcaactaccgaccctatcaacgtaaacgtctatattcctaaaatccgatcgcgacgctaaaacgacccacgcaaaatcccaccccgaatcgcgtccaaaataacgacgaaaccccaaaacaaccgccttaaacccacgccgatctcccgacctaaaa

SEQ ID NO: 12807 - DNA, 566 bp, Artificial Sequence
  chemically treated genomic DNA (Homo sapiens) CpG-island No: 12807
tatagttatgcggagtaatagaaagttttttattttttcgggttgaaaggcgcgatattagaaagcggtgggtttggttttaggtgttattgttgcggattttcgattttagtttagatttttttagacgtttgagtcgtaatttgtttttttagtaacggggttcgttaggtttcggtggtgcggggtttcgcgtttgcgtagtgggtacggtagcggcgcgcggaggagggtgaggggcgggtttagcgagcggacgtcgggcgcggcggcgcgcggagaagtgcggcggagcggcgtttgtattagtaggtaatcgcgtattgggtgcgtcggggagggcggtgtgggttagttaggttttaggtttgggtcgaggaggttgttttcgcgtttatcgcgtttcgggttagttatcgattttgttagcgtgagcgtttgtgtttttgaagttcggtcgcgacgttggggcggtttacgtagagttttatttcggatcgcgtttaaggtggcggcgaagttttaggatagtcgttttggatttacgtcgatttttcgatttgaaa

SEQ ID NO: 12808 - DNA, 566 bp, Artificial Sequence
  chemically treated genomic DNA (Homo sapiens) CpG-island No: 12808
tttcaaatcgaaaaatcgacgtaaatccaaaacgactatcctaaaacttcgccgccaccttaaacgcgatccgaaataaaactctacgtaaaccgccccaacgtcgcgaccgaacttcaaaaacacaaacgctcacgctaacaaaatcgataactaacccgaaacgcgataaacgcgaaaacaacctcctcgacccaaacctaaaacctaactaacccacaccgccctccccgacgcacccaatacgcgattacctactaatacaaacgccgctccgccgcacttctccgcgcgccgccgcgcccgacgtccgctcgctaaacccgcccctcaccctcctccgcgcgccgctaccgtacccactacgcaaacgcgaaaccccgcaccaccgaaacctaacgaaccccgttactaaaaaaacaaattacgactcaaacgtctaaaaaaatctaaactaaaatcgaaaatccgcaacaataacacctaaaaccaaacccaccgctttctaatatcgcgcctttcaacccgaaaaaataaaaaactttctattactccgcataactata

SEQ ID NO: 12809 - DNA, 566 bp, Artificial Sequence
  chemically treated genomic DNA (Homo sapiens) CpG-island No: 12809
tgcgcgttgttacgggacgtcggtgttattgcggggaagcgacggtagttatgggggagagggtcgggttcgttgatttcgttcgggggagtaatgggcgtttttcggcgggtaggtttttgtggtaaggaggttaaggtgtcgggggattcggggattcgggtcgggcgcgcgttatttttttcgcgttgtagtagcgagttcgggttcgtttgttggtttgagagcgtattttgtgcggcgcgtcgttttttcgagtgtacgattagtagtatgtcgatagatatagcgttgatgtttttttttagttttatgatgtcgtttttttttcgatttgggcgtcgcggtcgtacgttaggttgtttgcgttgtaaatggtttcgtgcgcgtagttgttttatacgggagagggcgagggcgcggaagagggcgttttttcgtcgttggagtcgtagggcgttgtttttcgttgattttgttaaatacgttattagggttcgtttgggagggcgttattttaatgaagcggttttaagttatttttgaaaggaaattttcgggtttaa

SEQ ID NO: 12810 - DNA, 566 bp, Artificial Sequence
  chemically treated genomic DNA (Homo sapiens) CpG-island No: 12810
ttaaacccgaaaatttcctttcaaaaataacttaaaaccgcttcattaaaataacgccctcccaaacgaaccctaataacgtatttaacaaaatcaacgaaaaacaacgccctacgactccaacgacgaaaaaacgccctcttccgcgccctcgccctctcccgtataaaacaactacgcgcacgaaaccatttacaacgcaaacaacctaacgtacgaccgcgacgcccaaatcgaaaaaaaaacgacatcataaaactaaaaaaaaacatcaacgctatatctatcgacatactactaatcgtacactcgaaaaaacgacgcgccgcacaaaatacgctctcaaaccaacaaacgaacccgaactcgctactacaacgcgaaaaaaataacgcgcgcccgacccgaatccccgaatcccccgacaccttaacctccttaccacaaaaacctacccgccgaaaaacgcccattactcccccgaacgaaatcaacgaacccgaccctctcccccataactaccgtcgcttccccgcaataacaccgacgtcccgtaacaacgcgca

SEQ ID NO: 12811 - DNA, 566 bp, Artificial Sequence
  chemically treated genomic DNA (Homo sapiens) CpG-island No: 12811
ttgggttcggggatttttttttaaaggtgatttagagtcgttttattagggtagcgtttttttaggcgggttttaatggcgtgtttggtagagttagcgaaaagtagcgttttgcggttttagcggcgggggagcgttttttttcgcgttttcgttttttttcgtgtggggtagttgcgcgtacggggttatttgtagcgtaagtagtttagcgtgcggtcgcggcgtttaggtcggaaaggaggcggtattatggagttgaagaaggatattaacgttgtatttatcgatatgttgttgatcgtgtattcggagaagcggcgcgtcgtatagggtacgtttttagattagtaggcgaattcgagttcgttgttgtagcgcggaggaggtaacgcgcgttcgattcgggttttcgggtttttcggtattttggtttttttgttataagggtttgttcgtcggggggcgtttattgttttttcgaacgaggttagcgaattcgatttttttttttatggttgtcgtcgttttttcgtagtggtatcggcgtttcgtggtaacgcgta

SEQ ID NO: 12812 - DNA, 566 bp, Artificial Sequence
  chemically treated genomic DNA (Homo sapiens) CpG-island No: 12812
tacgcgttaccacgaaacgccgataccactacgaaaaaacgacgacaaccataaaaaaaaaaatcgaattcgctaacctcgttcgaaaaaacaataaacgccccccgacgaacaaacccttataacaaaaaaaccaaaataccgaaaaacccgaaaacccgaatcgaacgcgcgttacctcctccgcgctacaacaacgaactcgaattcgcctactaatctaaaaacgtaccctatacgacgcgccgcttctccgaatacacgatcaacaacatatcgataaatacaacgttaatatccttcttcaactccataataccgcctcctttccgacctaaacgccgcgaccgcacgctaaactacttacgctacaaataaccccgtacgcgcaactaccccacacgaaaaaaaacgaaaacgcgaaaaaaaacgctcccccgccgctaaaaccgcaaaacgctacttttcgctaactctaccaaacacgccattaaaacccgcctaaaaaaacgctaccctaataaaacgactctaaatcacctttaaaaaaaaatccccgaacccaa

SEQ ID NO: 12813 - DNA, 590 bp, Artificial Sequence
  chemically treated genomic DNA (Homo sapiens) CpG-island No: 12813
tagtttttataatggttggtagagaacgtcgttcgtgcggtggagttaggtttttggggcgtggattttaattgcggttgttcgtcgaatatcggttaacggtagcggcggcggggcgacgttatttaaagattttgaatttatttattagggtgtaaaagcgatgcgtgaagttgtatcggcgtatttgttcgttagcgtgaaagtgcgtttgggttgggatagcggtgagaagaaatttgaaatcgtcgatgcggtttaataggttggcgttacggagttggtggtgtatgggcggacgaaagagtagggttatcgcgcggagtatattgattggtaggcgattggcgatattcgttagcggttgaatatttcggtgattgttaacggtgaaatttgggattggtagagcgcgtaataatgtatggcgattagcggttgcgacgtagtgatgattggtcgcggggcgtttaatatttttaatttgagtcgggtggtaaaatataacgaatcgcgaatgtcgtggtcggaggtggttgttttgttgtaaaaatatattcgtttggaaaagtagggcgatatcgggttat

SEQ ID NO: 12814 - DNA, 590 bp, Artificial Sequence
  chemically treated genomic DNA (Homo sapiens) CpG-island No: 12814
ataacccgatatcgccctacttttccaaacgaatatatttttacaacaaaacaaccacctccgaccacgacattcgcgattcgttatattttaccacccgactcaaattaaaaatattaaacgccccgcgaccaatcatcactacgtcgcaaccgctaatcgccatacattattacgcgctctaccaatcccaaatttcaccgttaacaatcaccgaaatattcaaccgctaacgaatatcgccaatcgcctaccaatcaatatactccgcgcgataaccctactctttcgtccgcccatacaccaccaactccgtaacgccaacctattaaaccgcatcgacgatttcaaatttcttctcaccgctatcccaacccaaacgcactttcacgctaacgaacaaatacgccgatacaacttcacgcatcgcttttacaccctaataaataaattcaaaatctttaaataacgtcgccccgccgccgctaccgttaaccgatattcgacgaacaaccgcaattaaaatccacgccccaaaaacctaactccaccgcacgaacgacgttctctaccaaccattataaaaacta

SEQ ID NO: 12815 - DNA, 590 bp, Artificial Sequence
  chemically treated genomic DNA (Homo sapiens) CpG-island No: 12815
ataattcggtatcgttttgtttttttagacgggtatatttttgtagtaaagtaattattttcggttacggtattcgcggttcgttatattttattattcggtttaggttgggaatattgagcgtttcgcgattaattattattgcgtcgtagtcgttgatcgttatgtattgttgcgcgttttgttagttttagattttatcgttggtaattatcggaatatttagtcgttggcgaatatcgttaatcgtttgttagttaatatgtttcgcgcggtaattttgttttttcgttcgtttatgtattattagtttcgtagcgttagtttgttgaatcgtatcggcgattttaaatttttttttatcgttgttttagtttagacgtatttttacgttgacgggtaaatgcgtcggtatagttttacgtatcgtttttgtattttggtagatgagtttaggatttttgagtaacgtcgtttcgtcgtcgttatcgttaatcgatattcgacgggtagtcgtaattgagatttacgttttaggaatttaattttatcgtacgggcggcgttttttgttagttattgtgggaattg

SEQ ID NO: 12816 - DNA, 590 bp, Artificial Sequence
  chemically treated genomic DNA (Homo sapiens) CpG-island No: 12816
caattcccacaataactaacaaaaaacgccgcccgtacgataaaattaaattcctaaaacgtaaatctcaattacgactacccgtcgaatatcgattaacgataacgacgacgaaacgacgttactcaaaaatcctaaactcatctaccaaaatacaaaaacgatacgtaaaactataccgacgcatttacccgtcaacgtaaaaatacgtctaaactaaaacaacgataaaaaaaaatttaaaatcgccgatacgattcaacaaactaacgctacgaaactaataatacataaacgaacgaaaaaacaaaattaccgcgcgaaacatattaactaacaaacgattaacgatattcgccaacgactaaatattccgataattaccaacgataaaatctaaaactaacaaaacgcgcaacaatacataacgatcaacgactacgacgcaataataattaatcgcgaaacgctcaatattcccaacctaaaccgaataataaaatataacgaaccgcgaataccgtaaccgaaaataattactttactacaaaaatatacccgtctaaaaaaacaaaacgataccgaattat

SEQ ID NO: 12817 - DNA, 653 bp, Artificial Sequence
  chemically treated genomic DNA (Homo sapiens) CpG-island No: 12817
tggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcggtgatatcgttcgcgttggatgaacgaatcggtggtgtttggggttcggaatcgtgaaaacgttggttgtgcggtggtgaaaagtcgttgttttggtcgttttatgaaggtttttttggggttgcgggattcgggattttggggggggtttggggggtttcgtaattcgggtttttggggttttttttcgggttcgggtgtggttat

SEQ ID NO: 12818 - DNA, 653 bp, Artificial Sequence
  chemically treated genomic DNA (Homo sapiens) CpG-island No: 12818
ataaccacacccgaacccgaaaaaaaaccccaaaaacccgaattacgaaaccccccaaaccccccccaaaatcccgaatcccgcaaccccaaaaaaaccttcataaaacgaccaaaacaacgacttttcaccaccgcacaaccaacgttttcacgattccgaaccccaaacaccaccgattcgttcatccaacgcgaacgatatcaccgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgacccca

SEQ ID NO: 12819 - DNA, 653 bp, Artificial Sequence
  chemically treated genomic DNA (Homo sapiens) CpG-island No: 12819
gtgattatattcgggttcgggaaaaaattttaaaagttcgaattgcggggttttttaggttttttttaaaatttcgggtttcgtaattttaagaaagtttttatggaacggttagaatagcggttttttattatcgtataattaacgtttttacggtttcgaattttaagtattatcggttcgtttatttagcgcggacggtgttatcgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgatttta

SEQ ID NO: 12820 - DNA, 653 bp, Artificial Sequence
  chemically treated genomic DNA (Homo sapiens) CpG-island No: 12820
taaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgataacaccgtccgcgctaaataaacgaaccgataatacttaaaattcgaaaccgtaaaaacgttaattatacgataataaaaaaccgctattctaaccgttccataaaaactttcttaaaattacgaaacccgaaattttaaaaaaaacctaaaaaaccccgcaattcgaacttttaaaattttttcccgaacccgaatataatcac

SEQ ID NO: 12821 - DNA, 1126 bp, Artificial Sequence
  chemically treated genomic DNA (Homo sapiens) CpG-island No: 12821
gtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgacgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgaagattttacggaggaagaagagtatttattggcggatgatacgggtcggcgttggaagagagaatcgggggggttcggaggcggaatcgagaaacggcggttgaggcggagtgaaagtatttgatttgtcggaataaggaaggatttcgggtagggagaatcgaaaaatacggcggcgttggcgggtacggaaaggggaatggcgattattaggagtaaaagtacggaaaacggtatcgtcgtacgtattagggtgggtttaaaattcgtacgtatatttcgcggaagaacgagtcgggttatttataaattaaatataacgcgttttatatacgatatagtaataatatatcgaattttaagtaaatatatcgattcgtaataggtattattacgatagtcgttataagacgagagcgagattataacgtttaacgatgttatatagcgcgttaatataaatagcgtatataacgagggcgtataattatcggattcgtattgagataataataagttcggatttttagtatataagatacgttatatatatagtaggtaagttatacgagtaatcgagtttatcgtacgttacgtcgtagtaagggtcgcgataaaacggcgattaataacgagtacgttatttacgtcgatttgttatacgtaacgcgtattattatt

SEQ ID NO: 12822 - DNA, 1126 bp, Artificial Sequence
  chemically treated genomic DNA (Homo sapiens) CpG-island No: 12822
aataataatacgcgttacgtataacaaatcgacgtaaataacgtactcgttattaatcgccgttttatcgcgacccttactacgacgtaacgtacgataaactcgattactcgtataacttacctactatatatataacgtatcttatatactaaaaatccgaacttattattatctcaatacgaatccgataattatacgccctcgttatatacgctatttatattaacgcgctatataacatcgttaaacgttataatctcgctctcgtcttataacgactatcgtaataatacctattacgaatcgatatatttacttaaaattcgatatattattactatatcgtatataaaacgcgttatatttaatttataaataacccgactcgttcttccgcgaaatatacgtacgaattttaaacccaccctaatacgtacgacgataccgttttccgtacttttactcctaataatcgccattcccctttccgtacccgccaacgccgccgtatttttcgattctccctacccgaaatccttccttattccgacaaatcaaatactttcactccgcctcaaccgccgtttctcgattccgcctccgaacccccccgattctctcttccaacgccgacccgtatcatccgccaataaatactcttcttcctccgtaaaatcttcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgtcgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgac

SEQ ID NO: 12823 - DNA, 1126 bp, Artificial Sequence
  chemically treated genomic DNA (Homo sapiens) CpG-island No: 12823
ggtggtgatgcgcgttgcgtgtggtaagtcggcgtgggtagcgtgttcgttgttggtcgtcgttttgtcgcggtttttgttgcggcgtagcgtgcggtagattcggttgttcgtgtagtttgtttgttgtgtgtgtaacgtgttttgtgtgttgggggttcgagtttgttgttgttttagtgcgagttcgatagttgtgcgttttcgttgtgtacgttgtttgtgttggcgcgttgtgtggtatcgttgggcgttgtggtttcgttttcgttttatggcggttatcgtggtggtgtttgttgcgggtcggtatgtttgtttgggattcgatgtgttgttgttatgtcgtatgtgaggcgcgttgtgtttgatttgtagatggttcggttcgttttttcgcggggtgtacgtgcgggttttgagtttattttggtgcgtgcggcggtgtcgtttttcgtgtttttgtttttgatagtcgttattttttttttcgtgttcgttagcgtcgtcgtatttttcggttttttttgttcgggatttttttttgtttcggtaggttaggtgtttttatttcgttttaatcgtcgtttttcggtttcgttttcgagttttttcggtttttttttttagcgtcggttcgtgttattcgttagtgagtgttttttttttttcgtggagtttttaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgtcggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggt

SEQ ID NO: 12824 - DNA, 1126 bp, Artificial Sequence
  chemically treated genomic DNA (Homo sapiens) CpG-island No: 12824
accgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgacgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaaaaactccacgaaaaaaaaaaaacactcactaacgaataacacgaaccgacgctaaaaaaaaaaaccgaaaaaactcgaaaacgaaaccgaaaaacgacgattaaaacgaaataaaaacacctaacctaccgaaacaaaaaaaaatcccgaacaaaaaaaaccgaaaaatacgacgacgctaacgaacacgaaaaaaaaaataacgactatcaaaaacaaaaacacgaaaaacgacaccgccgcacgcaccaaaataaactcaaaacccgcacgtacaccccgcgaaaaaacgaaccgaaccatctacaaatcaaacacaacgcgcctcacatacgacataacaacaacacatcgaatcccaaacaaacataccgacccgcaacaaacaccaccacgataaccgccataaaacgaaaacgaaaccacaacgcccaacgataccacacaacgcgccaacacaaacaacgtacacaacgaaaacgcacaactatcgaactcgcactaaaacaacaacaaactcgaacccccaacacacaaaacacgttacacacacaacaaacaaactacacgaacaaccgaatctaccgcacgctacgccgcaacaaaaaccgcgacaaaacgacgaccaacaacgaacacgctacccacgccgacttaccacacgcaacgcgcatcaccacc

SEQ ID NO: 12825 - DNA, 510 bp, Artificial Sequence
  chemically treated genomic DNA (Homo sapiens) CpG-island No: 12825
  misc_feature (411)..(411): n is either a, c, g or t
cggtcggtcgttataatacgatcgggaaaggtttttttatcgtggacgtattttaatttgtttttcgcgatcggcgtttttatcgtcgttttcgtagattttgtcgtttttattgcgcgatttttatcgacgatgattttcgtttatcgattcgttgttcgcgatttcgttttttttttacgttgcgagtttttttttttggcgtatcggtatttttttttcgttcgtatttttcgtagcggaggttgatcgatattatatttgtacggcgcgcgtttttcgttcgatttttgttattttcgatcggacgtttttttattacgtttcgagcgtatttcggcgtacgggatttgattttcgtcgtcgtttttcgttagtcgattatgtaagtattttttcgcgatcgggttnggtcgcgtttatatcgattttattttcgcgcggacgtatattagtcgttgatttttttagttttatggagaagatttttgttgtttatttttttataat

SEQ ID NO: 12826 - DNA, 510 bp, Artificial Sequence
  chemically treated genomic DNA (Homo sapiens) CpG-island No: 12826
  misc_feature (100)..(100): n is either a, c, g or t
attataaaaaaataaacaacaaaaatcttctccataaaactaaaaaaatcaacgactaatatacgtccgcgcgaaaataaaatcgatataaacgcgaccnaacccgatcgcgaaaaaatacttacataatcgactaacgaaaaacgacgacgaaaatcaaatcccgtacgccgaaatacgctcgaaacgtaataaaaaaacgtccgatcgaaaataacaaaaatcgaacgaaaaacgcgcgccgtacaaatataatatcgatcaacctccgctacgaaaaatacgaacgaaaaaaaaataccgatacgccaaaaaaaaaaactcgcaacgtaaaaaaaaaacgaaatcgcgaacaacgaatcgataaacgaaaatcatcgtcgataaaaatcgcgcaataaaaacgacaaaatctacgaaaacgacgataaaaacgccgatcgcgaaaaacaaattaaaatacgtccacgataaaaaaacctttcccgatcgtattataacgaccgaccg

SEQ ID NO: 12827 - DNA, 510 bp, Artificial Sequence
  chemically treated genomic DNA (Homo sapiens) CpG-island No: 12827
  misc_feature (100)..(100): n is either a, c, g or t
attgtagggagataagtaataagagttttttttatggggttggaaggattagcggttggtgtacgttcgcgcgggagtggggtcgatatgagcgcggttnagttcggtcgcgagggagtgtttgtatgatcgattaacgaggagcggcggcgggagttaagtttcgtgcgtcggagtgcgttcggggcgtggtggggaggcgttcggtcggaggtggtagagatcgagcgaggagcgcgcgtcgtgtagatgtggtgtcggttagttttcgttacgaggggtacggacggaagggggatgtcgatacgttaggggagagagttcgtagcgtgaaggagaggcggggtcgcgggtaacggatcgataagcggaggttatcgtcggtggggatcgcgtagtggaggcggtagggtttacgggggcgacggtaagggcgtcgatcgcggggggtagattaggatgcgtttacggtaggagagtttttttcggtcgtattgtggcggtcggtcg

SEQ ID NO: 12828 - DNA, 510 bp, Artificial Sequence
  chemically treated genomic DNA (Homo sapiens) CpG-island No: 12828
  misc_feature (411)..(411): n is either a, c, g or t
cgaccgaccgccacaatacgaccgaaaaaaactctcctaccgtaaacgcatcctaatctaccccccgcgatcgacgcccttaccgtcgcccccgtaaaccctaccgcctccactacgcgatccccaccgacgataacctccgcttatcgatccgttacccgcgaccccgcctctccttcacgctacgaactctctcccctaacgtatcgacatcccccttccgtccgtacccctcgtaacgaaaactaaccgacaccacatctacacgacgcgcgctcctcgctcgatctctaccacctccgaccgaacgcctccccaccacgccccgaacgcactccgacgcacgaaacttaactcccgccgccgctcctcgttaatcgatcatacaaacactccctcgcgaccgaactnaaccgcgctcatatcgaccccactcccgcgcgaacgtacaccaaccgctaatccttccaaccccataaaaaaaactcttattacttatctccctacaat

SEQ ID NO: 12829 - DNA, 812 bp, Artificial Sequence
  chemically treated genomic DNA (Homo sapiens) CpG-island No: 12829
cggagaatggagggttcgtagcggcgtagaagaggatggaatcgagacgaagaagttgggatattaatgagggatagtaagtagaaaagaatggggtttttttggggtaggacggggttcgcggtcgggttttttcggtcgtggtcgggtaggggttgaaagtatcgggtacgggaggaggaagcgggcgggcgtcgaggtcgattgttttgtttggggatcgtttgtattcgtagggaggttcgggtaggcgttcgggttttcgggttgtagtatttcgttcgtcgtgttttttcggagtcgaatattagttcgcgttcgagttcgtagcgcggattttcgggggcgttaacgacgtcgttttatttcgggttgaagttttggaagaggttttttaggtttatggcggagaattttatcgcggcgtttttttttttttttttcgtatttcgtgttgtatagtttgcgttttatagcgggtttatggcgttagcgttagtcgcgtttacgttgttgttttcgttattgttgtcgttttcgttgtcgtcgtcgtcgtcgtcgtcgtcgtcgtcgtcgtcgtcgttcggagaaatttgagttatcgttttttgttttttttttcgggttttcgtacgagggtcgcgtatgcgttcggagtttcgtttagagcgtttttcgttgggaggtttttatttttgtgttcgtacgcgatcggcggaggagatggtagggggatggaggttgggagtgagtagggtttcgaggaaggggatgttgacgggttgaaggtttgtagggagggagcgcgtcgt

SEQ ID NO: 12830 - DNA, 812 bp, Artificial Sequence
  chemically treated genomic DNA (Homo sapiens) CpG-island No: 12830
acgacgcgctccctccctacaaaccttcaacccgtcaacatccccttcctcgaaaccctactcactcccaacctccatccccctaccatctcctccgccgatcgcgtacgaacacaaaaataaaaacctcccaacgaaaaacgctctaaacgaaactccgaacgcatacgcgaccctcgtacgaaaacccgaaaaaaaaaacaaaaaacgataactcaaatttctccgaacgacgacgacgacgacgacgacgacgacgacgacgacgacaacgaaaacgacaacaataacgaaaacaacaacgtaaacgcgactaacgctaacgccataaacccgctataaaacgcaaactatacaacacgaaatacgaaaaaaaaaaaaaaaaacgccgcgataaaattctccgccataaacctaaaaaacctcttccaaaacttcaacccgaaataaaacgacgtcgttaacgcccccgaaaatccgcgctacgaactcgaacgcgaactaatattcgactccgaaaaaacacgacgaacgaaatactacaacccgaaaacccgaacgcctacccgaacctccctacgaatacaaacgatccccaaacaaaacaatcgacctcgacgcccgcccgcttcctcctcccgtacccgatactttcaacccctacccgaccacgaccgaaaaaacccgaccgcgaaccccgtcctaccccaaaaaaaccccattcttttctacttactatccctcattaatatcccaacttcttcgtctcgattccatcctcttctacgccgctacgaaccctccattctccg

SEQ ID NO: 12831 - DNA, 812 bp, Artificial Sequence
  chemically treated genomic DNA (Homo sapiens) CpG-island No: 12831
gcggcgcgttttttttttgtaggtttttagttcgttagtattttttttttcggggttttgtttatttttagtttttatttttttgttatttttttcgtcggtcgcgtgcggatataaggatggggattttttagcgaggagcgttttgggcggggtttcggacgtatgcgcggttttcgtacggaagttcggaaggaggggtagggggcggtggtttaggttttttcgggcggcggcggcggcggcggcggcgacggcgacggcgacggtagcggggacggtagtagtagcgggagtagtagcgtggacgcggttggcgttggcgttatgaattcgttgtaaggcgtaggttgtgtagtacggggtgcgggggaggaggaggaggacgtcgcggtgaagtttttcgttatgaatttgaggggttttttttaggattttaattcgaggtgaggcggcgtcgttggcgttttcgggagttcgcgttgcgggttcgggcgcgggttggtgttcggtttcggggaggtacggcgggcgagatgttgtagttcgaggattcgggcgtttgttcgagtttttttgcgggtgtaagcggtttttaggtaaaatagtcggtttcggcgttcgttcgtttttttttttcgtgttcggtgtttttagtttttgttcggttacggtcggaagggttcggtcgcgagtttcgttttgttttaagggaattttatttttttttgtttgttgttttttattggtgttttaattttttcgtttcggttttatttttttttgcgtcgttgcgggttttttatttttcg

SEQ ID NO: 12832 - DNA, 812 bp, Artificial Sequence
  chemically treated genomic DNA (Homo sapiens) CpG-island No: 12832
cgaaaaataaaaaacccgcaacgacgcaaaaaaaaataaaaccgaaacgaaaaaattaaaacaccaataaaaaacaacaaacaaaaaaaaataaaattcccttaaaacaaaacgaaactcgcgaccgaacccttccgaccgtaaccgaacaaaaactaaaaacaccgaacacgaaaaaaaaaaacgaacgaacgccgaaaccgactattttacctaaaaaccgcttacacccgcaaaaaaactcgaacaaacgcccgaatcctcgaactacaacatctcgcccgccgtacctccccgaaaccgaacaccaacccgcgcccgaacccgcaacgcgaactcccgaaaacgccaacgacgccgcctcacctcgaattaaaatcctaaaaaaaacccctcaaattcataacgaaaaacttcaccgcgacgtcctcctcctcctcccccgcaccccgtactacacaacctacgccttacaacgaattcataacgccaacgccaaccgcgtccacgctactactcccgctactactaccgtccccgctaccgtcgccgtcgccgtcgccgccgccgccgccgccgccgcccgaaaaaacctaaaccaccgccccctacccctccttccgaacttccgtacgaaaaccgcgcatacgtccgaaaccccgcccaaaacgctcctcgctaaaaaatccccatccttatatccgcacgcgaccgacgaaaaaaataacaaaaaaataaaaactaaaaataaacaaaaccccgaaaaaaaaaatactaacgaactaaaaacctacaaaaaaaaaacgcgccgc

SEQ ID NO: 12833 - DNA, 618 bp, Artificial Sequence
  chemically treated genomic DNA (Homo sapiens) CpG-island No: 12833
cggggtttttggtttcgtttatttcgcgggggtcggcggggtcggtttgggcgttcgcgtcgtcgttgcgttttgttcgttgggtatattgtttttgggaggggcgggtagatatggtggcgtcgtcgtttttttttcggttttagtatgtcgcggtcgtttcgcggttattcggtttgtcggtttcgagcggtagtttcggggtggcgatggggtcgcgtcgaggtagcggaggttttgcgggcgattggaggttggtagtgggcgggagaaagaggaaggtaggcgcggttgggtttcggtttttggcgtcgcggtattttttgtttcggtagtttgacggtttcgtcgggtttttcggagaggggaacgggcggcgagggtggcgggttttgggcgttttgtgttgcggggtcgagaggcgttcgggtcgcggcgggatcggtcggattagatagggttaatggaagagtttggttagtttcgcgcggggttttcgtagcgatagttttggtcgcggggattggagttttgagggggagaagtttgtcgttttgaaggttcgggatttttgttttaaagatttcgtcgtcgagaattgcgggtgtattgttttag

SEQ ID NO: 12834 - DNA, 618 bp, Artificial Sequence
  chemically treated genomic DNA (Homo sapiens) CpG-island No: 12834
ctaaaacaatacacccgcaattctcgacgacgaaatctttaaaacaaaaatcccgaaccttcaaaacgacaaacttctccccctcaaaactccaatccccgcgaccaaaactatcgctacgaaaaccccgcgcgaaactaaccaaactcttccattaaccctatctaatccgaccgatcccgccgcgacccgaacgcctctcgaccccgcaacacaaaacgcccaaaacccgccaccctcgccgcccgttcccctctccgaaaaacccgacgaaaccgtcaaactaccgaaacaaaaaataccgcgacgccaaaaaccgaaacccaaccgcgcctaccttcctctttctcccgcccactaccaacctccaatcgcccgcaaaacctccgctacctcgacgcgaccccatcgccaccccgaaactaccgctcgaaaccgacaaaccgaataaccgcgaaacgaccgcgacatactaaaaccgaaaaaaaaacgacgacgccaccatatctacccgcccctcccaaaaacaatatacccaacgaacaaaacgcaacgacgacgcgaacgcccaaaccgaccccgccgacccccgcgaaataaacgaaaccaaaaaccccg

SEQ ID NO: 12835 - DNA, 618 bp, Artificial Sequence
  chemically treated genomic DNA (Homo sapiens) CpG-island No: 12835
ttgaggtagtgtattcgtagttttcggcggcgaagtttttggggtagaagtttcgagtttttagaacggtaggttttttttttttaggattttagttttcgcggttaaggttgtcgttgcgggggtttcgcgcgggattggttaggtttttttattaattttgtttggttcggtcgatttcgtcgcgattcgagcgtttttcggtttcgtagtatagggcgtttaggattcgttattttcgtcgttcgttttttttttcggagagttcggcggggtcgttaggttgtcgagataaagggtatcgcggcgttagaggtcgaggtttagtcgcgtttgtttttttttttttttcgtttattgttaatttttagtcgttcgtagaattttcgttgtttcggcgcgattttatcgttatttcggggttgtcgttcgggatcggtaagtcgggtagtcgcgaggcggtcgcggtatgttagggtcgaggagggggcggcggcgttattatgtttgttcgttttttttagaagtagtgtgtttagcggataaagcgtagcggcggcgcgggcgtttaggtcgatttcgtcgattttcgcggaataagcggggttaggagtttcg

SEQ ID NO: 12836 - DNA, 618 bp, Artificial Sequence
  chemically treated genomic DNA (Homo sapiens) CpG-island No: 12836
cgaaactcctaaccccgcttattccgcgaaaatcgacgaaatcgacctaaacgcccgcgccgccgctacgctttatccgctaaacacactacttctaaaaaaaacgaacaaacataataacgccgccgccccctcctcgaccctaacataccgcgaccgcctcgcgactacccgacttaccgatcccgaacgacaaccccgaaataacgataaaatcgcgccgaaacaacgaaaattctacgaacgactaaaaattaacaataaacgaaaaaaaaaaaaaaacaaacgcgactaaacctcgacctctaacgccgcgataccctttatctcgacaacctaacgaccccgccgaactctccgaaaaaaaaaacgaacgacgaaaataacgaatcctaaacgccctatactacgaaaccgaaaaacgctcgaatcgcgacgaaatcgaccgaaccaaacaaaattaataaaaaaacctaaccaatcccgcgcgaaacccccgcaacgacaaccttaaccgcgaaaactaaaatcctaaaaaaaaaaaacctaccgttctaaaaactcgaaacttctaccccaaaaacttcgccgccgaaaactacgaatacactacctcaa

SEQ ID NO: 12837 - DNA, 504 bp, Artificial Sequence
  chemically treated genomic DNA (Homo sapiens) CpG-island No: 12837
gcgttcgtcgatacgttcgagaagcgcgtatcggtgatgagcgatatcgttttgttttacgagatatgttttagcgcggaggtgagttggtaggttttttttatgtcggtgtcggacggttcgtcgtcgattattattatgatatcgttttgtataattttttgtcgtttgatcgttttgatcgtttgcgttttcgagataaatattcgtattcggtcggtgtggtggtatacgttattttcgtttattatcgacgggtcgatcgtcgtggttttgattatcgaaatttttcggcgcgatgttgttcgttcggaagtagatcgtcgatgttagttttttcgttttttgtttttttcggcgggaggattacgttattcggttattatatcgttttgttttcgtaagtatttgcggaagttttttcgggggttatggaattttttattatataaaggttttcgttatttgtttggtagtttagggttttgcgttttaaattcgtag

SEQ ID NO: 12838 - DNA, 504 bp, Artificial Sequence
  chemically treated genomic DNA (Homo sapiens) CpG-island No: 12838
ctacgaatttaaaacgcaaaaccctaaactaccaaacaaataacgaaaacctttatataataaaaaattccataacccccgaaaaaacttccgcaaatacttacgaaaacaaaacgatataataaccgaataacgtaatcctcccgccgaaaaaaacaaaaaacgaaaaaactaacatcgacgatctacttccgaacgaacaacatcgcgccgaaaaatttcgataatcaaaaccacgacgatcgacccgtcgataataaacgaaaataacgtataccaccacaccgaccgaatacgaatatttatctcgaaaacgcaaacgatcaaaacgatcaaacgacaaaaaattatacaaaacgatatcataataataatcgacgacgaaccgtccgacaccgacataaaaaaaacctaccaactcacctccgcgctaaaacatatctcgtaaaacaaaacgatatcgctcatcaccgatacgcgcttctcgaacgtatcgacgaacgc

SEQ ID NO: 12839 - DNA, 504 bp, Artificial Sequence
  chemically treated genomic DNA (Homo sapiens) CpG-island No: 12839
ttacggatttggaacgtaagattttggattgttaaataggtggcgaaaatttttatatggtggaaggttttatagttttcgggggggttttcgtaagtgtttgcgaaagtaagacggtgtaatagtcgaatgacgtgattttttcgtcggagaaggtaaaaagcgaaagggttgatatcgacggtttgttttcggacgagtaatatcgcgtcgaaaggtttcggtgattaaggttacggcgatcgattcgtcggtggtgggcgaagatggcgtatattattatatcggtcgggtgcgggtgtttgtttcggaagcgtaggcgattaaggcgattaagcggtaagagattgtgtagggcgatattatggtggtgatcggcggcgggtcgttcggtatcggtatggaagagatttattagtttattttcgcgttaaagtatatttcgtggggtaagacggtgtcgtttattatcgatgcgcgtttttcgggcgtgtcgacgggcgt

SEQ ID NO: 12840 - DNA, 504 bp, Artificial Sequence
  chemically treated genomic DNA (Homo sapiens) CpG-island No: 12840
acgcccgtcgacacgcccgaaaaacgcgcatcgataataaacgacaccgtcttaccccacgaaatatactttaacgcgaaaataaactaataaatctcttccataccgataccgaacgacccgccgccgatcaccaccataatatcgccctacacaatctcttaccgcttaatcgccttaatcgcctacgcttccgaaacaaacacccgcacccgaccgatataataatatacgccatcttcgcccaccaccgacgaatcgatcgccgtaaccttaatcaccgaaacctttcgacgcgatattactcgtccgaaaacaaaccgtcgatatcaaccctttcgctttttaccttctccgacgaaaaaatcacgtcattcgactattacaccgtcttactttcgcaaacacttacgaaaacccccccgaaaactataaaaccttccaccatataaaaattttcgccacctatttaacaatccaaaatcttacgttccaaatccgtaa

SEQ ID NO: 12841 - DNA, 622 bp, Artificial Sequence
  chemically treated genomic DNA (Homo sapiens) CpG-island No: 12841
  misc_feature (268)..(268): n is either a, c, g or t
ttcgttttcgatagcgacgtaagtatatttattattcgaagcgtttttggttttcgattttaagtttttttatatatgtatgttttttaacggtatttacgtattttatttatggttagtttttttttttaatttgtacgttttttatatatattgttgtcgggttatattttttttattttttttttacggttttttatttttacgtaatggtattttttcgttacggtatgttagcgttttttttttttatgtgtcgtttattttnatttttttttattttatgttcgattttatttttttttttattcgtagggtttagttaattatacgttgagtttttttttttttttagtttcgttttggttttttcgtaaacgttacgtttttttttttttttttggttttagagtcgtcgttacgttttagcgatatgttttcgcgatagcgcgatttttattggttaaggttattgcgtatatttttttttttggtttttgtttttatttgttacgttttacgtgatatcgtttcgtttttattggtttttttttattcgttttatttttgtcggaaatgaaatagagggacgagagagggggatggaggagagaaggagaga

SEQ ID NO: 12842 - DNA, 622 bp, Artificial Sequence
  chemically treated genomic DNA (Homo sapiens) CpG-island No: 12842
  misc_feature (355)..(355): n is either a, c, g or t
tctctccttctctcctccatccccctctctcgtccctctatttcatttccgacaaaaataaaacgaataaaaaaaaaccaataaaaacgaaacgatatcacgtaaaacgtaacaaataaaaacaaaaaccaaaaaaaaaaatatacgcaataaccttaaccaataaaaatcgcgctatcgcgaaaacatatcgctaaaacgtaacgacgactctaaaaccaaaaaaaaaaaaaaaaacgtaacgtttacgaaaaaaccaaaacgaaactaaaaaaaaaaaaaaactcaacgtataattaactaaaccctacgaataaaaaaaaaaataaaatcgaacataaaataaaaaaaaatnaaaataaacgacacataaaaaaaaaaaacgctaacataccgtaacgaaaaaataccattacgtaaaaataaaaaaccgtaaaaaaaaaataaaaaaaatataacccgacaacaatatatataaaaaacgtacaaattaaaaaaaaaaactaaccataaataaaatacgtaaataccgttaaaaaacatacatatataaaaaaacttaaaatcgaaaaccaaaaacgcttcgaataataaatatacttacgtcgctatcgaaaacgaa

SEQ ID NO: 12843 - DNA, 622 bp, Artificial Sequence
  chemically treated genomic DNA (Homo sapiens) CpG-island No: 12843
  misc_feature (355)..(355): n is either a, c, g or t
ttttttttttttttttttatttttttttttcgtttttttattttattttcggtaagagtgagacgaatggggggggattagtgagagcgaggcgatattacgtgagacgtaatagatagaggtaaaggttaagagagggagtatacgtaatggttttggttagtaggaatcgcgttatcgcgggagtatgtcgttgaggcgtgacgacgattttaagattaagaggggagagggaggcgtaacgtttgcgaggagattaaggcggaattgggggagagggggagtttagcgtgtagttagttgaattttgcgggtaggaagagaggtaaaatcgagtatggggtagaggaaggtngggataaacgatatatagaagggggggacgttagtatatcgtgacgggggggtattattgcgtaagggtaggaggtcgtaaggaaagaataggggaggtgtggttcgataatagtgtgtgtgaggggcgtgtaaattaggagaggagattgattataggtgggatacgtgggtatcgttagggaatatgtatatgtggggggatttggggtcgggagttaagggcgtttcgggtgatgagtatgtttgcgtcgttgtcggggacggg

SEQ ID NO: 12844 - DNA, 622 bp, Artificial Sequence
  chemically treated genomic DNA (Homo sapiens) CpG-island No: 12844
  misc_feature (268)..(268): n is either a, c, g or t
cccgtccccgacaacgacgcaaacatactcatcacccgaaacgcccttaactcccgaccccaaatccccccacatatacatattccctaacgatacccacgtatcccacctataatcaatctcctctcctaatttacacgcccctcacacacactattatcgaaccacacctcccctattctttccttacgacctcctacccttacgcaataatacccccccgtcacgatatactaacgtcccccccttctatatatcgtttatcccnaccttcctctaccccatactcgattttacctctcttcctacccgcaaaattcaactaactacacgctaaactccccctctcccccaattccgccttaatctcctcgcaaacgttacgcctccctctcccctcttaatcttaaaatcgtcgtcacgcctcaacgacatactcccgcgataacgcgattcctactaaccaaaaccattacgtatactccctctcttaacctttacctctatctattacgtctcacgtaatatcgcctcgctctcactaatccccccccattcgtctcactcttaccgaaaataaaataaaaaaacgaaaaaaaaaaataaaaaaaaaaaaaaaaaa

SEQ ID NO: 12845 - DNA, 610 bp, Artificial Sequence
  chemically treated genomic DNA (Homo sapiens) CpG-island No: 12845
gcgtgtgagtgttgcgtggcgcggtttggtcgtatggttaagcgtgtgagtgttgtgtggcgcggtttggtcgtatggttaagcgtgtgagtgttgcgtggcgcggtttggtcgtatggttaagcgtgtgagtgttgcgtggtttggtttggtcgtatggttaagcgtgttagtgttgcgtggtttggtttggtcgtatggttaagcgtgtgagtgttgtgtggcgtagtttggtcgtatggttaaacgtgtgagtgttgcgtggtttggtttggtcgtatggtttagcgtgttagtgttgcgtggtttggtttggtcgtatggttaagcgtgtgagtgttgtgtggcgtagtttggtcgtatggttaagcgtgtgagtgttgcgtggtttggtttggtcgtatggttaagcgtgttagcgttgcgtggcgcggtttggtcgtatgattaagcgtgtgagtgttgcgtggcgtggtttggtcgtatggttaagtgtgtgagtgttgtgtggcgcggtttggtcgcgtgttaggtatgtgagtgggttttatatgtgtacgttttttttgtgtttcggaatgaggttaggtttttttcgttttttttttag

SEQ ID NO: 12846 - DNA, 610 bp, Artificial Sequence
  chemically treated genomic DNA (Homo sapiens) CpG-island No: 12846
ctaaaaaaaaaacgaaaaaaacctaacctcattccgaaacacaaaaaaaacgtacacatataaaacccactcacatacctaacacgcgaccaaaccgcgccacacaacactcacacacttaaccatacgaccaaaccacgccacgcaacactcacacgcttaatcatacgaccaaaccgcgccacgcaacgctaacacgcttaaccatacgaccaaaccaaaccacgcaacactcacacgcttaaccatacgaccaaactacgccacacaacactcacacgcttaaccatacgaccaaaccaaaccacgcaacactaacacgctaaaccatacgaccaaaccaaaccacgcaacactcacacgtttaaccatacgaccaaactacgccacacaacactcacacgcttaaccatacgaccaaaccaaaccacgcaacactaacacgcttaaccatacgaccaaaccaaaccacgcaacactcacacgcttaaccatacgaccaaaccgcgccacgcaacactcacacgcttaaccatacgaccaaaccgcgccacacaacactcacacgcttaaccatacgaccaaaccgcgccacgcaacactcacacgc

SEQ ID NO: 12847 - DNA, 610 bp, Artificial Sequence
  chemically treated genomic DNA (Homo sapiens) CpG-island No: 12847
ttagagggaggacggaggagatttggttttatttcgggatataaggaggacgtgtatatgtggagtttatttatatgtttaatacgcgattaggtcgcgttatatagtatttatatatttaattatgcgattaggttacgttacgtagtatttatacgtttaattatgcgattaggtcgcgttacgtagcgttaatacgtttaattatgcgattaggttaggttacgtagtatttatacgtttaattatgcgattaggttgcgttatatagtatttatacgtttaattatgcgattaggttaggttacgtagtattaatacgttaaattatgcgattaggttaggttacgtagtatttatacgtttaattatgcgattaggttgcgttatatagtatttatacgtttaattatgcgattaggttaggttacgtagtattaatacgtttaattatgcgattaggttaggttacgtagtatttatacgtttaattatgcgattaggtcgcgttacgtagtatttatacgtttaattatgcgattaggtcgcgttatatagtatttatacgtttaattatgcgattaggtcgcgttacgtagtatttatacgt

SEQ ID NO: 12848 - DNA, 610 bp, Artificial Sequence
  chemically treated genomic DNA (Homo sapiens) CpG-island No: 12848
acgtataaatactacgtaacgcgacctaatcgcataattaaacgtataaatactatataacgcgacctaatcgcataattaaacgtataaatactacgtaacgcgacctaatcgcataattaaacgtataaatactacgtaacctaacctaatcgcataattaaacgtattaatactacgtaacctaacctaatcgcataattaaacgtataaatactatataacgcaacctaatcgcataattaaacgtataaatactacgtaacctaacctaatcgcataatttaacgtattaatactacgtaacctaacctaatcgcataattaaacgtataaatactatataacgcaacctaatcgcataattaaacgtataaatactacgtaacctaacctaatcgcataattaaacgtattaacgctacgtaacgcgacctaatcgcataattaaacgtataaatactacgtaacgtaacctaatcgcataattaaatatataaatactatataacgcgacctaatcgcgtattaaacatataaataaactccacatatacacgtcctccttatatcccgaaataaaaccaaatctcctccgtcctccctctaa

SEQ ID NO: 12849 - DNA, 530 bp, Artificial Sequence
  chemically treated genomic DNA (Homo sapiens) CpG-island No: 12849
taggtcgaattttttttggaagtcgtgtacggtggtcgattggggttttaggtttcggcgtaggcgggcgttataggttataatgcggtcgtaggcgtagtttgagttgtttatcgtggtgtcggcgttgttagggatgagttatttgaagattttattgttttttagacggatggcggtttagttttgcgttcgtatatagttgtagtcggcgttgaagtcgtttaggaatagtatgttttgcgggcgtcgcggagtcgcgtttgagtcgtcgtaggagtcgtcgaggtttcgtttttatgaattagattttcggggcgcgtttgtagggatttcgggatcgaggggtgggtttacgtcggtgttttatttgtcgattacgtttaggtatacgtcgtagagcgcgtcgattttcgttacggtttgatgcggcgtcgcgtgtagcgggattagtattaggttttgtgttgttgcgggaaggggtgggggcgttagagttcggcgggaggggagggtttttttttattttt

SEQ ID NO: 12850 - DNA, 530 bp, Artificial Sequence
  chemically treated genomic DNA (Homo sapiens) CpG-island No: 12850
aaaaataaaaaaaaaccctcccctcccgccgaactctaacgcccccaccccttcccgcaacaacacaaaacctaatactaatcccgctacacgcgacgccgcatcaaaccgtaacgaaaatcgacgcgctctacgacgtatacctaaacgtaatcgacaaataaaacaccgacgtaaacccacccctcgatcccgaaatccctacaaacgcgccccgaaaatctaattcataaaaacgaaacctcgacgactcctacgacgactcaaacgcgactccgcgacgcccgcaaaacatactattcctaaacgacttcaacgccgactacaactatatacgaacgcaaaactaaaccgccatccgtctaaaaaacaataaaatcttcaaataactcatccctaacaacgccgacaccacgataaacaactcaaactacgcctacgaccgcattataacctataacgcccgcctacgccgaaacctaaaaccccaatcgaccaccgtacacgacttccaaaaaaaattcgaccta

SEQ ID NO: 12851 - DNA, 530 bp, Artificial Sequence
  chemically treated genomic DNA (Homo sapiens) CpG-island No: 12851
aagagtggggaggagtttttttttttcgtcgagttttgacgtttttattttttttcgtagtagtatagaatttggtgttgatttcgttgtacgcggcgtcgtattaagtcgtggcggagatcgacgcgttttacgacgtgtatttggacgtgatcgataagtggggtatcgacgtaagtttatttttcggtttcggggtttttgtaggcgcgtttcgggggtttggtttatgagggcgggatttcgacggtttttgcggcggtttagacgcggtttcgcggcgttcgtaggatatgttgtttttgggcgattttaacgtcgattgtagttatgtgcgggcgtaggattgggtcgttattcgtttgaggagtagtgaggtttttaagtggtttatttttgatagcgtcgatattacggtgggtaatttagattgcgtttacgatcgtattgtggtttgtggcgttcgtttgcgtcggagtttgaagttttagtcggttatcgtgtacgatttttaggaggaattcggtttg

SEQ ID NO: 12852 - DNA, 530 bp, Artificial Sequence
  chemically treated genomic DNA (Homo sapiens) CpG-island No: 12852
caaaccgaattcctcctaaaaatcgtacacgataaccgactaaaacttcaaactccgacgcaaacgaacgccacaaaccacaatacgatcgtaaacgcaatctaaattacccaccgtaatatcgacgctatcaaaaataaaccacttaaaaacctcactactcctcaaacgaataacgacccaatcctacgcccgcacataactacaatcgacgttaaaatcgcccaaaaacaacatatcctacgaacgccgcgaaaccgcgtctaaaccgccgcaaaaaccgtcgaaatcccgccctcataaaccaaacccccgaaacgcgcctacaaaaaccccgaaaccgaaaaataaacttacgtcgataccccacttatcgatcacgtccaaatacacgtcgtaaaacgcgtcgatctccgccacgacttaatacgacgccgcgtacaacgaaatcaacaccaaattctatactactacgaaaaaaaataaaaacgtcaaaactcgacgaaaaaaaaaaactcctccccactctt

SEQ ID NO: 12853 - DNA, 619 bp, Artificial Sequence
  chemically treated genomic DNA (Homo sapiens) CpG-island No: 12853
tttcgcgtcgtattggtcgttaaggggcggtcgcggagggaaggggtgggtcggtgggtttgatagcgggtttgcgtaggcggtagcgtttgttttttttagtttttcgtttcgcgttatgggcgggtttcgggttttgttggtcgtattttgggcgttggaagtcgtcgggatcgtcgcgtttcgtatcggagtttttaatatttagagtttcggtgatagtaaagtgtcggatttcgtttgcggtagtattatcgcgaaggtggggttcgggtcggggcggggcggcgtttaggggtgttgatcgcgttgattttcgtattcgtcgtttttttttagattttggttggttatgatttcgcgttggtgtaggaggtgcgagatttagattttagcgtcgtgttcgcgtttatggagtagattaataggtgtggtgggtagggtttttcgtcgcgatttttcgtcgggatttcgtttcggcgcggcgtttcgattttgagcgggtttttgttttcgtagcgtgttcgagtacgagtatagttttgtgagtagttagtttttgggtcgggattagtataaggagatgtatttgttcgtgtataggtgaggggcgggtcgt

SEQ ID NO: 12854 - DNA, 619 bp, Artificial Sequence
  chemically treated genomic DNA (Homo sapiens) CpG-island No: 12854
acgacccgcccctcacctatacacgaacaaatacatctccttatactaatcccgacccaaaaactaactactcacaaaactatactcgtactcgaacacgctacgaaaacaaaaacccgctcaaaatcgaaacgccgcgccgaaacgaaatcccgacgaaaaatcgcgacgaaaaaccctacccaccacacctattaatctactccataaacgcgaacacgacgctaaaatctaaatctcgcacctcctacaccaacgcgaaatcataaccaaccaaaatctaaaaaaaaacgacgaatacgaaaatcaacgcgatcaacacccctaaacgccgccccgccccgacccgaaccccaccttcgcgataatactaccgcaaacgaaatccgacactttactatcaccgaaactctaaatattaaaaactccgatacgaaacgcgacgatcccgacgacttccaacgcccaaaatacgaccaacaaaacccgaaacccgcccataacgcgaaacgaaaaactaaaaaaaacaaacgctaccgcctacgcaaacccgctatcaaacccaccgacccaccccttccctccgcgaccgccccttaacgaccaatacgacgcgaaa

SEQ ID NO: 12855 - DNA, 619 bp, Artificial Sequence
  chemically treated genomic DNA (Homo sapiens) CpG-island No: 12855
gcggttcgttttttatttgtatacgaataggtatatttttttgtattggtttcggtttaggggttggttgtttataaagttgtattcgtgttcggatacgttgcggagataggggttcgtttagggtcggggcgtcgcgtcggggcgagatttcggcggggggtcgcgacgaggggttttgtttattatatttgttgatttgttttatgagcgcggatacggcgttgaggtttgggtttcgtattttttgtattagcgcgaggttatagttagttaggatttggggaggagcggcgggtgcgggggttagcgcggttagtatttttaaacgtcgtttcgtttcggttcgggttttattttcgcgatgatgttgtcgtaagcggggttcgatattttgttgttatcgaagttttgaatgttgaaggtttcgatgcgaagcgcggcggtttcggcggtttttagcgtttagagtgcggttagtagagttcggggttcgtttatggcgcggagcgagaggttgggagggatagacgttgtcgtttacgtagattcgttgttagatttatcgatttatttttttttttcgcggtcgttttttgacggttagtgcgacgcggaa

SEQ ID NO: 12856 - DNA, 619 bp, Artificial Sequence
  chemically treated genomic DNA (Homo sapiens) CpG-island No: 12856
ttccgcgtcgcactaaccgtcaaaaaacgaccgcgaaaaaaaaaaataaatcgataaatctaacaacgaatctacgtaaacgacaacgtctatccctcccaacctctcgctccgcgccataaacgaaccccgaactctactaaccgcactctaaacgctaaaaaccgccgaaaccgccgcgcttcgcatcgaaaccttcaacattcaaaacttcgataacaacaaaatatcgaaccccgcttacgacaacatcatcgcgaaaataaaacccgaaccgaaacgaaacgacgtttaaaaatactaaccgcgctaacccccgcacccgccgctcctccccaaatcctaactaactataacctcgcgctaatacaaaaaatacgaaacccaaacctcaacgccgtatccgcgctcataaaacaaatcaacaaatataataaacaaaacccctcgtcgcgaccccccgccgaaatctcgccccgacgcgacgccccgaccctaaacgaacccctatctccgcaacgtatccgaacacgaatacaactttataaacaaccaacccctaaaccgaaaccaatacaaaaaaatatacctattcgtatacaaataaaaaacgaaccgc

SEQ ID NO: 12857 - DNA, 659 bp, Artificial Sequence
  chemically treated genomic DNA (Homo sapiens) CpG-island No: 12857
tttcgtcgtcgagtcgttgcggggcgcggggtaaggggcgtgagtgggcggggcgggtttggttatatttatttcgattagtatacgtttacgtttcgtattttcgtcggttttcgtttatcgtacgacgatttcgggggagtttcgtttacggtacgtttatttttgtcgagtttcgtttatttttgtcgagtttcgtttatttttgtcgagtttcgtttatttttgtcgagtttcgtttttcgttcgttaagtttcgtttcgtatttatcgcgggttttgcgcgtttttttgtcggattttgtattgtatcgtttgtagcgtcgttgttaggtatacgtttgtttattttaatttttgttcggcgttgttttttggcgaagcgttttcggtttggggcgggggcgtagttgtaggaggtaggtgtagtcggcgtagttttcggaggttttggtggtatcgtttagttgcggggcgtttttgggggaatggtggtttggcgggtgtttgcgtttatataaaggggtggggtaacgggttgatttggttaagggttgatggcgggtttgttttcgtcggtttaagggtgtcgtgttaaagggattcgtatttgttttaatagtaatttttttaaatcgtatttatagggtttatgtttt

SEQ ID NO: 12858 - DNA, 659 bp, Artificial Sequence
  chemically treated genomic DNA (Homo sapiens) CpG-island No: 12858
aaaacataaaccctataaatacgatttaaaaaaattactattaaaacaaatacgaatccctttaacacgacacccttaaaccgacgaaaacaaacccgccatcaacccttaaccaaatcaacccgttaccccacccctttatataaacgcaaacacccgccaaaccaccattcccccaaaaacgccccgcaactaaacgataccaccaaaacctccgaaaactacgccgactacacctacctcctacaactacgcccccgccccaaaccgaaaacgcttcgccaaaaaacaacgccgaacaaaaattaaaataaacaaacgtatacctaacaacgacgctacaaacgatacaatacaaaatccgacaaaaaaacgcgcaaaacccgcgataaatacgaaacgaaacttaacgaacgaaaaacgaaactcgacaaaaataaacgaaactcgacaaaaataaacgaaactcgacaaaaataaacgaaactcgacaaaaataaacgtaccgtaaacgaaactcccccgaaatcgtcgtacgataaacgaaaaccgacgaaaatacgaaacgtaaacgtatactaatcgaaataaatataaccaaacccgccccgcccactcacgccccttaccccgcgccccgcaacgactcgacgacgaaa

SEQ ID NO: 12859 - DNA, 659 bp, Artificial Sequence
  chemically treated genomic DNA (Homo sapiens) CpG-island No: 12859
gagatatagattttgtaaatgcgatttaggggaattgttattgagataagtgcgggtttttttaatacgatatttttaggtcggcgagaataagttcgttattagtttttgattaagttagttcgttattttatttttttatatgggcgtaagtattcgttaagttattatttttttaggagcgtttcgtagttgaacggtgttattaaagttttcgggagttacgtcgattgtatttattttttgtagttgcgttttcgttttaggtcgaaggcgtttcgttagggaatagcgtcgggtagaaattggagtagataagcgtgtgtttggtagcggcgttataggcggtgtagtataagattcgataggagaacgcgtagggttcgcggtaggtgcggggcggggtttggcgggcggagggcggggttcggtagagatgggcggggttcggtagagatgggcggggttcggtagagatgggcggggttcggtagagatgggcgtgtcgtgagcggggttttttcgaggtcgtcgtgcggtaggcggaagtcgacggagatgcgggacgtgggcgtgtattggtcggggtgggtgtggttagattcgtttcgtttatttacgttttttgtttcgcgtttcgtagcgattcggcggcggaa

SEQ ID NO: 12860 - DNA, 659 bp, Artificial Sequence
  chemically treated genomic DNA (Homo sapiens) CpG-island No: 12860
ttccgccgccgaatcgctacgaaacgcgaaacaaaaaacgtaaataaacgaaacgaatctaaccacacccaccccgaccaatacacgcccacgtcccgcatctccgtcgacttccgcctaccgcacgacgacctcgaaaaaaccccgctcacgacacgcccatctctaccgaaccccgcccatctctaccgaaccccgcccatctctaccgaaccccgcccatctctaccgaaccccgccctccgcccgccaaaccccgccccgcacctaccgcgaaccctacgcgttctcctatcgaatcttatactacaccgcctataacgccgctaccaaacacacgcttatctactccaatttctacccgacgctattccctaacgaaacgccttcgacctaaaacgaaaacgcaactacaaaaaataaatacaatcgacgtaactcccgaaaactttaataacaccgttcaactacgaaacgctcctaaaaaaataataacttaacgaatacttacgcccatataaaaaaataaaataacgaactaacttaatcaaaaactaataacgaacttattctcgccgacctaaaaatatcgtattaaaaaaacccgcacttatctcaataacaattcccctaaatcgcatttacaaaatctatatctc

SEQ ID NO: 12861 - DNA, 748 bp, Artificial Sequence
  chemically treated genomic DNA (Homo sapiens) CpG-island No: 12861
gggtttcgcgagattcgcgaggtgtttgggtttgggagggtcggtcgagttcgtagttcgggttattcgggtttttgttagttcgggatgaattgttcgtatttcggtcgtatttttcgggtcggttcggttatttttttcgttgaagggcgtcgggaggtcgaggaagtcgttgggggttaaggtcgtcgttatcgtcgtaattgtattttcgttcgtttttcgttcggtttcggtttgggtttttgtcgtatgagcggtcgttattcgtattgttatcgcgttttttatgtcgtaacgcgtcgtaggaagatggcggatttacgattatgtcgttataataacgggtcgcgtcgaggttagcgtgagggaacggtaagaggagggcggggtagaatcggagcggattgacggataggcggggagtcgggtttggatagcggtgtggttttaaagggtagaggcggggtcgggcgcgttgagagcgaagatggggcgggattgtggggagggcgtggttacggtggagtagattgttagttagggggcggggcggtagaaggatttatgttcgaggttgtattcggatttgagagttagagaacgcgaggggcgagcggattggcggttgttaggtagtcgcgttttagcgttttcgtatttaaggataggtcgtttcgttcgcggttgttgttgggaagtcgttatagttttaattaggggtgtggtgtttgttgtttattgatcg

SEQ ID NO: 12862 - DNA, 748 bp, Artificial Sequence
  chemically treated genomic DNA (Homo sapiens) CpG-island No: 12862
cgatcaataaacaacaaacaccacacccctaattaaaactataacgacttcccaacaacaaccgcgaacgaaacgacctatccttaaatacgaaaacgctaaaacgcgactacctaacaaccgccaatccgctcgcccctcgcgttctctaactctcaaatccgaatacaacctcgaacataaatccttctaccgccccgccccctaactaacaatctactccaccgtaaccacgccctccccacaatcccgccccatcttcgctctcaacgcgcccgaccccgcctctaccctttaaaaccacaccgctatccaaacccgactccccgcctatccgtcaatccgctccgattctaccccgccctcctcttaccgttccctcacgctaacctcgacgcgacccgttattataacgacataatcgtaaatccgccatcttcctacgacgcgttacgacataaaaaacgcgataacaatacgaataacgaccgctcatacgacaaaaacccaaaccgaaaccgaacgaaaaacgaacgaaaatacaattacgacgataacgacgaccttaacccccaacgacttcctcgacctcccgacgcccttcaacgaaaaaaataaccgaaccgacccgaaaaatacgaccgaaatacgaacaattcatcccgaactaacaaaaacccgaataacccgaactacgaactcgaccgaccctcccaaacccaaacacctcgcgaatctcgcgaaaccc

SEQ ID NO: 12863 - DNA, 748 bp, Artificial Sequence
  chemically treated genomic DNA (Homo sapiens) CpG-island No: 12863
cggttagtgggtagtaggtattatatttttggttggagttgtggcggttttttagtagtagtcgcgggcggggcgatttgtttttaggtacggaagcgttggggcgcggttgtttagtagtcgttagttcgttcgtttttcgcgttttttggtttttaaattcgagtgtagtttcgaatataggtttttttgtcgtttcgttttttggttggtaatttgttttatcgtaattacgttttttttatagtttcgttttattttcgtttttagcgcgttcggtttcgtttttgttttttaaggttatatcgttatttaggttcggtttttcgtttgttcgttaattcgtttcggttttgtttcgttttttttttgtcgtttttttacgttggtttcggcgcggttcgttgttatgacgatatggtcgtaaattcgttatttttttgcggcgcgttgcgatatggagggcgcgatggtagtgcgggtgacggtcgtttatacggtagaagtttaggtcgaagtcgggcgggaagcgggcgagggtgtagttgcggcggtggcggcggttttggtttttagcggttttttcggtttttcggcgttttttagcgaggaaggtaatcgggtcgattcggagggtgcggtcggggtgcgggtagtttatttcgggttggtagaggttcggatggttcgagttgcgggttcgatcgatttttttagatttagatatttcgcggatttcgcgggattt

SEQ ID NO: 12864 - DNA, 748 bp, Artificial Sequence
  chemically treated genomic DNA (Homo sapiens) CpG-island No: 12864
aaatcccgcgaaatccgcgaaatatctaaatctaaaaaaatcgatcgaacccgcaactcgaaccatccgaacctctaccaacccgaaataaactacccgcaccccgaccgcaccctccgaatcgacccgattaccttcctcgctaaaaaacgccgaaaaaccgaaaaaaccgctaaaaaccaaaaccgccgccaccgccgcaactacaccctcgcccgcttcccgcccgacttcgacctaaacttctaccgtataaacgaccgtcacccgcactaccatcgcgccctccatatcgcaacgcgccgcaaaaaaataacgaatttacgaccatatcgtcataacaacgaaccgcgccgaaaccaacgtaaaaaaacgacaaaaaaaaaacgaaacaaaaccgaaacgaattaacgaacaaacgaaaaaccgaacctaaataacgatataaccttaaaaaacaaaaacgaaaccgaacgcgctaaaaacgaaaataaaacgaaactataaaaaaaacgtaattacgataaaacaaattaccaaccaaaaaacgaaacgacaaaaaaacctatattcgaaactacactcgaatttaaaaaccaaaaaacgcgaaaaacgaacgaactaacgactactaaacaaccgcgccccaacgcttccgtacctaaaaacaaatcgccccgcccgcgactactactaaaaaaccgccacaactccaaccaaaaatataatacctactacccactaaccg

SEQ ID NO: 12865 - DNA, 1219 bp, Artificial Sequence
  chemically treated genomic DNA (Homo sapiens) CpG-island No: 12865
attgaggcgcgtatttacgtttgtcggggaaggagtttcgggttggttcgcgggattggtcggtaagcgatttacgtggtggtttcgtgtttcgagcgcgtttacggtatagaggtacgggtacggtcgacgaaggtgtttcggttttttttcgcggcgtttttgcgagagtttcgtttatgttcgcgggagagatcggttaatggatagtcggtttggttcgggttatttcgtgaagggtttcgttatttaggttgattattcgtttttaatgggtgagcggttcgcggtagttcgggaatagcggttttgcgtttgcgttgtttttttttttggcgtattttcgtagcgagcgttttatttcgaatgtcggttggagttttgttagttaattatcggggcgttttaaggtcggtagttaatgatcgttttttttttcgcgtcgggttttatcgattggcgttgagttttcgtagttcgcgggaggcgggggcggattggcgaaggtgtaggttaatgggcggcgggcgcgaggcgttgggttaatgagcgtttcgggggcggggagggcgtcgcggcgggcggttgcgaggagcggtcggcgggcggcggcggtcggcgggcggcgatggcggcggcggaggtcggtggcgacgacgttcgttgcgtgcggttgagcgtcgagcgggtataggcgttgttggtcgacgtggatacgttgttgttcgattgcgacggcgtgttgtggcgcggggagattcgtttgtttggcgcgttcgaggttttgcggcgtttgtaattcgttgtaagcgtttgggttttattattaataatagtagtaagattcgcgttgtttacgtcgagaagttgcggcgtttgggtttcggcggtttcgcggggttcggcgttagtttggaggttttcggtacggtttattgtatcgcgttttatttgcgttagcgtttggtcggcgttttcgcgtttaaggtttacgtgttgggtagtttagttttggtcgcggagttggaggtcgtgggcgtcgttagcgtgggcgtggggttcgagttattgtaggggcgagggtttcggcgattggttgtacgcgtcgttggagttcgacgtgcgcgcggtggtggtgggttttgattcgtattttagttatatgaagtttattaaggttttgcgttatttgtagtagttcggttggtttgttcgtggg

SEQ ID NO: 12866 - DNA, 1219 bp, Artificial Sequence
  chemically treated genomic DNA (Homo sapiens) CpG-island No: 12866
cccacgaacaaaccaaccgaactactacaaataacgcaaaaccttaataaacttcatataactaaaatacgaatcaaaacccaccaccaccgcgcgcacgtcgaactccaacgacgcgtacaaccaatcgccgaaaccctcgcccctacaataactcgaaccccacgcccacgctaacgacgcccacgacctccaactccgcgaccaaaactaaactacccaacacgtaaaccttaaacgcgaaaacgccgaccaaacgctaacgcaaataaaacgcgatacaataaaccgtaccgaaaacctccaaactaacgccgaaccccgcgaaaccgccgaaacccaaacgccgcaacttctcgacgtaaacaacgcgaatcttactactattattaataataaaacccaaacgcttacaacgaattacaaacgccgcaaaacctcgaacgcgccaaacaaacgaatctccccgcgccacaacacgccgtcgcaatcgaacaacaacgtatccacgtcgaccaacaacgcctatacccgctcgacgctcaaccgcacgcaacgaacgtcgtcgccaccgacctccgccgccgccatcgccgcccgccgaccgccgccgcccgccgaccgctcctcgcaaccgcccgccgcgacgccctccccgcccccgaaacgctcattaacccaacgcctcgcgcccgccgcccattaacctacaccttcgccaatccgcccccgcctcccgcgaactacgaaaactcaacgccaatcgataaaacccgacgcgaaaaaaaaaacgatcattaactaccgaccttaaaacgccccgataattaactaacaaaactccaaccgacattcgaaataaaacgctcgctacgaaaatacgccaaaaaaaaaaacaacgcaaacgcaaaaccgctattcccgaactaccgcgaaccgctcacccattaaaaacgaataatcaacctaaataacgaaacccttcacgaaataacccgaaccaaaccgactatccattaaccgatctctcccgcgaacataaacgaaactctcgcaaaaacgccgcgaaaaaaaaccgaaacaccttcgtcgaccgtacccgtacctctataccgtaaacgcgctcgaaacacgaaaccaccacgtaaatcgcttaccgaccaatcccgcgaaccaacccgaaactccttccccgacaaacgtaaatacgcgcctcaat

SEQ ID NO: 12867 - DNA, 1219 bp, Artificial Sequence
  chemically treated genomic DNA (Homo sapiens) CpG-island No: 12867
tttacgagtaagttagtcgggttgttgtaggtagcgtagggttttggtgagttttatgtagttgaagtgcgggttaaagtttattattatcgcgcgtacgtcgggttttagcggcgcgtgtagttagtcgtcgggattttcgtttttgtagtggttcgggttttacgtttacgttggcgacgtttacggtttttagtttcgcggttagggttgggttgtttagtacgtaggttttgggcgcgggggcgtcggttaggcgttggcgtaggtagagcgcggtgtagtaggtcgtgtcgaagatttttaggttggcgtcgggtttcgcggggtcgtcgaagtttaggcgtcgtagtttttcggcgtaggtagcgcgggttttgttgttgttgttggtgatgaagtttaggcgtttgtagcgggttgtaagcgtcgtagggtttcgggcgcgttaggtaggcgggttttttcgcgttatagtacgtcgtcgtagtcgaatagtagcgtgtttacgtcggttagtagcgtttgtgttcgttcggcgtttagtcgtacgtagcgggcgtcgtcgttatcggttttcgtcgtcgttatcgtcgttcgtcggtcgtcgtcgttcgtcggtcgtttttcgtagtcgttcgtcgcggcgtttttttcgttttcggggcgtttattggtttagcgtttcgcgttcgtcgtttattggtttgtattttcgttaattcgttttcgtttttcgcgggttgcgggagtttagcgttaatcggtgaggttcggcgcggggagaggggcgattattggttatcggttttgggacgtttcggtgattggttggtagggttttaatcggtattcggagtgaagcgttcgttgcggaaatgcgttagaggggagagtagcgtaggcgtaaggtcgttgttttcgggttgtcgcgggtcgtttatttattggaagcgagtggttagtttaggtgacgaggttttttacggagtgattcgggttaggtcggttgtttattggtcggtttttttcgcgggtatgggcggggttttcgtaggagcgtcgcgggagggggtcggggtattttcgtcggtcgtgttcgtgtttttgtgtcgtggacgcgttcgggatacggggttattacgtgggtcgtttatcggttagtttcgcgagttagttcggggtttttttttcggtaggcgtgagtacgcgttttagt

SEQ ID NO: 12868 - DNA, 1219 bp, Artificial Sequence
  chemically treated genomic DNA (Homo sapiens) CpG-island No: 12868
actaaaacgcgtactcacgcctaccgaaaaaaaaaccccgaactaactcgcgaaactaaccgataaacgacccacgtaataaccccgtatcccgaacgcgtccacgacacaaaaacacgaacacgaccgacgaaaataccccgaccccctcccgcgacgctcctacgaaaaccccgcccatacccgcgaaaaaaaccgaccaataaacaaccgacctaacccgaatcactccgtaaaaaacctcgtcacctaaactaaccactcgcttccaataaataaacgacccgcgacaacccgaaaacaacgaccttacgcctacgctactctcccctctaacgcatttccgcaacgaacgcttcactccgaataccgattaaaaccctaccaaccaatcaccgaaacgtcccaaaaccgataaccaataatcgcccctctccccgcgccgaacctcaccgattaacgctaaactcccgcaacccgcgaaaaacgaaaacgaattaacgaaaatacaaaccaataaacgacgaacgcgaaacgctaaaccaataaacgccccgaaaacgaaaaaaacgccgcgacgaacgactacgaaaaacgaccgacgaacgacgacgaccgacgaacgacgataacgacgacgaaaaccgataacgacgacgcccgctacgtacgactaaacgccgaacgaacacaaacgctactaaccgacgtaaacacgctactattcgactacgacgacgtactataacgcgaaaaaacccgcctacctaacgcgcccgaaaccctacgacgcttacaacccgctacaaacgcctaaacttcatcaccaacaacaacaacaaaacccgcgctacctacgccgaaaaactacgacgcctaaacttcgacgaccccgcgaaacccgacgccaacctaaaaatcttcgacacgacctactacaccgcgctctacctacgccaacgcctaaccgacgcccccgcgcccaaaacctacgtactaaacaacccaaccctaaccgcgaaactaaaaaccgtaaacgtcgccaacgtaaacgtaaaacccgaaccactacaaaaacgaaaatcccgacgactaactacacgcgccgctaaaacccgacgtacgcgcgataataataaactttaacccgcacttcaactacataaaactcaccaaaaccctacgctacctacaacaacccgactaacttactcgtaaa

SEQ ID NO: 12869 - DNA, 592 bp, Artificial Sequence
  chemically treated genomic DNA (Homo sapiens) CpG-island No: 12869
agttcgcgtcgtcgtttagggttttgcggaggtcggatatacgtgggtgtacgcggtcgagcgtagggtcgcgcggggttcggtcggcgtagaggcgttgggggcgtcgtagacgcgaggttcgggatttagttggttgtttcgtcgcgtttttcgtttttttttttttttagttcgttcggttttttttttttttagcgttcgcgtcggagtcggagtcggagtcggagtggcggaggtacgggtagtgttcgttaggcgtcggtagtagttatagtagtttggcgtttggcggcggcggcggtggtagcggcgggcgggttggcgtcgtggattgggtcgggaatcgtgcggacgagggtgttgcgtttgcggcggcggcggtttacgcgggcgcgtacggcggtttttcgggttcggattaattgcggcggcggcggtggcggcggcggcggcggcggcggcggcggcgagtgggtcgtcggggcgggcgtttggcgagttgtagagattaggtaagttcgggatgttcgatttttggcgtcggtcgggttatagggatgagttatttgttagggtaaattttacgttt

SEQ ID NO: 12870 - DNA, 592 bp, Artificial Sequence
  chemically treated genomic DNA (Homo sapiens) CpG-island No: 12870
aaacgtaaaatttaccctaacaaataactcatccctataacccgaccgacgccaaaaatcgaacatcccgaacttacctaatctctacaactcgccaaacgcccgccccgacgacccactcgccgccgccgccgccgccgccgccgccgccaccgccgccgccgcaattaatccgaacccgaaaaaccgccgtacgcgcccgcgtaaaccgccgccgccgcaaacgcaacaccctcgtccgcacgattcccgacccaatccacgacgccaacccgcccgccgctaccaccgccgccgccgccaaacgccaaactactataactactaccgacgcctaacgaacactacccgtacctccgccactccgactccgactccgactccgacgcgaacgctaaaaaaaaaaaaaaccgaacgaactaaaaaaaaaaaaaaacgaaaaacgcgacgaaacaaccaactaaatcccgaacctcgcgtctacgacgcccccaacgcctctacgccgaccgaaccccgcgcgaccctacgctcgaccgcgtacacccacgtatatccgacctccgcaaaaccctaaacgacgacgcgaact

SEQ ID NO: 12871 - DNA, 592 bp, Artificial Sequence
  chemically treated genomic DNA (Homo sapiens) CpG-island No: 12871
gggcgtaaagtttgttttggtaggtggtttatttttgtggttcggtcggcgttaggagtcgggtatttcggatttatttggtttttgtagttcgttagacgttcgtttcgacggtttattcgtcgtcgtcgtcgtcgtcgtcgtcgtcgttatcgtcgtcgtcgtagttagttcgggttcggggggtcgtcgtgcgcgttcgcgtaagtcgtcgtcgtcgtaggcgtagtattttcgttcgtacggttttcggtttagtttacggcgttagttcgttcgtcgttgttatcgtcgtcgtcgttaagcgttaggttgttgtggttgttgtcggcgtttagcgagtattgttcgtgttttcgttatttcggtttcggtttcggtttcgacgcggacgttggagggaggggagatcgggcggattggagggagggaggggcggggagcgcggcggagtagttaattgggtttcgagtttcgcgtttgcggcgtttttagcgtttttgcgtcggtcggatttcgcgcggttttgcgttcggtcgcgtgtatttacgtgtgttcggttttcgtagggttttgggcggcggcgcgggtt

SEQ ID NO: 12872 - DNA, 592 bp, Artificial Sequence
  chemically treated genomic DNA (Homo sapiens) CpG-island No: 12872
aacccgcgccgccgcccaaaaccctacgaaaaccgaacacacgtaaatacacgcgaccgaacgcaaaaccgcgcgaaatccgaccgacgcaaaaacgctaaaaacgccgcaaacgcgaaactcgaaacccaattaactactccgccgcgctccccgcccctccctccctccaatccgcccgatctcccctccctccaacgtccgcgtcgaaaccgaaaccgaaaccgaaataacgaaaacacgaacaatactcgctaaacgccgacaacaaccacaacaacctaacgcttaacgacgacgacgataacaacgacgaacgaactaacgccgtaaactaaaccgaaaaccgtacgaacgaaaatactacgcctacgacgacgacgacttacgcgaacgcgcacgacgaccccccgaacccgaactaactacgacgacgacgataacgacgacgacgacgacgacgacgacgacgaataaaccgtcgaaacgaacgtctaacgaactacaaaaaccaaataaatccgaaatacccgactcctaacgccgaccgaaccacaaaaataaaccacctaccaaaacaaactttacgccc

SEQ ID NO: 12873 - DNA, 519 bp, Artificial Sequence
  chemically treated genomic DNA (Homo sapiens) CpG-island No: 12873
atcgtcgtttagataaagtatcgggcgtttggtagcgttaattatcgtcgttgcgttacgaatgtttttttcgttaaaggcgggggcggcggttttttttgttatagcgggttgtgttttaattttaaaaattgtcgtttgtttatttttaggaatgtttatttatatcgggtttgggcggtttgattgcgtaatgcggaaggtatcgtttatgatttgcgggagtttttcgatatgtttgattagatagttgtgtttggtgatggggatagagatgtcgtaggtgtttattttttggaaggcgtcggtgtcgattatcgaggcgggaatttgattagtgatgtaaattagcgggatggagtttagtcgcgtatcggtaatggcggttattaggttagtcgtattcggttcgttataggttatatagatcgtcggtttatcgtcggtgcgcgttattttttgagcgataaagttcgcgttttgtttatgacgggttagaatatattttgtatagtatgg

SEQ ID NO: 12874 - DNA, 519 bp, Artificial Sequence
  chemically treated genomic DNA (Homo sapiens) CpG-island No: 12874
ccatactatacaaaatatattctaacccgtcataaacaaaacgcgaactttatcgctcaaaaaataacgcgcaccgacgataaaccgacgatctatataacctataacgaaccgaatacgactaacctaataaccgccattaccgatacgcgactaaactccatcccgctaatttacatcactaatcaaattcccgcctcgataatcgacaccgacgccttccaaaaaataaacacctacgacatctctatccccatcaccaaacacaactatctaatcaaacatatcgaaaaactcccgcaaatcataaacgataccttccgcattacgcaatcaaaccgcccaaacccgatataaataaacattcctaaaaataaacaaacgacaatttttaaaattaaaacacaacccgctataacaaaaaaaaccgccgcccccgcctttaacgaaaaaaacattcgtaacgcaacgacgataattaacgctaccaaacgcccgatactttatctaaacgacgat

SEQ ID NO: 12875 - DNA, 519 bp, Artificial Sequence
  chemically treated genomic DNA (Homo sapiens) CpG-island No: 12875
ttatgttatataagatatattttggttcgttatgaatagggcgcgggttttatcgtttagggaatggcgcgtatcgacggtaaatcggcggtttgtatggtttgtagcggatcgggtgcgattaatttggtgatcgttattgtcgatgcgcggttggattttatttcgttgatttgtattattggttaggttttcgtttcgatgatcggtatcgacgttttttaggaagtggatatttacggtatttttatttttattattaaatataattatttggttagatatatcgaagaattttcgtaggttatgagcgatgtttttcgtattgcgtaattaggtcgtttaggttcggtgtggatagatatttttaaggatgagtaaacggtagtttttgagattgaaatatagttcgttatggtagaaaaagtcgtcgttttcgtttttagcgaagaaagtattcgtgacgtagcggcgatgattaacgttgttaaacgttcggtgttttatttgggcggcggt

SEQ ID NO: 12876 - DNA, 519 bp, Artificial Sequence
  chemically treated genomic DNA (Homo sapiens) CpG-island No: 12876
accgccgcccaaataaaacaccgaacgtttaacaacgttaatcatcgccgctacgtcacgaatactttcttcgctaaaaacgaaaacgacgactttttctaccataacgaactatatttcaatctcaaaaactaccgtttactcatccttaaaaatatctatccacaccgaacctaaacgacctaattacgcaatacgaaaaacatcgctcataacctacgaaaattcttcgatatatctaaccaaataattatatttaataataaaaataaaaataccgtaaatatccacttcctaaaaaacgtcgataccgatcatcgaaacgaaaacctaaccaataatacaaatcaacgaaataaaatccaaccgcgcatcgacaataacgatcaccaaattaatcgcacccgatccgctacaaaccatacaaaccgccgatttaccgtcgatacgcgccattccctaaacgataaaacccgcgccctattcataacgaaccaaaatatatcttatataacataa

SEQ ID NO: 12877 - DNA, 535 bp, Artificial Sequence
  chemically treated genomic DNA (Homo sapiens) CpG-island No: 12877
tgggcgtcgcgcggggttgggggcgtttagaagacgtgcgagtgttcgcggttttgttgttgtttttagtatttttcgtattttttaagtgatgggaataagggttcgtttaggtagtcgttgtcgtcgtatcgttttttcgttcgttttttgcgcgcggagttatttagttatattttcggtatttcgagtttttttttcggagttgttgtttttattttggttgttatcgtcgtcgtcgcgggtggttcgttgttgattgggttcgtcgggagacggagaagtattttttggtttttttttagtagtttttatattttaattttgtcgtcgtcgtcgcgtttgttttcgtagcggcgttcggtcgtatattgtgggggcgtacgtcgggaggtttcgtaagatcgtggaggtaggaaacggtattattgcgtttttgtttcggttttttgttgttcgttttggatggtttttgaaagtgtttgagttttttcggaaattttggggtcggagaagataaattttggaatttttt

SEQ ID NO: 12878 - DNA, 535 bp, Artificial Sequence
  chemically treated genomic DNA (Homo sapiens) CpG-island No: 12878
aaaaaattccaaaatttatcttctccgaccccaaaatttccgaaaaaactcaaacactttcaaaaaccatccaaaacgaacaacaaaaaaccgaaacaaaaacgcaataataccgtttcctacctccacgatcttacgaaacctcccgacgtacgcccccacaatatacgaccgaacgccgctacgaaaacaaacgcgacgacgacgacaaaattaaaatataaaaactactaaaaaaaaaccaaaaaatacttctccgtctcccgacgaacccaatcaacaacgaaccacccgcgacgacgacgataacaaccaaaataaaaacaacaactccgaaaaaaaaactcgaaataccgaaaatataactaaataactccgcgcgcaaaaaacgaacgaaaaaacgatacgacgacaacgactacctaaacgaacccttattcccatcacttaaaaaatacgaaaaatactaaaaacaacaacaaaaccgcgaacactcgcacgtcttctaaacgcccccaaccccgcgcgacgccca

SEQ ID NO: 12879 - DNA, 535 bp, Artificial Sequence
  chemically treated genomic DNA (Homo sapiens) CpG-island No: 12879
gaagaattttaaggtttgtttttttcggttttaggattttcgaggaggtttagatatttttaagaattatttaaagcgaataataaagagtcgaggtagaagcgtagtagtgtcgttttttgtttttacggttttgcggagtttttcggcgtgcgtttttataatgtgcggtcgagcgtcgttgcgagggtaggcgcggcggcggcggtaaagttggggtgtgagagttgttgagggagggttaaaaagtgttttttcgtttttcggcgagtttagttagtagcgggttattcgcggcggcggcgatagtagttaaagtagaagtagtagtttcggaggaagggttcggggtgtcgggagtgtgattgggtgatttcgcgcgtagagagcgagcgagggggcggtgcggcgatagcggttgtttgggcgggtttttgtttttattatttgggggatgcggagggtattggagatagtagtaggatcgcggatattcgtacgttttttgggcgtttttagtttcgcgcggcgttta

SEQ ID NO: 12880 - DNA, 535 bp, Artificial Sequence
  chemically treated genomic DNA (Homo sapiens) CpG-island No: 12880
taaacgccgcgcgaaactaaaaacgcccaaaaaacgtacgaatatccgcgatcctactactatctccaataccctccgcatcccccaaataataaaaacaaaaacccgcccaaacaaccgctatcgccgcaccgccccctcgctcgctctctacgcgcgaaatcacccaatcacactcccgacaccccgaacccttcctccgaaactactacttctactttaactactatcgccgccgccgcgaataacccgctactaactaaactcgccgaaaaacgaaaaaacactttttaaccctccctcaacaactctcacaccccaactttaccgccgccgccgcgcctaccctcgcaacgacgctcgaccgcacattataaaaacgcacgccgaaaaactccgcaaaaccgtaaaaacaaaaaacgacactactacgcttctacctcgactctttattattcgctttaaataattcttaaaaatatctaaacctcctcgaaaatcctaaaaccgaaaaaaacaaaccttaaaattcttc

SEQ ID NO: 12881 - DNA, 701 bp, Artificial Sequence
  chemically treated genomic DNA (Homo sapiens) CpG-island No: 12881
cgttcggagttcgggggaatcgaaggtttaggagtttaaggttatttacgaattttagttcgttttttggggcgattttttggagtagttacgtgttttttcggcgtcgtacgtcgcgtagttgtattttggttgcggttcgcgttttcggattcgtagttcggagtcggcgtattagggtttgcggtttttaagggcgaggattcgaagttttcggggttgagagcgatagtgggggtatatttggtttcgttattcgtcgttttgtgatcgaggaggcgggtaagaaggtagagagaagggaagggacgagaggcgaagggacgagaggcgtagggacgtttttgcgtatagtcgtcgatttcgtgtatttgtagtcgttcgaggcgtcgttatagttttttttttataggttcgcggtttcgttttatttcggtcgtttcgtttggggtcgcgatcgttttttcgtaatacgtgcggttttttatggttgttggatagtatcggagcggtcgttttagttagtttcgtaggatgaagggaggatacgagggtcggtgtagttttagaagttcgtatttatattagcgcgtttttcgtttcgagtcgttattcgatatttcgacgatatgaggggatggcggtttttaatcggcggtttaggttcgcgtttcgagttcggttttggtaattattagtgt

SEQ ID NO: 12882 - DNA, 701 bp, Artificial Sequence
  chemically treated genomic DNA (Homo sapiens) CpG-island No: 12882
acactaataattaccaaaaccgaactcgaaacgcgaacctaaaccgccgattaaaaaccgccatcccctcatatcgtcgaaatatcgaataacgactcgaaacgaaaaacgcgctaatataaatacgaacttctaaaactacaccgaccctcgtatcctcccttcatcctacgaaactaactaaaacgaccgctccgatactatccaacaaccataaaaaaccgcacgtattacgaaaaaacgatcgcgaccccaaacgaaacgaccgaaataaaacgaaaccgcgaacctataaaaaaaaaactataacgacgcctcgaacgactacaaatacacgaaatcgacgactatacgcaaaaacgtccctacgcctctcgtcccttcgcctctcgtcccttcccttctctctaccttcttacccgcctcctcgatcacaaaacgacgaataacgaaaccaaatatacccccactatcgctctcaaccccgaaaacttcgaatcctcgcccttaaaaaccgcaaaccctaatacgccgactccgaactacgaatccgaaaacgcgaaccgcaaccaaaatacaactacgcgacgtacgacgccgaaaaaacacgtaactactccaaaaaatcgccccaaaaaacgaactaaaattcgtaaataaccttaaactcctaaaccttcgattcccccgaactccgaacg

SEQ ID NO: 12883 - DNA, 701 bp, Artificial Sequence
  chemically treated genomic DNA (Homo sapiens) CpG-island No: 12883
gtattggtagttattagggtcgggttcggggcgcggatttaaatcgtcggttaggggtcgttatttttttatatcgtcgggatatcgggtggcggttcgggacggaggacgcgttagtgtgagtgcgggtttttagaattatatcgattttcgtgttttttttttattttgcggggttggttggagcggtcgtttcggtgttgtttagtagttatagggagtcgtacgtgttgcgggaaagcggtcgcggttttaggcggggcggtcgggatggagcggggtcgcgagtttgtggggaaggggttgtggcggcgtttcgagcggttgtaggtatacggggtcggcggttgtgcgtagaggcgtttttgcgtttttcgttttttcgtttttcgtttttttttttttttttgtttttttgttcgttttttcggttatagagcgacgaatgacgagattaggtgtatttttattgtcgtttttagtttcggggatttcgggttttcgtttttgaaggtcgtaggttttagtgcgtcggtttcgggttgcgggttcgggagcgcgggtcgtagttaaggtgtagttgcgcggcgtgcggcgtcgggggaatacgtggttgttttaggaagtcgttttagggaacgggttgggattcgtgggtgattttgggtttttaaattttcggttttttcgggtttcgggcg

SEQ ID NO: 12884 - DNA, 701 bp, Artificial Sequence
  chemically treated genomic DNA (Homo sapiens) CpG-island No: 12884
cgcccgaaacccgaaaaaaccgaaaatttaaaaacccaaaatcacccacgaatcccaacccgttccctaaaacgacttcctaaaacaaccacgtattcccccgacgccgcacgccgcgcaactacaccttaactacgacccgcgctcccgaacccgcaacccgaaaccgacgcactaaaacctacgaccttcaaaaacgaaaacccgaaatccccgaaactaaaaacgacaataaaaatacacctaatctcgtcattcgtcgctctataaccgaaaaaacgaacaaaaaaacaaaaaaaaaaaaaaaaacgaaaaacgaaaaaacgaaaaacgcaaaaacgcctctacgcacaaccgccgaccccgtatacctacaaccgctcgaaacgccgccacaaccccttccccacaaactcgcgaccccgctccatcccgaccgccccgcctaaaaccgcgaccgctttcccgcaacacgtacgactccctataactactaaacaacaccgaaacgaccgctccaaccaaccccgcaaaataaaaaaaaaacacgaaaatcgatataattctaaaaacccgcactcacactaacgcgtcctccgtcccgaaccgccacccgatatcccgacgatataaaaaaataacgacccctaaccgacgatttaaatccgcgccccgaacccgaccctaataactaccaatac

SEQ ID NO: 12885 - DNA, 514 bp, Artificial Sequence
  chemically treated genomic DNA (Homo sapiens) CpG-island No: 12885
  misc_feature (331)..(331): n is either a, c, g or t
  misc_feature (386)..(387): n is either a, c, g or t
  misc_feature (401)..(401): n is either a, c, g or t
gcggtttttcggggtatttgttgttttggcgtttttttttttggttttcgtttcgttcgtagcgtttttcgatatttttcgttcgttgcgcgcgtattttcgtttttcgggcgatttgtttgagtatttcgcgagcgtacgtgttttaggaagtgacgtatagtttttttgggggtcgggggcggggttaggttataaatcgtcggttaggggtcgttatttttttagagcgtcgggatatcgggtggcggttcgggacggaggacgcgttagtgtgagtgcgggtttttagaattatatcgattttcgtgttttttttttattttgcggngttggttggagcggtcgtttcggtgttgtttagtagttatagggagtcgtacggnngagcgggaaagcgncgcgggtttaggcggggcgggcgggatggagcggggtcgcgagtttggggggaagggttgggcggggtttcgagcggttgtagggttttaaaattagaatatgagtttttatt

SEQ ID NO: 12886 - DNA, 514 bp, Artificial Sequence
  chemically treated genomic DNA (Homo sapiens) CpG-island No: 12886
  misc_feature (114)..(114): n is either a, c, g or t
  misc_feature (128)..(129): n is either a, c, g or t
  misc_feature (184)..(184): n is either a, c, g or t
aataaaaactcatattctaattttaaaaccctacaaccgctcgaaaccccgcccaacccttccccccaaactcgcgaccccgctccatcccgcccgccccgcctaaacccgcgncgctttcccgctcnnccgtacgactccctataactactaaacaacaccgaaacgaccgctccaaccaacnccgcaaaataaaaaaaaaacacgaaaatcgatataattctaaaaacccgcactcacactaacgcgtcctccgtcccgaaccgccacccgatatcccgacgctctaaaaaaataacgacccctaaccgacgatttataacctaaccccgcccccgacccccaaaaaaactatacgtcacttcctaaaacacgtacgctcgcgaaatactcaaacaaatcgcccgaaaaacgaaaatacgcgcgcaacgaacgaaaaatatcgaaaaacgctacgaacgaaacgaaaaccaaaaaaaaaaacgccaaaacaacaaataccccgaaaaaccgc

SEQ ID NO: 12887 - DNA, 514 bp, Artificial Sequence
  chemically treated genomic DNA (Homo sapiens) CpG-island No: 12887
  misc_feature (114)..(114): n is either a, c, g or t
  misc_feature (128)..(129): n is either a, c, g or t
  misc_feature (184)..(184): n is either a, c, g or t
ggtgggagtttatgttttagttttagggttttgtagtcgttcgaggtttcgtttagtttttttttttaggttcgcggtttcgttttatttcgttcgtttcgtttgggttcgcgncgttttttcgtttnntcgtgcggttttttatggttgttggatagtatcggagcggtcgttttagttagtntcgtaggatgaagggaggatacgagggtcggtgtagttttagaagttcgtatttatattagcgcgtttttcgtttcgagtcgttattcgatatttcgacgttttgaggggatggcggtttttaatcggcggtttatagtttggtttcgttttcggtttttaggggggttgtgcgttattttttgaggtacgtacgttcgcgaggtgtttagatagatcgttcggggggcggggatgcgcgcgtagcgggcggagaatatcggagggcgttgcgggcgaggcgaaggttaagggaaaaggcgttaaggtagtaggtgtttcgaggagtcgt

SEQ ID NO: 12888 - DNA, 514 bp, Artificial Sequence
  chemically treated genomic DNA (Homo sapiens) CpG-island No: 12888
  misc_feature (331)..(331): n is either a, c, g or t
  misc_feature (386)..(387): n is either a, c, g or t
  misc_feature (401)..(401): n is either a, c, g or t
acgactcctcgaaacacctactaccttaacgccttttcccttaaccttcgcctcgcccgcaacgccctccgatattctccgcccgctacgcgcgcatccccgccccccgaacgatctatctaaacacctcgcgaacgtacgtacctcaaaaaataacgcacaacccccctaaaaaccgaaaacgaaaccaaactataaaccgccgattaaaaaccgccatcccctcaaaacgtcgaaatatcgaataacgactcgaaacgaaaaacgcgctaatataaatacgaacttctaaaactacaccgaccctcgtatcctcccttcatcctacganactaactaaaacgaccgctccgatactatccaacaaccataaaaaaccgcacgannaaacgaaaaaacgncgcgaacccaaacgaaacgaacgaaataaaacgaaaccgcgaacctaaaaaaaaaaactaaacgaaacctcgaacgactacaaaaccctaaaactaaaacataaactcccacc

SEQ ID NO: 12889 - DNA, 650 bp, Artificial Sequence
  chemically treated genomic DNA (Homo sapiens) CpG-island No: 12889
tcgttttttttttcgcggtgatttttcggtttcggcgttcggcgagggcgcgcggttggtgttcgtttcgttcgaaaggtaggggttcggttgtgttttcgtttggtttttaacgttttatttttcgggagattcgtagttttttattattttgtattttttttttcgaatttgggggcggttatcgtgtaattggcgttagtcgcggagtaggaggagtttttcgcgatttcggaggcgttcggcgtagtcgttcgggattggggttggcgggagtttgagatttcgggtagggttgtttttttttttgttttttcgttagattcgcggggaaggaatcgtgttcgcgtcgtttttggttcgcgttatttttttttggtttttgtcggtttcgggtttttgcggttcgatgtggtaggcgtcgcgagagaggtagtagtcggttggagtagcggttttttaggtttcggagttcggtgcgtttttgcggtcgtcgtttttgggtttcggcgggttatttttgtcggtcggtttcgttgcgggtttgtattgttcgggtgagggaaattgggggtgcgggaagatcggtttgggtcggggttcgggcggtttggggtttgtgttgtttcgatttttcggttttgtagttt

SEQ ID NO: 12890 - DNA, 650 bp, Artificial Sequence
  chemically treated genomic DNA (Homo sapiens) CpG-island No: 12890
aaactacaaaaccgaaaaatcgaaacaacacaaaccccaaaccgcccgaaccccgacccaaaccgatcttcccgcacccccaatttccctcacccgaacaatacaaacccgcaacgaaaccgaccgacaaaaataacccgccgaaacccaaaaacgacgaccgcaaaaacgcaccgaactccgaaacctaaaaaaccgctactccaaccgactactacctctctcgcgacgcctaccacatcgaaccgcaaaaacccgaaaccgacaaaaaccaaaaaaaaataacgcgaaccaaaaacgacgcgaacacgattccttccccgcgaatctaacgaaaaaacaaaaaaaaaaacaaccctacccgaaatctcaaactcccgccaaccccaatcccgaacgactacgccgaacgcctccgaaatcgcgaaaaactcctcctactccgcgactaacgccaattacacgataaccgcccccaaattcgaaaaaaaaaatacaaaataataaaaaactacgaatctcccgaaaaataaaacgttaaaaaccaaacgaaaacacaaccgaacccctacctttcgaacgaaacgaacaccaaccgcgcgccctcgccgaacgccgaaaccgaaaaatcaccgcgaaaaaaaaaacga

SEQ ID NO: 12891 - DNA, 650 bp, Artificial Sequence
  chemically treated genomic DNA (Homo sapiens) CpG-island No: 12891
aggttgtaaagtcggagggtcggggtagtatagattttaggtcgttcggatttcggtttagatcggttttttcgtatttttaattttttttattcgggtagtgtaaattcgtagcgaagtcggtcggtaagagtgattcgtcgaggtttaggagcgacgatcgtagaggcgtatcgggtttcgagatttgaggggtcgttgttttagtcggttgttgtttttttcgcggcgtttgttatatcgggtcgtagaagttcgaggtcggtagaaattaaaggaaggtggcgcgggttaggggcggcgcgggtacgatttttttttcgcggatttggcgggggagtagaggagggagtagttttgttcggagttttaggttttcgttagttttaatttcgggcgattgcgtcgagcgttttcggagtcgcgggaagttttttttgtttcgcggttggcgttagttgtacggtggtcgtttttaaattcgaggaggaaggtgtaaagtggtgggaggttgcgggtttttcggagggtgaggcgttggggattaggcgggagtatagtcgaatttttatttttcgggcggggcggatattagtcgcgcgttttcgtcgggcgtcgggatcggaaaattatcgcgaagggagggacga

SEQ ID NO: 12892 - DNA, 650 bp, Artificial Sequence
  chemically treated genomic DNA (Homo sapiens) CpG-island No: 12892
tcgtccctcccttcgcgataattttccgatcccgacgcccgacgaaaacgcgcgactaatatccgccccgcccgaaaaataaaaattcgactatactcccgcctaatccccaacgcctcaccctccgaaaaacccgcaacctcccaccactttacaccttcctcctcgaatttaaaaacgaccaccgtacaactaacgccaaccgcgaaacaaaaaaaacttcccgcgactccgaaaacgctcgacgcaatcgcccgaaattaaaactaacgaaaacctaaaactccgaacaaaactactccctcctctactcccccgccaaatccgcgaaaaaaaaatcgtacccgcgccgcccctaacccgcgccaccttcctttaatttctaccgacctcgaacttctacgacccgatataacaaacgccgcgaaaaaaacaacaaccgactaaaacaacgacccctcaaatctcgaaacccgatacgcctctacgatcgtcgctcctaaacctcgacgaatcactcttaccgaccgacttcgctacgaatttacactacccgaataaaaaaaattaaaaatacgaaaaaaccgatctaaaccgaaatccgaacgacctaaaatctatactaccccgaccctccgactttacaacct

SEQ ID NO: 12893 - DNA, 529 bp, Artificial Sequence
  chemically treated genomic DNA (Homo sapiens) CpG-island No: 12893
cgttatcggtagcggttttcgtcgtttgattcgttagtaacgtttagtcgtttagtgaatttaagtaattcgtagttgcgtagaaggaaataatggtttcggcggtgttatttaacgttattcgtgcggtattatcgaatggcgaagtagaaacgcgtagtgcggtattagggattatttttataatcgcggtggtagaaagtatatagtaaacggcggtaattaatattttattaatggtggcgatagggatattgcgtttcgggttttttattatatttgcggtaacggaggtattttttatatcgatgaacgattatagcgtaacgttaaaggtattttgaattgtattaaaggtgtttaggtcgttgacgttttatgtcgttatataggttttattatcgaattagaattagttaaattcggtaatttcgattatggggattaacgttagttcggtggttattgtttgtatatcggtggagatttttcgatttataatgtttaataggattaaaaattatagtat

SEQ ID NO: 12894 - DNA, 529 bp, Artificial Sequence
  chemically treated genomic DNA (Homo sapiens) CpG-island No: 12894
atactataatttttaatcctattaaacattataaatcgaaaaatctccaccgatatacaaacaataaccaccgaactaacgttaatccccataatcgaaattaccgaatttaactaattctaattcgataataaaacctatataacgacataaaacgtcaacgacctaaacacctttaatacaattcaaaatacctttaacgttacgctataatcgttcatcgatataaaaaatacctccgttaccgcaaatataataaaaaacccgaaacgcaatatccctatcgccaccattaataaaatattaattaccgccgtttactatatactttctaccaccgcgattataaaaataatccctaataccgcactacgcgtttctacttcgccattcgataataccgcacgaataacgttaaataacaccgccgaaaccattatttccttctacgcaactacgaattacttaaattcactaaacgactaaacgttactaacgaatcaaacgacgaaaaccgctaccgataacg

SEQ ID NO: 12895 - DNA, 529 bp, Artificial Sequence
  chemically treated genomic DNA (Homo sapiens) CpG-island No: 12895
gtgttgtgatttttggttttgttaaatattgtgggtcggaaaatttttatcggtgtgtaggtagtggttatcgggttggcgttgatttttatagtcggaattgtcgaatttggttggttttggttcggtggtgaaatttatatggcggtatggaacgttagcggtttgggtatttttggtgtaatttaaagtatttttaacgttacgttgtggtcgtttatcggtgtggaaagtgttttcgttgtcgtaggtgtggtgaaaaattcgaaacgtaatgtttttatcgttattattggtggggtattgattgtcgtcgtttgttatgtattttttattatcgcgattatggggatgatttttaatgtcgtattgcgcgtttttgtttcgttattcggtgatgtcgtacggatggcgttgggtgatatcgtcggggttattgtttttttttgcgtagttgcgggttgtttaggtttattgggcggttggacgttgttggcgggttaaacggcgaaagtcgttgtcgatgacg

SEQ ID NO: 12896 - DNA, 529 bp, Artificial Sequence
  chemically treated genomic DNA (Homo sapiens) CpG-island No: 12896
cgtcatcgacaacgactttcgccgtttaacccgccaacaacgtccaaccgcccaataaacctaaacaacccgcaactacgcaaaaaaaaacaataaccccgacgatatcacccaacgccatccgtacgacatcaccgaataacgaaacaaaaacgcgcaatacgacattaaaaatcatccccataatcgcgataataaaaaatacataacaaacgacgacaatcaataccccaccaataataacgataaaaacattacgtttcgaatttttcaccacacctacgacaacgaaaacactttccacaccgataaacgaccacaacgtaacgttaaaaatactttaaattacaccaaaaatacccaaaccgctaacgttccataccgccatataaatttcaccaccgaaccaaaaccaaccaaattcgacaattccgactataaaaatcaacgccaacccgataaccactacctacacaccgataaaaattttccgacccacaatatttaacaaaaccaaaaatcacaacac

SEQ ID NO: 12897 - DNA, 615 bp, Artificial Sequence
  chemically treated genomic DNA (Homo sapiens) CpG-island No: 12897
aagtattgcgttgtttgtcgggcgttggttcgaagtcggcgtagcgtatggcgtttacgttgttttagcgcgatcgtagcggcggaatgcgtttggcgtaggcgtttattcgggcgatgtcggaaatcggttattgcgtcgattgtcgtatttttatcgaataggaagtttgtaatatttgttcgaattcgcgtcgttaggaaaacggttaaatttgcgtggtggagagttcggcggatatttacgttattgagtagacggggtagtttttaggtcgttattttgtgttgatggggtatttgttatcgttggacggtatcggttcggatgatatcgggtttgatcgtttggaatagcgtttggtagaggaaaaaattattgaagtgattttcgttattaattttacggttgaaggtgaagttatcgttaattatattgtcgagttttgcgcgtaatatgacgtggaagttagtcgaatcgtttatggcgtttcggttggcggcgagttggaaatggtcgacggtattacgttgttatatttttttgtcgggcgttataagattcgtttttaagtaaacgagagtaggattatttgttttcgtttgaaattatttt

SEQ ID NO: 12898 - DNA, 615 bp, Artificial Sequence
  chemically treated genomic DNA (Homo sapiens) CpG-island No: 12898
aaaataatttcaaacgaaaacaaataatcctactctcgtttacttaaaaacgaatcttataacgcccgacaaaaaaatataacaacgtaataccgtcgaccatttccaactcgccgccaaccgaaacgccataaacgattcgactaacttccacgtcatattacgcgcaaaactcgacaatataattaacgataacttcaccttcaaccgtaaaattaataacgaaaatcacttcaataattttttcctctaccaaacgctattccaaacgatcaaacccgatatcatccgaaccgataccgtccaacgataacaaataccccatcaacacaaaataacgacctaaaaactaccccgtctactcaataacgtaaatatccgccgaactctccaccacgcaaatttaaccgttttcctaacgacgcgaattcgaacaaatattacaaacttcctattcgataaaaatacgacaatcgacgcaataaccgatttccgacatcgcccgaataaacgcctacgccaaacgcattccgccgctacgatcgcgctaaaacaacgtaaacgccatacgctacgccgacttcgaaccaacgcccgacaaacaacgcaatactt

SEQ ID NO: 12899 - DNA, 615 bp, Artificial Sequence
  chemically treated genomic DNA (Homo sapiens) CpG-island No: 12899
agaataattttaagcgagagtaggtgattttgttttcgtttgtttaaaaacgaattttatgacgttcggtaagggagtgtgataacgtggtgtcgtcgattatttttagttcgtcgttaatcggaacgttatgagcgattcggttggtttttacgttatattgcgcgtaaagttcggtaatgtagttagcggtagttttatttttaatcgtggggttggtggcgaggattattttagtgatttttttttttgttagacgttgttttagacgattaagttcgatattattcggatcgatgtcgtttagcggtgatagatgttttattaatataaaataacgatttgaaaattgtttcgtttgtttaatggcgtagatgttcgtcggattttttattacgtagatttgatcgtttttttgacgacgcggattcgaatagatgttatagattttttgttcggtgaaagtgcggtaatcggcgtagtggtcgattttcgatatcgttcgggtgagcgtttgcgttagacgtatttcgtcgttacgatcgcgttgaagtagcgtgaacgttatacgttgcgtcgatttcgggttaacgttcggtagatagcgtagtgttt

SEQ ID NO: 12900 - DNA, 615 bp, Artificial Sequence
  chemically treated genomic DNA (Homo sapiens) CpG-island No: 12900
aaacactacgctatctaccgaacgttaacccgaaatcgacgcaacgtataacgttcacgctacttcaacgcgatcgtaacgacgaaatacgtctaacgcaaacgctcacccgaacgatatcgaaaatcgaccactacgccgattaccgcactttcaccgaacaaaaaatctataacatctattcgaatccgcgtcgtcaaaaaaacgatcaaatctacgtaataaaaaatccgacgaacatctacgccattaaacaaacgaaacaattttcaaatcgttattttatattaataaaacatctatcaccgctaaacgacatcgatccgaataatatcgaacttaatcgtctaaaacaacgtctaacaaaaaaaaaaatcactaaaataatcctcgccaccaaccccacgattaaaaataaaactaccgctaactacattaccgaactttacgcgcaatataacgtaaaaaccaaccgaatcgctcataacgttccgattaacgacgaactaaaaataatcgacgacaccacgttatcacactcccttaccgaacgtcataaaattcgtttttaaacaaacgaaaacaaaatcacctactctcgcttaaaattattct

SEQ ID NO: 12901 - DNA, 503 bp, Artificial Sequence
  chemically treated genomic DNA (Homo sapiens) CpG-island No: 12901
attcgtgttgttttagtaatagttggggacgttgcgcgataaaattgatcgtatttaggcgttggttggttggattgttgaataagattggcgttgacgttaattacgttattcgtgcgggtttgttgtttaagtgcgatttgatgattaatatggttttcgagtttatcgatatttagggcgttatggggatgtattatgcgcgttacgatggcgaagcggaagatgtcgcggtggcgttgaatgagtagtattagtcgcgttttgttggtgatgatttgtcgtttaatttagtagtttgtgcgttggcgattgttgataagatggatattttggcgggtattttcggtatcggttagtattcgaaaggcgataaagattcgtttgcgttgcgtcgtgtcgcgtttggcgtgttgcgaattatcgttgagaagaattttaattttgatttgtaaacgttgatcgaagaagcggtgcgtttgtatggcgataagttgattaat

SEQ ID NO: 12902 - DNA, 503 bp, Artificial Sequence
  chemically treated genomic DNA (Homo sapiens) CpG-island No: 12902
attaatcaacttatcgccatacaaacgcaccgcttcttcgatcaacgtttacaaatcaaaattaaaattcttctcaacgataattcgcaacacgccaaacgcgacacgacgcaacgcaaacgaatctttatcgcctttcgaatactaaccgataccgaaaatacccgccaaaatatccatcttatcaacaatcgccaacgcacaaactactaaattaaacgacaaatcatcaccaacaaaacgcgactaatactactcattcaacgccaccgcgacatcttccgcttcgccatcgtaacgcgcataatacatccccataacgccctaaatatcgataaactcgaaaaccatattaatcatcaaatcgcacttaaacaacaaacccgcacgaataacgtaattaacgtcaacgccaatcttattcaacaatccaaccaaccaacgcctaaatacgatcaattttatcgcgcaacgtccccaactattactaaaacaacacgaat

SEQ ID NO: 12903 - DNA, 503 bp, Artificial Sequence
  chemically treated genomic DNA (Homo sapiens) CpG-island No: 12903
attagttagtttatcgttatatagacgtatcgttttttcggttagcgtttgtagattaaggttgaggttttttttaacgataattcgtagtacgttaagcgcggtacgacgtagcgtaaacgggtttttgtcgtttttcggatgttgatcgatatcgaagatattcgttagggtatttattttgttagtaatcgttagcgtataagttattgggttggacggtaggttattattagtaaaacgcggttgatattgtttatttagcgttatcgcgatatttttcgtttcgttatcgtgacgcgtatagtgtatttttataacgttttgggtgtcggtgaattcgaagattatgttggttattaggtcgtatttagatagtagattcgtacgggtagcgtggttaacgttagcgttaattttgtttagtaatttagttagttagcgtttggatgcggttagttttgtcgcgtagcgtttttaattgttgttggaataatacgggt

SEQ ID NO: 12904 - DNA, 503 bp, Artificial Sequence
  chemically treated genomic DNA (Homo sapiens) CpG-island No: 12904
acccgtattattccaacaacaattaaaaacgctacgcgacaaaactaaccgcatccaaacgctaactaactaaattactaaacaaaattaacgctaacgttaaccacgctacccgtacgaatctactatctaaatacgacctaataaccaacataatcttcgaattcaccgacacccaaaacgttataaaaatacactatacgcgtcacgataacgaaacgaaaaatatcgcgataacgctaaataaacaatatcaaccgcgttttactaataataacctaccgtccaacccaataacttatacgctaacgattactaacaaaataaataccctaacgaatatcttcgatatcgatcaacatccgaaaaacgacaaaaacccgtttacgctacgtcgtaccgcgcttaacgtactacgaattatcgttaaaaaaaacctcaaccttaatctacaaacgctaaccgaaaaaacgatacgtctatataacgataaactaactaat

SEQ ID NO: 12905 - DNA, 545 bp, Artificial Sequence
  chemically treated genomic DNA (Homo sapiens) CpG-island No: 12905
atcgttagggacgtttttttgtttgcgttttcgttcgtttagtgttttgcgttgcgtattcgttcggggcgttggtttggttcggtcgcgcgattatttcgggcgaatgatacgtcgggtttttagacgggggtttcggcgtcgggcgggtagttttattatcgtaggcggcgtcgcgagatcgcggtttttgtagcggggtagtaggtgcggggtgggttaggcgtttcggggttttgttcgttgcgttttagagtcgcgttttaggtttttttcggcgtcggttcgggtaggacgcgatgttttggaggcgttaggggcgcggtcggtttagttcgagcgtggaggtcgcggcggacgtaggtttggttttgtttatttagcgtttttcgtattcgcggtttcgcgttcgtttcgcgttagttttagcgtttgcgtcgttttcgttcgagttcggtagcgcggttttaggtatttgcgagttttttcggggttattagaggtgttcgtgtagggatttgggtttgaggggcggtgtttgtagt

SEQ ID NO: 12906 - DNA, 545 bp, Artificial Sequence
  chemically treated genomic DNA (Homo sapiens) CpG-island No: 12906
actacaaacaccgcccctcaaacccaaatccctacacgaacacctctaataaccccgaaaaaactcgcaaatacctaaaaccgcgctaccgaactcgaacgaaaacgacgcaaacgctaaaactaacgcgaaacgaacgcgaaaccgcgaatacgaaaaacgctaaataaacaaaaccaaacctacgtccgccgcgacctccacgctcgaactaaaccgaccgcgcccctaacgcctccaaaacatcgcgtcctacccgaaccgacgccgaaaaaaacctaaaacgcgactctaaaacgcaacgaacaaaaccccgaaacgcctaacccaccccgcacctactaccccgctacaaaaaccgcgatctcgcgacgccgcctacgataataaaactacccgcccgacgccgaaacccccgtctaaaaacccgacgtatcattcgcccgaaataatcgcgcgaccgaaccaaaccaacgccccgaacgaatacgcaacgcaaaacactaaacgaacgaaaacgcaaacaaaaaaacgtccctaacgat

SEQ ID NO: 12907 - DNA, 545 bp, Artificial Sequence
  chemically treated genomic DNA (Homo sapiens) CpG-island No: 12907
gttgtaggtatcgttttttaagtttaggtttttgtacggatatttttgatgatttcgaagaggttcgtaggtgtttaaggtcgcgttgtcgggttcgagcggaggcggcgtaggcgttgaggttggcgcggagcgggcgcggggtcgcgggtgcggaaagcgttaggtaagtagggttaggtttgcgttcgtcgcggtttttacgttcgggttgggtcggtcgcgtttttgacgtttttagggtatcgcgttttgttcgggtcggcgtcgaggagagtttggggcgcggttttgaggcgtagcgggtagggtttcgggacgtttggtttatttcgtatttgttgtttcgttgtaaggatcgcggtttcgcggcgtcgtttgcggtggtggagttgttcgttcggcgtcggagttttcgtttggggattcggcgtgttattcgttcgaggtggtcgcgcggtcgggttaggttagcgtttcgggcgggtgcgtagcgtagggtattgggcgggcggaggcgtagatagggaggcgtttttggcggt

SEQ ID NO: 12908 - DNA, 545 bp, Artificial Sequence
  chemically treated genomic DNA (Homo sapiens) CpG-island No: 12908
accgccaaaaacgcctccctatctacgcctccgcccgcccaataccctacgctacgcacccgcccgaaacgctaacctaacccgaccgcgcgaccacctcgaacgaataacacgccgaatccccaaacgaaaactccgacgccgaacgaacaactccaccaccgcaaacgacgccgcgaaaccgcgatccttacaacgaaacaacaaatacgaaataaaccaaacgtcccgaaaccctacccgctacgcctcaaaaccgcgccccaaactctcctcgacgccgacccgaacaaaacgcgataccctaaaaacgtcaaaaacgcgaccgacccaacccgaacgtaaaaaccgcgacgaacgcaaacctaaccctacttacctaacgctttccgcacccgcgaccccgcgcccgctccgcgccaacctcaacgcctacgccgcctccgctcgaacccgacaacgcgaccttaaacacctacgaacctcttcgaaatcatcaaaaatatccgtacaaaaacctaaacttaaaaaacgatacctacaac

SEQ ID NO: 12909 - DNA, 1887 bp, Artificial Sequence
  chemically treated genomic DNA (Homo sapiens) CpG-island No: 12909
  misc_feature (3)..(4): n is either a, c, g or t
  misc_feature (21)..(21): n is either a, c, g or t
  misc_feature (37)..(37): n is either a, c, g or t
  misc_feature (43)..(44): n is either a, c, g or t
  misc_feature (51)..(51): n is either a, c, g or t
  misc_feature (55)..(55): n is either a, c, g or t
  misc_feature (60)..(60): n is either a, c, g or t
  misc_feature (81)..(81): n is either a, c, g or t
  misc_feature (89)..(89): n is either a, c, g or t
  misc_feature (94)..(94): n is either a, c, g or t
  misc_feature (100)..(100): n is either a, c, g or t
  misc_feature (111)..(111): n is either a, c, g or t
  misc_feature (121)..(121): n is either a, c, g or t
  misc_feature (141)..(141): n is either a, c, g or t
  misc_feature (186)..(186): n is either a, c, g or t
  misc_feature (215)..(215): n is either a, c, g or t
  misc_feature (240)..(240): n is either a, c, g or t
  misc_feature (268)..(268): n is either a, c, g or t
  misc_feature (315)..(315): n is either a, c, g or t
  misc_feature (324)..(324): n is either a, c, g or t
  misc_feature (330)..(330): n is either a, c, g or t
  misc_feature (339)..(339): n is either a, c, g or t
  misc_feature (368)..(368): n is either a, c, g or t
  misc_feature (380)..(380): n is either a, c, g or t
  misc_feature (425)..(425): n is either a, c, g or t
  misc_feature (431)..(431): n is either a, c, g or t
  misc_feature (459)..(459): n is either a, c, g or t
  misc_feature (501)..(501): n is either a, c, g or t
  misc_feature (519)..(519): n is either a, c, g or t
  misc_feature (529)..(529): n is either a, c, g or t
  misc_feature (536)..(536): n is either a, c, g or t
  misc_feature (580)..(580): n is either a, c, g or t
  misc_feature (602)..(602): n is either a, c, g or t
  misc_feature (620)..(620): n is either a, c, g or t
  misc_feature (649)..(649): n is either a, c, g or t
  misc_feature (677)..(677): n is either a, c, g or t
  misc_feature (698)..(698): n is either a, c, g or t
  misc_feature (734)..(734): n is either a, c, g or t
  misc_feature (756)..(756): n is either a, c, g or t
  misc_feature (772)..(772): n is either a, c, g or t
  misc_feature (814)..(814): n is either a, c, g or t
  misc_feature (885)..(885): n is either a, c, g or t
  misc_feature (888)..(891): n is either a, c, g or t
  misc_feature (893)..(893): n is either a, c, g or t
  misc_feature (976)..(976): n is either a, c, g or t
  misc_feature (1011)..(1011): n is either a, c, g or t
  misc_feature (1014)..(1015): n is either a, c, g or t
  misc_feature (1017)..(1019): n is either a, c, g or t
  misc_feature (1022)..(1022): n is either a, c, g or t
  misc_feature (1057)..(1057): n is either a, c, g or t
  misc_feature (1131)..(1131): n is either a, c, g or t
  misc_feature (1167)..(1167): n is either a, c, g or t
  misc_feature (1685)..(1685): n is either a, c, g or t
ttnncgtttcgtagcggtcgnttttttacgtcgcgantcgtannttatttnttanggatnttattgtttgcgtcgacgttnattatttngcgangtcgtntagacgatttngacgcgatanttgttacgttcgtttttatngttttattcggttagtgcgatgatgtcggttcgattatattgttngtatagatgcgtattttagtcgacgagtnattacgatttttaagagtatattanggtcgacgtagtaattttattcgattantgtcgattcgtttagtagtatacgttcgcgtacgacgtattgcgcgngatatatanttcggnttcgtagantttcgtcgcgcggaattcgtacgttatantatcgtttcgancgatatcgcgcgtagcgtattttattacgcgatattattacgtanattgtnatcgtcgttcgtgcgatttcggcgtatnttcgtattcgagtcgtcgcgttttcgatattattcgttagtntagtcgttatagtatttngtcgtagtanagtcgtntatcgcgtaattagtacgcgtcgatatgttacgcgttgatatanacgcgcgtaattattcgcgcgnatagatatttttgacgantgttcgcgagagatacgcgacgcgtatancgtagtcgtatttgcgtcgtaattattnttcgtatatgatcgtagcgantcgttcgtataatttatatcggtatttatacgcganttatcgcgtatatgtgtcgatntttgcgtttacgttgnttcgcgtattcgcgcgatatgttacgtttatgtatcgtatantcgtcgcgttattcgatagcgtatcgttcgatatattttttcgttatgcgttacggattttttaatattanttnnnnantttatcgtatgcgttcgtaggtgttattagtgatcgtttagagtcgtcggtttttttatcgttagtttttcggagatttagancgacgttcgcgttattttcgtagttcgtcgcggtnatnntnnnagntatatcgtcgtgattcgttattcgtgatacgtcgntttatttaaattcgtttacgattttttttttagtcgcgcgatatagcgcgttatcgtcgttttatttgcgcgantattacgttatacgtacgtgtttttcgtatagcgtncggattattcgcgacgttcgcgtagtaattcgtttcgtttcgcggtattacgcgcgagtttcgcgcgattttttcgtatttttgcgcgatttttatatagttcgtcgcgattcgcgtacgacggttacgattttttagtattcgtagtaattttcgtcgtgtcgcgttttcgttatatttttatattcgtcgagtttcgcgcgattttcgtaatcgcgacgatcgattacgtagttttcggatcgcgttattcgttatacgcgttatattttcggaacgtttcgagattcgcgcgtttcgcgattcgtacgtatatcgtgtgttcgtatatattcgtattttttaagttgttttagtttcgtataacgtagatttttttacgttcgataatcgtcgttcgtttcgtttacgttcgatcgcgtaatcgcgcgattaatttagttgtttagatatttcgttatattttttgagatttcgcgtcgtacgcgatttcgttagtcgatcgcgtgatcgcggtnagcgtttcgaacgtcgagatattttcgcgcgttttcggttttcgtagttatcgatcgttcgtatcgttatcgattcgtcgttcggttacgattataatatttgcgatacgtcgtcgttatacgacgtttttttttcgttatttttatggttattattacgttcggttatcgcgattatattttgtattcggagcggtatgga

SEQ ID NO: 12910 - DNA, 1887 bp, Artificial Sequence
  chemically treated genomic DNA (Homo sapiens) CpG-island No: 12910
  misc_feature (203)..(203): n is either a, c, g or t
  misc_feature (721)..(721): n is either a, c, g or t
  misc_feature (757)..(757): n is either a, c, g or t
  misc_feature (831)..(831): n is either a, c, g or t
  misc_feature (866)..(866): n is either a, c, g or t
  misc_feature (869)..(871): n is either a, c, g or t
  misc_feature (873)..(874): n is either a, c, g or t
  misc_feature (877)..(877): n is either a, c, g or t
  misc_feature (912)..(912): n is either a, c, g or t
  misc_feature (995)..(995): n is either a, c, g or t
  misc_feature (997)..(1000): n is either a, c, g or t
  misc_feature (1003)..(1003): n is either a, c, g or t
  misc_feature (1074)..(1074): n is either a, c, g or t
  misc_feature (1116)..(1116): n is either a, c, g or t
  misc_feature (1132)..(1132): n is either a, c, g or t
  misc_feature (1154)..(1154): n is either a, c, g or t
  misc_feature (1190)..(1190): n is either a, c, g or t
  misc_feature (1211)..(1211): n is either a, c, g or t
  misc_feature (1239)..(1239): n is either a, c, g or t
  misc_feature (1268)..(1268): n is either a, c, g or t
  misc_feature (1286)..(1286): n is either a, c, g or t
  misc_feature (1308)..(1308): n is either a, c, g or t
  misc_feature (1352)..(1352): n is either a, c, g or t
  misc_feature (1359)..(1359): n is either a, c, g or t
  misc_feature (1369)..(1369): n is either a, c, g or t
  misc_feature (1387)..(1387): n is either a, c, g or t
  misc_feature (1429)..(1429): n is either a, c, g or t
  misc_feature (1457)..(1457): n is either a, c, g or t
  misc_feature (1463)..(1463): n is either a, c, g or t
  misc_feature (1508)..(1508): n is either a, c, g or t
  misc_feature (1520)..(1520): n is either a, c, g or t
  misc_feature (1549)..(1549): n is either a, c, g or t
  misc_feature (1558)..(1558): n is either a, c, g or t
  misc_feature (1564)..(1564): n is either a, c, g or t
  misc_feature (1573)..(1573): n is either a, c, g or t
  misc_feature (1620)..(1620): n is either a, c, g or t
  misc_feature (1648)..(1648): n is either a, c, g or t
  misc_feature (1673)..(1673): n is either a, c, g or t
  misc_feature (1702)..(1702): n is either a, c, g or t
  misc_feature (1747)..(1747): n is either a, c, g or t
  misc_feature (1767)..(1767): n is either a, c, g or t
  misc_feature (1777)..(1777): n is either a, c, g or t
  misc_feature (1788)..(1788): n is either a, c, g or t
  misc_feature (1794)..(1794): n is either a, c, g or t
  misc_feature (1799)..(1799): n is either a, c, g or t
  misc_feature (1807)..(1807): n is either a, c, g or t
  misc_feature (1828)..(1828): n is either a, c, g or t
  misc_feature (1833)..(1833): n is either a, c, g or t
  misc_feature (1837)..(1837): n is either a, c, g or t
  misc_feature (1844)..(1845): n is either a, c, g or t
  misc_feature (1851)..(1851): n is either a, c, g or t
  misc_feature (1867)..(1867): n is either a, c, g or t
  misc_feature (1884)..(1885): n is either a, c, g or t
tccataccgctccgaatacaaaatataatcgcgataaccgaacgtaataataaccataaaaataacgaaaaaaaaacgtcgtataacgacgacgtatcgcaaatattataatcgtaaccgaacgacgaatcgataacgatacgaacgatcgataactacgaaaaccgaaaacgcgcgaaaatatctcgacgttcgaaacgctnaccgcgatcacgcgatcgactaacgaaatcgcgtacgacgcgaaatctcaaaaaatataacgaaatatctaaacaactaaattaatcgcgcgattacgcgatcgaacgtaaacgaaacgaacgacgattatcgaacgtaaaaaaatctacgttatacgaaactaaaacaacttaaaaaatacgaatatatacgaacacacgatatacgtacgaatcgcgaaacgcgcgaatctcgaaacgttccgaaaatataacgcgtataacgaataacgcgatccgaaaactacgtaatcgatcgtcgcgattacgaaaatcgcgcgaaactcgacgaatataaaaatataacgaaaacgcgacacgacgaaaattactacgaatactaaaaaatcgtaaccgtcgtacgcgaatcgcgacgaactatataaaaatcgcgcaaaaatacgaaaaaatcgcgcgaaactcgcgcgtaataccgcgaaacgaaacgaattactacgcgaacgtcgcgaataatccgnacgctatacgaaaaacacgtacgtataacgtaatantcgcgcaaataaaacgacgataacgcgctatatcgcgcgactaaaaaaaaaatcgtaaacgaatttaaataaancgacgtatcacgaataacgaatcacgacgatatanctnnnannatnaccgcgacgaactacgaaaataacgcgaacgtcgntctaaatctccgaaaaactaacgataaaaaaaccgacgactctaaacgatcactaataacacctacgaacgcatacgataaantnnnnaantaatattaaaaaatccgtaacgcataacgaaaaaatatatcgaacgatacgctatcgaataacgcgacgantatacgatacataaacgtaacatatcgcgcgaatacgcgaancaacgtaaacgcaaanatcgacacatatacgcgataantcgcgtataaataccgatataaattatacgaacgantcgctacgatcatatacgaanaataattacgacgcaaatacgactacgntatacgcgtcgcgtatctctcgcgaacantcgtcaaaaatatctatncgcgcgaataattacgcgcgtntatatcaacgcgtaacatatcgacgcgtactaattacgcgatanacgactntactacgacnaaatactataacgactanactaacgaataatatcgaaaacgcgacgactcgaatacgaanatacgccgaaatcgcacgaacgacgatnacaatntacgtaataatatcgcgtaataaaatacgctacgcgcgatatcgntcgaaacgatantataacgtacgaattccgcgcgacgaaantctacgaanccgaantatatatcncgcgcaatacgtcgtacgcgaacgtatactactaaacgaatcgacantaatcgaataaaattactacgtcgaccntaatatactcttaaaaatcgtaatnactcgtcgactaaaatacgcatctatacnaacaatataatcgaaccgacatcatcgcactaaccgaataaaacnataaaaacgaacgtaacaantatcgcgtcnaaatcgtctanacgacntcgcnaaataatnaacgtcgacgcaaacaataanatccntaanaaataanntacgantcgcgacgtaaaaaancgaccgctacgaaacgnnaa

SEQ ID NO: 12911 - DNA, 1887 bp, Artificial Sequence
  chemically treated genomic DNA (Homo sapiens) CpG-island No: 12911
  misc_feature (203)..(203): n is either a, c, g or t
  misc_feature (721)..(721): n is either a, c, g or t
  misc_feature (757)..(757): n is either a, c, g or t
  misc_feature (831)..(831): n is either a, c, g or t
  misc_feature (866)..(866): n is either a, c, g or t
  misc_feature (869)..(871): n is either a, c, g or t
  misc_feature (873)..(874): n is either a, c, g or t
  misc_feature (877)..(877): n is either a, c, g or t
  misc_feature (912)..(912): n is either a, c, g or t
  misc_feature (995)..(995): n is either a, c, g or t
  misc_feature (997)..(1000): n is either a, c, g or t
  misc_feature (1003)..(1003): n is either a, c, g or t
  misc_feature (1074)..(1074): n is either a, c, g or t
  misc_feature (1116)..(1116): n is either a, c, g or t
  misc_feature (1132)..(1132): n is either a, c, g or t
  misc_feature (1154)..(1154): n is either a, c, g or t
  misc_feature (1190)..(1190): n is either a, c, g or t
  misc_feature (1211)..(1211): n is either a, c, g or t
  misc_feature (1239)..(1239): n is either a, c, g or t
  misc_feature (1268)..(1268): n is either a, c, g or t
  misc_feature (1286)..(1286): n is either a, c, g or t
  misc_feature (1308)..(1308): n is either a, c, g or t
  misc_feature (1352)..(1352): n is either a, c, g or t
  misc_feature (1359)..(1359): n is either a, c, g or t
  misc_feature (1369)..(1369): n is either a, c, g or t
  misc_feature (1387)..(1387): n is either a, c, g or t
  misc_feature (1429)..(1429): n is either a, c, g or t
  misc_feature (1457)..(1457): n is either a, c, g or t
  misc_feature (1463)..(1463): n is either a, c, g or t
  misc_feature (1508)..(1508): n is either a, c, g or t
  misc_feature (1520)..(1520): n is either a, c, g or t
  misc_feature (1549)..(1549): n is either a, c, g or t
  misc_feature (1558)..(1558): n is either a, c, g or t
  misc_feature (1564)..(1564): n is either a, c, g or t
  misc_feature (1573)..(1573): n is either a, c, g or t
  misc_feature (1620)..(1620): n is either a, c, g or t
  misc_feature (1648)..(1648): n is either a, c, g or t
  misc_feature (1673)..(1673): n is either a, c, g or t
  misc_feature (1702)..(1702): n is either a, c, g or t
  misc_feature (1747)..(1747): n is either a, c, g or t
  misc_feature (1767)..(1767): n is either a, c, g or t
  misc_feature (1777)..(1777): n is either a, c, g or t
  misc_feature (1788)..(1788): n is either a, c, g or t
  misc_feature (1794)..(1794): n is either a, c, g or t
  misc_feature (1799)..(1799): n is either a, c, g or t
  misc_feature (1807)..(1807): n is either a, c, g or t
  misc_feature (1828)..(1828): n is either a, c, g or t
  misc_feature (1833)..(1833): n is either a, c, g or t
  misc_feature (1837)..(1837): n is either a, c, g or t
  misc_feature (1844)..(1845): n is either a, c, g or t
  misc_feature (1851)..(1851): n is either a, c, g or t
  misc_feature (1867)..(1867): n is either a, c, g or t
  misc_feature (1884)..(1885): n is either a, c, g or t
tttatgtcgtttcgggtgtaagatgtgatcgcggtggtcgggcgtggtggtgattatgggaatgacggagaagaggcgtcgtgtggcggcggcgtgtcgtaggtgttgtaatcgtggtcgggcggcgggtcgatgacggtgcgaacggtcgatgattgcgagagtcgggagcgcgcggagatgtttcgacgttcggagcgttngtcgcgattacgcgatcgattggcgagatcgcgtgcgacgcgagattttaggggatatggcgaggtatttggataattgggttgatcgcgcgattgcgcgatcgggcgtgagcggggcgaacggcgattgtcgggcgtgggagagtttgcgttatgcgggattgggataatttggggaatgcggatatatgcggatatacggtgtacgtgcggatcgcgggacgcgcgggtttcggggcgtttcggagatgtggcgcgtatggcgggtggcgcggttcggggattacgtggtcgatcgtcgcgattacggagatcgcgcggaattcggcgaatatggagatatggcgagagcgcgatacggcggggattattgcggatgttggagggtcgtggtcgtcgtgcgcgaatcgcggcgaattgtgtgggaatcgcgtagaaatacggggagatcgcgcgagattcgcgcgtgatgtcgcgaaacgaggcggattgttgcgcggacgtcgcgggtgattcgngcgttgtgcgggagatacgtgcgtgtggcgtggtantcgcgtagatagggcggcgatagcgcgttgtatcgcgcgattgagaggggaatcgtggacgagtttgggtagancggcgtgttacgggtggcgagttacggcggtatanttnnnannatnatcgcgacgggttgcggaggtggcgcgggcgtcgntttggattttcgggggattggcggtggaaaggtcggcgattttgggcggttattggtggtatttgcggacgtatgcggtggantnnnnggntgatattgggagattcgtggcgtatagcggaggagtatatcgggcgatacgttgtcggatagcgcgacgantgtgcggtatatgggcgtgatatgtcgcgcggatgcgcgggntaacgtaggcgtagangtcggtatatgtgcgcgatgantcgcgtgtgagtgtcggtatggattatgcggacgantcgttgcgattatatgcggangatgattgcgacgtagatacggttacgntatacgcgtcgcgtatttttcgcgagtantcgttaggagtatttatncgcgcggatgattacgcgcgtntatattaacgcgtgatatgtcgacgcgtgttgattgcgcggtanacgattntgttgcggtngagtgttgtgacgattangttggcggatgatatcgggagcgcgacgattcgggtgcggangtacgtcgggatcgtacggacggcggtnatagtntgcgtggtgatatcgcgtggtgggatacgttgcgcgcgatgtcgntcggggcgatantgtgacgtgcggatttcgcgcggcgggantttacgagntcggantatatattncgcgtaatacgtcgtgcgcgggcgtatattattgggcggatcgatantagtcgggtgagattgttacgtcggttntgatatatttttggggatcgtgatnattcgtcggttaggatacgtatttgtgtnggtagtataatcgggtcggtattatcgtattgatcgggtagagtngtgagggcgggcgtaataantatcgcgttnggatcgtttgngcggtntcgtnggatgatnagcgtcggcgtaggtagtagnatttntggngggtganntacgantcgcgacgtagaggancgatcgttgcggggcgnnga

SEQ ID NO: 12912 - DNA, 1887 bp, Artificial Sequence
  chemically treated genomic DNA (Homo sapiens) CpG-island No: 12912
  misc_feature (3)..(4): n is either a, c, g or t
  misc_feature (21)..(21): n is either a, c, g or t
  misc_feature (37)..(37): n is either a, c, g or t
  misc_feature (43)..(44): n is either a, c, g or t
  misc_feature (51)..(51): n is either a, c, g or t
  misc_feature (55)..(55): n is either a, c, g or t
  misc_feature (60)..(60): n is either a, c, g or t
  misc_feature (81)..(81): n is either a, c, g or t
  misc_feature (89)..(89): n is either a, c, g or t
  misc_feature (94)..(94): n is either a, c, g or t
  misc_feature (100)..(100): n is either a, c, g or t
  misc_feature (111)..(111): n is either a, c, g or t
  misc_feature (121)..(121): n is either a, c, g or t
  misc_feature (141)..(141): n is either a, c, g or t
  misc_feature (186)..(186): n is either a, c, g or t
  misc_feature (215)..(215): n is either a, c, g or t
  misc_feature (240)..(240): n is either a, c, g or t
  misc_feature (268)..(268): n is either a, c, g or t
  misc_feature (315)..(315): n is either a, c, g or t
  misc_feature (324)..(324): n is either a, c, g or t
  misc_feature (330)..(330): n is either a, c, g or t
  misc_feature (339)..(339): n is either a, c, g or t
  misc_feature (368)..(368): n is either a, c, g or t
  misc_feature (380)..(380): n is either a, c, g or t
  misc_feature (425)..(425): n is either a, c, g or t
  misc_feature (431)..(431): n is either a, c, g or t
  misc_feature (459)..(459): n is either a, c, g or t
  misc_feature (501)..(501): n is either a, c, g or t
  misc_feature (519)..(519): n is either a, c, g or t
  misc_feature (529)..(529): n is either a, c, g or t
  misc_feature (536)..(536): n is either a, c, g or t
  misc_feature (580)..(580): n is either a, c, g or t
  misc_feature (602)..(602): n is either a, c, g or t
  misc_feature (620)..(620): n is either a, c, g or t
  misc_feature (649)..(649): n is either a, c, g or t
  misc_feature (677)..(677): n is either a, c, g or t
  misc_feature (698)..(698): n is either a, c, g or t
  misc_feature (734)..(734): n is either a, c, g or t
  misc_feature (756)..(756): n is either a, c, g or t
  misc_feature (772)..(772): n is either a, c, g or t
  misc_feature (814)..(814): n is either a, c, g or t
  misc_feature (885)..(885): n is either a, c, g or t
  misc_feature (888)..(891): n is either a, c, g or t
  misc_feature (893)..(893): n is either a, c, g or t
  misc_feature (976)..(976): n is either a, c, g or t
  misc_feature (1011)..(1011): n is either a, c, g or t
  misc_feature (1014)..(1015): n is either a, c, g or t
  misc_feature (1017)..(1019): n is either a, c, g or t
  misc_feature (1022)..(1022): n is either a, c, g or t
  misc_feature (1057)..(1057): n is either a, c, g or t
  misc_feature (1131)..(1131): n is either a, c, g or t
  misc_feature (1167)..(1167): n is either a, c, g or t
  misc_feature (1685)..(1685): n is either a, c, g or t
tcnncgccccgcaacgatcgntcctctacgtcgcgantcgtanntcacccnccanaaatnctactacctacgccgacgctnatcatccnacganaccgcncaaacgatccnaacgcgatanttattacgcccgccctcacnactctacccgatcaatacgataataccgacccgattatactaccnacacaaatacgtatcctaaccgacgaatnatcacgatccccaaaaatatatcanaaccgacgtaacaatctcacccgactantatcgatccgcccaataatatacgcccgcgcacgacgtattacgcgnaatatatantccganctcgtaaantcccgccgcgcgaaatccgcacgtcacantatcgccccgancgacatcgcgcgcaacgtatcccaccacgcgatatcaccacgcanactatnaccgccgtccgtacgatcccgacgtacntccgcacccgaatcgtcgcgctcccgatatcatccgccaacntaatcgtcacaacactcnaccgcaacanaatcgtntaccgcgcaatcaacacgcgtcgacatatcacgcgttaatatanacgcgcgtaatcatccgcgcgnataaatactcctaacgantactcgcgaaaaatacgcgacgcgtatancgtaaccgtatctacgtcgcaatcatcntccgcatataatcgcaacgantcgtccgcataatccataccgacactcacacgcgantcatcgcgcacatataccgacntctacgcctacgttancccgcgcatccgcgcgacatatcacgcccatataccgcacantcgtcgcgctatccgacaacgtatcgcccgatatactcctccgctatacgccacgaatctcccaatatcanccnnnnantccaccgcatacgtccgcaaataccaccaataaccgcccaaaatcgccgacctttccaccgccaatcccccgaaaatccaaancgacgcccgcgccacctccgcaacccgtcgcgatnatnntnnnaantataccgccgtaactcgccacccgtaacacgccgntctacccaaactcgtccacgattcccctctcaatcgcgcgatacaacgcgctatcgccgccctatctacgcgantaccacgccacacgcacgtatctcccgcacaacgcncgaatcacccgcgacgtccgcgcaacaatccgcctcgtttcgcgacatcacgcgcgaatctcgcgcgatctccccgtatttctacgcgattcccacacaattcgccgcgattcgcgcacgacgaccacgaccctccaacatccgcaataatccccgccgtatcgcgctctcgccatatctccatattcgccgaattccgcgcgatctccgtaatcgcgacgatcgaccacgtaatccccgaaccgcgccacccgccatacgcgccacatctccgaaacgccccgaaacccgcgcgtcccgcgatccgcacgtacaccgtatatccgcatatatccgcattccccaaattatcccaatcccgcataacgcaaactctcccacgcccgacaatcgccgttcgccccgctcacgcccgatcgcgcaatcgcgcgatcaacccaattatccaaatacctcgccatatcccctaaaatctcgcgtcgcacgcgatctcgccaatcgatcgcgtaatcgcgacnaacgctccgaacgtcgaaacatctccgcgcgctcccgactctcgcaatcatcgaccgttcgcaccgtcatcgacccgccgcccgaccacgattacaacacctacgacacgccgccgccacacgacgcctcttctccgtcattcccataatcaccaccacgcccgaccaccgcgatcacatcttacacccgaaacgacataaa

SEQ ID NO: 12913 - DNA, 764 bp, Artificial Sequence
  chemically treated genomic DNA (Homo sapiens) CpG-island No: 12913
ggttcgcggttggtaacgttcgttgggtttcgggtggggttttagggaggtcggggcggatcgcggcgttcggatcgtcgaattttgtttagttttaggcgagcgcgtgtgtagcgggagtcgtttttttcggcggtagttcggtttggttgttttttttcgcgggcgcgcgggtttcggagtcggcggtatcggggaagtttttttcgggcgcggtttttcggagaggaataaaggcggcgttttggtcgcgttgttatcgtcgcgttcgtaaggttagcgcgttcgtttagagttcgagacgtcggttcgtgtttcgttatttatttgtagttttcgttgcgcgtttcgtcggttcggttttgatttatttttcgtttcggagcgagacgtaaataattttcgttttttgcgtttattggtttcggcggcgaggggcgggtatatttgtttcggagtttcgggagagggggcgggagtcgggtgataaagttattgtcgagaggttttaggaattgttagttttaatttaacgtttttaatggttagtttttaagcggttggagataaagttcgcgcgtatattggattcgggtgggaggtggtatcgtaggtcgcgttgatcggaaagtaggttcgtgttatcgtttgcgtcggaatttgcgggatcggatcgagagttttttcggtaagttgattggttgggatagtaggattaggtttgttaagaagagttacgggcgggtacgtattgtttattggtt

SEQ ID NO: 12914 - DNA, 764 bp, Artificial Sequence
  chemically treated genomic DNA (Homo sapiens) CpG-island No: 12914
aaccaataaacaatacgtacccgcccgtaactcttcttaacaaacctaatcctactatcccaaccaatcaacttaccgaaaaaactctcgatccgatcccgcaaattccgacgcaaacgataacacgaacctactttccgatcaacgcgacctacgataccacctcccacccgaatccaatatacgcgcgaactttatctccaaccgcttaaaaactaaccattaaaaacgttaaattaaaactaacaattcctaaaacctctcgacaataactttatcacccgactcccgccccctctcccgaaactccgaaacaaatatacccgcccctcgccgccgaaaccaataaacgcaaaaaacgaaaattatttacgtctcgctccgaaacgaaaaataaatcaaaaccgaaccgacgaaacgcgcaacgaaaactacaaataaataacgaaacacgaaccgacgtctcgaactctaaacgaacgcgctaaccttacgaacgcgacgataacaacgcgaccaaaacgccgcctttattcctctccgaaaaaccgcgcccgaaaaaaacttccccgataccgccgactccgaaacccgcgcgcccgcgaaaaaaaacaaccaaaccgaactaccgccgaaaaaaacgactcccgctacacacgcgctcgcctaaaactaaacaaaattcgacgatccgaacgccgcgatccgccccgacctccctaaaaccccacccgaaacccaacgaacgttaccaaccgcgaacc

SEQ ID NO: 12915 - DNA, 764 bp, Artificial Sequence
  chemically treated genomic DNA (Homo sapiens) CpG-island No: 12915
aattaatgggtagtgcgtgttcgttcgtggttttttttgataggtttaattttgttgttttagttaattagtttgtcggaggagttttcgattcggtttcgtaggtttcggcgtagacgatgatacggatttatttttcggttaacgcggtttgcggtattattttttattcgggtttaatgtgcgcgcgagttttgtttttaatcgtttgggaattgattattaggaacgttggattaggattgatagtttttgaaatttttcggtaatagttttgttattcgattttcgttttttttttcgaagtttcgagataggtgtgttcgtttttcgtcgtcggagttaatgggcgtagggggcggggattgtttacgtttcgtttcggggcggaaagtgggttagggtcgggtcggcggagcgcgtagcgggggttgtaggtgagtggcggggtacgggtcgacgtttcgggttttgggcgggcgcgttgattttgcgggcgcggcggtagtagcgcggttagggcgtcgtttttgttttttttcggagggtcgcgttcgagagaggttttttcggtgtcgtcgatttcggaattcgcgcgttcgcgggagggaatagttaggtcgggttgtcgtcggggagggcggttttcgttgtatacgcgttcgtttggggttgggtagggttcggcggttcgggcgtcgcgattcgtttcggtttttttggaattttattcggggtttagcgggcgttgttagtcgcgagtt

SEQ ID NO: 12916 - DNA, 764 bp, Artificial Sequence
  chemically treated genomic DNA (Homo sapiens) CpG-island No: 12916
aactcgcgactaacaacgcccgctaaaccccgaataaaattccaaaaaaaccgaaacgaatcgcgacgcccgaaccgccgaaccctacccaaccccaaacgaacgcgtatacaacgaaaaccgccctccccgacgacaacccgacctaactattccctcccgcgaacgcgcgaattccgaaatcgacgacaccgaaaaaacctctctcgaacgcgaccctccgaaaaaaaacaaaaacgacgccctaaccgcgctactaccgccgcgcccgcaaaatcaacgcgcccgcccaaaacccgaaacgtcgacccgtaccccgccactcacctacaacccccgctacgcgctccgccgacccgaccctaacccactttccgccccgaaacgaaacgtaaacaatccccgccccctacgcccattaactccgacgacgaaaaacgaacacacctatctcgaaacttcgaaaaaaaaaacgaaaatcgaataacaaaactattaccgaaaaatttcaaaaactatcaatcctaatccaacgttcctaataatcaattcccaaacgattaaaaacaaaactcgcgcgcacattaaacccgaataaaaaataataccgcaaaccgcgttaaccgaaaaataaatccgtatcatcgtctacgccgaaacctacgaaaccgaatcgaaaactcctccgacaaactaattaactaaaacaacaaaattaaacctatcaaaaaaaaccacgaacgaacacgcactacccattaatt

SEQ ID NO: 12917 - DNA, 634 bp, Artificial Sequence
  chemically treated genomic DNA (Homo sapiens) CpG-island No: 12917
tcgattgggttacgttgggagagtgttttcgttttagttaatgggcggtagttatagagcgttttgttcgtagagtcgggcgcggggtttttataaaaggcgttcgaagcgggggcgcgcgttttagagacgtgaattgtcgttgtagagattgcgggcggttgagacgtcgtttgtttggtatttatgagcgtagcggagtttcgatatcgtcgtcgtcgttatggagttcgagatcgaattcgagttcgttacgtttttggtgaagagttttaattagcgttatcgcgatttggagttgagtggcgatcgcggttggagtgtgggttattttaaggtttatttgagtcgcgtttatttcgagcgttcggtgagagcggtttcgatttttcgtttttatgttgtggtttttcgttttttgttggggatgttacgttcggttgttttgttttgtggttttttttcgttgacggttgcgatcgttcggtcgggttattttttttaaggttgtggttttttttttttttgtttcgtcgacgcgggcgttttttttgttgtttaatagtcgttaattattattaatttgattttgggcgagttattttatttttttaagttttgttttttttttagt

SEQ ID NO: 12918 - DNA, 634 bp, Artificial Sequence
  chemically treated genomic DNA (Homo sapiens) CpG-island No: 12918
actaaaaaaaaaacaaaacttaaaaaaataaaataactcgcccaaaatcaaattaataataattaacgactattaaacaacaaaaaaaacgcccgcgtcgacgaaacaaaaaaaaaaaaaaccacaaccttaaaaaaaataacccgaccgaacgatcgcaaccgtcaacgaaaaaaaaccacaaaacaaaacaaccgaacgtaacatccccaacaaaaaacgaaaaaccacaacataaaaacgaaaaatcgaaaccgctctcaccgaacgctcgaaataaacgcgactcaaataaaccttaaaataacccacactccaaccgcgatcgccactcaactccaaatcgcgataacgctaattaaaactcttcaccaaaaacgtaacgaactcgaattcgatctcgaactccataacgacgacgacgatatcgaaactccgctacgctcataaataccaaacaaacgacgtctcaaccgcccgcaatctctacaacgacaattcacgtctctaaaacgcgcgcccccgcttcgaacgccttttataaaaaccccgcgcccgactctacgaacaaaacgctctataactaccgcccattaactaaaacgaaaacactctcccaacgtaacccaatcga

SEQ ID NO: 12919 - DNA, 634 bp, Artificial Sequence
  chemically treated genomic DNA (Homo sapiens) CpG-island No: 12919
gttggggaagaaatagggtttggaggggtgaaatgattcgtttaaggttaggttgatgataattgacggttattgggtaatagaaggggcgttcgcgtcggcggggtaaggaaaggggagattatagttttggggaaggtgattcggtcgagcgatcgtagtcgttagcgggaggaggttataggatagggtagtcgaacgtggtatttttagtagagggcggggggttatagtataggggcgggaagtcggggtcgtttttatcggacgttcggggtagacgcggtttaggtgggttttgaggtggtttatattttagtcgcggtcgttatttagttttaagtcgcggtggcgttggttggggttttttattaggagcgtgacgggttcgggttcggtttcggattttatggcggcggcggcggtgtcggggtttcgttgcgtttataggtgttaggtaggcggcgttttagtcgttcgtaatttttgtaacgatagtttacgtttttggggcgcgcgttttcgtttcgggcgttttttatagaagtttcgcgttcggttttgcggatagaacgttttgtggttgtcgtttattggttgaggcggaggtatttttttaacgtggtttaatcgg

SEQ ID NO: 12920 - DNA, 634 bp, Artificial Sequence
  chemically treated genomic DNA (Homo sapiens) CpG-island No: 12920
ccgattaaaccacgttaaaaaaatacctccgcctcaaccaataaacgacaaccacaaaacgttctatccgcaaaaccgaacgcgaaacttctataaaaaacgcccgaaacgaaaacgcgcgccccaaaaacgtaaactatcgttacaaaaattacgaacgactaaaacgccgcctacctaacacctataaacgcaacgaaaccccgacaccgccgccgccgccataaaatccgaaaccgaacccgaacccgtcacgctcctaataaaaaaccccaaccaacgccaccgcgacttaaaactaaataacgaccgcgactaaaatataaaccacctcaaaacccacctaaaccgcgtctaccccgaacgtccgataaaaacgaccccgacttcccgcccctatactataaccccccgccctctactaaaaataccacgttcgactaccctatcctataacctcctcccgctaacgactacgatcgctcgaccgaatcaccttccccaaaactataatctcccctttccttaccccgccgacgcgaacgccccttctattacccaataaccgtcaattatcatcaacctaaccttaaacgaatcatttcacccctccaaaccctatttcttccccaac

SEQ ID NO: 12921 - DNA, 999 bp, Artificial Sequence
  chemically treated genomic DNA (Homo sapiens) CpG-island No: 12921
gggcgttattttaaaagaaattttttcggttaattagaaggttaggaacggttcggtttttttttttgagaagtaataaaaaggcgtttttgttaaggttttcggtcggattcggagtataggaagtacgtaagttatttataagcgaggggattaagaggcggtgtagagtgaatgaaagttttagagtcgaagtgaattggcggagttttaggcggttttgtttaatgcgaggtgcgttgttgtttagttaatattttcggtagagttaaagtatttttttttgcgagtgtatggcgatttgcgttcgataaggcgtagcgttaagaagaatttcggtttagtaggcgcgcgtttcggatagcgtcgggtttagggtatggatagagttagttgggcgcgtagagagcgtagcggattcgggcggtaggagcgttgagttagataaaggtttcggagttgcgtttgttttcgggagtcgggttttaggcgttgggcgtcgaggttgcggaatttcgtcgggggtagtttcggtcggttttttttttcgtcggttggtttcgagttttcggatttgttttgttcgttttttttcgggtttgggaatttgtcgaggcgatttaggcggtttcggcggggatcgggagttcgaggttcgcggcgcgtttgtcgggttaggagttagggagcgtcgtaagtttttaaggcgcgtgcgaggattcggcgtgtagtgtttcgagttgggttgggcgtcgagagtatgggtagcgattcgagcgcgttcggacggtcgggttggacgggtagttttttcggcgatcgggaggaggcggcgcggtcgcgattgttgtcgttgtttttggtgtttttgggttgtttgggttttggcgtagcggtcgaagacgcggaggtttatgtcgaggtaagattttcgttttgttttttggttgcgggttgggggtttggagggagaggcgttacgttcgtaggttgggattt

SEQ ID NO: 12922 - DNA, 999 bp, Artificial Sequence
  chemically treated genomic DNA (Homo sapiens) CpG-island No: 12922
aaatcccaacctacgaacgtaacgcctctccctccaaacccccaacccgcaaccaaaaaacaaaacgaaaatcttacctcgacataaacctccgcgtcttcgaccgctacgccaaaacccaaacaacccaaaaacaccaaaaacaacgacaacaatcgcgaccgcgccgcctcctcccgatcgccgaaaaaactacccgtccaacccgaccgtccgaacgcgctcgaatcgctacccatactctcgacgcccaacccaactcgaaacactacacgccgaatcctcgcacgcgccttaaaaacttacgacgctccctaactcctaacccgacaaacgcgccgcgaacctcgaactcccgatccccgccgaaaccgcctaaatcgcctcgacaaattcccaaacccgaaaaaaaacgaacaaaacaaatccgaaaactcgaaaccaaccgacgaaaaaaaaaaccgaccgaaactacccccgacgaaattccgcaacctcgacgcccaacgcctaaaacccgactcccgaaaacaaacgcaactccgaaacctttatctaactcaacgctcctaccgcccgaatccgctacgctctctacgcgcccaactaactctatccataccctaaacccgacgctatccgaaacgcgcgcctactaaaccgaaattcttcttaacgctacgccttatcgaacgcaaatcgccatacactcgcaaaaaaaaatactttaactctaccgaaaatattaactaaacaacaacgcacctcgcattaaacaaaaccgcctaaaactccgccaattcacttcgactctaaaactttcattcactctacaccgcctcttaatcccctcgcttataaataacttacgtacttcctatactccgaatccgaccgaaaaccttaacaaaaacgcctttttattacttctcaaaaaaaaaaaccgaaccgttcctaaccttctaattaaccgaaaaaatttcttttaaaataacgccc

SEQ ID NO: 12923 - DNA, 999 bp, Artificial Sequence
  chemically treated genomic DNA (Homo sapiens) CpG-island No: 12923
aagttttagtttgcggacgtggcgtttttttttttaagtttttagttcgtagttaaagggtagggcgggggttttatttcggtatggattttcgcgttttcggtcgttacgttaaggtttaggtagtttagaagtattaggagtagcggtagtagtcgcggtcgcgtcgttttttttcggtcgtcgaggaggttgttcgtttagttcggtcgttcgggcgcgttcgggtcgttgtttatgttttcggcgtttagtttagttcggaatattgtacgtcggattttcgtacgcgttttggaaatttgcgacgttttttggtttttggttcggtaggcgcgtcgcggatttcgggttttcggttttcgtcggagtcgtttaggtcgtttcggtaaatttttaagttcgaggagaagcgggtagggtaggttcgggagttcggaattagtcggcgggaaagggggtcgatcggagttgttttcggcgaggtttcgtagtttcggcgtttagcgtttggggttcggttttcgagagtaagcgtaatttcggagtttttgtttggtttagcgtttttgtcgttcgggttcgttgcgttttttgcgcgtttagttgattttgtttatgttttgggttcggcgttgttcggagcgcgcgtttattggatcgggattttttttgacgttgcgttttgtcgggcgtaggtcgttatgtattcgtaggaagaagtattttgattttgtcgagagtattagttagatagtaacgtatttcgtattgagtagggtcgtttaaggtttcgttaatttatttcggttttggagtttttatttattttatatcgttttttggttttttcgtttataaatggtttacgtgttttttatgtttcggattcggtcgggaattttggtaggggcgtttttttattgttttttaagagggggaatcgggtcgtttttggttttttggttggtcgggggggttttttttgaggtaacgttt

SEQ ID NO: 12924 - DNA, 999 bp, Artificial Sequence
  chemically treated genomic DNA (Homo sapiens) CpG-island No: 12924
aaacgttacctcaaaaaaaacccccccgaccaaccaaaaaaccaaaaacgacccgattccccctcttaaaaaacaataaaaaaacgcccctaccaaaattcccgaccgaatccgaaacataaaaaacacgtaaaccatttataaacgaaaaaaccaaaaaacgatataaaataaataaaaactccaaaaccgaaataaattaacgaaaccttaaacgaccctactcaatacgaaatacgttactatctaactaatactctcgacaaaatcaaaatacttcttcctacgaatacataacgacctacgcccgacaaaacgcaacgtcaaaaaaaatcccgatccaataaacgcgcgctccgaacaacgccgaacccaaaacataaacaaaatcaactaaacgcgcaaaaaacgcaacgaacccgaacgacaaaaacgctaaaccaaacaaaaactccgaaattacgcttactctcgaaaaccgaaccccaaacgctaaacgccgaaactacgaaacctcgccgaaaacaactccgatcgaccccctttcccgccgactaattccgaactcccgaacctaccctacccgcttctcctcgaacttaaaaatttaccgaaacgacctaaacgactccgacgaaaaccgaaaacccgaaatccgcgacgcgcctaccgaaccaaaaaccaaaaaacgtcgcaaatttccaaaacgcgtacgaaaatccgacgtacaatattccgaactaaactaaacgccgaaaacataaacaacgacccgaacgcgcccgaacgaccgaactaaacgaacaacctcctcgacgaccgaaaaaaaacgacgcgaccgcgactactaccgctactcctaatacttctaaactacctaaaccttaacgtaacgaccgaaaacgcgaaaatccataccgaaataaaacccccgccctaccctttaactacgaactaaaaacttaaaaaaaaaaacgccacgtccgcaaactaaaactt

SEQ ID NO: 12925 - DNA, 543 bp, Artificial Sequence
  chemically treated genomic DNA (Homo sapiens) CpG-island No: 12925
  misc_feature (338)..(338): n is either a, c, g or t
gtcgcggcggcggtattgtgttgcgcgttgtgtttttgtaataaggttacgtttaggaagcgtttttcgtattatatatatttgaattgttgttcgcgggcgtgtacgttttggtgtttgttgagatgttttcgttgtttgaaggttttgtcgtagttggggtatttgtagggtttttcgtttgtgtgtattcgtcggtgtcgttgtaggtttgacgcgtatttgaagcgtttttcgtagtttgggtatttgagtggtttttcgcgggtcggatcgtagcggtgttgtacgaattcggaagaggagaagaagcggcgttcgtaaagcgtgtagcgtangggtttttttgtcgtcgtatagtgggttagttggtgtttttgtagggtcgacgcgcgtttgtaggttttgttgtatatagggtatttgaagggtcgttcggtcgcgtcgggtaggtatttgtgtcgtagtagttcggtagattggttaaagtttttttggtatacggggtatttgaagagagtttcgagggtgtgtacgtgttgg

SEQ ID NO: 12926 - DNA, 543 bp, Artificial Sequence
  chemically treated genomic DNA (Homo sapiens) CpG-island No: 12926
  misc_feature (206)..(206): n is either a, c, g or t
ccaacacgtacacaccctcgaaactctcttcaaataccccgtataccaaaaaaactttaaccaatctaccgaactactacgacacaaatacctacccgacgcgaccgaacgacccttcaaataccctatatacaacaaaacctacaaacgcgcgtcgaccctacaaaaacaccaactaacccactatacgacgacaaaaaaacccntacgctacacgctttacgaacgccgcttcttctcctcttccgaattcgtacaacaccgctacgatccgacccgcgaaaaaccactcaaatacccaaactacgaaaaacgcttcaaatacgcgtcaaacctacaacgacaccgacgaatacacacaaacgaaaaaccctacaaataccccaactacgacaaaaccttcaaacaacgaaaacatctcaacaaacaccaaaacgtacacgcccgcgaacaacaattcaaatatatataatacgaaaaacgcttcctaaacgtaaccttattacaaaaacacaacgcgcaacacaataccgccgccgcgac

SEQ ID NO: 12927 - DNA, 543 bp, Artificial Sequence
  chemically treated genomic DNA (Homo sapiens) CpG-island No: 12927
  misc_feature (206)..(206): n is either a, c, g or t
ttagtacgtgtatattttcgagattttttttaagtgtttcgtgtgttagaaaggttttgattaatttgtcgagttgttgcggtataagtgtttgttcggcgcggtcgagcggttttttaagtgttttgtgtgtaataaggtttataagcgcgcgtcggttttgtagaagtattagttggtttattgtgcggcggtagagaagtttntgcgttgtacgttttgcgaacgtcgtttttttttttttttcgagttcgtgtagtatcgttgcgattcggttcgcgagaagttatttaagtgtttagattgcgagaaacgttttaagtacgcgttagatttgtagcggtatcggcgggtatatataggcgagaagttttataagtgttttaattgcgataaggtttttaagtagcgggagtattttaataagtattagggcgtgtacgttcgcgagtagtagtttaagtgtgtatggtgcggggagcgttttttagacgtggttttgttgtaggagtatagcgcgtagtatagtgtcgtcgtcgcggt

SEQ ID NO: 12928 - DNA, 543 bp, Artificial Sequence
  chemically treated genomic DNA (Homo sapiens) CpG-island No: 12928
  misc_feature (338)..(338): n is either a, c, g or t
accgcgacgacgacactatactacgcgctatactcctacaacaaaaccacgtctaaaaaacgctccccgcaccatacacacttaaactactactcgcgaacgtacacgccctaatacttattaaaatactcccgctacttaaaaaccttatcgcaattaaaacacttataaaacttctcgcctatatatacccgccgataccgctacaaatctaacgcgtacttaaaacgtttctcgcaatctaaacacttaaataacttctcgcgaaccgaatcgcaacgatactacacgaactcgaaaaaaaaaaaaaaacgacgttcgcaaaacgtacaacgcanaaacttctctaccgccgcacaataaaccaactaatacttctacaaaaccgacgcgcgcttataaaccttattacacacaaaacacttaaaaaaccgctcgaccgcgccgaacaaacacttataccgcaacaactcgacaaattaatcaaaacctttctaacacacgaaacacttaaaaaaaatctcgaaaatatacacgtactaa

SEQ ID NO: 12929 - DNA, 513 bp, Artificial Sequence
  chemically treated genomic DNA (Homo sapiens) CpG-island No: 12929
gaggttttatagcgtttcgacgtttttattttggcgtttaagttttagtttggattttgggggcggaatcggcgcgatttggtcgattttattttcgagacgttttagcgttttattttagagtagttgtagtagttgtatttcggtaatcgttcgcggtaagtttttcgagtttttcgcgttattttcgcggttttattcggtggtttaggtttttatcgggatattttcgcggtttaaaagtttatagttaatcggagcgggcgatttcggcgtgagatttcgtttttggaggatttggtagttaattagagtgaagattcgcgaaattagcggttgagtaagaatgggcggtattagtttagtatttcgttttacgcggtagtcgcggttaattagagtcgtgttcgtcgaggcgtttcgcgttgggattattcgcgcgtttatgtgagtgttaatatttagacgtacgcgtattggcgtatcgagtttaaatttttttttatatatttt

SEQ ID NO: 12930 - DNA, 513 bp, Artificial Sequence
  chemically treated genomic DNA (Homo sapiens) CpG-island No: 12930
aaaatatataaaaaaaaatttaaactcgatacgccaatacgcgtacgtctaaatattaacactcacataaacgcgcgaataatcccaacgcgaaacgcctcgacgaacacgactctaattaaccgcgactaccgcgtaaaacgaaatactaaactaataccgcccattcttactcaaccgctaatttcgcgaatcttcactctaattaactaccaaatcctccaaaaacgaaatctcacgccgaaatcgcccgctccgattaactataaacttttaaaccgcgaaaatatcccgataaaaacctaaaccaccgaataaaaccgcgaaaataacgcgaaaaactcgaaaaacttaccgcgaacgattaccgaaatacaactactacaactactctaaaataaaacgctaaaacgtctcgaaaataaaatcgaccaaatcgcgccgattccgcccccaaaatccaaactaaaacttaaacgccaaaataaaaacgtcgaaacgctataaaacctc

SEQ ID NO: 12931 - DNA, 513 bp, Artificial Sequence
  chemically treated genomic DNA (Homo sapiens) CpG-island No: 12931
gggatatgtgagaggagatttaagttcgatgcgttagtgcgcgtgcgtttgagtgttggtatttatataggcgcgcgagtagttttagcgcgaggcgtttcggcgggtacggttttgattggtcgcgattgtcgcgtggggcgggatgttgggttggtatcgtttatttttgtttagtcgttggtttcgcgggtttttattttggttggttgttagattttttaggggcggggttttacgtcgaagtcgttcgtttcgattggttgtgggtttttgagtcgcggaagtgtttcggtaagggtttgggttatcgagtgaggtcgcggggatgacgcggggggttcgggaggtttgtcgcgagcggttgtcgagatgtagttgttgtagttgttttgagataaggcgttgaagcgtttcggaggtgaagtcggttaaatcgcgtcggtttcgtttttaggatttaaattgggatttaagcgttagagtgagagcgtcgaaacgttgtgaggtttt

SEQ ID NO: 12932 - DNA, 513 bp, Artificial Sequence
  chemically treated genomic DNA (Homo sapiens) CpG-island No: 12932
aaaacctcacaacgtttcgacgctctcactctaacgcttaaatcccaatttaaatcctaaaaacgaaaccgacgcgatttaaccgacttcacctccgaaacgcttcaacgccttatctcaaaacaactacaacaactacatctcgacaaccgctcgcgacaaacctcccgaaccccccgcgtcatccccgcgacctcactcgataacccaaacccttaccgaaacacttccgcgactcaaaaacccacaaccaatcgaaacgaacgacttcgacgtaaaaccccgcccctaaaaaatctaacaaccaaccaaaataaaaacccgcgaaaccaacgactaaacaaaaataaacgataccaacccaacatcccgccccacgcgacaatcgcgaccaatcaaaaccgtacccgccgaaacgcctcgcgctaaaactactcgcgcgcctatataaataccaacactcaaacgcacgcgcactaacgcatcgaacttaaatctcctctcacatatccc

SEQ ID NO: 12933 - DNA, 764 bp, Artificial Sequence
  chemically treated genomic DNA (Homo sapiens) CpG-island No: 12933
gtcgggttgaatttatcgcgcggatcggtagggggagcggcggcgaagatagcgttagatagcgggttttagagatcgtagcgcgcggcgtggcgtagggtttcgtcggttattgatttaaggcgcggcggcgcggagttcgagaggcgttagggattgggcggtagcgcggtttcggagtttggttcggatattttcgcgattcgtggtaggagttcggatttaaataaaggcgggcggcgaataaaaggcggcggcggagcggagtgttcgggttgcgagttgaggattgggattcgcgcgtagtttttcgcggtttgtttgttttggagcggagggggagttttagttttttgcggtttcgagaagtttttttttgcgattttcgcgaggagacgagtttgcgtagcgtggtggtcgtcgtttttcgattttttgcgtattttttttcgcgtcggcggtttagtttagtttcgttcggtcggtcgaggtgagtgtacggtcgcggggcgttattcgggtttggtttcggggttgggggatgtattgttaggaggagggggaagtttttcgcgtcgttcgtatttcgatttgtttggcgtcgcgcgcgaagttttttcgttttttagttagttcgggatgcgggtttcggagtttttcgggaaagacggttaggggtggatagaatttaagtttgttttttacgatcgggttttagtttcgtattattttttcgcgggattgtagtatttttggtcggttaa

SEQ ID NO: 12934 - DNA, 764 bp, Artificial Sequence
  chemically treated genomic DNA (Homo sapiens) CpG-island No: 12934
ttaaccgaccaaaaatactacaatcccgcgaaaaaataatacgaaactaaaacccgatcgtaaaaaacaaacttaaattctatccacccctaaccgtctttcccgaaaaactccgaaacccgcatcccgaactaactaaaaaacgaaaaaacttcgcgcgcgacgccaaacaaatcgaaatacgaacgacgcgaaaaacttccccctcctcctaacaatacatcccccaaccccgaaaccaaacccgaataacgccccgcgaccgtacactcacctcgaccgaccgaacgaaactaaactaaaccgccgacgcgaaaaaaaatacgcaaaaaatcgaaaaacgacgaccaccacgctacgcaaactcgtctcctcgcgaaaatcgcaaaaaaaaacttctcgaaaccgcaaaaaactaaaactccccctccgctccaaaacaaacaaaccgcgaaaaactacgcgcgaatcccaatcctcaactcgcaacccgaacactccgctccgccgccgccttttattcgccgcccgcctttatttaaatccgaactcctaccacgaatcgcgaaaatatccgaaccaaactccgaaaccgcgctaccgcccaatccctaacgcctctcgaactccgcgccgccgcgccttaaatcaataaccgacgaaaccctacgccacgccgcgcgctacgatctctaaaacccgctatctaacgctatcttcgccgccgctccccctaccgatccgcgcgataaattcaacccgac

SEQ ID NO: 12935 - DNA, 764 bp, Artificial Sequence
  chemically treated genomic DNA (Homo sapiens) CpG-island No: 12935
ttggtcgattaagaatgttgtagtttcgcggggagatggtgcggagttggggttcggtcgtagagggtaagtttgggttttgtttatttttgatcgtttttttcggggggtttcgaggttcgtatttcgggttggttggagagcgagagaatttcgcgcgcggcgttaagtaggtcggggtgcggacggcgcggaggatttttttttttttttagtaatgtattttttagtttcgagattaagttcggatggcgtttcgcggtcgtgtatttatttcggtcggtcgaacggggttaggttgagtcgtcggcgcgggagagagtgcgtagagggtcggggggcggcggttattacgttgcgtagattcgttttttcgcggaagtcgtagggggaagtttttcggagtcgtaggaggttggggtttttttttcgttttagggtaagtagatcgcgggaagttgcgcgcgaattttagtttttagttcgtaattcgagtatttcgtttcgtcgtcgttttttattcgtcgttcgtttttgtttgggttcgggtttttattacgggtcgcgggggtgttcgagttaggtttcggagtcgcgttgtcgtttaatttttggcgtttttcgggtttcgcgtcgtcgcgttttgaattagtggtcggcgagattttgcgttacgtcgcgcgttgcggtttttgggattcgttgtttggcgttgttttcgtcgtcgttttttttgtcgattcgcgcggtgggtttagttcggt

SEQ ID NO: 12936 - DNA, 764 bp, Artificial Sequence
  chemically treated genomic DNA (Homo sapiens) CpG-island No: 12936
accgaactaaacccaccgcgcgaatcgacaaaaaaaacgacgacgaaaacaacgccaaacaacgaatcccaaaaaccgcaacgcgcgacgtaacgcaaaatctcgccgaccactaattcaaaacgcgacgacgcgaaacccgaaaaacgccaaaaattaaacgacaacgcgactccgaaacctaactcgaacacccccgcgacccgtaataaaaacccgaacccaaacaaaaacgaacgacgaataaaaaacgacgacgaaacgaaatactcgaattacgaactaaaaactaaaattcgcgcgcaacttcccgcgatctacttaccctaaaacgaaaaaaaaaccccaacctcctacgactccgaaaaacttccccctacgacttccgcgaaaaaacgaatctacgcaacgtaataaccgccgccccccgaccctctacgcactctctcccgcgccgacgactcaacctaaccccgttcgaccgaccgaaataaatacacgaccgcgaaacgccatccgaacttaatctcgaaactaaaaaatacattactaaaaaaaaaaaaaaatcctccgcgccgtccgcaccccgacctacttaacgccgcgcgcgaaattctctcgctctccaaccaacccgaaatacgaacctcgaaaccccccgaaaaaaacgatcaaaaataaacaaaacccaaacttaccctctacgaccgaaccccaactccgcaccatctccccgcgaaactacaacattcttaatcgaccaa

SEQ ID NO: 12937 - DNA, 526 bp, Artificial Sequence
  chemically treated genomic DNA (Homo sapiens) CpG-island No: 12937
tagcgattcgggggaatgggagttggggttcgggtttcggggaggcgattggttgaaggatagaggtttgggaggggtagagcgatggggatatggacggcggttcgttgtagggatttcggggtattgggagtcgggggtcggggatagttttggttttttgtttttttttgtcgtttgttgttttagtttttttcgttttgcggcgaggtgggtagggtgagttttcgggacgaatggtagttttggaagaggtttggggttaaggataggttagggcggcgggagaggcggatcggtggcgtggttggatttgggcgcgttgtcggattttttatattattagttgtaggtaggcgtttgcgttttcgttggagttgtggtcgttttggttgttttggatgatttgtgttaggtagtcggtcgcgagatttttgagggagcgtttgtaggggaaatttaggtagtgcgggaagagtacgttcgtgtttattacggtgttgtggatgagttttagggttagtag

SEQ ID NO: 12938 - DNA, 526 bp, Artificial Sequence
  chemically treated genomic DNA (Homo sapiens) CpG-island No: 12938
ctactaaccctaaaactcatccacaacaccgtaataaacacgaacgtactcttcccgcactacctaaatttcccctacaaacgctccctcaaaaatctcgcgaccgactacctaacacaaatcatccaaaacaaccaaaacgaccacaactccaacgaaaacgcaaacgcctacctacaactaataatataaaaaatccgacaacgcgcccaaatccaaccacgccaccgatccgcctctcccgccgccctaacctatccttaaccccaaacctcttccaaaactaccattcgtcccgaaaactcaccctacccacctcgccgcaaaacgaaaaaaactaaaacaacaaacgacaaaaaaaaacaaaaaaccaaaactatccccgacccccgactcccaataccccgaaatccctacaacgaaccgccgtccatatccccatcgctctacccctcccaaacctctatccttcaaccaatcgcctccccgaaacccgaaccccaactcccattcccccgaatcgcta

SEQ ID NO: 12939 - DNA, 526 bp, Artificial Sequence
  chemically treated genomic DNA (Homo sapiens) CpG-island No: 12939
ttgttggttttgaagtttatttatagtatcgtggtggatacgggcgtgtttttttcgtattatttgggttttttttataagcgtttttttaggaatttcgcggtcgattatttggtatagattatttagaatagttaggacggttataattttagcgaggacgtaaacgtttgtttgtagttggtgatgtggaaggttcgatagcgcgtttagatttagttacgttatcggttcgtttttttcgtcgttttggtttgtttttagttttaggttttttttaaaattgttattcgtttcgagagtttattttgtttatttcgtcgtaaagcgaaagaaattggagtagtaggcggtaggagagggtaaaaagttaagattattttcgattttcgatttttagtgtttcggagtttttgtagcgggtcgtcgtttatgtttttatcgttttgttttttttagatttttgttttttaattaatcgttttttcgaggttcgagttttaatttttattttttcgggtcgttg

SEQ ID NO: 12940 - DNA, 526 bp, Artificial Sequence
  chemically treated genomic DNA (Homo sapiens) CpG-island No: 12940
caacgacccgaaaaaataaaaattaaaactcgaacctcgaaaaaacgattaattaaaaaacaaaaatctaaaaaaaacaaaacgataaaaacataaacgacgacccgctacaaaaactccgaaacactaaaaatcgaaaatcgaaaataatcttaactttttaccctctcctaccgcctactactccaatttctttcgctttacgacgaaataaacaaaataaactctcgaaacgaataacaattttaaaaaaaacctaaaactaaaaacaaaccaaaacgacgaaaaaaacgaaccgataacgtaactaaatctaaacgcgctatcgaaccttccacatcaccaactacaaacaaacgtttacgtcctcgctaaaattataaccgtcctaactattctaaataatctataccaaataatcgaccgcgaaattcctaaaaaaacgcttataaaaaaaacccaaataatacgaaaaaaacacgcccgtatccaccacgatactataaataaacttcaaaaccaacaa

SEQ ID NO: 12941 - DNA, 1026 bp, Artificial Sequence
  chemically treated genomic DNA (Homo sapiens) CpG-island No: 12941
gacgtttagtattttttgatagtagttgagatatttggcggttagttcgtgtttcgggtttttttggaggaaggtgtaggtcgtcgttatcgttttttttagtcggttagtttggtcggggggtagggggtgggggagcgggttagtaagatcggagttcgcggtttcgagcgtacggcgggtttcgtgttttgggtgaagataacgttttttcgatcgatttgtggggagttacgacgtttagttcgagataggttttcgggtgggggcgggtttttatttttgaatagcgcgtagtgtaggtattggtagggtaggcggttttggaagttacgtagtagttgtcgcggcgggtagggtatttggaaggcgggtagcgttcgtttgtagcgtcgtaggtaggcggttcgttttaggacgcggtcgaagagtcgtagttcgtaggtttattcgtttgcgcggtcgtcgtcgggatcgggtttggtcgcgggcgcggggtcgttgtagttggcgtggtagaaggtttcgttgtcgcgtaggagtcggtgtagtcgtagcgtcgtttttaggtagcgcgcgttttcgcgttagttttttttttcgtattgttttagagcgtgttcgtacgtcgcggttagcggtattaggttttcgggcgggaagtttcggaagttgtatttttcgtattgcgtttcggcgttgtttagtagtaattatagtagtttttacgttattcgagttatgttcgtcgcgtcgtcggtttttcggagttgagttggttgtttcgcggacggaaggggatagggtcgggtttcgggcgggcggcgcgttcgttgggttttagcgtcgggtacgaggcggtaaggtggggcggggtttgggttacgacgttttttttttttttttagagggttcgatagtgtcgttaagtttttttcgtcggttcgggtttttgttttgggggtgttttttaggtagagaatgcgtcggggagcgtttttcgttagagatgggaagtttaggaag

SEQ ID NO: 12942 - DNA, 1026 bp, Artificial Sequence
  chemically treated genomic DNA (Homo sapiens) CpG-island No: 12942
cttcctaaacttcccatctctaacgaaaaacgctccccgacgcattctctacctaaaaaacacccccaaaacaaaaacccgaaccgacgaaaaaaacttaacgacactatcgaaccctctaaaaaaaaaaaaaaaacgtcgtaacccaaaccccgccccaccttaccgcctcgtacccgacgctaaaacccaacgaacgcgccgcccgcccgaaacccgaccctatccccttccgtccgcgaaacaaccaactcaactccgaaaaaccgacgacgcgacgaacataactcgaataacgtaaaaactactataattactactaaacaacgccgaaacgcaatacgaaaaatacaacttccgaaacttcccgcccgaaaacctaataccgctaaccgcgacgtacgaacacgctctaaaacaatacgaaaaaaaaaactaacgcgaaaacgcgcgctacctaaaaacgacgctacgactacaccgactcctacgcgacaacgaaaccttctaccacgccaactacaacgaccccgcgcccgcgaccaaacccgatcccgacgacgaccgcgcaaacgaataaacctacgaactacgactcttcgaccgcgtcctaaaacgaaccgcctacctacgacgctacaaacgaacgctacccgccttccaaataccctacccgccgcgacaactactacgtaacttccaaaaccgcctaccctaccaatacctacactacgcgctattcaaaaataaaaacccgcccccacccgaaaacctatctcgaactaaacgtcgtaactccccacaaatcgatcgaaaaaacgttatcttcacccaaaacacgaaacccgccgtacgctcgaaaccgcgaactccgatcttactaacccgctcccccaccccctaccccccgaccaaactaaccgactaaaaaaaacgataacgacgacctacaccttcctccaaaaaaacccgaaacacgaactaaccgccaaatatctcaactactatcaaaaaatactaaacgtc

SEQ ID NO: 12943 - DNA, 1026 bp, Artificial Sequence
  chemically treated genomic DNA (Homo sapiens) CpG-island No: 12943
ttttttgggttttttatttttggcgggaagcgtttttcgacgtattttttatttaggggatatttttaaggtaggagttcgggtcgacggagaggatttaacgatattatcggattttttgggaaaagaggggagacgtcgtgatttaggtttcgttttattttgtcgtttcgtgttcggcgttaagatttagcgggcgcgtcgttcgttcggggttcggttttgttttttttcgttcgcggggtagttagtttagtttcggagagtcggcggcgcggcgggtatggttcgggtggcgtgggggttgttgtggttgttgttgggtagcgtcggggcgtagtacgagaagtatagttttcggggtttttcgttcgaggatttgatgtcgttggtcgcggcgtacgggtacgttttggagtagtacgagggagagagttggcgcgagagcgcgcgttatttggaggcggcgttgcggttgtatcggtttttgcgcgatagcgaggttttttgttacgttaattgtagcggtttcgcgttcgcggttaagttcgatttcgacggcggtcgcgtagacgagtgggtttgcgagttgcggtttttcggtcgcgttttggagcgagtcgtttgtttgcggcgttgtaagcggacgttgttcgttttttaggtgttttattcgtcgcggtagttgttgcgtgatttttagagtcgtttgttttattagtatttgtattacgcgttgtttaagggtgggagttcgtttttattcggggatttgtttcgggttgggcgtcgtggttttttatagatcggtcgaaggagcgttatttttatttaaggtacgaagttcgtcgtgcgttcggggtcgcgagtttcggttttgttgattcgtttttttattttttatttttcgattaggttaatcggttggagaaggcggtggcggcggtttatatttttttttagaggaattcgaagtacgagttgatcgttaagtattttaattattattaggggatgttggacgtt

SEQ ID NO: 12944 - DNA, 1026 bp, Artificial Sequence
  chemically treated genomic DNA (Homo sapiens) CpG-island No: 12944
aacgtccaacatcccctaataataattaaaatacttaacgatcaactcgtacttcgaattcctctaaaaaaaaatataaaccgccgccaccgccttctccaaccgattaacctaatcgaaaaataaaaaataaaaaaacgaatcaacaaaaccgaaactcgcgaccccgaacgcacgacgaacttcgtaccttaaataaaaataacgctccttcgaccgatctataaaaaaccacgacgcccaacccgaaacaaatccccgaataaaaacgaactcccacccttaaacaacgcgtaatacaaatactaataaaacaaacgactctaaaaatcacgcaacaactaccgcgacgaataaaacacctaaaaaacgaacaacgtccgcttacaacgccgcaaacaaacgactcgctccaaaacgcgaccgaaaaaccgcaactcgcaaacccactcgtctacgcgaccgccgtcgaaatcgaacttaaccgcgaacgcgaaaccgctacaattaacgtaacaaaaaacctcgctatcgcgcaaaaaccgatacaaccgcaacgccgcctccaaataacgcgcgctctcgcgccaactctctccctcgtactactccaaaacgtacccgtacgccgcgaccaacgacatcaaatcctcgaacgaaaaaccccgaaaactatacttctcgtactacgccccgacgctacccaacaacaaccacaacaacccccacgccacccgaaccatacccgccgcgccgccgactctccgaaactaaactaactaccccgcgaacgaaaaaaaacaaaaccgaaccccgaacgaacgacgcgcccgctaaatcttaacgccgaacacgaaacgacaaaataaaacgaaacctaaatcacgacgtctcccctcttttcccaaaaaatccgataatatcgttaaatcctctccgtcgacccgaactcctaccttaaaaatatcccctaaataaaaaatacgtcgaaaaacgcttcccgccaaaaataaaaaacccaaaaaa

SEQ ID NO: 12945 - DNA, 607 bp, Artificial Sequence
  chemically treated genomic DNA (Homo sapiens) CpG-island No: 12945
tttttcgttagtttagggcgagagttagggacgcggcgtcgggcgagttgcgcgggtttcgggggaggcgcgatttcggaggtatttgttcggattttttttcgttttgtttagatttttggttcgcggagtttcgaggcgcgttcggttcgaatcgcgcgatttttaagtcgtcgcgtttaggattttagcgcgttttttgtcgtcggtgtagggtggcgttcgatggtatcggtttttatttgtttagggacggttgggatcggtttcgcggtcgttcgttatttttttgtttttaacgatatttgcgttttcgatagttcgtatttgagtatggggtttgatcgggtcgggtcggggtcgggtcggggtgggagtcggcgcggatagcgaattgagttcggcgtggtcgggcggcggttgtttcggattttggttaaggtagtaatttagtaatcgaataaaaggcgaagagatttgatagttaagttacgtttttcgttatttcgaagtttcgtttttgggggagacgtttattttttggtgcgagtttattggttatttcgtttgattgtttcgtggaggggcggagtttcgtttttagttt

SEQ ID NO: 12946 - DNA, 607 bp, Artificial Sequence
  chemically treated genomic DNA (Homo sapiens) CpG-island No: 12946
aaactaaaaacgaaactccgcccctccacgaaacaatcaaacgaaataaccaataaactcgcaccaaaaaataaacgtctcccccaaaaacgaaacttcgaaataacgaaaaacgtaacttaactatcaaatctcttcgccttttattcgattactaaattactaccttaaccaaaatccgaaacaaccgccgcccgaccacgccgaactcaattcgctatccgcgccgactcccaccccgacccgaccccgacccgacccgatcaaaccccatactcaaatacgaactatcgaaaacgcaaatatcgttaaaaacaaaaaaataacgaacgaccgcgaaaccgatcccaaccgtccctaaacaaataaaaaccgataccatcgaacgccaccctacaccgacgacaaaaaacgcgctaaaatcctaaacgcgacgacttaaaaatcgcgcgattcgaaccgaacgcgcctcgaaactccgcgaaccaaaaatctaaacaaaacgaaaaaaaatccgaacaaatacctccgaaatcgcgcctcccccgaaacccgcgcaactcgcccgacgccgcgtccctaactctcgccctaaactaacgaaaaa

SEQ ID NO: 12947 - DNA, 607 bp, Artificial Sequence
  chemically treated genomic DNA (Homo sapiens) CpG-island No: 12947
ggattggaggcgaggtttcgtttttttacgggatagttaggcgagatagttagtgagttcgtattagagggtgggcgttttttttaggggcggagtttcgaggtggcgaggggcgtggtttggttgttaggttttttcgttttttgttcggttattgagttgttgttttggttagagttcggagtagtcgtcgttcgattacgtcgagtttagttcgttgttcgcgtcggtttttatttcggttcgatttcgattcggttcggttaggttttatatttaggtgcgggttatcgggggcgtaggtatcgttggggatagaggggtggcgagcggtcgcggggtcggttttagtcgtttttgggtaggtgagggtcggtgttatcgagcgttattttgtatcggcggtagggggcgcgttggggttttgggcgcggcgatttgggggtcgcgcggttcgggtcgagcgcgtttcggagtttcgcgaattagagatttgagtaaggcggggagggattcggataggtgttttcggggtcgcgtttttttcggggttcgcgtagttcgttcgacgtcgcgtttttgattttcgttttgggttggcggggga

SEQ ID NO: 12948 - DNA, 607 bp, Artificial Sequence
  chemically treated genomic DNA (Homo sapiens) CpG-island No: 12948
tcccccgccaacccaaaacgaaaatcaaaaacgcgacgtcgaacgaactacgcgaaccccgaaaaaaacgcgaccccgaaaacacctatccgaatccctccccgccttactcaaatctctaattcgcgaaactccgaaacgcgctcgacccgaaccgcgcgacccccaaatcgccgcgcccaaaaccccaacgcgccccctaccgccgatacaaaataacgctcgataacaccgaccctcacctacccaaaaacgactaaaaccgaccccgcgaccgctcgccacccctctatccccaacgatacctacgcccccgataacccgcacctaaatataaaacctaaccgaaccgaatcgaaatcgaaccgaaataaaaaccgacgcgaacaacgaactaaactcgacgtaatcgaacgacgactactccgaactctaaccaaaacaacaactcaataaccgaacaaaaaacgaaaaaacctaacaaccaaaccacgcccctcgccacctcgaaactccgcccctaaaaaaaacgcccaccctctaatacgaactcactaactatctcgcctaactatcccgtaaaaaaacgaaacctcgcctccaatcc

SEQ ID NO: 12949 - DNA, 860 bp, Artificial Sequence
  chemically treated genomic DNA (Homo sapiens) CpG-island No: 12949
  misc_feature (697)..(697): n is either a, c, g or t
tttcgcgttcgtcgtttttcgcgttttcgtttttttcgtttatttgtcggttaattttagtatttcgtgtacgttgttcgtgttgacgcggatgcgttcggtgtatatgtattcgattacggtttttattgtgtcgggttcgggtttcggttcggagttttatttgcgtatttttattcgtttcgagcgggattcggaaaattggttcgagagtaggggcgtgaagtattcggtggcggtagttagtatcgagcggtgggttcggaattcgcggtttttagtttcgtcgaagtatagggtaatgtcgtagaagaggttttggcgtcgttgttcgttttgtcgttaggatagttttgagtagtgagagttgtattcgaaattttcggtttttgggttcggatcgttttcgttcgtttttattgtagagattttcggtttaggttcgaagtttatcgtgtcgttgtttcggatttcggcggttagttttgtcgagtcggcggcggttcgtttttatgttttttatttttagtatttgaagagatgtagtcgcggtcgtcgtcgtcgtcgtcgttattgtcgtagtcgttattttgacgtcgttgcgttcggtttttatagtttcggaacgatgcggttgttggtacgatatagagggattttgggattaaatagtgcgcgcggggcggggttaggtcgntcgtcggtcgtatatgcgtcgtttcgtttttagtagcgtcgtttcgtttttagtagcgtcgtttcgtttttagtagcgtcgtttcgtttttagtagttttgtttgttttggtgaggttcgttagtaatagtcgtttagtttagaagatttcgttttaggttta

SEQ ID NO: 12950 - DNA, 860 bp, Artificial Sequence
  chemically treated genomic DNA (Homo sapiens) CpG-island No: 12950
  misc_feature (164)..(164): n is either a, c, g or t
taaacctaaaacgaaatcttctaaactaaacgactattactaacgaacctcaccaaaacaaacaaaactactaaaaacgaaacgacgctactaaaaacgaaacgacgctactaaaaacgaaacgacgctactaaaaacgaaacgacgcatatacgaccgacgancgacctaaccccgccccgcgcgcactatttaatcccaaaatccctctatatcgtaccaacaaccgcatcgttccgaaactataaaaaccgaacgcaacgacgtcaaaataacgactacgacaataacgacgacgacgacgacgaccgcgactacatctcttcaaatactaaaaataaaaaacataaaaacgaaccgccgccgactcgacaaaactaaccgccgaaatccgaaacaacgacacgataaacttcgaacctaaaccgaaaatctctacaataaaaacgaacgaaaacgatccgaacccaaaaaccgaaaatttcgaatacaactctcactactcaaaactatcctaacgacaaaacgaacaacgacgccaaaacctcttctacgacattaccctatacttcgacgaaactaaaaaccgcgaattccgaacccaccgctcgatactaactaccgccaccgaatacttcacgcccctactctcgaaccaattttccgaatcccgctcgaaacgaataaaaatacgcaaataaaactccgaaccgaaacccgaacccgacacaataaaaaccgtaatcgaatacatatacaccgaacgcatccgcgtcaacacgaacaacgtacacgaaatactaaaattaaccgacaaataaacgaaaaaaacgaaaacgcgaaaaacgacgaacgcgaaa

SEQ ID NO: 12951 - DNA, 860 bp, Artificial Sequence
  chemically treated genomic DNA (Homo sapiens) CpG-island No: 12951
  misc_feature (164)..(164): n is either a, c, g or t
taggtttggggcgaagttttttggattgggcgattgttattgacggattttattaaggtaggtagagttgttggaggcgaggcggcgttgttggaggcgaggcggcgttgttggaggcgaggcggcgttgttggaggcgaggcggcgtatgtgcggtcggcggncgatttggtttcgtttcgcgcgtattatttaattttagaatttttttgtgtcgtattaatagtcgtatcgtttcgaggttgtggaggtcgggcgtagcggcgttaagatggcggttgcggtagtggcggcggcggcggcggcggtcgcggttgtatttttttaggtattggagatggagagtatggaaacgggtcgtcgtcggttcggtaggattggtcgtcgaggttcgaggtagcggtacggtggatttcgggtttgggtcggggatttttgtaatggaggcgagcgggggcgattcgggtttagaagtcgaggatttcgagtgtagtttttattgtttagagttgttttggcggtagaacgagtagcggcgttagggttttttttgcgatattattttgtgtttcggcggggttggaggtcgcgagtttcgggtttatcgttcggtattggttgtcgttatcgagtattttacgtttttgttttcgggttagtttttcgagtttcgttcgggacgggtggagatgcgtaagtggagtttcgagtcggggttcgaattcgatatagtggaagtcgtaatcgagtatatgtatatcgggcgtattcgcgttagtacgggtagcgtgtacgaggtgttggagttggtcgataggtaggcgagggaggcgggagcgcggagggcggcgggcgcggag

SEQ ID NO: 12952 - DNA, 860 bp, Artificial Sequence
  chemically treated genomic DNA (Homo sapiens) CpG-island No: 12952
  misc_feature (697)..(697): n is either a, c, g or t
ctccgcgcccgccgccctccgcgctcccgcctccctcgcctacctatcgaccaactccaacacctcgtacacgctacccgtactaacgcgaatacgcccgatatacatatactcgattacgacttccactatatcgaattcgaaccccgactcgaaactccacttacgcatctccacccgtcccgaacgaaactcgaaaaactaacccgaaaacaaaaacgtaaaatactcgataacgacaaccaataccgaacgataaacccgaaactcgcgacctccaaccccgccgaaacacaaaataatatcgcaaaaaaaaccctaacgccgctactcgttctaccgccaaaacaactctaaacaataaaaactacactcgaaatcctcgacttctaaacccgaatcgcccccgctcgcctccattacaaaaatccccgacccaaacccgaaatccaccgtaccgctacctcgaacctcgacgaccaatcctaccgaaccgacgacgacccgtttccatactctccatctccaatacctaaaaaaatacaaccgcgaccgccgccgccgccgccgccactaccgcaaccgccatcttaacgccgctacgcccgacctccacaacctcgaaacgatacgactattaatacgacacaaaaaaattctaaaattaaataatacgcgcgaaacgaaaccaaatcgnccgccgaccgcacatacgccgcctcgcctccaacaacgccgcctcgcctccaacaacgccgcctcgcctccaacaacgccgcctcgcctccaacaactctacctaccttaataaaatccgtcaataacaatcgcccaatccaaaaaacttcgccccaaaccta

SEQ ID NO: 12953 - DNA, 698 bp, Artificial Sequence
  chemically treated genomic DNA (Homo sapiens) CpG-island No: 12953
gggagcgaggagtcggaggaagttcggtttgcgttttgcgggtagtaggatacgattttttcggcgcgttttcgtcggcgtcgtagcgggcgcgcgggcgatagggtgggcgtggatcgatgggggtatcgtttttggagaagggcgggcgtcgttgtttcgggggcgggacgcgtcgaggagtggggcgcgagtcgtcggttttgattagtgcggcggagttgcggcggtggagttgttcggtcgggagttcggcggcgagacggagaggcggcggaggtgttcgcgcgtagggtttggtgggcggtcgcgaggttcgggagaggcgaatcggagcgcgggatcgcggtcgtttcgattagagtcgggagatcgtagtattcgtagtcgttcgcgagcgcgtcgaagatagcgcgtaggcgagagcgcgcgggcgggggcgcgtaggttttgttcgtttttttcgtttttattttttttcgtttttttttttttttatttttttttcgtttttcgcgttttcgtatcgggcgtttattttgttttttttttgcgggagcgttgttcgtgttggcggtcgtagcgggtcgggtcggttcggcgggtcgggggatggcgttgttggatttggttttggagggaatggtcgttttcgggttcgttttttttttggtgttgtggttgatgtattttatggt

SEQ ID NO: 12954 - DNA, 698 bp, Artificial Sequence
  chemically treated genomic DNA (Homo sapiens) CpG-island No: 12954
accataaaatacatcaaccacaacaccaaaaaaaaaacgaacccgaaaacgaccattccctccaaaaccaaatccaacaacgccatcccccgacccgccgaaccgacccgacccgctacgaccgccaacacgaacaacgctcccgcaaaaaaaaaacaaaataaacgcccgatacgaaaacgcgaaaaacgaaaaaaaaataaaaaaaaaaaaaaacgaaaaaaaataaaaacgaaaaaaacgaacaaaacctacgcgcccccgcccgcgcgctctcgcctacgcgctatcttcgacgcgctcgcgaacgactacgaatactacgatctcccgactctaatcgaaacgaccgcgatcccgcgctccgattcgcctctcccgaacctcgcgaccgcccaccaaaccctacgcgcgaacacctccgccgcctctccgtctcgccgccgaactcccgaccgaacaactccaccgccgcaactccgccgcactaatcaaaaccgacgactcgcgccccactcctcgacgcgtcccgcccccgaaacaacgacgcccgcccttctccaaaaacgatacccccatcgatccacgcccaccctatcgcccgcgcgcccgctacgacgccgacgaaaacgcgccgaaaaaatcgtatcctactacccgcaaaacgcaaaccgaacttcctccgactcctcgctccc

SEQ ID NO: 12955 - DNA, 698 bp, Artificial Sequence
  chemically treated genomic DNA (Homo sapiens) CpG-island No: 12955
gttatgaaatgtattagttatagtattaagaagaggacgaattcgaagacggttattttttttaaggttaggtttagtagcgttatttttcggttcgtcggatcggttcggttcgttgcggtcgttaatacggataacgttttcgtaggaggaggatagggtgggcgttcggtgcgggggcgcgggaggcgagaggaaggtggggagaggaaagggcggaggggggtggggacggaaggggcgggtagggtttgcgcgttttcgttcgcgcgttttcgtttgcgcgttgttttcggcgcgttcgcgggcggttgcgggtgttgcggtttttcggttttggtcggggcgatcgcggtttcgcgtttcggttcgtttttttcgagtttcgcggtcgtttattagattttgcgcgcgggtattttcgtcgttttttcgtttcgtcgtcgggttttcggtcgagtagttttatcgtcgtagtttcgtcgtattaattaaaatcggcggttcgcgttttatttttcggcgcgtttcgttttcggaataacggcgttcgtttttttttaggggcggtgtttttatcggtttacgtttattttgtcgttcgcgcgttcgttgcggcgtcggcgagagcgcgtcggggagatcgtgttttgttgttcgtaggacgtaggtcgggtttttttcggtttttcgttttt

SEQ ID NO: 12956 - DNA, 698 bp, Artificial Sequence
  chemically treated genomic DNA (Homo sapiens) CpG-island No: 12956
aaaaacgaaaaaccgaaaaaaacccgacctacgtcctacgaacaacaaaacacgatctccccgacgcgctctcgccgacgccgcaacgaacgcgcgaacgacaaaataaacgtaaaccgataaaaacaccgcccctaaaaaaaaacgaacgccgttattccgaaaacgaaacgcgccgaaaaataaaacgcgaaccgccgattttaattaatacgacgaaactacgacgataaaactactcgaccgaaaacccgacgacgaaacgaaaaaacgacgaaaatacccgcgcgcaaaatctaataaacgaccgcgaaactcgaaaaaaacgaaccgaaacgcgaaaccgcgatcgccccgaccaaaaccgaaaaaccgcaacacccgcaaccgcccgcgaacgcgccgaaaacaacgcgcaaacgaaaacgcgcgaacgaaaacgcgcaaaccctacccgccccttccgtccccacccccctccgccctttcctctccccaccttcctctcgcctcccgcgcccccgcaccgaacgcccaccctatcctcctcctacgaaaacgttatccgtattaacgaccgcaacgaaccgaaccgatccgacgaaccgaaaaataacgctactaaacctaaccttaaaaaaaataaccgtcttcgaattcgtcctcttcttaatactataactaatacatttcataac

SEQ ID NO: 12957 - DNA, 716 bp, Artificial Sequence
  chemically treated genomic DNA (Homo sapiens) CpG-island No: 12957
  misc_feature (75)..(75): n is either a, c, g or t
  misc_feature (485)..(485): n is either a, c, g or t
atttttcgttttcgcggtttcgtttcgggatcgggggtcgtttcgtcggtttttttcggtttgggaattacgggnttttgtttttaggaatttgtgggcgtttttttcgtttttgattttgataaagttatagttacgcgggaaaacgtttttcgggttttgagtttaatttgggcgtcgcgggggttttaagggttttgcgcggttcggtattacggttttattttcgttttttatcgtcgttagttcgggtcgagttcgcggcgtatttaggttttagcggttttatcgtttattagggttgggcgaggttttttttcggcgtttttattatttcgcgatttcgggcgtcggaggggatgagtttcggatgttcggcgtttaggtttcgaggatgttttgaagcgttggggtataggcgtcgtttcggattgtgttttttttattttttttttagttttgtcgcggtttgagcgcggcgtatntgcgtattgcgttttcggtcgttgttttggtgattcgagcggacgtggttacgttttcggttagggtttgggaaagggtggggggagggggtagttcgggagtaagtgggggtcggcgggggagaaggagagaatcgggagaggggaatttgcgggggtcgggtgggggttcgggggtagaggaggatttagggaatcggggatagggtagggttaggggttcggtggggg

SEQ ID NO: 12958 - DNA, 716 bp, Artificial Sequence
  chemically treated genomic DNA (Homo sapiens) CpG-island No: 12958
  misc_feature (232)..(232): n is either a, c, g or t
  misc_feature (642)..(642): n is either a, c, g or t
cccccaccgaacccctaaccctaccctatccccgattccctaaatcctcctctacccccgaacccccacccgacccccgcaaattcccctctcccgattctctccttctcccccgccgacccccacttactcccgaactaccccctccccccaccctttcccaaaccctaaccgaaaacgtaaccacgtccgctcgaatcaccaaaacaacgaccgaaaacgcaatacgcanatacgccgcgctcaaaccgcgacaaaactaaaaaaaaaataaaaaaaacacaatccgaaacgacgcctataccccaacgcttcaaaacatcctcgaaacctaaacgccgaacatccgaaactcatcccctccgacgcccgaaatcgcgaaataataaaaacgccgaaaaaaaacctcgcccaaccctaataaacgataaaaccgctaaaacctaaatacgccgcgaactcgacccgaactaacgacgataaaaaacgaaaataaaaccgtaataccgaaccgcgcaaaacccttaaaacccccgcgacgcccaaattaaactcaaaacccgaaaaacgttttcccgcgtaactataactttatcaaaatcaaaaacgaaaaaaacgcccacaaattcctaaaaacaaaancccgtaattcccaaaccgaaaaaaaccgacgaaacgacccccgatcccgaaacgaaaccgcgaaaacgaaaaat

SEQ ID NO: 12959 - DNA, 716 bp, Artificial Sequence
  chemically treated genomic DNA (Homo sapiens) CpG-island No: 12959
  misc_feature (232)..(232): n is either a, c, g or t
  misc_feature (642)..(642): n is either a, c, g or t
tttttatcgagtttttagttttgttttattttcggttttttgggtttttttttattttcgagtttttattcggttttcgtaaatttttttttttcggttttttttttttttttcgtcgatttttatttattttcggattgttttttttttttatttttttttagattttggtcggaggcgtggttacgttcgttcgggttattaaggtaacggtcgggagcgtagtgcgtanatgcgtcgcgtttaggtcgcggtaaggttgaggggaaggtggagggggtatagttcggagcggcgtttgtattttagcgttttagggtattttcggggtttgggcgtcgggtattcgggatttatttttttcggcgttcgaggtcgcgggatagtgggggcgtcgggaggaagtttcgtttagttttggtgggcggtggggtcgttggggtttgggtgcgtcgcgggttcggttcggattgacggcggtggggggcggggatggggtcgtggtgtcgggtcgcgtagaatttttgggattttcgcggcgtttaggttgggtttagggttcggagaacgttttttcgcgtggttatggttttgttagaattaggagcgggagaggcgtttatagatttttgagggtagaanttcgtggtttttaggtcgaaaggagtcggcgaggcgattttcgatttcgggacggagtcgcgggaacgggggat

SEQ ID NO: 12960 - DNA, 716 bp, Artificial Sequence
  chemically treated genomic DNA (Homo sapiens) CpG-island No: 12960
  misc_feature (75)..(75): n is either a, c, g or t
  misc_feature (485)..(485): n is either a, c, g or t
atcccccgttcccgcgactccgtcccgaaatcgaaaatcgcctcgccgactcctttcgacctaaaaaccacgaanttctaccctcaaaaatctataaacgcctctcccgctcctaattctaacaaaaccataaccacgcgaaaaaacgttctccgaaccctaaacccaacctaaacgccgcgaaaatcccaaaaattctacgcgacccgacaccacgaccccatccccgccccccaccgccgtcaatccgaaccgaacccgcgacgcacccaaaccccaacgaccccaccgcccaccaaaactaaacgaaacttcctcccgacgcccccactatcccgcgacctcgaacgccgaaaaaaataaatcccgaatacccgacgcccaaaccccgaaaataccctaaaacgctaaaatacaaacgccgctccgaactataccccctccaccttcccctcaaccttaccgcgacctaaacgcgacgcatntacgcactacgctcccgaccgttaccttaataacccgaacgaacgtaaccacgcctccgaccaaaatctaaaaaaaaataaaaaaaaaaaacaatccgaaaataaataaaaatcgacgaaaaaaaaaaaaaaaaccgaaaaaaaaaaatttacgaaaaccgaataaaaactcgaaaataaaaaaaaacccaaaaaaccgaaaataaaacaaaactaaaaactcgataaaaa

SEQ ID NO: 12961 - DNA, 694 bp, Artificial Sequence
  chemically treated genomic DNA (Homo sapiens) CpG-island No: 12961
ggtcgagttggtcgttcggttgcgtaatgttgtttagtcgagtttcgtttcgtagcgtaggttattcgcgtcgttcgcgtttgtatttttatcgtttagcgtggaggggttttggtttatttttgtgtcgagcgttgtttttcgtttcgggcggagcgaggttcgggggtcggtcgttaggggaggcgtcgcggcggtggcggttttgcggttcggagggcgggtcgacgggagtcgttgtttgggtcgcgcgtcgttcggagttcgtattcgttgtcgagtttgtagcggagcgcgtagttagttcggttttcggattggatttttttattgatataaatttcgttcggtcgttttacgtagggatattttcgtttttcgtaggttgttttcgttcgtcgattcgttcgtttttttttcggtgttatttattaggagtatatattttagtcggcgtatttttttcgttcgtaaatatagcgttgttacgtttttttcgggttttgtattcgtttatacgtacgttttgatatagatttcgtttttttatacgttttttttagttttttttttattttattttttagaagaattttagtatacgtttcgtattttgtttgtttgttttagatcgattttttcgtttttttttaaatttttattttatcgaaattttttttgttaatgaaagatt

SEQ ID NO: 12962 - DNA, 694 bp, Artificial Sequence
  chemically treated genomic DNA (Homo sapiens) CpG-island No: 12962
aatctttcattaacaaaaaaaatttcgataaaataaaaatttaaaaaaaaacgaaaaaatcgatctaaaacaaacaaacaaaatacgaaacgtatactaaaattcttctaaaaaataaaataaaaaaaaaactaaaaaaaacgtataaaaaaacgaaatctatatcaaaacgtacgtataaacgaatacaaaacccgaaaaaaacgtaacaacgctatatttacgaacgaaaaaaatacgccgactaaaatatatactcctaataaataacaccgaaaaaaaaacgaacgaatcgacgaacgaaaacaacctacgaaaaacgaaaatatccctacgtaaaacgaccgaacgaaatttatatcaataaaaaaatccaatccgaaaaccgaactaactacgcgctccgctacaaactcgacaacgaatacgaactccgaacgacgcgcgacccaaacaacgactcccgtcgacccgccctccgaaccgcaaaaccgccaccgccgcgacgcctcccctaacgaccgacccccgaacctcgctccgcccgaaacgaaaaacaacgctcgacacaaaaataaaccaaaacccctccacgctaaacgataaaaatacaaacgcgaacgacgcgaataacctacgctacgaaacgaaactcgactaaacaacattacgcaaccgaacgaccaactcgacc

SEQ ID NO: 12963 - DNA, 694 bp, Artificial Sequence
  chemically treated genomic DNA (Homo sapiens) CpG-island No: 12963
aattttttattaataaggggagtttcggtgaagtggaggtttggggaaaggcgaggaagtcggtttggagtaagtaagtaaagtgcggaacgtgtattgggatttttttagaaagtggggtgggaaaggagttagggagggcgtgtggagggacgagatttgtgttagaacgtgcgtgtgagcggatataaaattcgagagaggcgtgatagcgttgtgtttgcgagcgggaggggtgcgtcggttggggtgtgtgtttttggtgagtgatatcgaggggaaggcgggcgggtcggcgggcgggggtagtttgcgaggggcgggagtgtttttgcgtggggcggtcgagcggagtttgtgttagtgaaggaatttagttcgggggtcgagttggttgcgcgtttcgttgtaagttcggtagcgggtgcgagtttcggacggcgcgcggtttaggtagcggttttcgtcggttcgtttttcgagtcgtagggtcgttatcgtcgcggcgttttttttggcgatcggttttcggatttcgtttcgttcgggacgaggagtagcgttcgatatagaggtaagttaggatttttttacgttgggcggtggggatgtaggcgcgggcgacgcgagtggtttgcgttgcgggacgagattcggttgggtagtattgcgtagtcgggcggttagttcggtt

SEQ ID NO: 12964 - DNA, 694 bp, Artificial Sequence
  chemically treated genomic DNA (Homo sapiens) CpG-island No: 12964
aaccgaactaaccgcccgactacgcaatactacccaaccgaatctcgtcccgcaacgcaaaccactcgcgtcgcccgcgcctacatccccaccgcccaacgtaaaaaaatcctaacttacctctatatcgaacgctactcctcgtcccgaacgaaacgaaatccgaaaaccgatcgccaaaaaaaacgccgcgacgataacgaccctacgactcgaaaaacgaaccgacgaaaaccgctacctaaaccgcgcgccgtccgaaactcgcacccgctaccgaacttacaacgaaacgcgcaaccaactcgacccccgaactaaattccttcactaacacaaactccgctcgaccgccccacgcaaaaacactcccgcccctcgcaaactacccccgcccgccgacccgcccgccttcccctcgatatcactcaccaaaaacacacaccccaaccgacgcacccctcccgctcgcaaacacaacgctatcacgcctctctcgaattttatatccgctcacacgcacgttctaacacaaatctcgtccctccacacgccctccctaactcctttcccaccccactttctaaaaaaatcccaatacacgttccgcactttacttacttactccaaaccgacttcctcgcctttccccaaacctccacttcaccgaaactccccttattaataaaaaatt

SEQ ID NO: 12965 - DNA, 794 bp, Artificial Sequence
  chemically treated genomic DNA (Homo sapiens) CpG-island No: 12965
ggtcgaggttcgggtttcgttcgttacggttttcggggtttcgtttatatttggtagaagttacgtttcgttcgtgtgggtggggacggttcgtcggatcgaaatttttagattgttgttttaggtaacgggtttttcgattttttggttttttatgtgaggaaattatagcgcggtcggtatttagagagtcggttagtcgcgaagttttcgtcggacgaagggattagttagcgttttgttagatagcgaggtcggaagcggaggcgtggtttttgcgcggtttcggaaattagtgaggtcggcgcgcgttcgtcggaagtcgcgatttcgacgcgttttttattgttttcggcgtcggaagtggtcgcgggtcgttttgttttttgttcgaggggcgtgcgcgggttaggggcggtcgcggaggcggaagtatttatggcggagggcggtagtttagacgggcgggtagggtcgggtttcgtaggtaacgtgcgcgcggttattgtgtcgcggggcgtgtggggatggcgaagggttggtttcggcgtttttgtcgaggttttgcgttttcgtttcgggttggtcgggtttacggggtagttagggagtcgtattttgtaggtcgggggtggggtttagcgcggttcgtagtgttgggcgattttattacggacgcgttgtttttttttcggtttcgagtgtagttttcgcgttagatttttttttcggtggaatttgttcgtaatttttttttcgttagtcgatatagatttgatatgatttaatcgtaa

SEQ ID NO: 12966 - DNA, 794 bp, Artificial Sequence
  chemically treated genomic DNA (Homo sapiens) CpG-island No: 12966
ttacgattaaatcatatcaaatctatatcgactaacgaaaaaaaaattacgaacaaattccaccgaaaaaaaaatctaacgcgaaaactacactcgaaaccgaaaaaaaaacaacgcgtccgtaataaaatcgcccaacactacgaaccgcgctaaaccccacccccgacctacaaaatacgactccctaactaccccgtaaacccgaccaacccgaaacgaaaacgcaaaacctcgacaaaaacgccgaaaccaacccttcgccatccccacacgccccgcgacacaataaccgcgcgcacgttacctacgaaacccgaccctacccgcccgtctaaactaccgccctccgccataaatacttccgcctccgcgaccgcccctaacccgcgcacgcccctcgaacaaaaaacaaaacgacccgcgaccacttccgacgccgaaaacaataaaaaacgcgtcgaaatcgcgacttccgacgaacgcgcgccgacctcactaatttccgaaaccgcgcaaaaaccacgcctccgcttccgacctcgctatctaacaaaacgctaactaatcccttcgtccgacgaaaacttcgcgactaaccgactctctaaataccgaccgcgctataatttcctcacataaaaaaccaaaaaatcgaaaaacccgttacctaaaacaacaatctaaaaatttcgatccgacgaaccgtccccacccacacgaacgaaacgtaacttctaccaaatataaacgaaaccccgaaaaccgtaacgaacgaaacccgaacctcgacc

SEQ ID NO: 12967 - DNA, 794 bp, Artificial Sequence
  chemically treated genomic DNA (Homo sapiens) CpG-island No: 12967
ttgcggttgggttatattaaatttgtatcggttaacgggaaggaagttacgagtaagttttatcggaaagaaaatttagcgcggggattgtattcgaggtcgaggagagggtagcgcgttcgtggtggggtcgtttagtattgcgagtcgcgttgaattttattttcggtttgtagggtgcggttttttggttgtttcgtggattcggttagttcgggacgaggacgtaggatttcggtagggacgtcggagttagtttttcgttatttttatacgtttcgcggtatagtggtcgcgcgtacgttatttgcggagttcggttttgttcgttcgtttgggttgtcgtttttcgttatggatgttttcgttttcgcggtcgtttttgattcgcgtacgtttttcgggtaggaagtagaacgattcgcgattattttcggcgtcgagggtaatggggggcgcgtcggggtcgcggttttcggcgggcgcgcgtcggttttattggttttcggggtcgcgtaggggttacgttttcgttttcggtttcgttgtttagtagggcgttggttggttttttcgttcggcgggaatttcgcggttaatcgattttttggatgtcggtcgcgttgtggtttttttatataagaagttaaggagtcggaaagttcgttgtttgaggtagtagtttgggaatttcggttcggcgggtcgtttttatttatacggacggggcgtggtttttgttagatgtgggcggggtttcgagggtcgtggcgggcgggattcgggtttcggtt

SEQ ID NO: 12968 - DNA, 794 bp, Artificial Sequence
  chemically treated genomic DNA (Homo sapiens) CpG-island No: 12968
aaccgaaacccgaatcccgcccgccacgaccctcgaaaccccgcccacatctaacaaaaaccacgccccgtccgtataaataaaaacgacccgccgaaccgaaattcccaaactactacctcaaacaacgaactttccgactccttaacttcttatataaaaaaaccacaacgcgaccgacatccaaaaaatcgattaaccgcgaaattcccgccgaacgaaaaaaccaaccaacgccctactaaacaacgaaaccgaaaacgaaaacgtaacccctacgcgaccccgaaaaccaataaaaccgacgcgcgcccgccgaaaaccgcgaccccgacgcgccccccattaccctcgacgccgaaaataatcgcgaatcgttctacttcctacccgaaaaacgtacgcgaatcaaaaacgaccgcgaaaacgaaaacatccataacgaaaaacgacaacccaaacgaacgaacaaaaccgaactccgcaaataacgtacgcgcgaccactataccgcgaaacgtataaaaataacgaaaaactaactccgacgtccctaccgaaatcctacgtcctcgtcccgaactaaccgaatccacgaaacaaccaaaaaaccgcaccctacaaaccgaaaataaaattcaacgcgactcgcaatactaaacgaccccaccacgaacgcgctaccctctcctcgacctcgaatacaatccccgcgctaaattttctttccgataaaacttactcgtaacttccttcccgttaaccgatacaaatttaatataacccaaccgcaa

SEQ ID NO: 12969 - DNA, 792 bp, Artificial Sequence
  chemically treated genomic DNA (Homo sapiens) CpG-island No: 12969
  misc_feature (42)..(42): n is either a, c, g or t
  misc_feature (236)..(236): n is either a, c, g or t
  misc_feature (727)..(727): n is either a, c, g or t
ttcggggttttcgcggagaatatttattcgagggtattggangtttggaaagggtttgcgagtatattgggggtagcgcggggggaagggttttttaggggtcgggcgcgatagtcggattgtcgtcggggaagaggtaggatgcggttttttttaggataaatatatacgtttatatatatattcgtttttcgatttcgggttagtttcgagtttcggcggttttttattttcgngcgcgcgagcggattttcgatacggtttttcgtatggtgggtatcgcggcggcggttgtaggtgggtttttagttcggattttgtatttgttacggcgtggtatacgcgggagattcggttgcgtcgcgtagagcgtttagttgtagtttgggtcgcgtcgtcgtttatttagggtagagttgtcgtcgggcgcggttttcgtacgtcgataggaggaggagaaaggtagcggtggcggcgaaggtggcggcgttcgtagagttgggcgagtttttgttgtagtcgcggaggggcggttcggcgaggggcggagttcgggcgtcggcgtcgggggaggggtttgcggggttcgcgttttttttttcgcggtcgtttagtaaggaaggcgggtgaggggcggggagagttagggggagtttttttcgtttcgtttcgtttcgtttcggatcgtattacgatttaaaggggggattaatttttagtttttttnagttttttagcgttttcgtttcgttttgtggagttggttgattcggttttttttttaggttattt

SEQ ID NO: 12970 - DNA, 792 bp, Artificial Sequence
  chemically treated genomic DNA (Homo sapiens) CpG-island No: 12970
  misc_feature (66)..(66): n is either a, c, g or t
  misc_feature (557)..(557): n is either a, c, g or t
  misc_feature (751)..(751): n is either a, c, g or t
aaataacctaaaaaaaaaaccgaatcaaccaactccacaaaacgaaacgaaaacgctaaaaaactnaaaaaaactaaaaattaatcccccctttaaatcgtaatacgatccgaaacgaaacgaaacgaaacgaaaaaaactccccctaactctccccgcccctcacccgccttccttactaaacgaccgcgaaaaaaaaaacgcgaaccccgcaaacccctcccccgacgccgacgcccgaactccgcccctcgccgaaccgcccctccgcgactacaacaaaaactcgcccaactctacgaacgccgccaccttcgccgccaccgctacctttctcctcctcctatcgacgtacgaaaaccgcgcccgacgacaactctaccctaaataaacgacgacgcgacccaaactacaactaaacgctctacgcgacgcaaccgaatctcccgcgtataccacgccgtaacaaatacaaaatccgaactaaaaacccacctacaaccgccgccgcgatacccaccatacgaaaaaccgtatcgaaaatccgctcgcgcgcncgaaaataaaaaaccgccgaaactcgaaactaacccgaaatcgaaaaacgaatatatatataaacgtatatatttatcctaaaaaaaaccgcatcctacctcttccccgacgacaatccgactatcgcgcccgacccctaaaaaacccttccccccgcgctacccccaatatactcgcaaaccctttccaaacntccaataccctcgaataaatattctccgcgaaaaccccgaa

SEQ ID NO: 12971 - DNA, 792 bp, Artificial Sequence
  chemically treated genomic DNA (Homo sapiens) CpG-island No: 12971
  misc_feature (66)..(66): n is either a, c, g or t
  misc_feature (557)..(557): n is either a, c, g or t
  misc_feature (751)..(751): n is either a, c, g or t
gagtggtttggaggaggaatcgggttaattaattttatagggcggagcgaaaacgttggaggattnaaggaggttaagagttgattttttttttgagtcgtgatacggttcgaagcggggcggggcggggcgaaggaggttttttttggtttttttcgttttttattcgttttttttgttgagcggtcgcgggagggggagcgcgagtttcgtaggtttttttttcggcgtcggcgttcgagtttcgtttttcgtcgagtcgttttttcgcggttgtagtaagagttcgtttagttttgcgggcgtcgttattttcgtcgttatcgttgttttttttttttttttgtcggcgtgcgggggtcgcgttcggcggtagttttgttttaggtgggcggcggcgcggtttaggttgtagttgagcgttttgcgcggcgtagtcgggtttttcgcgtgtattacgtcgtgataggtgtagagttcgggttgaggatttatttgtagtcgtcgtcgcgatgtttattatgcggaggatcgtgtcggagattcgttcgcgcgtncgaaggtaaggggtcgtcgaggttcggggttagttcggggtcgggaagcgagtgtgtgtgtgagcgtgtgtgtttattttggaagagatcgtattttatttttttttcggcggtagttcgattgtcgcgttcggtttttaggggattttttttttcgcgttgtttttagtgtattcgtagattttttttaggtntttagtattttcgaatgggtgtttttcgcgggagtttcgag

SEQ ID NO: 12972 - DNA, 792 bp, Artificial Sequence
  chemically treated genomic DNA (Homo sapiens) CpG-island No: 12972
  misc_feature (42)..(42): n is either a, c, g or t
  misc_feature (236)..(236): n is either a, c, g or t
  misc_feature (727)..(727): n is either a, c, g or t
ctcgaaactcccgcgaaaaacacccattcgaaaatactaaanacctaaaaaaaatctacgaatacactaaaaacaacgcgaaaaaaaaaatcccctaaaaaccgaacgcgacaatcgaactaccgccgaaaaaaaaataaaatacgatctcttccaaaataaacacacacgctcacacacacactcgcttcccgaccccgaactaaccccgaacctcgacgaccccttaccttcgnacgcgcgaacgaatctccgacacgatcctccgcataataaacatcgcgacgacgactacaaataaatcctcaacccgaactctacacctatcacgacgtaatacacgcgaaaaacccgactacgccgcgcaaaacgctcaactacaacctaaaccgcgccgccgcccacctaaaacaaaactaccgccgaacgcgacccccgcacgccgacaaaaaaaaaaaaaaaacaacgataacgacgaaaataacgacgcccgcaaaactaaacgaactcttactacaaccgcgaaaaaacgactcgacgaaaaacgaaactcgaacgccgacgccgaaaaaaaaacctacgaaactcgcgctccccctcccgcgaccgctcaacaaaaaaaacgaataaaaaacgaaaaaaaccaaaaaaaacctccttcgccccgccccgccccgcttcgaaccgtatcacgactcaaaaaaaaaatcaactcttaacctccttnaatcctccaacgttttcgctccgccctataaaattaattaacccgattcctcctccaaaccactc

SEQ ID NO: 12973 - DNA, 544 bp, Artificial Sequence
  chemically treated genomic DNA (Homo sapiens) CpG-island No: 12973
ggcgtagggcgcggtttcgggcgtcgttatcgtagcggcgtcgagggtcggaggtgtagtttttttttaggagagaaggcgagtcgttgtcggtcgtttagttagaaggtcgagggaatcgcgcgggtgtttttcgttagtcggttttttgggaatagggcgggggcgatattttagggagtagggttgaggatcgtaaaaattaatcgtgggtatcggcgcggggttacgtataggagaggagcgggagaggggttggtgggggttttagggcggttgaggtcgtggttttgtttgtggattcggcgggcgtttcgaagtttggggtcgttacggttttagtttcgtcggtttcggtcggagattttaggtcgtagtttttttttttttcggcgttttttttttagtgaggagttgagcgcgggcggcgcggggggaggggtggcggcggagagaatagttagttgtttaaaatttttttagagtagtttttaattttttttttgcgttcgggttcggaggggggagggggaaggagagcggg

SEQ ID NO: 12974 - DNA, 544 bp, Artificial Sequence
  chemically treated genomic DNA (Homo sapiens) CpG-island No: 12974
cccgctctccttccccctcccccctccgaacccgaacgcaaaaaaaaaattaaaaactactctaaaaaaattttaaacaactaactattctctccgccgccacccctccccccgcgccgcccgcgctcaactcctcactaaaaaaaaaacgccgaaaaaaaaaaaaactacgacctaaaatctccgaccgaaaccgacgaaactaaaaccgtaacgaccccaaacttcgaaacgcccgccgaatccacaaacaaaaccacgacctcaaccgccctaaaacccccaccaacccctctcccgctcctctcctatacgtaaccccgcgccgatacccacgattaatttttacgatcctcaaccctactccctaaaatatcgcccccgccctattcccaaaaaaccgactaacgaaaaacacccgcgcgattccctcgaccttctaactaaacgaccgacaacgactcgccttctctcctaaaaaaaaactacacctccgaccctcgacgccgctacgataacgacgcccgaaaccgcgccctacgcc

SEQ ID NO: 12975 - DNA, 544 bp, Artificial Sequence
  chemically treated genomic DNA (Homo sapiens) CpG-island No: 12975
ttcgttttttttttttttttttttttcgaattcgggcgtaaggggggaattagaaattgttttagaaggattttaaataattggttgtttttttcgtcgttattttttttttcgcgtcgttcgcgtttagttttttattggagagaaggcgtcgggaggaggagaaattgcggtttggagttttcggtcggagtcggcggagttggagtcgtggcggttttagatttcggggcgttcgtcgagtttatagatagagttacggttttagtcgttttggggtttttattagtttttttttcgttttttttttatgcgtgatttcgcgtcggtatttacgattgatttttgcggtttttagttttattttttggggtgtcgttttcgttttgtttttagagggtcggttggcgagggatattcgcgcggttttttcgattttttggttgagcgatcgatagcgattcgtttttttttttggggaaaggttgtattttcggttttcggcgtcgttgcggtggcggcgttcggggtcgcgttttgcgtt

SEQ ID NO: 12976 - DNA, 544 bp, Artificial Sequence
  chemically treated genomic DNA (Homo sapiens) CpG-island No: 12976
aacgcaaaacgcgaccccgaacgccgccaccgcaacgacgccgaaaaccgaaaatacaacctttccccaaaaaaaaaaacgaatcgctatcgatcgctcaaccaaaaaatcgaaaaaaccgcgcgaatatccctcgccaaccgaccctctaaaaacaaaacgaaaacgacaccccaaaaaataaaactaaaaaccgcaaaaatcaatcgtaaataccgacgcgaaatcacgcataaaaaaaaaacgaaaaaaaaactaataaaaaccccaaaacgactaaaaccgtaactctatctataaactcgacgaacgccccgaaatctaaaaccgccacgactccaactccgccgactccgaccgaaaactccaaaccgcaatttctcctcctcccgacgccttctctccaataaaaaactaaacgcgaacgacgcgaaaaaaaaaataacgacgaaaaaaacaaccaattatttaaaatccttctaaaacaatttctaattccccccttacgcccgaattcgaaaaaaaaaaaaaaaaaaaaaacgaa

SEQ ID NO: 12977 - DNA, 1501 bp, Artificial Sequence
  chemically treated genomic DNA (Homo sapiens) CpG-island No: 12977
agcggagagggaaggcgggagggagggagtcggggagggagggaaggagggaggagattgtcgttgaggtttagtcgttatcgcgcgtttcggaaggttagagggagggggaggtttgttagtttcgcgcgttgtttgggcgaagggggcggagttttggcgtggggcggttaatagtgggggtggttgcgtgggtcgttatggggacggggttgttttcggggaggttgtgatgggttgataggtgcgtgatagtgggagttgttttcggtataagtatgtacggtaaaggtaagagtaatagtagcgtcgtttcgttcgatagttaggttcgggagaagtaagtgttttcgttttttatttattttcgtttttatacgcgcgtatatttacgtacgtattcgtatattttgggagatatagatatttttcgttcggggagcgtcgggggtgggttggtagggggaggggtgtcgcgatgggggcgtgtggtgcggggagttgcgttttttcgggaggtgcgggcgttgggcgggcggtcgtagggggttgtcggcgggagggatcgggtgtgttgaggggcggcggtggtgttggtggcgaggatggaaatttgtttgggtgattgagggaaataattcgcgggtttattttttaaagtaattttagagttggggttcggggtttcggggatttggggagtcgtcgggggtggcgggaggggtagttgcgtggaggaaggcgcgtagtgggaatgtgggtgtttggcgggtcggtcggggtcggggtcggggtcggggcgggtagcgcggggagcgcggcggcgggggtttgggcgttggggtttagggtcgcgagcgcggggcgaggcgaggcgagggcggcggtgtcgggcgcgcggcgggcggaagtcgggcgtggagcggtcgagcggggtttcgcggggcgcggagacgcgcgcggggcgcggagggcgtgtgcgggttgggcgttcgggtttttttgggttagttacggacgcggcgttcgtagtttttcgcgtatcgcggggttggggttggggttggggcgggggcgggggcgggtgggcgtcggagacgtcgtcgaagtttgggagtcggagagggatcgagttttcggggagttaaagtgtgttggcgaggagcgggattcgttggaggaggttggcgtttttgtttttcgtagcggatttaatttcgcggcggcggttggcgaattttttgtgaggttggtagttttcgagcggcgggaggggcgggttcggcggggcggtggtcgggggcgcgcggaggggagttgtgggagtcgtcgggggcgttcgaggagggtagttgtggcggggagggttagtggttcgaaaaggggtttgtgggaggggagaagcgtttaggtgggaaggagtcgtttggttatagttgtggggagatataggtgttaatttcggtgggagtttaagaggcggttggcgagaatagagttt

SEQ ID NO: 12978 - DNA, 1501 bp, Artificial Sequence
  chemically treated genomic DNA (Homo sapiens) CpG-island No: 12978
aaactctattctcgccaaccgcctcttaaactcccaccgaaattaacacctatatctccccacaactataaccaaacgactccttcccacctaaacgcttctcccctcccacaaaccccttttcgaaccactaaccctccccgccacaactaccctcctcgaacgcccccgacgactcccacaactcccctccgcgcgcccccgaccaccgccccgccgaacccgcccctcccgccgctcgaaaactaccaacctcacaaaaaattcgccaaccgccgccgcgaaattaaatccgctacgaaaaacaaaaacgccaacctcctccaacgaatcccgctcctcgccaacacactttaactccccgaaaactcgatccctctccgactcccaaacttcgacgacgtctccgacgcccacccgcccccgcccccgccccaaccccaaccccaaccccgcgatacgcgaaaaactacgaacgccgcgtccgtaactaacccaaaaaaacccgaacgcccaacccgcacacgccctccgcgccccgcgcgcgtctccgcgccccgcgaaaccccgctcgaccgctccacgcccgacttccgcccgccgcgcgcccgacaccgccgccctcgcctcgcctcgccccgcgctcgcgaccctaaaccccaacgcccaaacccccgccgccgcgctccccgcgctacccgccccgaccccgaccccgaccccgaccgacccgccaaacacccacattcccactacgcgccttcctccacgcaactacccctcccgccacccccgacgactccccaaatccccgaaaccccgaaccccaactctaaaattactttaaaaaataaacccgcgaattatttccctcaatcacccaaacaaatttccatcctcgccaccaacaccaccgccgcccctcaacacacccgatccctcccgccgacaaccccctacgaccgcccgcccaacgcccgcacctcccgaaaaaacgcaactccccgcaccacacgcccccatcgcgacacccctccccctaccaacccacccccgacgctccccgaacgaaaaatatctatatctcccaaaatatacgaatacgtacgtaaatatacgcgcgtataaaaacgaaaataaataaaaaacgaaaacacttacttctcccgaacctaactatcgaacgaaacgacgctactattactcttacctttaccgtacatacttataccgaaaacaactcccactatcacgcacctatcaacccatcacaacctccccgaaaacaaccccgtccccataacgacccacgcaaccacccccactattaaccgccccacgccaaaactccgcccccttcgcccaaacaacgcgcgaaactaacaaacctccccctccctctaaccttccgaaacgcgcgataacgactaaacctcaacgacaatctcctccctccttccctccctccccgactccctccctcccgccttccctctccgct

SEQ ID NO: 12979 - DNA, 1501 bp, Artificial Sequence
  chemically treated genomic DNA (Homo sapiens) CpG-island No: 12979
gggttttgttttcgttagtcgttttttgggtttttatcgaagttaatatttgtatttttttataattgtaattaagcggtttttttttatttgaacgtttttttttttttataaattttttttcggattattggtttttttcgttatagttgtttttttcgggcgttttcggcggtttttataattttttttcgcgcgttttcgattatcgtttcgtcgggttcgtttttttcgtcgttcgggggttgttagttttataaaaagttcgttagtcgtcgtcgcggagttgggttcgttgcgagaggtagaaacgttagttttttttagcggatttcgtttttcgttaatatattttagtttttcgggaattcggttttttttcgatttttaaatttcggcggcgttttcggcgtttattcgttttcgttttcgttttagttttagttttagtttcgcgatgcgcgggggattgcgggcgtcgcgttcgtagttggtttaggaaagttcggacgtttaattcgtatacgtttttcgcgtttcgcgcgcgttttcgcgtttcgcggggtttcgttcggtcgttttacgttcggttttcgttcgtcgcgcgttcggtatcgtcgttttcgtttcgtttcgtttcgcgttcgcggttttaagttttagcgtttaggttttcgtcgtcgcgtttttcgcgttgttcgtttcgatttcggtttcgatttcggtcggttcgttaaatatttatatttttattgcgcgtttttttttacgtagttgtttttttcgttattttcggcggttttttaggttttcggagtttcggattttagttttaaagttattttggaaggtgaattcgcgggttattttttttaattatttaaataagtttttattttcgttattagtattatcgtcgttttttaatatattcggtttttttcgtcgatagttttttgcggtcgttcgtttagcgttcgtatttttcgggaaagcgtagtttttcgtattatacgtttttatcgcggtatttttttttttgttagtttattttcggcgtttttcgggcggagagtgtttgtgttttttagagtgtgcgagtgcgtgcgtgagtgtgcgcgcgtgtgaaggcggaggtgggtgagaagcggagatatttatttttttcgggtttggttgtcggacgggacggcgttgttgttatttttgtttttgtcgtatatgtttgtgtcgagagtagtttttattgttacgtatttgttaatttattatagttttttcgggaatagtttcgtttttatggcgatttacgtagttatttttattattggtcgttttacgttaaagtttcgtttttttcgtttaggtaacgcgcgagattgataggtttttttttttttttggtttttcgaagcgcgcggtggcggttaagttttagcggtagtttttttttttttttttttttttttcgattttttttttttcgtttttttttttcgtt

SEQ ID NO: 12980 - DNA, 1501 bp, Artificial Sequence
  chemically treated genomic DNA (Homo sapiens) CpG-island No: 12980
aacgaaaaaaaaaaacgaaaaaaaaaaaatcgaaaaaaaaaaaaaaaaaaaaaaaaactaccgctaaaacttaaccgccaccgcgcgcttcgaaaaaccaaaaaaaaaaaaaaacctatcaatctcgcgcgttacctaaacgaaaaaaacgaaactttaacgtaaaacgaccaataataaaaataactacgtaaatcgccataaaaacgaaactattcccgaaaaaactataataaattaacaaatacgtaacaataaaaactactctcgacacaaacatatacgacaaaaacaaaaataacaacaacgccgtcccgtccgacaaccaaacccgaaaaaaataaatatctccgcttctcacccacctccgccttcacacgcgcgcacactcacgcacgcactcgcacactctaaaaaacacaaacactctccgcccgaaaaacgccgaaaataaactaacaaaaaaaaaaataccgcgataaaaacgtataatacgaaaaactacgctttcccgaaaaatacgaacgctaaacgaacgaccgcaaaaaactatcgacgaaaaaaaccgaatatattaaaaaacgacgataatactaataacgaaaataaaaacttatttaaataattaaaaaaaataacccgcgaattcaccttccaaaataactttaaaactaaaatccgaaactccgaaaacctaaaaaaccgccgaaaataacgaaaaaaacaactacgtaaaaaaaaacgcgcaataaaaatataaatatttaacgaaccgaccgaaatcgaaaccgaaatcgaaacgaacaacgcgaaaaacgcgacgacgaaaacctaaacgctaaaacttaaaaccgcgaacgcgaaacgaaacgaaacgaaaacgacgataccgaacgcgcgacgaacgaaaaccgaacgtaaaacgaccgaacgaaaccccgcgaaacgcgaaaacgcgcgcgaaacgcgaaaaacgtatacgaattaaacgtccgaactttcctaaaccaactacgaacgcgacgcccgcaatcccccgcgcatcgcgaaactaaaactaaaactaaaacgaaaacgaaaacgaataaacgccgaaaacgccgccgaaatttaaaaatcgaaaaaaaaccgaattcccgaaaaactaaaatatattaacgaaaaacgaaatccgctaaaaaaaactaacgtttctacctctcgcaacgaacccaactccgcgacgacgactaacgaactttttataaaactaacaacccccgaacgacgaaaaaaacgaacccgacgaaacgataatcgaaaacgcgcgaaaaaaaattataaaaaccgccgaaaacgcccgaaaaaaacaactataacgaaaaaaaccaataatccgaaaaaaaatttataaaaaaaaaaaaacgttcaaataaaaaaaaaccgcttaattacaattataaaaaaatacaaatattaacttcgataaaaacccaaaaaacgactaacgaaaacaaaaccc

SEQ ID NO: 12981 - DNA, 1317 bp, Artificial Sequence
  chemically treated genomic DNA (Homo sapiens) CpG-island No: 12981
agagcgaggtaggtgggattttaggatgttcgttcggcggggcgatttcggttattttcgagattagggtttttttcgttcggtcgttacgttcgcgcgtagttcgggttatttcgaaatttcggcgcggttattataggataaattacgcgagtagagtttagcggcgcgttgggtatgcgcgggggcggcgcgatgtttatttttcgagaggcgggaatttcggattgagatcgggtcgggcgtgcgttgtcgagagaggacgcgcgttttagtcggttgtcgcgtacggcgggttcgcgtcgacgtagtacggtttcgagggcgcgacgcgtcgtcgtcgtcgtcgtcggtttcggattattgtgagttcgcggcgtgaggcgtgggaggaagcgcggttgttgtcgtttagcgtcgtttcgtcgtcgtttgttttcgttttacggcgtcgagtcgcggttcgagtgagtgcggggcgtcgggcggggcgcgggtcgggggttgggcgggttttttttgtgtagcggtcgtgggttgggcgcggttttgagggcggaggggtagagcggggtcgtttaattagtttcggggcggatgcggcggagatcggtttttttcgcgttttcggttcgggttttgggaggaggggaggtcggtggtcgtgaggaggttgggggttttcgcggaggtcgagaggtttaaggaggttagggggcgcgttgggaggcgggggttcggggcgttgggtggtcgggaggtttggggaagattgggaggttgagggacgtggggaggtcgggagttcgaggaggtcgggggttttgggggcgcgcggggaggttaaggggttcggggaagatagaaaggttgggggacgtggggagttcgggagacgtgaggaggaaggggggggcggttttcgaaaaggtcgggcgcgcggagaggtcgaggggtttgaggaagacgaggaggtcggggttttgggggcgcgtagggcggatagaggcgcggggaggacgggtcggttttcgtcggagcggatttaatgtttgaaaaataaaaggggagaggtaggaggaggaagagggaaatcgtagggacgtcggtagggttcgttcggacgcgagagggaggttcgcgacggttcgattttcgtttttcgggcgcggtttcgcgggtagttaagggtgggtttcgagcggtttgtcggtgttcgagttttaagttcgtcgtgttttcgaacgtaaatttttaagtttggtagagtttcgtgggttttttggcgggagttttggagtttttattgaagttttt

SEQ ID NO: 12982 - DNA, 1317 bp, Artificial Sequence
  chemically treated genomic DNA (Homo sapiens) CpG-island No: 12982
aaaaacttcaataaaaactccaaaactcccgccaaaaaacccacgaaactctaccaaacttaaaaatttacgttcgaaaacacgacgaacttaaaactcgaacaccgacaaaccgctcgaaacccacccttaactacccgcgaaaccgcgcccgaaaaacgaaaatcgaaccgtcgcgaacctccctctcgcgtccgaacgaaccctaccgacgtccctacgatttccctcttcctcctcctacctctccccttttatttttcaaacattaaatccgctccgacgaaaaccgacccgtcctccccgcgcctctatccgccctacgcgcccccaaaaccccgacctcctcgtcttcctcaaacccctcgacctctccgcgcgcccgaccttttcgaaaaccgccccccccttcctcctcacgtctcccgaactccccacgtcccccaacctttctatcttccccgaaccccttaacctccccgcgcgcccccaaaacccccgacctcctcgaactcccgacctccccacgtccctcaacctcccaatcttccccaaacctcccgaccacccaacgccccgaacccccgcctcccaacgcgccccctaacctccttaaacctctcgacctccgcgaaaacccccaacctcctcacgaccaccgacctcccctcctcccaaaacccgaaccgaaaacgcgaaaaaaaccgatctccgccgcatccgccccgaaactaattaaacgaccccgctctacccctccgccctcaaaaccgcgcccaacccacgaccgctacacaaaaaaaacccgcccaacccccgacccgcgccccgcccgacgccccgcactcactcgaaccgcgactcgacgccgtaaaacgaaaacaaacgacgacgaaacgacgctaaacgacaacaaccgcgcttcctcccacgcctcacgccgcgaactcacaataatccgaaaccgacgacgacgacgacgacgcgtcgcgccctcgaaaccgtactacgtcgacgcgaacccgccgtacgcgacaaccgactaaaacgcgcgtcctctctcgacaacgcacgcccgacccgatctcaatccgaaattcccgcctctcgaaaaataaacatcgcgccgcccccgcgcatacccaacgcgccgctaaactctactcgcgtaatttatcctataataaccgcgccgaaatttcgaaataacccgaactacgcgcgaacgtaacgaccgaacgaaaaaaaccctaatctcgaaaataaccgaaatcgccccgccgaacgaacatcctaaaatcccacctacctcgctct

SEQ ID NO: 12983 - DNA, 1317 bp, Artificial Sequence
  chemically treated genomic DNA (Homo sapiens) CpG-island No: 12983
gaggattttagtgagggttttagggttttcgttaagaagtttacggggttttattaaatttgagggtttgcgttcggggatacggcgggtttggggttcgggtatcggtaggtcgttcggagtttatttttggttgttcgcgaggtcgcgttcgggggacggaggtcgggtcgtcgcgagtttttttttcgcgttcgggcgaattttgtcgacgtttttgcgatttttttttttttttttttgtttttttttttttgttttttaggtattgggttcgtttcggcggaggtcggttcgtttttttcgcgtttttgttcgttttgcgcgtttttagagtttcggttttttcgttttttttaggtttttcggttttttcgcgcgttcggttttttcgaaagtcgtttttttttttttttttacgtttttcggattttttacgttttttagtttttttgtttttttcgaattttttggttttttcgcgcgtttttaaaattttcgattttttcgagttttcggtttttttacgttttttagttttttagttttttttaagtttttcgattatttagcgtttcgaattttcgttttttagcgcgttttttgatttttttaagtttttcggttttcgcgagggtttttaatttttttacggttatcggttttttttttttttagaattcgggtcgggggcgcgggaggggtcggttttcgtcgtattcgtttcgggattggttgggcggtttcgttttgttttttcgtttttagggtcgcgtttagtttacgatcgttgtatagaaggagttcgtttagttttcgattcgcgtttcgttcggcgtttcgtatttattcggatcgcggttcggcgtcgtgaagcgaaggtagacgacgacggggcggcgttgggcgatagtagtcgcgtttttttttacgttttacgtcgcgggtttatagtggttcgggatcggcggcggcggcggcggcgcgtcgcgttttcgaggtcgtgttgcgtcggcgcgggttcgtcgtgcgcggtagtcggttgaggcgcgcgttttttttcggtagcgtacgttcgattcggttttagttcggagttttcgtttttcgggggatgaatatcgcgtcgttttcgcgtatgtttagcgcgtcgttaggttttgttcgcgtaatttgttttgtagtgatcgcgtcggggtttcggggtggttcgggttgcgcgcgggcgtggcggtcggacgaggaaagttttggtttcgggggtggtcggggtcgtttcgtcgagcggatattttggggttttatttgtttcgtttt

SEQ ID NO: 12984 - DNA, 1317 bp, Artificial Sequence
  chemically treated genomic DNA (Homo sapiens) CpG-island No: 12984
aaaacgaaacaaataaaaccccaaaatatccgctcgacgaaacgaccccgaccacccccgaaaccaaaactttcctcgtccgaccgccacgcccgcgcgcaacccgaaccaccccgaaaccccgacgcgatcactacaaaacaaattacgcgaacaaaacctaacgacgcgctaaacatacgcgaaaacgacgcgatattcatcccccgaaaaacgaaaactccgaactaaaaccgaatcgaacgtacgctaccgaaaaaaaacgcgcgcctcaaccgactaccgcgcacgacgaacccgcgccgacgcaacacgacctcgaaaacgcgacgcgccgccgccgccgccgccgatcccgaaccactataaacccgcgacgtaaaacgtaaaaaaaaacgcgactactatcgcccaacgccgccccgtcgtcgtctaccttcgcttcacgacgccgaaccgcgatccgaataaatacgaaacgccgaacgaaacgcgaatcgaaaactaaacgaactccttctatacaacgatcgtaaactaaacgcgaccctaaaaacgaaaaaacaaaacgaaaccgcccaaccaatcccgaaacgaatacgacgaaaaccgacccctcccgcgcccccgacccgaattctaaaaaaaaaaaaaaccgataaccgtaaaaaaattaaaaaccctcgcgaaaaccgaaaaacttaaaaaaatcaaaaaacgcgctaaaaaacgaaaattcgaaacgctaaataatcgaaaaacttaaaaaaaactaaaaaactaaaaaacgtaaaaaaaccgaaaactcgaaaaaatcgaaaattttaaaaacgcgcgaaaaaaccaaaaaattcgaaaaaaacaaaaaaactaaaaaacgtaaaaaatccgaaaaacgtaaaaaaaaaaaaaaaaacgactttcgaaaaaaccgaacgcgcgaaaaaaccgaaaaacctaaaaaaaacgaaaaaaccgaaactctaaaaacgcgcaaaacgaacaaaaacgcgaaaaaaacgaaccgacctccgccgaaacgaacccaatacctaaaaaacaaaaaaaaaaaaacaaaaaaaaaaaaaaaaaaatcgcaaaaacgtcgacaaaattcgcccgaacgcgaaaaaaaaactcgcgacgacccgacctccgtcccccgaacgcgacctcgcgaacaaccaaaaataaactccgaacgacctaccgatacccgaaccccaaacccgccgtatccccgaacgcaaaccctcaaatttaataaaaccccgtaaacttcttaacgaaaaccctaaaaccctcactaaaatcctc

SEQ ID NO: 12985 - DNA, 976 bp, Artificial Sequence
  chemically treated genomic DNA (Homo sapiens) CpG-island No: 12985
  misc_feature (128)..(128): n is either a, c, g or t
gtgtgtcggcgcgtttgtgcgtggagggggataattgtatttagcgcgaggtattgggggaggaggaagcggtacgagagatttgaataattgattttttagtcgtattagacgttcgggagcggagnggagcgtggttttaatattacggatagtagcgcgcgtcgtcgtagcgtttcgtcgttagttagttatttattttggttttatttgtcgtcgtggttttcggaacgggtggtcgcgtttcgttcgtcgtcgagggattgcggggtttgtttcgatttatttaggagagaggttgcgggtaggagacgttttcgttcgtcggagttcgaagttttttgggtttgagcgggggttattgcgtttcgtcggttgagaataagtttttaagttggtgtggagggcgtcgttatttttttttttttttttttcggaggcgatcgtagtagaaagacgtttcgggaattcgttttgtagtgttgtgaattagggtgtttaggcgtttatcggattttcgttgggaagtggggagtcgaacgttcggcgcggagttggtttagtagcgaagggttcggagggagttgttttttttcgttcgcgtttttttcggtcggggatcgcggggattttcggttatacgcgagcgcgtttttatatttatatatatattcgtttttaaatatattagttcggagttgggttgcggagagggtgtttcggcgcgtttagaggatcgggtagttgtcgttcggagtggggtaggaagcggagttagggattttggaggggagtttttagggtttggtcggattatgggatcgggtgagcgttgagaatcgcggtcgtagttattagttttggagatgattaggagcggttattgttgagaattatgtggagagaggttgcggtgagtgttagcgcgggacgtcgcgtttgggaggtttttttgggaaggggggaggtgggaggt

SEQ ID NO: 12986 - DNA, 976 bp, Artificial Sequence
  chemically treated genomic DNA (Homo sapiens) CpG-island No: 12986
  misc_feature (849)..(849): n is either a, c, g or t
acctcccacctccccccttcccaaaaaaacctcccaaacgcgacgtcccgcgctaacactcaccgcaacctctctccacataattctcaacaataaccgctcctaatcatctccaaaactaataactacgaccgcgattctcaacgctcacccgatcccataatccgaccaaaccctaaaaactcccctccaaaatccctaactccgcttcctaccccactccgaacgacaactacccgatcctctaaacgcgccgaaacaccctctccgcaacccaactccgaactaatatatttaaaaacgaatatatatataaatataaaaacgcgctcgcgtataaccgaaaatccccgcgatccccgaccgaaaaaaacgcgaacgaaaaaaaacaactccctccgaacccttcgctactaaaccaactccgcgccgaacgttcgactccccacttcccaacgaaaatccgataaacgcctaaacaccctaattcacaacactacaaaacgaattcccgaaacgtctttctactacgatcgcctccgaaaaaaaaaaaaaaaaaaataacgacgccctccacaccaacttaaaaacttattctcaaccgacgaaacgcaataacccccgctcaaacccaaaaaacttcgaactccgacgaacgaaaacgtctcctacccgcaacctctctcctaaataaatcgaaacaaaccccgcaatccctcgacgacgaacgaaacgcgaccacccgttccgaaaaccacgacgacaaataaaaccaaaataaataactaactaacgacgaaacgctacgacgacgcgcgctactatccgtaatattaaaaccacgctccnctccgctcccgaacgtctaatacgactaaaaaatcaattattcaaatctctcgtaccgcttcctcctcccccaatacctcgcgctaaatacaattatccccctccacgcacaaacgcgccgacacac

SEQ ID NO: 12987 - DNA, 976 bp, Artificial Sequence
  chemically treated genomic DNA (Homo sapiens) CpG-island No: 12987
  misc_feature (849)..(849): n is either a, c, g or t
gttttttattttttttttttttaagggggttttttaggcgcggcgtttcgcgttagtatttatcgtagtttttttttatatagtttttagtagtggtcgtttttggttatttttagggttgatggttgcggtcgcgatttttagcgtttattcggttttatgattcggttaagttttaggagtttttttttaagatttttagtttcgttttttgttttatttcggacggtaattgttcggttttttgagcgcgtcggagtatttttttcgtaatttagtttcgggttggtgtgtttgagggcgagtgtgtgtgtgagtgtgggagcgcgttcgcgtgtggtcggggattttcgcggttttcggtcgagagaggcgcgggcggggaaaggtagtttttttcgggtttttcgttgttgggttagtttcgcgtcgggcgttcggttttttattttttagcgggagttcggtgagcgtttggatattttggtttatagtattgtaaagcgggttttcggggcgtttttttgttgcggtcgttttcgaggaagaggagaaggaaggtagcggcgttttttatattaatttagggatttgtttttagtcggcgagacgtagtagttttcgtttaagtttaagaggtttcgagtttcggcgggcgaaagcgttttttgttcgtagttttttttttaggtgggtcgagatagatttcgtagtttttcggcggcgagcggagcgcggttattcgtttcgagagttacggcggtaaataaggttaggataggtggttggttggcgacggggcgttgcggcggcgcgcgttgttgttcgtggtgttggaattacgttttntttcgttttcgggcgtttggtgcggttgaagaattaattatttagatttttcgtatcgttttttttttttttagtgtttcgcgttgggtatagttatttttttttacgtataggcgcgtcgatatat

SEQ ID NO: 12988 - DNA, 976 bp, Artificial Sequence
  chemically treated genomic DNA (Homo sapiens) CpG-island No: 12988
  misc_feature (128)..(128): n is either a, c, g or t
atatatcgacgcgcctatacgtaaaaaaaaataactatacccaacgcgaaacactaaaaaaaaaaaaaacgatacgaaaaatctaaataattaattcttcaaccgcaccaaacgcccgaaaacgaaanaaaacgtaattccaacaccacgaacaacaacgcgcgccgccgcaacgccccgtcgccaaccaaccacctatcctaaccttatttaccgccgtaactctcgaaacgaataaccgcgctccgctcgccgccgaaaaactacgaaatctatctcgacccacctaaaaaaaaaactacgaacaaaaaacgctttcgcccgccgaaactcgaaacctcttaaacttaaacgaaaactactacgtctcgccgactaaaaacaaatccctaaattaatataaaaaacgccgctaccttccttctcctcttcctcgaaaacgaccgcaacaaaaaaacgccccgaaaacccgctttacaatactataaaccaaaatatccaaacgctcaccgaactcccgctaaaaaataaaaaaccgaacgcccgacgcgaaactaacccaacaacgaaaaacccgaaaaaaactacctttccccgcccgcgcctctctcgaccgaaaaccgcgaaaatccccgaccacacgcgaacgcgctcccacactcacacacacactcgccctcaaacacaccaacccgaaactaaattacgaaaaaaatactccgacgcgctcaaaaaaccgaacaattaccgtccgaaataaaacaaaaaacgaaactaaaaatcttaaaaaaaaactcctaaaacttaaccgaatcataaaaccgaataaacgctaaaaatcgcgaccgcaaccatcaaccctaaaaataaccaaaaacgaccactactaaaaactatataaaaaaaaactacgataaatactaacgcgaaacgccgcgcctaaaaaacccccttaaaaaaaaaaaaaataaaaaac

SEQ ID NO: 12989 - DNA, 508 bp, Artificial Sequence
  chemically treated genomic DNA (Homo sapiens) CpG-island No: 12989
ggtcggattttacgaggtgttcgttaggagtttcgtttatcgttatttttttttataggcgattttcgttttttttagattatttttagttacgtgattcgcggagcggcggtttgttggtttaattggattttgcgtcgtttcgtagttttgtcggtaaacgttagtaaggggcggttttttagttgtgtagtcgttttcgcgttcgtgggttggagtatttgtgggcgaggtagggcggagattcgggagaggttgggattttttttttatcgcgtttttcgtcggcgtgacgtagtgtttgggtttcgtttttgtttttttagtattagagttttcggtttcgtttacgcgttttgggtataagagttttttcgttggtttcggaggtggggttgcgtttataaggggcgatcgtatttacggcggcggttattgtattgtgtttttattttttcggtgagaaattaagatagaaaattaattataataatatagagtaagtgtg

SEQ ID NO: 12990 - DNA, 508 bp, Artificial Sequence
  chemically treated genomic DNA (Homo sapiens) CpG-island No: 12990
cacacttactctatattattataattaattttctatcttaatttctcaccgaaaaaataaaaacacaatacaataaccgccgccgtaaatacgatcgccccttataaacgcaaccccacctccgaaaccaacgaaaaaactcttatacccaaaacgcgtaaacgaaaccgaaaactctaatactaaaaaaacaaaaacgaaacccaaacactacgtcacgccgacgaaaaacgcgataaaaaaaaaatcccaacctctcccgaatctccgccctacctcgcccacaaatactccaacccacgaacgcgaaaacgactacacaactaaaaaaccgccccttactaacgtttaccgacaaaactacgaaacgacgcaaaatccaattaaaccaacaaaccgccgctccgcgaatcacgtaactaaaaataatctaaaaaaaacgaaaatcgcctataaaaaaaaataacgataaacgaaactcctaacgaacacctcgtaaaatccgacc

SEQ ID NO: 12991 - DNA, 508 bp, Artificial Sequence
  chemically treated genomic DNA (Homo sapiens) CpG-island No: 12991
tatatttgttttgtgttattatggttagttttttattttggttttttatcggggaggtgggaatataatatagtggtcgtcgtcgtgaatacggtcgttttttgtgagcgtaattttattttcgggattaacgagaggatttttatgtttaaggcgcgtgagcgaagtcggagattttagtattgagggggtaagaacggggtttagatattacgttacgtcggcggaaagcgcgatggaggggaggttttagtttttttcgagttttcgttttgtttcgtttataaatgttttagtttacggacgcggaagcgattgtatagttaaagaatcgttttttgttaacgtttgtcggtaaaattacggagcggcgtaggatttagttgagttagtaggtcgtcgtttcgcgagttacgtgattggaagtagtttgggaaaagcggaagtcgtttgtgggaggaggtggcggtgggcggaatttttagcggatatttcgtggagttcggtt

SEQ ID NO: 12992 - DNA, 508 bp, Artificial Sequence
  chemically treated genomic DNA (Homo sapiens) CpG-island No: 12992
aaccgaactccacgaaatatccgctaaaaattccgcccaccgccacctcctcccacaaacgacttccgcttttcccaaactacttccaatcacgtaactcgcgaaacgacgacctactaactcaactaaatcctacgccgctccgtaattttaccgacaaacgttaacaaaaaacgattctttaactatacaatcgcttccgcgtccgtaaactaaaacatttataaacgaaacaaaacgaaaactcgaaaaaaactaaaacctcccctccatcgcgctttccgccgacgtaacgtaatatctaaaccccgttcttaccccctcaatactaaaatctccgacttcgctcacgcgccttaaacataaaaatcctctcgttaatcccgaaaataaaattacgctcacaaaaaacgaccgtattcacgacgacgaccactatattatattcccacctccccgataaaaaaccaaaataaaaaactaaccataataacacaaaacaaatata

SEQ ID NO: 12993 - DNA, 601 bp, Artificial Sequence
  chemically treated genomic DNA (Homo sapiens) CpG-island No: 12993
gcgagtttcgacgcgtagcggggttaggcgtcggtttttttttattacgcgttcggtttagggtcgtttagtcgtcgttatcgtcgtcgtatttatgggtagatggagtcggcgcggaaggttcgcgcgttttgcgtcgtcgtcgtttagtgtcgtcgttagtatttttttcgtttttttttttttcgggtttatttcgcgggggcggcgttattttttcgttgtttaggttcgggtatcgcgggcgtttcgcgggcggtagtcgtttttttcgagcgcgatttttaggttgggttcggggtcgggcggggagggaggagagattgagcgtgaagggagagggcgttcgagttttcggggacggaagtgtggagaataggagcgtgtgagggggcgttcgaggtgtcgggggcgggggaagagtatgagtaggggtgggggtaggggtgttaggtgtagtaggtagggaggtagaggcggcgagtgggggcgttcgagggatcggggcggggcggggagcgtaagggtggtaaggcgttcgagagttagggttggagttgaaggtgggtgatagggagggggcgtttaggtgttaggattt

SEQ ID NO: 12994 - DNA, 601 bp, Artificial Sequence
  chemically treated genomic DNA (Homo sapiens) CpG-island No: 12994
aaatcctaacacctaaacgccccctccctatcacccaccttcaactccaaccctaactctcgaacgccttaccacccttacgctccccgccccgccccgatccctcgaacgcccccactcgccgcctctacctccctacctactacacctaacacccctacccccacccctactcatactcttcccccgcccccgacacctcgaacgccccctcacacgctcctattctccacacttccgtccccgaaaactcgaacgccctctcccttcacgctcaatctctcctccctccccgcccgaccccgaacccaacctaaaaatcgcgctcgaaaaaaacgactaccgcccgcgaaacgcccgcgatacccgaacctaaacaacgaaaaaataacgccgcccccgcgaaataaacccgaaaaaaaaaaaaacgaaaaaaatactaacgacgacactaaacgacgacgacgcaaaacgcgcgaaccttccgcgccgactccatctacccataaatacgacgacgataacgacgactaaacgaccctaaaccgaacgcgtaataaaaaaaaaccgacgcctaaccccgctacgcgtcgaaactcgc

SEQ ID NO: 12995 - DNA, 601 bp, Artificial Sequence
  chemically treated genomic DNA (Homo sapiens) CpG-island No: 12995
aggttttgatatttgggcgttttttttttgttatttatttttagttttagttttgattttcgggcgttttgttatttttacgtttttcgtttcgtttcggtttttcgggcgtttttattcgtcgtttttatttttttatttgttatatttggtatttttgtttttatttttgtttatatttttttttcgttttcgatatttcgggcgtttttttatacgtttttattttttatattttcgttttcgaaaattcgggcgttttttttttttacgtttagtttttttttttttttcgttcggtttcggatttagtttggagatcgcgttcgggaggggcggttgtcgttcgcggggcgttcgcggtgttcgggtttgggtagcgaggaggtgacgtcgttttcgcgggatgagttcggaagaaggaggggcggaggaggtgttggcggcggtattgagcggcggcggcgtagggcgcgcgggtttttcgcgtcgattttatttatttatgggtgcggcggcggtggcggcggttgagcgattttgggtcgggcgcgtgatgaggaggggtcggcgtttgatttcgttgcgcgtcggagttcgt

SEQ ID NO: 12996 - DNA, 601 bp, Artificial Sequence
  chemically treated genomic DNA (Homo sapiens) CpG-island No: 12996
acgaactccgacgcgcaacgaaatcaaacgccgacccctcctcatcacgcgcccgacccaaaatcgctcaaccgccgccaccgccgccgcacccataaataaataaaatcgacgcgaaaaacccgcgcgccctacgccgccgccgctcaataccgccgccaacacctcctccgcccctccttcttccgaactcatcccgcgaaaacgacgtcacctcctcgctacccaaacccgaacaccgcgaacgccccgcgaacgacaaccgcccctcccgaacgcgatctccaaactaaatccgaaaccgaacgaaaaaaaaaaaaaaactaaacgtaaaaaaaaaaaacgcccgaattttcgaaaacgaaaatataaaaaataaaaacgtataaaaaaacgcccgaaatatcgaaaacgaaaaaaaaatataaacaaaaataaaaacaaaaataccaaatataacaaataaaaaaataaaaacgacgaataaaaacgcccgaaaaaccgaaacgaaacgaaaaacgtaaaaataacaaaacgcccgaaaatcaaaactaaaactaaaaataaataacaaaaaaaaaacgcccaaatatcaaaacct

SEQ ID NO: 12997 - DNA, 531 bp, Artificial Sequence
  chemically treated genomic DNA (Homo sapiens) CpG-island No: 12997
aggaggtcgcggagtcgttgcggggaggcggcggggttttggggtcgtatggttttcggttgtcgggtagcgcggagttggaggcggaggagatcgaggagaggaacgtggttagcgtttggtttcgtcgcgtttcgaggtcgtcgtaggttgtattaatgcgttttttattcgcgcgttttttttttttttttaatttttttcgttttcgcgatattcggagtttttatttcgtaataggtttcgagtttttatttcgagttcggcgtgggggcggatcgagagtcgggttcgtttttttttattgtagtcgttcggtttgttaggattttcgcggggttgcgtagattttcgtggagagttcgtttgtagggtttgggcggggtggttcgtggttaggagtcgtaggtcggggattttcgtaggtaatatagcgtcgtttaaatgaatattttagagatacgtggtttaatttgggtatacgagttatttttaagggtcgttaatttatggtatgggtcggcgagtttt

SEQ ID NO: 12998 - DNA, 531 bp, Artificial Sequence
  chemically treated genomic DNA (Homo sapiens) CpG-island No: 12998
aaaactcgccgacccataccataaattaacgacccttaaaaataactcgtatacccaaattaaaccacgtatctctaaaatattcatttaaacgacgctatattacctacgaaaatccccgacctacgactcctaaccacgaaccaccccgcccaaaccctacaaacgaactctccacgaaaatctacgcaaccccgcgaaaatcctaacaaaccgaacgactacaataaaaaaaaacgaacccgactctcgatccgcccccacgccgaactcgaaataaaaactcgaaacctattacgaaataaaaactccgaatatcgcgaaaacgaaaaaaattaaaaaaaaaaaaaaaacgcgcgaataaaaaacgcattaatacaacctacgacgacctcgaaacgcgacgaaaccaaacgctaaccacgttcctctcctcgatctcctccgcctccaactccgcgctacccgacaaccgaaaaccatacgaccccaaaaccccgccgcctccccgcaacgactccgcgacctcct

SEQ ID NO: 12999 - DNA, 531 bp, Artificial Sequence
  chemically treated genomic DNA (Homo sapiens) CpG-island No: 12999
aagattcgtcgatttatgttatagattgacgatttttgaaggtggttcgtgtatttaggttaagttacgtgtttttaaaatgtttatttaggcggcgttgtgttatttgcgggaattttcgatttgcggtttttgattacgggttatttcgtttagattttgtaggcgggttttttacgagggtttgcgtagtttcgcgggggttttgataggtcgagcgattgtagtaggagggggcgggttcggttttcggttcgtttttacgtcgggttcggggtgggggttcggggtttattacgggatggaagtttcgggtgtcgcgggggcgggaggaattaagggagggagagaggcgcgcgggtgaaaggcgtattgatgtagtttgcggcggtttcggagcgcggcggagttagacgttgattacgttttttttttcggtttttttcgtttttagtttcgcgttgttcggtagtcgggagttatgcgattttagggtttcgtcgttttttcgtagcggtttcgcggtttttt

SEQ ID NO: 13000 - DNA, 531 bp, Artificial Sequence
  chemically treated genomic DNA (Homo sapiens) CpG-island No: 13000
aaaaaaccgcgaaaccgctacgaaaaaacgacgaaaccctaaaatcgcataactcccgactaccgaacaacgcgaaactaaaaacgaaaaaaaccgaaaaaaaaaacgtaatcaacgtctaactccgccgcgctccgaaaccgccgcaaactacatcaatacgcctttcacccgcgcgcctctctccctcccttaattcctcccgcccccgcgacacccgaaacttccatcccgtaataaaccccgaacccccaccccgaacccgacgtaaaaacgaaccgaaaaccgaacccgccccctcctactacaatcgctcgacctatcaaaacccccgcgaaactacgcaaaccctcgtaaaaaacccgcctacaaaatctaaacgaaataacccgtaatcaaaaaccgcaaatcgaaaattcccgcaaataacacaacgccgcctaaataaacattttaaaaacacgtaacttaacctaaatacacgaaccaccttcaaaaatcgtcaatctataacataaatcgacgaatctt

SEQ ID NO: 13001 - DNA, 563 bp, Artificial Sequence
  chemically treated genomic DNA (Homo sapiens) CpG-island No: 13001
ggggttttcggtttcgcggttcgttttcgggtgtgtttggaggagttttttttttgtggcgcgcgggagttatgtgatgcgttagtcggcgggacgggtgagttgtttattcgggaaatcgttttcgtttttttacgattttttcggttttcgtttgggtgtttttcgggtcggtagtatttcgttttcgggcgttcgaagcgagtttttcgggggtttgttcgtaggtattttttttttttcgagacggcgcgcgcgttttcggttttgatcgcggtcggatatattcgcgtttcggttcgtttgtcgttattttcgtttgttttttttagttattttatttttagttgttttcgttattttattttattattttttttcgttttttcgcgtattacgcgtttcggtttttagttttttttttttttgaatcgtttattttatagtttttcgttttcgggaagaagaaatatttttcgaagcgtattttttagttttttttttttacgcgttcgtttttttttttttttgttttttttgggggaggggggttgtcgttttgg

SEQ ID NO: 13002 - DNA, 563 bp, Artificial Sequence
  chemically treated genomic DNA (Homo sapiens) CpG-island No: 13002
ccaaaacgacaacccccctcccccaaaaaaaacaaaaaaaaaaaaaaacgaacgcgtaaaaaaaaaaaactaaaaaatacgcttcgaaaaatatttcttcttcccgaaaacgaaaaactataaaataaacgattcaaaaaaaaaaaaaactaaaaaccgaaacgcgtaatacgcgaaaaaacgaaaaaaaataataaaataaaataacgaaaacaactaaaaataaaataactaaaaaaaacaaacgaaaataacgacaaacgaaccgaaacgcgaatatatccgaccgcgatcaaaaccgaaaacgcgcgcgccgtctcgaaaaaaaaaaaatacctacgaacaaacccccgaaaaactcgcttcgaacgcccgaaaacgaaatactaccgacccgaaaaacacccaaacgaaaaccgaaaaaatcgtaaaaaaacgaaaacgatttcccgaataaacaactcacccgtcccgccgactaacgcatcacataactcccgcgcgccacaaaaaaaaaactcctccaaacacacccgaaaacgaaccgcgaaaccgaaaacccc

SEQ ID NO: 13003 - DNA, 563 bp, Artificial Sequence
  chemically treated genomic DNA (Homo sapiens) CpG-island No: 13003
ttaaggcgatagttttttttttttaagaaaagtagggggaggggagggcgagcgcgtggggaaggagggttgaggagtgcgtttcgggaaatgtttttttttttcgggggcgaagggttgtgaagtgagcggtttaagggaaaggggaattggaggtcgggacgcgtagtgcgcggagaggcgggggagggtggtggagtaaggtggcggggatagttaagggtggggtgattggagggagtaggcgggagtggcgataggcggatcggggcgcgagtgtgttcggtcgcggttagggtcgggagcgcgcgcgtcgtttcggaggggaaggggtgtttgcgaataagttttcggggaattcgtttcgagcgttcggaggcggagtattgtcggttcgaggggtatttaggcgggagtcgagagggtcgtgaggaagcgaggacggtttttcggataagtaatttattcgtttcgtcggttgacgtattatatggttttcgcgcgttatagagggagaatttttttaggtatattcgggagcgggtcgcggggtcggaaatttt

SEQ ID NO: 13004 - DNA, 563 bp, Artificial Sequence
  chemically treated genomic DNA (Homo sapiens) CpG-island No: 13004
aaaatttccgaccccgcgacccgctcccgaatatacctaaaaaaattctccctctataacgcgcgaaaaccatataatacgtcaaccgacgaaacgaataaattacttatccgaaaaaccgtcctcgcttcctcacgaccctctcgactcccgcctaaatacccctcgaaccgacaatactccgcctccgaacgctcgaaacgaattccccgaaaacttattcgcaaacaccccttcccctccgaaacgacgcgcgcgctcccgaccctaaccgcgaccgaacacactcgcgccccgatccgcctatcgccactcccgcctactccctccaatcaccccacccttaactatccccgccaccttactccaccaccctcccccgcctctccgcgcactacgcgtcccgacctccaattcccctttcccttaaaccgctcacttcacaacccttcgcccccgaaaaaaaaaaacatttcccgaaacgcactcctcaaccctccttccccacgcgctcgccctcccctccccctacttttcttaaaaaaaaaaaactatcgccttaa

SEQ ID NO: 13005 - DNA, 506 bp, Artificial Sequence
  chemically treated genomic DNA (Homo sapiens) CpG-island No: 13005
aatcgtagtaggcgattttttaaggggatattgggggaggtacggaacgcgttcgaaaatgttgggacgtcggttattggatttttagttttgcggcgatttttttttcgttgaggggtggaggttgtatcgcggggcgttagggacgggaggatatttttataggagttatacgggagtgtcgtaagtagggcgaggcggggtacgtgtgatacggcgttcggtttcgggtcgtttggtcgttgggggatagaggtttttttttcgttacgttcgttttttttggttttggcggggcgtttttggggtcgggaggagtttcgtttttagcggagcgtttgtcggtatttagtttttttttttcgttttggcggtgggaatttgatttttttttttggtcgcgtttcgggggttggagtttgtttttttacgtcgtttaatgagcgttttttaaagggaattgtttttttggttttttttcgttcgtagttgtttttatttgggcg

SEQ ID NO: 13006 - DNA, 506 bp, Artificial Sequence
  chemically treated genomic DNA (Homo sapiens) CpG-island No: 13006
cgcccaaataaaaacaactacgaacgaaaaaaaaccaaaaaaacaattccctttaaaaaacgctcattaaacgacgtaaaaaaacaaactccaacccccgaaacgcgaccaaaaaaaaaaatcaaattcccaccgccaaaacgaaaaaaaaaaactaaataccgacaaacgctccgctaaaaacgaaactcctcccgaccccaaaaacgccccgccaaaaccaaaaaaaacgaacgtaacgaaaaaaaaacctctatcccccaacgaccaaacgacccgaaaccgaacgccgtatcacacgtaccccgcctcgccctacttacgacactcccgtataactcctataaaaatatcctcccgtccctaacgccccgcgatacaacctccacccctcaacgaaaaaaaaatcgccgcaaaactaaaaatccaataaccgacgtcccaacattttcgaacgcgttccgtacctcccccaatatccccttaaaaaatcgcctactacgatt

SEQ ID NO: 13007 - DNA, 506 bp, Artificial Sequence
  chemically treated genomic DNA (Homo sapiens) CpG-island No: 13007
cgtttaggtagaggtagttgcggacgagaggaggttaaggaggtagttttttttagagggcgtttattgggcgacgtggggaaataagttttagttttcgaagcgcgattaaaaggagaaattaagtttttatcgttagggcgggggagggaagttgggtgtcggtaggcgtttcgttggagacgagatttttttcggttttagaagcgtttcgttagggttagagagggcgagcgtggcgggagggaagtttttgttttttagcggttaggcgattcgaagtcgagcgtcgtgttatacgtatttcgtttcgttttgtttgcggtattttcgtgtaatttttatgaaaatgttttttcgtttttgacgtttcgcggtgtaatttttattttttaacgaggagggggtcgtcgtaggattgggaatttagtggtcggcgttttagtattttcggacgcgtttcgtgttttttttagtatttttttgagggatcgtttattgcgatt

SEQ ID NO: 13008 - DNA, 506 bp, Artificial Sequence
  chemically treated genomic DNA (Homo sapiens) CpG-island No: 13008
aatcgcaataaacgatccctcaaaaaaatactaaaaaaaacacgaaacgcgtccgaaaatactaaaacgccgaccactaaattcccaatcctacgacgaccccctcctcgttaaaaaataaaaattacaccgcgaaacgtcaaaaacgaaaaaacattttcataaaaattacacgaaaataccgcaaacaaaacgaaacgaaatacgtataacacgacgctcgacttcgaatcgcctaaccgctaaaaaacaaaaacttccctcccgccacgctcgccctctctaaccctaacgaaacgcttctaaaaccgaaaaaaatctcgtctccaacgaaacgcctaccgacacccaacttccctcccccgccctaacgataaaaacttaatttctccttttaatcgcgcttcgaaaactaaaacttatttccccacgtcgcccaataaacgccctctaaaaaaaactacctccttaacctcctctcgtccgcaactacctctacctaaacg

SEQ ID NO: 13009 - DNA, 1023 bp, Artificial Sequence
  chemically treated genomic DNA (Homo sapiens) CpG-island No: 13009
gtgcgaagttagtagtgcgcgtgcgcgcgggtacgggcgcgcgatcgtcgggttttcgcgttttttttttttttcgtttttttataatttggttggcgtggaggaggcgtcgtcggagtcggagggcggggagttaggaggagggagttcgagagttgtggagattagtgattgggagaagtcgtagttcgtttaggttcgcgttttttcgtttttcgttttttttttttatatatttatttcgtttttcgttttagttcgcgcgttagttttttttttcgttcggggtttttgtcggtagtttttcgggttttggcgcggcgggggcgtttcgggggtgttttcgttttttcgttgcgggcgggcgggcggtatgtggcgtttggtgttttcgaagttgggtcgtttgtttcgttcgttgaagttggcggcgttgggtagtttgttggtgttgatggtgttgtattcgtcgtcgttgttcgttttttggtagcgtaacgaattgatcgatcggcgttttttgtagtttaataagtgttcggcgtgtttcggtacgagttggtgtcgtcgtttttttaacgggtaggtggtattcgaggcgtggggtcgtttgcgtttgttggatttttttaacgtgaagaacgtgtatttcgcgtagtacggcgagtttcgcgagggcggtcgtcgtcgagtggtgtttaagcgtttcggttcgtagcgcgagttggcgtagttcgattagagtatttgtaagcgggttatcggtcggtttcgttgcgatttgttgtaggttatgtttcggatcgagttcgcgcgttttaacggcgacgtgcgtttgtttacgttcgaggcggtggagggttggtcggatttggtgtattgtttttcgtagcgttttttcgatcgtttggtgcgtcgttacgcggagattaaggattcgggtagttttttgtttcgtaattttaaggattcggagcgtatgtagttgttgttgattttggtttttaatttcgagtcgttggt

SEQ ID NO: 13010 - DNA, 1023 bp, Artificial Sequence
  chemically treated genomic DNA (Homo sapiens) CpG-island No: 13010
accaacgactcgaaattaaaaaccaaaatcaacaacaactacatacgctccgaatccttaaaattacgaaacaaaaaactacccgaatccttaatctccgcgtaacgacgcaccaaacgatcgaaaaaacgctacgaaaaacaatacaccaaatccgaccaaccctccaccgcctcgaacgtaaacaaacgcacgtcgccgttaaaacgcgcgaactcgatccgaaacataacctacaacaaatcgcaacgaaaccgaccgataacccgcttacaaatactctaatcgaactacgccaactcgcgctacgaaccgaaacgcttaaacaccactcgacgacgaccgccctcgcgaaactcgccgtactacgcgaaatacacgttcttcacgttaaaaaaatccaacaaacgcaaacgaccccacgcctcgaataccacctacccgttaaaaaaacgacgacaccaactcgtaccgaaacacgccgaacacttattaaactacaaaaaacgccgatcgatcaattcgttacgctaccaaaaaacgaacaacgacgacgaatacaacaccatcaacaccaacaaactacccaacgccgccaacttcaacgaacgaaacaaacgacccaacttcgaaaacaccaaacgccacataccgcccgcccgcccgcaacgaaaaaacgaaaacacccccgaaacgcccccgccgcgccaaaacccgaaaaactaccgacaaaaaccccgaacgaaaaaaaaaactaacgcgcgaactaaaacgaaaaacgaaataaatatataaaaaaaaaaaacgaaaaacgaaaaaacgcgaacctaaacgaactacgacttctcccaatcactaatctccacaactctcgaactccctcctcctaactccccgccctccgactccgacgacgcctcctccacgccaaccaaattataaaaaaacgaaaaaaaaaaaaaacgcgaaaacccgacgatcgcgcgcccgtacccgcgcgcacgcgcactactaacttcgcac

SEQ ID NO: 13011 - DNA, 1023 bp, Artificial Sequence
  chemically treated genomic DNA (Homo sapiens) CpG-island No: 13011
attagcggttcggggttgaaggttagggttagtagtagttgtatgcgtttcgagtttttgaggttgcgaagtaggaagttgttcgagtttttggttttcgcgtagcggcgtattaggcggtcgagaaggcgttgcgaggggtagtgtattaggttcgattagttttttatcgtttcgggcgtgagtagacgtacgtcgtcgttgaggcgcgcgaattcggttcggggtatggtttgtagtaggtcgtagcggggtcggtcggtggttcgtttgtagatgttttggtcgagttgcgttagttcgcgttgcgagtcgaggcgtttgagtattattcggcggcggtcgttttcgcggggttcgtcgtattgcgcgaagtatacgttttttacgttgaggaagtttagtaggcgtaagcggttttacgtttcgaatattatttgttcgttgaggaagcggcggtattagttcgtgtcgaagtacgtcgggtatttattgagttgtaggaagcgtcggtcggttagttcgttgcgttgttaagaggcgagtagcgacggcgagtgtagtattattagtattaataggttgtttagcgtcgttagttttagcgagcgggataggcggtttagtttcgggggtattaggcgttatatatcgttcgttcgttcgtaacgggagggcgagggtattttcggggcgttttcgtcgcgttaagattcggagagttatcggtaggaatttcgggcgagagaaggagttagcgcgcgggttggggcggagggcggagtaggtgtgtgagagaggaagacggggagcgggaaggcgcgggtttgagcgggttgcgattttttttagttattagtttttataattttcgagttttttttttttagtttttcgtttttcgatttcggcggcgttttttttacgttagttaagttatagaggagcgggagggggagggagcgcggggattcgacggtcgcgcgttcgtgttcgcgcgtacgcgtattgttggtttcgtat

SEQ ID NO: 13012 - DNA, 1023 bp, Artificial Sequence
  chemically treated genomic DNA (Homo sapiens) CpG-island No: 13012
atacgaaaccaacaatacgcgtacgcgcgaacacgaacgcgcgaccgtcgaatccccgcgctccctccccctcccgctcctctataacttaactaacgtaaaaaaaacgccgccgaaatcgaaaaacgaaaaactaaaaaaaaaaaactcgaaaattataaaaactaataactaaaaaaaatcgcaacccgctcaaacccgcgccttcccgctccccgtcttcctctctcacacacctactccgccctccgccccaacccgcgcgctaactccttctctcgcccgaaattcctaccgataactctccgaatcttaacgcgacgaaaacgccccgaaaataccctcgccctcccgttacgaacgaacgaacgatatataacgcctaatacccccgaaactaaaccgcctatcccgctcgctaaaactaacgacgctaaacaacctattaatactaataatactacactcgccgtcgctactcgcctcttaacaacgcaacgaactaaccgaccgacgcttcctacaactcaataaatacccgacgtacttcgacacgaactaataccgccgcttcctcaacgaacaaataatattcgaaacgtaaaaccgcttacgcctactaaacttcctcaacgtaaaaaacgtatacttcgcgcaatacgacgaaccccgcgaaaacgaccgccgccgaataatactcaaacgcctcgactcgcaacgcgaactaacgcaactcgaccaaaacatctacaaacgaaccaccgaccgaccccgctacgacctactacaaaccataccccgaaccgaattcgcgcgcctcaacgacgacgtacgtctactcacgcccgaaacgataaaaaactaatcgaacctaatacactacccctcgcaacgccttctcgaccgcctaatacgccgctacgcgaaaaccaaaaactcgaacaacttcctacttcgcaacctcaaaaactcgaaacgcatacaactactactaaccctaaccttcaaccccgaaccgctaat

SEQ ID NO: 13013 - DNA, 671 bp, Artificial Sequence
  chemically treated genomic DNA (Homo sapiens) CpG-island No: 13013
tttgcgtcgttcgtaaagtacgtgggagggaaattgaggttcggatagttttttttttacgtttacggagcgtcgatcgcggtttgggttagaaggagttatacggtaaaaaggggattgtacgtcgaattttatttttcgtcggtttttgttttttcgaatttttagcggttcgggtttttttttttcgcgggaagaatatttatagtcgagcgatttaggacgggagtggttcgggaagacgcgttagtcgtttacgattgtagtttagtaggttttcgaggtagcggtaggtagtggggtatgggcgttcggcggttattttagagggttgttcgagtttttcgcgatcgtcgttgtttgatcggttagcgcgttttagtatcgcgtatagtagtagttttaatttcgcggcgcgcgtacggaggttcggcgcgtttatcgcggtttagcggtttaggtttttattcgaagtttttagtcggcgcgcgttcggggttcggtataaatttttagtcgagggtgtacgttcgttttcgcggtcgcgtgcgcgtttttttttcgcgttgttcggttaatttttttttttattttcggcggcgaagtttttttatgtttttaaatagtaggagggaaatcgaaaagaattgttaattgtaatagagttgtag

SEQ ID NO: 13014 - DNA, 671 bp, Artificial Sequence
  chemically treated genomic DNA (Homo sapiens) CpG-island No: 13014
ctacaactctattacaattaacaattcttttcgatttccctcctactatttaaaaacataaaaaaacttcgccgccgaaaataaaaaaaaaaattaaccgaacaacgcgaaaaaaaaacgcgcacgcgaccgcgaaaacgaacgtacaccctcgactaaaaatttataccgaaccccgaacgcgcgccgactaaaaacttcgaataaaaacctaaaccgctaaaccgcgataaacgcgccgaacctccgtacgcgcgccgcgaaattaaaactactactatacgcgatactaaaacgcgctaaccgatcaaacaacgacgatcgcgaaaaactcgaacaaccctctaaaataaccgccgaacgcccataccccactacctaccgctacctcgaaaacctactaaactacaatcgtaaacgactaacgcgtcttcccgaaccactcccgtcctaaatcgctcgactataaatattcttcccgcgaaaaaaaaaaacccgaaccgctaaaaattcgaaaaaacaaaaaccgacgaaaaataaaattcgacgtacaatcccctttttaccgtataactccttctaacccaaaccgcgatcgacgctccgtaaacgtaaaaaaaaaactatccgaacctcaatttccctcccacgtactttacgaacgacgcaaa

SEQ ID NO: 13015 - DNA, 671 bp, Artificial Sequence
  chemically treated genomic DNA (Homo sapiens) CpG-island No: 13015
ttgtaattttgttgtagttggtagtttttttcggttttttttttgttgtttgggggtatgaaagggtttcgtcgtcgggagtaaaagaaggaattgatcgggtagcgcgagggaggagcgcgtacgcgatcgcgagggcgggcgtgtattttcggttggaagtttgtgtcgggtttcgagcgcgcgtcggttgggagtttcgggtagagatttaggtcgttggatcgcgatgagcgcgtcgagttttcgtgcgcgcgtcgcggggttggggttgttgttgtgcgcggtgttggggcgcgttggtcggttagatagcggcggtcgcggggaattcgggtagttttttggggtagtcgtcgagcgtttatgttttattatttgtcgttgtttcggggatttgttggattgtagtcgtaagcggttagcgcgttttttcgagttattttcgttttgggtcgttcggttgtaagtatttttttcgcggggggagggggttcgggtcgttggagattcgagaaaataggagtcggcggggaatggggttcggcgtgtagttttttttttgtcgtatagttttttttggtttaggtcgcgatcggcgtttcgtgggcgtggaaaaagaattgttcgggttttagttttttttttacgtgttttgcgggcggcgtagg

SEQ ID NO: 13016 - DNA, 671 bp, Artificial Sequence
  chemically treated genomic DNA (Homo sapiens) CpG-island No: 13016
cctacgccgcccgcaaaacacgtaaaaaaaaaactaaaacccgaacaattctttttccacgcccacgaaacgccgatcgcgacctaaaccaaaaaaaactatacgacaaaaaaaaaactacacgccgaaccccattccccgccgactcctattttctcgaatctccaacgacccgaaccccctccccccgcgaaaaaaatacttacaaccgaacgacccaaaacgaaaataactcgaaaaaacgcgctaaccgcttacgactacaatccaacaaatccccgaaacaacgacaaataataaaacataaacgctcgacgactaccccaaaaaactacccgaattccccgcgaccgccgctatctaaccgaccaacgcgccccaacaccgcgcacaacaacaaccccaaccccgcgacgcgcgcacgaaaactcgacgcgctcatcgcgatccaacgacctaaatctctacccgaaactcccaaccgacgcgcgctcgaaacccgacacaaacttccaaccgaaaatacacgcccgccctcgcgatcgcgtacgcgctcctccctcgcgctacccgatcaattccttcttttactcccgacgacgaaaccctttcatacccccaaacaacaaaaaaaaaaccgaaaaaaactaccaactacaacaaaattacaa

SEQ ID NO: 13017 - DNA, 620 bp, Artificial Sequence
  chemically treated genomic DNA (Homo sapiens) CpG-island No: 13017
tgggtgcgcgcggtgggggagggggtcggttttagttttaagtgcggttatttacgaagacgcgttgggtacgaagaaatttacggcgacgaagtaatttttttcggggttagagtattcggtaggattgtttacgtttaggttgaaggcgcggtatagaggtagtaggagtttcgagagaagaagcgggaggtcgcggggatcgaggcgtagtcgtcgtcgcggcggaaaagttatcgtcgaagtgcgcgcgggacgttaagtcgggagcggtagttattttttttcgttttagcgaggcgtttagtgttcgcggttcgtcgtttgcgcgcgtttaaatttgtcggtcgtttttttttcggttagttcgggatagtttcggggtaggtaagagggttgagtttcggagcgatcgttagggacgaggggcgtagagcgcgcggggcggggatagtagcgtagacggttttttgttttttttcggtttcgtcgttttacgtagcgtttgaggttggggattgtcggggtgagcgtcgtattttaggtttgagagtcgcggcggtattgggaggagatttggaaggaggaggagtcggttcgggaggttgttgtggagttgg

SEQ ID NO: 13018 - DNA, 620 bp, Artificial Sequence
  chemically treated genomic DNA (Homo sapiens) CpG-island No: 13018
ccaactccacaacaacctcccgaaccgactcctcctccttccaaatctcctcccaataccgccgcgactctcaaacctaaaatacgacgctcaccccgacaatccccaacctcaaacgctacgtaaaacgacgaaaccgaaaaaaaacaaaaaaccgtctacgctactatccccgccccgcgcgctctacgcccctcgtccctaacgatcgctccgaaactcaaccctcttacctaccccgaaactatcccgaactaaccgaaaaaaaaacgaccgacaaatttaaacgcgcgcaaacgacgaaccgcgaacactaaacgcctcgctaaaacgaaaaaaaataactaccgctcccgacttaacgtcccgcgcgcacttcgacgataacttttccgccgcgacgacgactacgcctcgatccccgcgacctcccgcttcttctctcgaaactcctactacctctataccgcgccttcaacctaaacgtaaacaatcctaccgaatactctaaccccgaaaaaaattacttcgtcgccgtaaatttcttcgtacccaacgcgtcttcgtaaataaccgcacttaaaactaaaaccgaccccctcccccaccgcgcgcaccca

SEQ ID NO: 13019 - DNA, 620 bp, Artificial Sequence
  chemically treated genomic DNA (Homo sapiens) CpG-island No: 13019
ttagttttatagtagtttttcgggtcggttttttttttttttaggtttttttttagtgtcgtcgcggtttttaggtttgaggtgcggcgtttatttcggtagtttttagttttagacgttgcgtggagcggcggagtcggagggaagtaaaggatcgtttgcgttgttgttttcgtttcgcgcgttttgcgtttttcgtttttggcggtcgtttcgaagtttagtttttttgtttgtttcggagttgtttcgggttagtcgagaagagagcggtcggtaagtttgggcgcgcgtaggcggcgggtcgcgggtattgggcgtttcgttggggcggggggaggtggttatcgttttcggtttggcgtttcgcgcgtatttcggcgatggttttttcgtcgcggcgacggttgcgtttcggttttcgcggtttttcgttttttttttcgggatttttgttatttttgtgtcgcgtttttaatttagacgtggatagttttgtcgagtattttggtttcgagggaagttatttcgtcgtcgtggattttttcgtgtttagcgcgttttcgtaagtggtcgtatttggaattggagtcggtttttttttttatcgcgcgtattta

SEQ ID NO: 13020 - DNA, 620 bp, Artificial Sequence
  chemically treated genomic DNA (Homo sapiens) CpG-island No: 13020
taaatacgcgcgataaaaaaaaaaaccgactccaattccaaatacgaccacttacgaaaacgcgctaaacacgaaaaaatccacgacgacgaaataacttccctcgaaaccaaaatactcgacaaaactatccacgtctaaattaaaaacgcgacacaaaaataacaaaaatcccgaaaaaaaaaacgaaaaaccgcgaaaaccgaaacgcaaccgtcgccgcgacgaaaaaaccatcgccgaaatacgcgcgaaacgccaaaccgaaaacgataaccacctccccccgccccaacgaaacgcccaatacccgcgacccgccgcctacgcgcgcccaaacttaccgaccgctctcttctcgactaacccgaaacaactccgaaacaaacaaaaaaactaaacttcgaaacgaccgccaaaaacgaaaaacgcaaaacgcgcgaaacgaaaacaacaacgcaaacgatcctttacttccctccgactccgccgctccacgcaacgtctaaaactaaaaactaccgaaataaacgccgcacctcaaacctaaaaaccgcgacgacactaaaaaaaaacctaaaaaaaaaaaaaaccgacccgaaaaactactataaaactaa

SEQ ID NO: 13021 - DNA, 1254 bp, Artificial Sequence
  chemically treated genomic DNA (Homo sapiens) CpG-island No: 13021
tcgtcgcgcgtcggggtcggtttttttttttttgagcgcgcgttcgggtagcgggggaggaaacgaggagggatttcggagagcgttttttgttttcgtttcgggcgttttatcgttacgagtgtcgtttgcggtttatatttaggtcgttcgtatttgttcgcgtcgtttttcggtcgggaggggttttcgtttttagtttagatgattatattcgttttcgcggttttattcgagcgcgttcggggagggggcgtgttcggcgggggcgcggtcgtttggcgggcgtcggtttcgagagttaagattcgtttcgcgcgacgcgcggggttagtcgcgggtcggagcggtaggggaaggggcgaggtttcgggcgtttcggttcgttcggtttttatttcgcgttttatcggggatttcgggggcgtggtcgggtagttcgcgtcgatttcgttcgcgcgattcgggcgttcgcgtcgttttattgatttgtgtgagtttttaggtgcgttttgaggtgcgaagatttttcgtaaattttttcgtagttcgcgtagtggtatttgtgttttttttgcggggattcgaggtcggcgcgatttcggtttcgtcggattttttgtttgaggtcgggttcgtcgtttttcgcgggtttcggttttcgttcgggttttagtttcgtttcgggtttcggttcgttttacgtcgggttggggggcgcggtcgtcgcgttttcggcgtcgggggaggtgggttcgggggcgggcggcggtaggcggtagggggttttcgtttttcgggtcgcggcgttttttttgcgtttcgtcggggcgggcgtcggcgtttgttggttgaggttcgttaggattcgcgttattacgaagagcgaggcgttgtttttatcgtcgcggcgtttttcgacgcggggtagcgtgggggtggcggttacggtcgcgttttcgggtcgggatttcggtttttttcgcggttcgtgtacgatcgcgcggttcgatatggatacgaggtattcggcggcgaagtggtttatataggcggcggttgttatgttgcgggttggggtcggcggcggtgtttttgttgcgagtcgttagtcgcgtattcgtatttacggtttcgggagagcgggcggggggcgggggcgcggcgcgtttttttttcgggttgggttgggttgttaaatatgttttaattaattatagtatttttggggttttgaggttgtttacgattttt

SEQ ID NO: 13022 - DNA, 1254 bp, Artificial Sequence
  chemically treated genomic DNA (Homo sapiens) CpG-island No: 13022
aaaaatcgtaaacaacctcaaaaccccaaaaatactataattaattaaaacatatttaacaacccaacccaacccgaaaaaaaaacgcgccgcgcccccgccccccgcccgctctcccgaaaccgtaaatacgaatacgcgactaacgactcgcaacaaaaacaccgccgccgaccccaacccgcaacataacaaccgccgcctatataaaccacttcgccgccgaatacctcgtatccatatcgaaccgcgcgatcgtacacgaaccgcgaaaaaaaccgaaatcccgacccgaaaacgcgaccgtaaccgccacccccacgctaccccgcgtcgaaaaacgccgcgacgataaaaacaacgcctcgctcttcgtaataacgcgaatcctaacgaacctcaaccaacaaacgccgacgcccgccccgacgaaacgcaaaaaaaacgccgcgacccgaaaaacgaaaaccccctaccgcctaccgccgcccgcccccgaacccacctcccccgacgccgaaaacgcgacgaccgcgccccccaacccgacgtaaaacgaaccgaaacccgaaacgaaactaaaacccgaacgaaaaccgaaacccgcgaaaaacgacgaacccgacctcaaacaaaaaatccgacgaaaccgaaatcgcgccgacctcgaatccccgcaaaaaaaacacaaataccactacgcgaactacgaaaaaatttacgaaaaatcttcgcacctcaaaacgcacctaaaaactcacacaaatcaataaaacgacgcgaacgcccgaatcgcgcgaacgaaatcgacgcgaactacccgaccacgcccccgaaatccccgataaaacgcgaaataaaaaccgaacgaaccgaaacgcccgaaacctcgccccttcccctaccgctccgacccgcgactaaccccgcgcgtcgcgcgaaacgaatcttaactctcgaaaccgacgcccgccaaacgaccgcgcccccgccgaacacgccccctccccgaacgcgctcgaataaaaccgcgaaaacgaatataatcatctaaactaaaaacgaaaacccctcccgaccgaaaaacgacgcgaacaaatacgaacgacctaaatataaaccgcaaacgacactcgtaacgataaaacgcccgaaacgaaaacaaaaaacgctctccgaaatccctcctcgtttcctcccccgctacccgaacgcgcgctcaaaaaaaaaaaaaccgaccccgacgcgcgacga

SEQ ID NO: 13023 - DNA, 1254 bp, Artificial Sequence
  chemically treated genomic DNA (Homo sapiens) CpG-island No: 13023
gggagtcgtgggtagttttaaagttttagagatgttgtgattgattgagatatatttggtagtttagtttagttcgaggagagggcgcgtcgcgttttcgtttttcgttcgttttttcgaggtcgtgggtgcggatgcgcggttgacgattcgtagtaagagtatcgtcgtcggttttagttcgtagtatggtagtcgtcgtttatgtggattatttcgtcgtcgagtgtttcgtgtttatgtcgagtcgcgcggtcgtgtacgggtcgcgggaggggtcggagtttcggttcgagggcgcggtcgtggtcgttatttttacgttgtttcgcgtcgaggagcgtcgcgacggtaaggatagcgtttcgtttttcgtggtggcgcggattttagcggattttaattagtaagcgtcggcgttcgtttcggcggagcgtagggagggcgtcgcggttcggaaggcgaggattttttgtcgtttgtcgtcgttcgttttcgagtttatttttttcggcgtcgaaggcgcggcggtcgcgttttttagttcggcgtggagcgagtcggagttcgaggcggggttggagttcgagcgggagtcggggttcgcggggagcggcgagttcggttttagataaagggttcggcggggtcgaagtcgcgtcgatttcgagttttcgtagaggaagtataagtgttattacgcgggttgcgagaaagtttacgggaaattttcgtattttaaggcgtatttgagaatttatataggttagtggggcggcgcgggcgttcggatcgcgcggacggggtcggcgcgagttgttcgattacgttttcggagttttcgatggggcgcgaggtgggggtcgggcgggtcggaacgttcggggtttcgtttttttttttgtcgtttcgattcgcggttggtttcgcgcgtcgcgcgaggcgggttttggttttcggagtcggcgttcgttaggcgatcgcgttttcgtcgggtacgtttttttttcgggcgcgttcgggtggggtcgcgggggcggatatagttatttgggttgggggcggggatttttttcggtcgggaggcggcgcgggtaggtgcgggcggtttgggtgtggatcgtaggcggtattcgtgacggtggggcgttcggagcgggggtaggggacgtttttcggggttttttttcgttttttttttcgttgttcgggcgcgcgtttaggaggggaggggtcggtttcggcgcgcggcgg

SEQ ID NO: 13024 - DNA, 1254 bp, Artificial Sequence
  chemically treated genomic DNA (Homo sapiens) CpG-island No: 13024
ccgccgcgcgccgaaaccgacccctcccctcctaaacgcgcgcccgaacaacgaaaaaaaaaacgaaaaaaaaccccgaaaaacgtcccctacccccgctccgaacgccccaccgtcacgaataccgcctacgatccacacccaaaccgcccgcacctacccgcgccgcctcccgaccgaaaaaaatccccgcccccaacccaaataactatatccgcccccgcgaccccacccgaacgcgcccgaaaaaaaaacgtacccgacgaaaacgcgatcgcctaacgaacgccgactccgaaaaccaaaacccgcctcgcgcgacgcgcgaaaccaaccgcgaatcgaaacgacaaaaaaaaaaacgaaaccccgaacgttccgacccgcccgacccccacctcgcgccccatcgaaaactccgaaaacgtaatcgaacaactcgcgccgaccccgtccgcgcgatccgaacgcccgcgccgccccactaacctatataaattctcaaatacgccttaaaatacgaaaatttcccgtaaactttctcgcaacccgcgtaataacacttatacttcctctacgaaaactcgaaatcgacgcgacttcgaccccgccgaaccctttatctaaaaccgaactcgccgctccccgcgaaccccgactcccgctcgaactccaaccccgcctcgaactccgactcgctccacgccgaactaaaaaacgcgaccgccgcgccttcgacgccgaaaaaaataaactcgaaaacgaacgacgacaaacgacaaaaaatcctcgccttccgaaccgcgacgccctccctacgctccgccgaaacgaacgccgacgcttactaattaaaatccgctaaaatccgcgccaccacgaaaaacgaaacgctatccttaccgtcgcgacgctcctcgacgcgaaacaacgtaaaaataacgaccacgaccgcgccctcgaaccgaaactccgacccctcccgcgacccgtacacgaccgcgcgactcgacataaacacgaaacactcgacgacgaaataatccacataaacgacgactaccatactacgaactaaaaccgacgacgatactcttactacgaatcgtcaaccgcgcatccgcacccacgacctcgaaaaaacgaacgaaaaacgaaaacgcgacgcgccctctcctcgaactaaactaaactaccaaatatatctcaatcaatcacaacatctctaaaactttaaaactacccacgactccc

SEQ ID NO: 13025 - DNA, 1352 bp, Artificial Sequence
  chemically treated genomic DNA (Homo sapiens) CpG-island No: 13025
agatagcgggcgggtggggcgcggtgggcggggttttcgtagttggtggcgtttgaagttttttcgatcgcggtgggagaggggtagtttagaagagttggtagcgggtttgcggcgggatggggaggaaggggtttcgcgtttttttagtagcggcgtcggtcgttttggtacgtagttcgtttttggaggtataggtcgcggtgggcgcgttattcgggttgttaggtttatcgttagtcgaggttagttttgttcgggttgattcgagttgaagggtagcgcggtcgtatttcggattttaggaacgagttcgagtttgtttttttcgcgggagttgtttcgttcggattttcggagttttgtaaggtaggggcgtggggagggcgagcggtttgaggttttaggcgcggttattcggtaagtcggcggcggagggcgcggcgcgagtgcgtttcgtttttaggtagtttcgcgttcggtcgggtagatacgttttttcgtcggcgtttatcgcgggaggaataaatggcgttttttagaaatcgtttttttttatgtcgggggttaaggttgttattatataaaagtttcggtagagaagtgttcgttgtgttttcgtcgcggggggtataagtagtcgtttcgcgtcgcgattattcggttcgtcgttttcggacgttatgcgttagcgcgtttcgttttagttttcgtttttttttttatcggtttaggggatacgtttattggcgcgcgtagggttcgggatcgggtacgtttttttaacggttcggattggtttggtcgtgtatttacggattaatggcgtttgtttcggttttcggttacgtttttttgtttaggcgcgggtacgcgatcgtttcgtttcgtcggtgcgcgttttggggttttcgtttttttcgcgcgcgtagtttttcgtagtcgtcgtcgtttgtaatttgcgtcgttaggatgtggttgggggttgacgtcgggtttagatgtggtttcggtttcgtttattttcggggtcgggtcgtttatacggagtcgcggcgcgtacggtagttgtttcgtttgttataatgcgcggcgaagttgcggtcgcgatttggcgaggtggtttttaacgttgtcgttcggtatttttagaatcggtcgtttttgacgtcgcgcggggattttagtcgttcgcgcgttttatgcgtttatttttcggtgttcggtcgggtcggcgtttcgtagacgcggagtcgcgcgggtgacggtataggcggttgcgcgtttagtttagtttagtttagtatttattttttttttattgtttttattttattttatttttagatttg

SEQ ID NO: 13026 - DNA, 1352 bp, Artificial Sequence
  chemically treated genomic DNA (Homo sapiens) CpG-island No: 13026
caaatctaaaaataaaataaaataaaaacaataaaaaaaaaataaatactaaactaaactaaactaaacgcgcaaccgcctataccgtcacccgcgcgactccgcgtctacgaaacgccgacccgaccgaacaccgaaaaataaacgcataaaacgcgcgaacgactaaaatccccgcgcgacgtcaaaaacgaccgattctaaaaataccgaacgacaacgttaaaaaccacctcgccaaatcgcgaccgcaacttcgccgcgcattataacaaacgaaacaactaccgtacgcgccgcgactccgtataaacgacccgaccccgaaaataaacgaaaccgaaaccacatctaaacccgacgtcaacccccaaccacatcctaacgacgcaaattacaaacgacgacgactacgaaaaactacgcgcgcgaaaaaaacgaaaaccccaaaacgcgcaccgacgaaacgaaacgatcgcgtacccgcgcctaaacaaaaaaacgtaaccgaaaaccgaaacaaacgccattaatccgtaaatacacgaccaaaccaatccgaaccgttaaaaaaacgtacccgatcccgaaccctacgcgcgccaataaacgtatcccctaaaccgataaaaaaaaaaacgaaaactaaaacgaaacgcgctaacgcataacgtccgaaaacgacgaaccgaataatcgcgacgcgaaacgactacttataccccccgcgacgaaaacacaacgaacacttctctaccgaaacttttatataataacaaccttaacccccgacataaaaaaaaacgatttctaaaaaacgccatttattcctcccgcgataaacgccgacgaaaaaacgtatctacccgaccgaacgcgaaactacctaaaaacgaaacgcactcgcgccgcgccctccgccgccgacttaccgaataaccgcgcctaaaacctcaaaccgctcgccctccccacgcccctaccttacaaaactccgaaaatccgaacgaaacaactcccgcgaaaaaaacaaactcgaactcgttcctaaaatccgaaatacgaccgcgctacccttcaactcgaatcaacccgaacaaaactaacctcgactaacgataaacctaacaacccgaataacgcgcccaccgcgacctatacctccaaaaacgaactacgtaccaaaacgaccgacgccgctactaaaaaaacgcgaaaccccttcctccccatcccgccgcaaacccgctaccaactcttctaaactacccctctcccaccgcgatcgaaaaaacttcaaacgccaccaactacgaaaaccccgcccaccgcgccccacccgcccgctatct

SEQ ID NO: 13027 - DNA, 1352 bp, Artificial Sequence
  chemically treated genomic DNA (Homo sapiens) CpG-island No: 13027
taagtttggaaatggggtaaggtgggggtagtggagaaagaatgagtgttgggttgggttgggttgggcgcgtagtcgtttgtgtcgttattcgcgcggtttcgcgtttgcgaggcgtcggttcggtcgggtatcgaagagtgagcgtatggggcgcgcgggcgattggggttttcgcgcggcgttaggggcggtcggttttaaggatgtcgagcggtagcgttagggattatttcgttaagtcgcggtcgtagtttcgtcgcgtattgtggtaggcgggatagttgtcgtgcgcgtcgcggtttcgtgtgggcggttcggtttcgggggtgggcggggtcggggttatatttggattcgacgttagtttttagttatattttggcggcgtaggttataggcggcggcggttgcggggagttgcgcgcgcggagggggcggggattttagagcgcgtatcggcggaacggagcggtcgcgtgttcgcgtttgggtaagggggcgtgatcgagggtcgggatagacgttattggttcgtgagtgtacggttaggttaattcgagtcgttagaggggcgtgttcggtttcgggttttgcgcgcgttagtgggcgtgttttttgggtcggtgggaggaggggcggaaattggagcggggcgcgttgacgtatgacgttcgggggcggcgggtcgggtagtcgcggcgcggagcggttgtttgtatttttcgcggcggggatatagcgagtatttttttgtcggagtttttatgtggtgatagttttggttttcggtatggaggggagcggtttttggagggcgttatttgtttttttcgcgatgggcgtcggcggggaggcgtgtttgttcggtcgggcgcggggttgtttaggggcggaacgtattcgcgtcgcgtttttcgtcgtcggtttgtcgggtggtcgcgtttagagttttaggtcgttcgttttttttacgtttttgttttgtagagtttcgggagttcgggcggggtagttttcgcgggagggatagattcgggttcgtttttggggttcggggtgcggtcgcgttgttttttagttcgggttagttcgagtaggattggtttcggttggcggtgagtttggtagttcgggtggcgcgtttatcgcggtttgtgtttttagaagcgaattacgtgttagggcggtcggcgtcgttgttgagggaacgcggggtttttttttttttatttcgtcgtaggttcgttgttaatttttttaggttgttttttttttatcgcggtcgggggggttttaaacgttattagttgcgaggatttcgtttatcgcgttttattcgttcgttgttt

SEQ ID NO: 13028 - DNA, 1352 bp, Artificial Sequence
  chemically treated genomic DNA (Homo sapiens) CpG-island No: 13028
aaacaacgaacgaataaaacgcgataaacgaaatcctcgcaactaataacgtttaaaacccccccgaccgcgataaaaaaaaaacaacctaaaaaaattaacaacgaacctacgacgaaataaaaaaaaaaaaaccccgcgttccctcaacaacgacgccgaccgccctaacacgtaattcgcttctaaaaacacaaaccgcgataaacgcgccacccgaactaccaaactcaccgccaaccgaaaccaatcctactcgaactaacccgaactaaaaaacaacgcgaccgcaccccgaaccccaaaaacgaacccgaatctatccctcccgcgaaaactaccccgcccgaactcccgaaactctacaaaacaaaaacgtaaaaaaaacgaacgacctaaaactctaaacgcgaccacccgacaaaccgacgacgaaaaacgcgacgcgaatacgttccgcccctaaacaaccccgcgcccgaccgaacaaacacgcctccccgccgacgcccatcgcgaaaaaaacaaataacgccctccaaaaaccgctcccctccataccgaaaaccaaaactatcaccacataaaaactccgacaaaaaaatactcgctatatccccgccgcgaaaaatacaaacaaccgctccgcgccgcgactacccgacccgccgcccccgaacgtcatacgtcaacgcgccccgctccaatttccgcccctcctcccaccgacccaaaaaacacgcccactaacgcgcgcaaaacccgaaaccgaacacgcccctctaacgactcgaattaacctaaccgtacactcacgaaccaataacgtctatcccgaccctcgatcacgcccccttacccaaacgcgaacacgcgaccgctccgttccgccgatacgcgctctaaaatccccgccccctccgcgcgcgcaactccccgcaaccgccgccgcctataacctacgccgccaaaatataactaaaaactaacgtcgaatccaaatataaccccgaccccgcccacccccgaaaccgaaccgcccacacgaaaccgcgacgcgcacgacaactatcccgcctaccacaatacgcgacgaaactacgaccgcgacttaacgaaataatccctaacgctaccgctcgacatccttaaaaccgaccgcccctaacgccgcgcgaaaaccccaatcgcccgcgcgccccatacgctcactcttcgatacccgaccgaaccgacgcctcgcaaacgcgaaaccgcgcgaataacgacacaaacgactacgcgcccaacccaacccaacccaacactcattctttctccactacccccaccttaccccatttccaaactta

SEQ ID NO: 13029 - DNA, 986 bp, Artificial Sequence
  chemically treated genomic DNA (Homo sapiens) CpG-island No: 13029
tcgtttgcgtcgttttttcggggcgttcgcgttgtgtttatttagttgtttttgaggtttcggttttttttaaatttttgaagcgtttcgtgtacgcgacgcggcggcggggtaagttggagttttcgtcgcgagtttttttcgttgtttgttcgtagtatagtcgcgtcgatttttttattatggcggcggtcgggcggggaagtcgggtcgtgcgtcgcgtgcgtgttttttttttttttttttttttttcggcggcggcggcggcggtagaagcggtagcgttcgttattgtcgttggtggtaggaggttgcgaggagtcggcgcggtcgtagtttttacggcgtaggtttacggtagcgtagtcgttttgaggtgagtgttttatcgcgtaatttttagttattttagtttcggcgtagtcgtaatacgtcgttcgttcgtcggtcggtcggttcgtttcgtagtcggtattttgtcgttttcggttttgggtttgggttttcgtcggattcggttcgtttcgggcggggggtttcggttcggtttagttaaatcgttatttcgaggatgcgtaggtcgtattaggttttaggcgttttggcgggttcgggagggaggcgttgttttttcgagagttttagggtttcggtttttttcgtcgtttggggttttcggggtcgcggtttttttttcgtcgtggaattcggggttcggttttttcgtagttcgggagcgggaggcgcgggagagtgcgtcgggttcgggagcgggaggtgggcgggttgcgcgggatcggagtcgcggttttcggttcgttttttcggtttttttcggttttcgtacgcgggcgggcgggcgggcggcgcggtggggtcgggttggggcgcgggagtcgttgttttttgcgggagaggaggttggttttttgggcgattttcgaagttttttttttgtcggggtggcgtgggtttgttatttaggt

SEQ ID NO: 13030 - DNA, 986 bp, Artificial Sequence
  chemically treated genomic DNA (Homo sapiens) CpG-island No: 13030
acctaaataacaaacccacgccaccccgacaaaaaaaaaacttcgaaaatcgcccaaaaaaccaacctcctctcccgcaaaaaacaacgactcccgcgccccaacccgaccccaccgcgccgcccgcccgcccgcccgcgtacgaaaaccgaaaaaaaccgaaaaaacgaaccgaaaaccgcgactccgatcccgcgcaacccgcccacctcccgctcccgaacccgacgcactctcccgcgcctcccgctcccgaactacgaaaaaaccgaaccccgaattccacgacgaaaaaaaaaccgcgaccccgaaaaccccaaacgacgaaaaaaaccgaaaccctaaaactctcgaaaaaacaacgcctccctcccgaacccgccaaaacgcctaaaacctaatacgacctacgcatcctcgaaataacgatttaactaaaccgaaccgaaaccccccgcccgaaacgaaccgaatccgacgaaaacccaaacccaaaaccgaaaacgacaaaataccgactacgaaacgaaccgaccgaccgacgaacgaacgacgtattacgactacgccgaaactaaaataactaaaaattacgcgataaaacactcacctcaaaacgactacgctaccgtaaacctacgccgtaaaaactacgaccgcgccgactcctcgcaacctcctaccaccaacgacaataacgaacgctaccgcttctaccgccgccgccgccgccgaaaaaaaaaaaaaaaaaaaaaaaacacgcacgcgacgcacgacccgacttccccgcccgaccgccgccataataaaaaaatcgacgcgactatactacgaacaaacaacgaaaaaaactcgcgacgaaaactccaacttaccccgccgccgcgtcgcgtacacgaaacgcttcaaaaatttaaaaaaaaccgaaacctcaaaaacaactaaataaacacaacgcgaacgccccgaaaaaacgacgcaaacga

SEQ ID NO: 13031 - DNA, 986 bp, Artificial Sequence
  chemically treated genomic DNA (Homo sapiens) CpG-island No: 13031
atttgggtaataagtttacgttatttcggtaggagggaagtttcggaggtcgtttaaagagttagttttttttttcgtaggagatagcggttttcgcgttttagttcggttttatcgcgtcgttcgttcgttcgttcgcgtacgagagtcgggaagggtcgagggggcgagtcgagagtcgcggtttcggtttcgcgtagttcgtttatttttcgttttcgggttcggcgtattttttcgcgtttttcgttttcgagttgcgggaaggtcgggtttcgggttttacggcggggagaaggtcgcggtttcgagagttttaggcggcggaggaggtcggaattttggggttttcgggagggtagcgtttttttttcgagttcgttaggacgtttggggtttagtgcggtttgcgtattttcggggtggcggtttggttgggtcgggtcggggtttttcgttcgaggcgggtcgaattcggcgggggtttaggtttagagtcgggggcggtagggtgtcggttgcggggcgggtcggtcggtcggcgggcgggcggcgtgttgcggttgcgtcggggttgaaatagttggagattgcgcggtagggtatttattttagagcggttgcgttatcgtgggtttgcgtcgtggagattgcgatcgcgtcggtttttcgtagttttttgttattagcggtaatggcgagcgttgtcgtttttgtcgtcgtcgtcgtcgtcgaggagggggaggggagggagagggtacgtacgcgacgtacggttcggttttttcgttcggtcgtcgttatgatgaggaggtcggcgcggttgtgttgcgggtaggtagcggagagggttcgcggcgagggttttagtttatttcgtcgtcgcgtcgcgtgtacggagcgttttagaggtttggagggggtcggaattttaaaagtaattggatgagtataacgcggacgtttcggagaagcggcgtaagcgg

SEQ ID NO: 13032 - DNA, 986 bp, Artificial Sequence
  chemically treated genomic DNA (Homo sapiens) CpG-island No: 13032
ccgcttacgccgcttctccgaaacgtccgcgttatactcatccaattacttttaaaattccgaccccctccaaacctctaaaacgctccgtacacgcgacgcgacgacgaaataaactaaaaccctcgccgcgaaccctctccgctacctacccgcaacacaaccgcgccgacctcctcatcataacgacgaccgaacgaaaaaaccgaaccgtacgtcgcgtacgtaccctctccctcccctccccctcctcgacgacgacgacgacgacaaaaacgacaacgctcgccattaccgctaataacaaaaaactacgaaaaaccgacgcgatcgcaatctccacgacgcaaacccacgataacgcaaccgctctaaaataaataccctaccgcgcaatctccaactatttcaaccccgacgcaaccgcaacacgccgcccgcccgccgaccgaccgacccgccccgcaaccgacaccctaccgcccccgactctaaacctaaacccccgccgaattcgacccgcctcgaacgaaaaaccccgacccgacccaaccaaaccgccaccccgaaaatacgcaaaccgcactaaaccccaaacgtcctaacgaactcgaaaaaaaaacgctaccctcccgaaaaccccaaaattccgacctcctccgccgcctaaaactctcgaaaccgcgaccttctccccgccgtaaaacccgaaacccgaccttcccgcaactcgaaaacgaaaaacgcgaaaaaatacgccgaacccgaaaacgaaaaataaacgaactacgcgaaaccgaaaccgcgactctcgactcgccccctcgacccttcccgactctcgtacgcgaacgaacgaacgaacgacgcgataaaaccgaactaaaacgcgaaaaccgctatctcctacgaaaaaaaaaactaactctttaaacgacctccgaaacttccctcctaccgaaataacgtaaacttattacccaaat

SEQ ID NO: 13033 - DNA, 865 bp, Artificial Sequence
  chemically treated genomic DNA (Homo sapiens) CpG-island No: 13033
ggttgttgcgtttttagtaggcgcggatcgtcgggtattttttgtttttttattttttcgttacgcgttgaggtcgattttagggagaggcggtgatttcggcgttcgcgttttttcgggatagtttggggttttacggcgcgcgttttggtttcgggtattttagggagacggggattattatggcgatttttagtcgagtaggtaggcgtggtggattttttcgatttcgaagtttttagtatttatcggggtcgttgtttttagcgttcgtttttttagtattttcggttttttttcggttttttttagggaatcgttacgggtttagttttattacgttttttcgttacgtttcgttgggaggagcgcggtcggttcgggaggtagttagtcgcggagtcgtttggacgcgaggtatttgtttgttttacgcggtatttaggtcgtcgtagttgtgggcgttgggtcggcgtgcgtttcgggggcggggtcgcgcgtataattatcgggcgtggggtagggtttcgtcgtggttatcgttgttagggtaaagcggtagcgcgcggagggtgagcggagcggggtttcgggtttgcgcgcgcgggatgggtcgttatttagtacgaggtcgatcgcggtttttagcgttcggaaatttagttcggcgttttagcgtttgggtttgggttgtcggagcggcgggcgcggggcgagggggcgggcgcggggcgagggggcgggcgcggggcgagggggcgggcgcgggcggcgtttttattggggtggtattggggtgagagcgtaggttaggttcgtttattcggttaatttgggagagattatcggagaagtttttttggga

SEQ ID NO: 13034 - DNA, 865 bp, Artificial Sequence
  chemically treated genomic DNA (Homo sapiens) CpG-island No: 13034
tcccaaaaaaacttctccgataatctctcccaaattaaccgaataaacgaacctaacctacgctctcaccccaataccaccccaataaaaacgccgcccgcgcccgccccctcgccccgcgcccgccccctcgccccgcgcccgccccctcgccccgcgcccgccgctccgacaacccaaacccaaacgctaaaacgccgaactaaatttccgaacgctaaaaaccgcgatcgacctcgtactaaataacgacccatcccgcgcgcgcaaacccgaaaccccgctccgctcaccctccgcgcgctaccgctttaccctaacaacgataaccacgacgaaaccctaccccacgcccgataattatacgcgcgaccccgcccccgaaacgcacgccgacccaacgcccacaactacgacgacctaaataccgcgtaaaacaaacaaatacctcgcgtccaaacgactccgcgactaactacctcccgaaccgaccgcgctcctcccaacgaaacgtaacgaaaaaacgtaataaaactaaacccgtaacgattccctaaaaaaaaccgaaaaaaaaccgaaaatactaaaaaaacgaacgctaaaaacaacgaccccgataaatactaaaaacttcgaaatcgaaaaaatccaccacgcctacctactcgactaaaaatcgccataataatccccgtctccctaaaatacccgaaaccaaaacgcgcgccgtaaaaccccaaactatcccgaaaaaacgcgaacgccgaaatcaccgcctctccctaaaatcgacctcaacgcgtaacgaaaaaataaaaaaacaaaaaatacccgacgatccgcgcctactaaaaacgcaacaacc

SEQ ID NO: 13035 - DNA, 865 bp, Artificial Sequence
  chemically treated genomic DNA (Homo sapiens) CpG-island No: 13035
ttttaaaagagttttttcgatgattttttttaggttggtcgagtgagcgggtttagtttgcgtttttattttagtgttattttagtgggagcgtcgttcgcgttcgttttttcgtttcgcgttcgttttttcgtttcgcgttcgttttttcgtttcgcgttcgtcgtttcggtagtttaaatttagacgttaaagcgtcgaattgggttttcgggcgttggaggtcgcggtcggtttcgtattaggtgacggtttatttcgcgcgcgtaagttcggaatttcgtttcgtttatttttcgcgcgttgtcgttttgttttggtaacggtaattacggcgaggttttgttttacgttcggtgattgtgcgcgcggtttcgttttcgaggcgtacgtcggtttagcgtttatagttgcggcggtttaggtgtcgcgtggggtaagtaggtgtttcgcgtttaggcggtttcgcggttggttgtttttcgagtcggtcgcgttttttttagcgaggcgtggcggggaggcgtagtgaggttgggttcgtggcggttttttgaggagggtcgagaaggggtcgggggtgttaggggaacgggcgttgggggtagcggtttcggtggatgttaagggtttcgggatcgggagagtttattacgtttgtttgttcggttgagaatcgttatggtaattttcgtttttttaaagtattcggggttagggcgcgcgtcgtggagttttaggttgtttcggagaggcgcgggcgtcgaggttatcgtttttttttggggtcgattttaacgcgtggcgaaaagatggagggataaggggtgttcggcggttcgcgtttgttgggggcgtagtagtt

SEQ ID NO: 13036 - DNA, 865 bp, Artificial Sequence
  chemically treated genomic DNA (Homo sapiens) CpG-island No: 13036
aactactacgcccccaacaaacgcgaaccgccgaacaccccttatccctccatcttttcgccacgcgttaaaatcgaccccaaaaaaaaacgataacctcgacgcccgcgcctctccgaaacaacctaaaactccacgacgcgcgccctaaccccgaatactttaaaaaaacgaaaattaccataacgattctcaaccgaacaaacaaacgtaataaactctcccgatcccgaaacccttaacatccaccgaaaccgctacccccaacgcccgttcccctaacacccccgaccccttctcgaccctcctcaaaaaaccgccacgaacccaacctcactacgcctccccgccacgcctcgctaaaaaaaacgcgaccgactcgaaaaacaaccaaccgcgaaaccgcctaaacgcgaaacacctacttaccccacgcgacacctaaaccgccgcaactataaacgctaaaccgacgtacgcctcgaaaacgaaaccgcgcgcacaatcaccgaacgtaaaacaaaacctcgccgtaattaccgttaccaaaacaaaacgacaacgcgcgaaaaataaacgaaacgaaattccgaacttacgcgcgcgaaataaaccgtcacctaatacgaaaccgaccgcgacctccaacgcccgaaaacccaattcgacgctttaacgtctaaatttaaactaccgaaacgacgaacgcgaaacgaaaaaacgaacgcgaaacgaaaaaacgaacgcgaaacgaaaaaacgaacgcgaacgacgctcccactaaaataacactaaaataaaaacgcaaactaaacccgctcactcgaccaacctaaaaaaaatcatcgaaaaaactcttttaaaa

SEQ ID NO: 13037 - DNA, 582 bp, Artificial Sequence
  chemically treated genomic DNA (Homo sapiens) CpG-island No: 13037
cggtaggagacgggcggatattggttcgggttaaagagtttagagtttagtcgttaggatttcgtaggcgtttattgcgcggggttgatcgagcgcgtcgagggtttcggggtcgaggtcgaattattttagtcgtcgtttttcgtcggcgggcgttttcgggttttagtcgaagtttttcgggttttttatttttgattttcgtcgttggtttcggaacgtttcgcggtttttgggcgtcgtttgtttttttttgtcgtcgtcgttgttattgttatttgcgggcgggttttcggttttaggcgcggcggggttttttatgttgttggttagcggttttttttagggtttagttcgttttgtcggaggcgattttatcgtcgcgcgtcgggagttaggtttcgttttttttatttttattggttacggtagttcgtcgtaatttcgtttcgcgaggcgattggttgttcgatcggtcggagcgggattcgaggaggtgggggtttaatgaagagatttttgaggggatttttttagttttgcggtattgttggcggacggagatttttaggttagttatag

SEQ ID NO: 13038 - DNA, 582 bp, Artificial Sequence
  chemically treated genomic DNA (Homo sapiens) CpG-island No: 13038
ctataactaacctaaaaatctccgtccgccaacaataccgcaaaactaaaaaaatcccctcaaaaatctcttcattaaacccccacctcctcgaatcccgctccgaccgatcgaacaaccaatcgcctcgcgaaacgaaattacgacgaactaccgtaaccaataaaaataaaaaaaacgaaacctaactcccgacgcgcgacgataaaatcgcctccgacaaaacgaactaaaccctaaaaaaaaccgctaaccaacaacataaaaaaccccgccgcgcctaaaaccgaaaacccgcccgcaaataacaataacaacgacgacgacaaaaaaaaacaaacgacgcccaaaaaccgcgaaacgttccgaaaccaacgacgaaaatcaaaaataaaaaacccgaaaaacttcgactaaaacccgaaaacgcccgccgacgaaaaacgacgactaaaataattcgacctcgaccccgaaaccctcgacgcgctcgatcaaccccgcgcaataaacgcctacgaaatcctaacgactaaactctaaactctttaacccgaaccaatatccgcccgtctcctaccg

SEQ ID NO: 13039 - DNA, 582 bp, Artificial Sequence
  chemically treated genomic DNA (Homo sapiens) CpG-island No: 13039
ttgtagttaatttaggagttttcgttcgttagtaatgtcgtaggattaaaaagatttttttaaaaatttttttattgagtttttattttttcgagtttcgtttcggtcggtcgagtagttaatcgtttcgcggggcggggttgcggcgagttgtcgtaattaatagaggtggagggggcggggtttggttttcggcgcgcggcggtagggtcgttttcggtaaagcgagttgaattttgaggggagtcgttgattagtagtatggaggatttcgtcgcgtttgggatcgggggttcgttcgtaaatggtaatggtaacggcggcggtaaagggaagtaggcggcgtttaagggtcgcgaagcgtttcgaagttagcggcgggagttagaggtgaggagttcggaaagtttcggttggggttcggagacgttcgtcggcgggaagcggcggttgaggtgattcggtttcggtttcggagttttcggcgcgttcgattagtttcgcgtagtgggcgtttgcggggttttagcggttgaattttgggttttttggttcggattagtgttcgttcgttttttgtcg

SEQ ID NO: 13040 - DNA, 582 bp, Artificial Sequence
  chemically treated genomic DNA (Homo sapiens) CpG-island No: 13040
cgacaaaaaacgaacgaacactaatccgaaccaaaaaacccaaaattcaaccgctaaaaccccgcaaacgcccactacgcgaaactaatcgaacgcgccgaaaactccgaaaccgaaaccgaatcacctcaaccgccgcttcccgccgacgaacgtctccgaaccccaaccgaaactttccgaactcctcacctctaactcccgccgctaacttcgaaacgcttcgcgacccttaaacgccgcctacttccctttaccgccgccgttaccattaccatttacgaacgaacccccgatcccaaacgcgacgaaatcctccatactactaatcaacgactcccctcaaaattcaactcgctttaccgaaaacgaccctaccgccgcgcgccgaaaaccaaaccccgccccctccacctctattaattacgacaactcgccgcaaccccgccccgcgaaacgattaactactcgaccgaccgaaacgaaactcgaaaaaataaaaactcaataaaaaaatttttaaaaaaatctttttaatcctacgacattactaacgaacgaaaactcctaaattaactacaa

SEQ ID NO: 13041 - DNA, 597 bp, Artificial Sequence
  chemically treated genomic DNA (Homo sapiens) CpG-island No: 13041
  misc_feature (558)..(558): n is either a, c, g or t
  misc_feature (577)..(577): n is either a, c, g or t
  misc_feature (591)..(591): n is either a, c, g or t
cggatcggtgttgataatgatcgtttttttgttgatggggcgcgaaacggtagtttcgattttgttagttttcgtacgtttttatttttttcggggttggcgtcggcggtgtttttgttggtttttttcggttttggcgcgaaagtcgggatgatgtcgttgtatagttggttgtcgcgcgtttattttgtcgtattatcgtacgtttcggcgttgatgtttggcgtaatggttaaaataggtattttcggtattttgaaagtagcgatggatttgttggcgtaaacgggtttgtttttgtggtggggtattttggtgatggcgatcggcgtaattttcgcgtttttgggcgtgttatatgcgttggcggaataggatattaaacggttgttggtttggagtatcgtcgaaaacgtcggtattattttgttggtagtcggtgtggcgatggtcggtttgttattgtacgattcgttgtttatcgtggttggattgttcggcgtattgttttatttgtttaattatgcgttgtttaaagggttgttatttttcggcgtngggacgattatttcgcgtntgtatatttacgantatgga

SEQ ID NO: 13042 - DNA, 597 bp, Artificial Sequence
  chemically treated genomic DNA (Homo sapiens) CpG-island No: 13042
  misc_feature (7)..(7): n is either a, c, g or t
  misc_feature (21)..(21): n is either a, c, g or t
  misc_feature (40)..(40): n is either a, c, g or t
tccatantcgtaaatatacanacgcgaaataatcgtcccnacgccgaaaaataacaaccctttaaacaacgcataattaaacaaataaaacaatacgccgaacaatccaaccacgataaacaacgaatcgtacaataacaaaccgaccatcgccacaccgactaccaacaaaataataccgacgttttcgacgatactccaaaccaacaaccgtttaatatcctattccgccaacgcatataacacgcccaaaaacgcgaaaattacgccgatcgccatcaccaaaataccccaccacaaaaacaaacccgtttacgccaacaaatccatcgctactttcaaaataccgaaaatacctattttaaccattacgccaaacatcaacgccgaaacgtacgataatacgacaaaataaacgcgcgacaaccaactatacaacgacatcatcccgactttcgcgccaaaaccgaaaaaaaccaacaaaaacaccgccgacgccaaccccgaaaaaaataaaaacgtacgaaaactaacaaaatcgaaactaccgtttcgcgccccatcaacaaaaaaacgatcattatcaacaccgatccg

SEQ ID NO: 13043 - DNA, 597 bp, Artificial Sequence
  chemically treated genomic DNA (Homo sapiens) CpG-island No: 13043
  misc_feature (7)..(7): n is either a, c, g or t
  misc_feature (21)..(21): n is either a, c, g or t
  misc_feature (40)..(40): n is either a, c, g or t
tttatgntcgtgggtatgtanacgcgaaataatcgttttngcgtcgagaaatagtagttttttgaatagcgtatggttgagtagatgaaatagtgcgtcgagtagtttaattacggtgagtagcgggtcgtgtagtgatagatcgattatcgttatatcgattgttagtaaaataatgtcgacgttttcgacggtattttaggttagtagtcgtttgatattttgtttcgttagcgtatatagtacgtttaggagcgcggagattgcgtcgatcgttattattagaatgttttattatagaggtaaattcgtttgcgttagtagatttatcgttatttttaggatgtcgaaaatatttattttgattattacgttagatattaacgtcgaagcgtgcgatggtgcggtagggtgagcgcgcggtaattagttgtgtaacggtattatttcggttttcgcgttaaaatcgaaaaaggttagtaggaatatcgtcgacgttagtttcggagaaagtgaaagcgtgcggaaattggtaaaatcgaggttgtcgtttcgcgttttattagtaagaaggcgattattattagtatcgattcg

SEQ ID NO: 13044 - DNA, 597 bp, Artificial Sequence
  chemically treated genomic DNA (Homo sapiens) CpG-island No: 13044
  misc_feature (558)..(558): n is either a, c, g or t
  misc_feature (577)..(577): n is either a, c, g or t
  misc_feature (591)..(591): n is either a, c, g or t
cgaatcgatactaataataatcgccttcttactaataaaacgcgaaacgacaacctcgattttaccaatttccgcacgctttcactttctccgaaactaacgtcgacgatattcctactaacctttttcgattttaacgcgaaaaccgaaataataccgttacacaactaattaccgcgcgctcaccctaccgcaccatcgcacgcttcgacgttaatatctaacgtaataatcaaaataaatattttcgacatcctaaaaataacgataaatctactaacgcaaacgaatttacctctataataaaacattctaataataacgatcgacgcaatctccgcgctcctaaacgtactatatacgctaacgaaacaaaatatcaaacgactactaacctaaaataccgtcgaaaacgtcgacattattttactaacaatcgatataacgataatcgatctatcactacacgacccgctactcaccgtaattaaactactcgacgcactatttcatctactcaaccatacgctattcaaaaaactactatttctcgacgcnaaaacgattatttcgcgtntacatacccacgancataaa

SEQ ID NO: 13045 - DNA, 587 bp, Artificial Sequence
  chemically treated genomic DNA (Homo sapiens) CpG-island No: 13045
  misc_feature (167)..(167): n is either a, c, g or t
  misc_feature (184)..(184): n is either a, c, g or t
  misc_feature (254)..(254): n is either a, c, g or t
  misc_feature (273)..(273): n is either a, c, g or t
  misc_feature (312)..(312): n is either a, c, g or t
  misc_feature (328)..(328): n is either a, c, g or t
  misc_feature (339)..(339): n is either a, c, g or t
  misc_feature (458)..(459): n is either a, c, g or t
  misc_feature (516)..(516): n is either a, c, g or t
acgtttttttgttattgcggtaattattagattcgtattacgtacggcgttattattagcgaagattttcggattggtggtttggtaacggtattggttttttatattcgcgatgatgcggttttatttgtttatcgttatatcgtgcgattttagttacggtattncgtgcggattgaagtanacgttataattatagcgtcggttggtatgataaatttattgtatttaacggtattgggacgcgacgtttntgggtattaggtttttaangacgcgtgcgtaggaaacgaaattcgtagacgtgatttngtttatttagtttaangcgtacggttnggacgtaattttcgagtggtttttttttcgcgggcgtttttatttttttttcgagttggttatgtattttatacgacgatagcgtagtgacgtattcgcgcgtgcgagtgcggtataanntagttatcgcgtgttgcgtcggtagtatacgacgtaagtcggcgtatgataacggtntcggtagtttcgagttatattgttaggtggtatgagacggagcgtataagtcgggattttatgggtaacgt

SEQ ID NO: 13046 - DNA, 587 bp, Artificial Sequence
  chemically treated genomic DNA (Homo sapiens) CpG-island No: 13046
  misc_feature (72)..(72): n is either a, c, g or t
  misc_feature (129)..(130): n is either a, c, g or t
  misc_feature (249)..(249): n is either a, c, g or t
  misc_feature (260)..(260): n is either a, c, g or t
  misc_feature (276)..(276): n is either a, c, g or t
  misc_feature (315)..(315): n is either a, c, g or t
  misc_feature (334)..(334): n is either a, c, g or t
  misc_feature (404)..(404): n is either a, c, g or t
  misc_feature (421)..(421): n is either a, c, g or t
acgttacccataaaatcccgacttatacgctccgtctcataccacctaacaatataactcgaaactaccganaccgttatcatacgccgacttacgtcgtatactaccgacgcaacacgcgataactannttataccgcactcgcacgcgcgaatacgtcactacgctatcgtcgtataaaatacataaccaactcgaaaaaaaaataaaaacgcccgcgaaaaaaaaaccactcgaaaattacgtccnaaccgtacgcnttaaactaaataaacnaaatcacgtctacgaatttcgtttcctacgcacgcgtcnttaaaaacctaatacccanaaacgtcgcgtcccaataccgttaaatacaataaatttatcataccaaccgacgctataattataacgtntacttcaatccgcacgnaataccgtaactaaaatcgcacgatataacgataaacaaataaaaccgcatcatcgcgaatataaaaaaccaataccgttaccaaaccaccaatccgaaaatcttcgctaataataacgccgtacgtaatacgaatctaataattaccgcaataacaaaaaaacgt

SEQ ID NO: 13047 - DNA, 587 bp, Artificial Sequence
  chemically treated genomic DNA (Homo sapiens) CpG-island No: 13047
  misc_feature (72)..(72): n is either a, c, g or t
  misc_feature (129)..(130): n is either a, c, g or t
  misc_feature (249)..(249): n is either a, c, g or t
  misc_feature (260)..(260): n is either a, c, g or t
  misc_feature (276)..(276): n is either a, c, g or t
  misc_feature (315)..(315): n is either a, c, g or t
  misc_feature (334)..(334): n is either a, c, g or t
  misc_feature (404)..(404): n is either a, c, g or t
  misc_feature (421)..(421): n is either a, c, g or t
acgttatttatgaaatttcggtttatacgtttcgttttatgttatttaatagtatggttcgaagttatcganatcgttattatacgtcgatttacgtcgtgtattgtcggcgtagtacgcgatgattgnnttgtatcgtattcgtacgcgcgagtacgttattgcgttatcgtcgtatgaagtatatggttagttcgagaaagaagtgaagacgttcgcgaagagggggttattcgaaaattacgtttnagtcgtgcgtnttgagttgaatgaatnaagttacgtttgcggatttcgttttttgcgtacgcgttnttgagagtttgatgtttangggcgtcgcgttttagtgtcgttgaatgtagtgaatttgttatgttagtcgacgttgtgattatggcgtntgttttaattcgtacgngatgtcgtggttggagtcgtacggtgtaacggtagataaatggggtcgtattatcgcggatgtggaaagttagtatcgttattagattattaattcgaaaattttcgttggtggtgacgtcgtgcgtggtgcggatttggtggttatcgtaatggtagaaggacgt

SEQ ID NO: 13048 - DNA, 587 bp, Artificial Sequence
  chemically treated genomic DNA (Homo sapiens) CpG-island No: 13048
  misc_feature (167)..(167): n is either a, c, g or t
  misc_feature (184)..(184): n is either a, c, g or t
  misc_feature (254)..(254): n is either a, c, g or t
  misc_feature (273)..(273): n is either a, c, g or t
  misc_feature (312)..(312): n is either a, c, g or t
  misc_feature (328)..(328): n is either a, c, g or t
  misc_feature (339)..(339): n is either a, c, g or t
  misc_feature (458)..(459): n is either a, c, g or t
  misc_feature (516)..(516): n is either a, c, g or t
acgtccttctaccattacgataaccaccaaatccgcaccacgcacgacgtcaccaccaacgaaaattttcgaattaataatctaataacgatactaactttccacatccgcgataatacgaccccatttatctaccgttacaccgtacgactccaaccacgacatcncgtacgaattaaaacanacgccataatcacaacgtcgactaacataacaaattcactacattcaacgacactaaaacgcgacgcccntaaacatcaaactctcaanaacgcgtacgcaaaaaacgaaatccgcaaacgtaacttnattcattcaactcaanacgcacgactnaaacgtaattttcgaataaccccctcttcgcgaacgtcttcacttctttctcgaactaaccatatacttcatacgacgataacgcaataacgtactcgcgcgtacgaatacgatacaanncaatcatcgcgtactacgccgacaatacacgacgtaaatcgacgtataataacgatntcgataacttcgaaccatactattaaataacataaaacgaaacgtataaaccgaaatttcataaataacgt

SEQ ID NO: 13049 - DNA, 518 bp, Artificial Sequence
  chemically treated genomic DNA (Homo sapiens) CpG-island No: 13049
ttattaggtttacgtcgagtcgaatttttttgttttcggaggtttttatttttatgagttgtagatgtaaaaaagtttgttcgttgagtagtttttcgaatttggtcggtgatagaggattcgaattttcgattttttcgtttcgaacgaagtgcgttattaggttgcgttaattatcgaatgcggggcgttttttgtcgtattggtatttatcgttttttaggtataggcggtgaacgttatcgtggcgtattaaattttagtcgaatcgggaaagtggtttaggtcgataatatttttgttaaagaaagcggataatcgtggattggcgtaagtttgatagcggattagtatcgtgcgggcgttggttttaggcgacgtgtaaatcggtaatttcggttttagttcgttagcggttgtagttagttaataggtgtcgattgaagtttttttgttggcgttaaaattgggtaatttcgaagcgttggtggtaaagaaaattattagtaaatcggaag

SEQ ID NO: 13050 - DNA, 518 bp, Artificial Sequence
  chemically treated genomic DNA (Homo sapiens) CpG-island No: 13050
cttccgatttactaataattttctttaccaccaacgcttcgaaattacccaattttaacgccaacaaaaaaacttcaatcgacacctattaactaactacaaccgctaacgaactaaaaccgaaattaccgatttacacgtcgcctaaaaccaacgcccgcacgatactaatccgctatcaaacttacgccaatccacgattatccgctttctttaacaaaaatattatcgacctaaaccactttcccgattcgactaaaatttaatacgccacgataacgttcaccgcctatacctaaaaaacgataaataccaatacgacaaaaaacgccccgcattcgataattaacgcaacctaataacgcacttcgttcgaaacgaaaaaatcgaaaattcgaatcctctatcaccgaccaaattcgaaaaactactcaacgaacaaacttttttacatctacaactcataaaaataaaaacctccgaaaacaaaaaaattcgactcgacgtaaacctaataa

SEQ ID NO: 13051 - DNA, 518 bp, Artificial Sequence
  chemically treated genomic DNA (Homo sapiens) CpG-island No: 13051
ttttcggtttgttgatagttttttttattattagcgtttcggagttatttagttttgacgttagtaagaagattttaatcggtatttgttggttggttgtaatcgttaacgggttggaatcgaggttgtcgatttgtacgtcgtttgaagttagcgttcgtacgatgttggttcgttgttaaatttacgttagtttacggttgttcgttttttttagtaaaggtgttgtcggtttgagttattttttcggttcggttgaggtttgatacgttacggtgacgtttatcgtttgtgtttgaaaagcgatgaatgttagtgcggtaagaagcgtttcgtattcggtgattggcgtagtttggtagcgtatttcgttcgggacgaaggggtcggaggttcgaattttttattatcgattaaattcgaaaagttgtttaacgagtaggtttttttgtatttgtagtttatgaggatgagaattttcgggggtagggaggttcgattcgacgtaggtttgataa

SEQ ID NO: 13052 - DNA, 518 bp, Artificial Sequence
  chemically treated genomic DNA (Homo sapiens) CpG-island No: 13052
ttatcaaacctacgtcgaatcgaacctccctacccccgaaaattctcatcctcataaactacaaatacaaaaaaacctactcgttaaacaacttttcgaatttaatcgataataaaaaattcgaacctccgaccccttcgtcccgaacgaaatacgctaccaaactacgccaatcaccgaatacgaaacgcttcttaccgcactaacattcatcgcttttcaaacacaaacgataaacgtcaccgtaacgtatcaaacctcaaccgaaccgaaaaaataactcaaaccgacaacacctttactaaaaaaaacgaacaaccgtaaactaacgtaaatttaacaacgaaccaacatcgtacgaacgctaacttcaaacgacgtacaaatcgacaacctcgattccaacccgttaacgattacaaccaaccaacaaataccgattaaaatcttcttactaacgtcaaaactaaataactccgaaacgctaataataaaaaaaactatcaacaaaccgaaaa

SEQ ID NO: 13053 - DNA, 520 bp, Artificial Sequence
  chemically treated genomic DNA (Homo sapiens) CpG-island No: 13053
ttattatagtttgttggcggtattgaaatattggggtattaaattcgggtaagtggagattgtgaatttgtagtcgttcgcgattatcgttgtttggtagcggggagatattgatggtgtttatgtttgggtatcggcggttaacgttttggaaaaagacggtaaggtgttgatcgattttgaataggtcgggtagtggggcgcgttaacgttggacgtttgggtggtgcgtaagattttgtcgagaaatattttgaggtcgtgaaagcgttcgttaaaagcgttatcgatgtttagtaatcgtatattgttaatttagacgtgtggttgaaatagtcggaaaatattagtaaattggcgcgtttaagcggcgtgtttgaaggtgacgtttcgggttggtgaagggaatattatttgacgcgtagtataaacgtagattgacggacggtgataagcgatattatacgcgtattttgaagataggtaagtcggtgtagtaatatatatagtagtattcggt

SEQ ID NO: 13054 - DNA, 520 bp, Artificial Sequence
  chemically treated genomic DNA (Homo sapiens) CpG-island No: 13054
accgaatactactatatatattactacaccgacttacctatcttcaaaatacgcgtataatatcgcttatcaccgtccgtcaatctacgtttatactacgcgtcaaataatattcccttcaccaacccgaaacgtcaccttcaaacacgccgcttaaacgcgccaatttactaatattttccgactatttcaaccacacgtctaaattaacaatatacgattactaaacatcgataacgcttttaacgaacgctttcacgacctcaaaatatttctcgacaaaatcttacgcaccacccaaacgtccaacgttaacgcgccccactacccgacctattcaaaatcgatcaacaccttaccgtctttttccaaaacgttaaccgccgatacccaaacataaacaccatcaatatctccccgctaccaaacaacgataatcgcgaacgactacaaattcacaatctccacttacccgaatttaataccccaatatttcaataccgccaacaaactataataa

SEQ ID NO: 13055 - DNA, 520 bp, Artificial Sequence
  chemically treated genomic DNA (Homo sapiens) CpG-island No: 13055
gtcgagtattattgtgtatattgttatatcgatttgtttgtttttaaaatgcgcgtgtgatatcgtttgttatcgttcgttagtttgcgtttgtgttgcgcgttagatagtattttttttattagttcggaacgttatttttaggtacgtcgtttaaacgcgttagtttgttgatgtttttcggttgttttagttatacgtttgggttagtaatgtacggttgttgagtatcgatggcgtttttagcgaacgtttttacgattttaggatgtttttcggtaaaattttgcgtattatttagacgtttagcgttggcgcgttttattgttcgatttgtttagaatcggttaatattttgtcgtttttttttagggcgttaatcgtcggtgtttagatataagtattattaatattttttcgttgttaggtagcgataatcgcgggcggttgtaggtttataatttttatttgttcgggtttaatgttttagtgttttagtgtcgttagtaggttgtagtgg

SEQ ID NO: 13056 - DNA, 520 bp, Artificial Sequence
  chemically treated genomic DNA (Homo sapiens) CpG-island No: 13056
ccactacaacctactaacgacactaaaacactaaaacattaaacccgaacaaataaaaattataaacctacaaccgcccgcgattatcgctacctaacaacgaaaaaatattaataatacttatatctaaacaccgacgattaacgccctaaaaaaaaacgacaaaatattaaccgattctaaacaaatcgaacaataaaacgcgccaacgctaaacgtctaaataatacgcaaaattttaccgaaaaacatcctaaaatcgtaaaaacgttcgctaaaaacgccatcgatactcaacaaccgtacattactaacccaaacgtataactaaaacaaccgaaaaacatcaacaaactaacgcgtttaaacgacgtacctaaaaataacgttccgaactaataaaaaaaatactatctaacgcgcaacacaaacgcaaactaacgaacgataacaaacgatatcacacgcgcattttaaaaacaaacaaatcgatataacaatatacacaataatactcgac

SEQ ID NO: 13057 - DNA, 624 bp, Artificial Sequence
  chemically treated genomic DNA (Homo sapiens) CpG-island No: 13057
attaaaagtattgcgttattggttgagttttttgttgcgaattttattgcggacgtggataacgttggtttcgtatacggtatcgtttaatggtttgttgtttcgcgtcgtttggcgttgaaagtagttaatttggcggaacgtaatcggatcgtgaaatcgaaaaacgcggttcggcgattgtttaggcgttcgacgttgaaggtaaatcgagtaaagcggtagaaggttgggcgcgtggttgcggtattatcgttgattaggttgagcgtttgattatcgataaaggcgaatggttgttgtatcgcgtttatgtgaagggcgaaatatcgaagtattgttgtcgaatatggttgcgatttttttggcgaaattgtcgatttcgaaattgatgcgttggggcgtaacgtacgtgtatttcgtgcgttcggtgtatatcgtgattttgttgttgggcgataaagttatttcggtaattattttgggtatttagttcgatcgcgtgattcgcggttatcgttttatgggcgagtcggaatttattatcgataacgtcgattagtattcggaaattttgcgtgatagtgggaaagttatcgtcgattacgaagaacgtaaggcgaa

SEQ ID NO: 13058 - DNA, 624 bp, Artificial Sequence
  chemically treated genomic DNA (Homo sapiens) CpG-island No: 13058
ttcgccttacgttcttcgtaatcgacgataactttcccactatcacgcaaaatttccgaatactaatcgacgttatcgataataaattccgactcgcccataaaacgataaccgcgaatcacgcgatcgaactaaatacccaaaataattaccgaaataactttatcgcccaacaacaaaatcacgatatacaccgaacgcacgaaatacacgtacgttacgccccaacgcatcaatttcgaaatcgacaatttcgccaaaaaaatcgcaaccatattcgacaacaatacttcgatatttcgcccttcacataaacgcgatacaacaaccattcgcctttatcgataatcaaacgctcaacctaatcaacgataataccgcaaccacgcgcccaaccttctaccgctttactcgatttaccttcaacgtcgaacgcctaaacaatcgccgaaccgcgtttttcgatttcacgatccgattacgttccgccaaattaactactttcaacgccaaacgacgcgaaacaacaaaccattaaacgataccgtatacgaaaccaacgttatccacgtccgcaataaaattcgcaacaaaaaactcaaccaataacgcaatacttttaat

SEQ ID NO: 13059 - DNA, 624 bp, Artificial Sequence
  chemically treated genomic DNA (Homo sapiens) CpG-island No: 13059
ttcgttttacgtttttcgtaatcggcgatgatttttttattgttacgtagaattttcggatattgatcggcgttatcgatggtgaatttcggttcgtttataaagcggtggtcgcgaattacgcgatcggattgaatgtttagaatggttgtcggaatgattttgtcgtttagtagtagggttacggtgtgtatcggacgtacgaagtgtacgtacgttgcgttttaacgtattagtttcgggatcggtagtttcgttagagaagtcgtaattatattcggtagtagtgtttcggtgtttcgttttttatatgggcgcgatatagtagttattcgtttttatcggtagttagacgtttagtttggttaacggtaatatcgtaattacgcgtttaattttttgtcgttttgttcggtttgtttttagcgtcgaacgtttgggtaatcgtcgggtcgcgtttttcgattttacgattcggttgcgtttcgttaggttagttatttttagcgttagacgacgcggagtagtaaattattgaacggtgtcgtgtgcgaggttagcgttatttacgttcgtagtaaagttcgtagtaaaggatttagttagtggcgtagtgtttttggt

SEQ ID NO: 13060 - DNA, 624 bp, Artificial Sequence
  chemically treated genomic DNA (Homo sapiens) CpG-island No: 13060
accaaaaacactacgccactaactaaatcctttactacgaactttactacgaacgtaaataacgctaacctcgcacacgacaccgttcaataatttactactccgcgtcgtctaacgctaaaaataactaacctaacgaaacgcaaccgaatcgtaaaatcgaaaaacgcgacccgacgattacccaaacgttcgacgctaaaaacaaaccgaacaaaacgacaaaaaattaaacgcgtaattacgatattaccgttaaccaaactaaacgtctaactaccgataaaaacgaataactactatatcgcgcccatataaaaaacgaaacaccgaaacactactaccgaatataattacgacttctctaacgaaactaccgatcccgaaactaatacgttaaaacgcaacgtacgtacacttcgtacgtccgatacacaccgtaaccctactactaaacgacaaaatcattccgacaaccattctaaacattcaatccgatcgcgtaattcgcgaccaccgctttataaacgaaccgaaattcaccatcgataacgccgatcaatatccgaaaattctacgtaacaataaaaaaatcatcgccgattacgaaaaacgtaaaacgaa

SEQ ID NO: 13061 - DNA, 945 bp, Artificial Sequence
  chemically treated genomic DNA (Homo sapiens) CpG-island No: 13061
  misc_feature (766)..(766): n is either a, c, g or t
  misc_feature (782)..(782): n is either a, c, g or t
  misc_feature (826)..(826): n is either a, c, g or t
  misc_feature (830)..(831): n is either a, c, g or t
  misc_feature (837)..(837): n is either a, c, g or t
gcgtttcgcgtgaagtttgcgtcgttaaagtcgcgcgtttttttattcgtttgaacgtgtcggaacgtttgcggtatttggtattatcgatatttttcggtggcgaatagtagcgcgttaatatcgttcgcggttttatcgtcgattattttattttgttgtttgacgaatttatcgtttcgttggacgttaaaaatagcgtcgcggtggtggaattgattcgcgaagttaaaattcgtggcgtagttatcgtaggtattttttatgacgaagttgtacgtaatgacgtcgtcgatcgtttgtatttaatgggagtttttttatgattattaataacgttaagttggtgttggaaaacgaggtggtaagcggttcgttggaggtgtagaacggcgaaattcgcgtttttgtcgaaagttagagtcgtttgtcggaggcgatggacggcgaaggcggttggttgttgtcggggttgattgagttgtatatcgataatttggataaattttttatttcgcgttcgaaagttgattggtttgtttattcggcgatgagtagttacgacgcgttgatggtggcgagcggtattattatcgtattggatgtcgtgggtaattggcgacgtgcgtcgacggcggcgatcggttggagaattttgagaagatgattaacgttatcgaagagacgtagaaacgcggcgttaatcgtgtcgagtatcgtttgtatttgcgttgcgaattggcgtattatattacgttgtcgttgnttgaaaattgttgtancgcgaagtcgtgacgtttgtgttcgtgatgtatttattcgcggnttanngttagntggtaatcgcgagaagtatcgcgaatattttaagttataattttttattgatgcgttaagcgtagttcgataaagtattgggttttgtcgagttgtttaagtcgattg

SEQ ID NO: 13062 - DNA, 945 bp, Artificial Sequence
  chemically treated genomic DNA (Homo sapiens) CpG-island No: 13062
  misc_feature (109)..(109): n is either a, c, g or t
  misc_feature (115)..(116): n is either a, c, g or t
  misc_feature (120)..(120): n is either a, c, g or t
  misc_feature (164)..(164): n is either a, c, g or t
  misc_feature (180)..(180): n is either a, c, g or t
caatcgacttaaacaactcgacaaaacccaatactttatcgaactacgcttaacgcatcaataaaaaattataacttaaaatattcgcgatacttctcgcgattaccanctaacnntaanccgcgaataaatacatcacgaacacaaacgtcacgacttcgcgntacaacaattttcaancaacgacaacgtaatataatacgccaattcgcaacgcaaatacaaacgatactcgacacgattaacgccgcgtttctacgtctcttcgataacgttaatcatcttctcaaaattctccaaccgatcgccgccgtcgacgcacgtcgccaattacccacgacatccaatacgataataataccgctcgccaccatcaacgcgtcgtaactactcatcgccgaataaacaaaccaatcaactttcgaacgcgaaataaaaaatttatccaaattatcgatatacaactcaatcaaccccgacaacaaccaaccgccttcgccgtccatcgcctccgacaaacgactctaactttcgacaaaaacgcgaatttcgccgttctacacctccaacgaaccgcttaccacctcgttttccaacaccaacttaacgttattaataatcataaaaaaactcccattaaatacaaacgatcgacgacgtcattacgtacaacttcgtcataaaaaatacctacgataactacgccacgaattttaacttcgcgaatcaattccaccaccgcgacgctatttttaacgtccaacgaaacgataaattcgtcaaacaacaaaataaaataatcgacgataaaaccgcgaacgatattaacgcgctactattcgccaccgaaaaatatcgataataccaaataccgcaaacgttccgacacgttcaaacgaataaaaaaacgcgcgactttaacgacgcaaacttcacgcgaaacgc

SEQ ID NO: 13063 - DNA, 945 bp, Artificial Sequence
  chemically treated genomic DNA (Homo sapiens) CpG-island No: 13063
  misc_feature (109)..(109): n is either a, c, g or t
  misc_feature (115)..(116): n is either a, c, g or t
  misc_feature (120)..(120): n is either a, c, g or t
  misc_feature (164)..(164): n is either a, c, g or t
  misc_feature (180)..(180): n is either a, c, g or t
taatcggtttgaatagttcggtaaggtttagtgttttatcggattgcgtttggcgtattaatgagaagttatggtttgaaatattcgcgatatttttcgcggttgttanttggtnntggntcgcgagtgggtatattacggatataagcgttacggtttcgcgntgtaatagtttttaantagcggtagcgtggtgtgatgcgttagttcgtagcgtagatgtagacggtgttcggtacggttgacgtcgcgtttttgcgttttttcgatggcgttgattatttttttaagattttttagtcgatcgtcgtcgtcggcgtacgtcgttaattgtttacggtatttagtacggtggtgatgtcgttcgttattattagcgcgtcgtggttgtttatcgtcgagtgggtaggttagttaattttcgggcgcggggtgaagaatttatttagattatcggtatgtagtttaattagtttcggtagtagttagtcgttttcgtcgtttatcgttttcggtaggcggttttggttttcggtaaaggcgcggatttcgtcgttttgtatttttagcgaatcgtttattatttcgttttttagtattagtttaacgttattgataattatgaagaggtttttattgggtgtaggcggtcggcgacgttattacgtatagtttcgttatggaagatgtttacgatggttgcgttacgggttttggtttcgcgaattagttttattatcgcggcgttgtttttggcgtttagcgaggcggtaggttcgttaagtagtagaatggggtagtcgacgataaagtcgcgggcgatgttgacgcgttgttgttcgttatcggaaaatgtcgatggtgttaggtgtcgtaggcgtttcggtacgtttaggcgggtgagaagacgcgcggttttagcggcgtaggttttacgcggaacgt

SEQ ID NO: 13064 - DNA, 945 bp, Artificial Sequence
  chemically treated genomic DNA (Homo sapiens) CpG-island No: 13064
  misc_feature (766)..(766): n is either a, c, g or t
  misc_feature (782)..(782): n is either a, c, g or t
  misc_feature (826)..(826): n is either a, c, g or t
  misc_feature (830)..(831): n is either a, c, g or t
  misc_feature (837)..(837): n is either a, c, g or t
acgttccgcgtaaaacctacgccgctaaaaccgcgcgtcttctcacccgcctaaacgtaccgaaacgcctacgacacctaacaccatcgacattttccgataacgaacaacaacgcgtcaacatcgcccgcgactttatcgtcgactaccccattctactacttaacgaacctaccgcctcgctaaacgccaaaaacaacgccgcgataataaaactaattcgcgaaaccaaaacccgtaacgcaaccatcgtaaacatcttccataacgaaactatacgtaataacgtcgccgaccgcctacacccaataaaaacctcttcataattatcaataacgttaaactaatactaaaaaacgaaataataaacgattcgctaaaaatacaaaacgacgaaatccgcgcctttaccgaaaaccaaaaccgcctaccgaaaacgataaacgacgaaaacgactaactactaccgaaactaattaaactacataccgataatctaaataaattcttcaccccgcgcccgaaaattaactaacctacccactcgacgataaacaaccacgacgcgctaataataacgaacgacatcaccaccgtactaaataccgtaaacaattaacgacgtacgccgacgacgacgatcgactaaaaaatcttaaaaaaataatcaacgccatcgaaaaaacgcaaaaacgcgacgtcaaccgtaccgaacaccgtctacatctacgctacgaactaacgcatcacaccacgctaccgctanttaaaaactattacancgcgaaaccgtaacgcttatatccgtaatatacccactcgcganccannaccaantaacaaccgcgaaaaatatcgcgaatatttcaaaccataacttctcattaatacgccaaacgcaatccgataaaacactaaaccttaccgaactattcaaaccgatta

SEQ ID NO: 13065 - DNA, 773 bp, Artificial Sequence
  chemically treated genomic DNA (Homo sapiens) CpG-island No: 13065
agcgtttcgttgttcggtgcgttattagaaataatggcgtttttcgttgttacgtcgttggagcgtttatttgggcgtattgtcggagttagtgaaatgatttttagtagttcgttcggtagtacgcgtattattttgtagtttgattttgatcgggatattaacggcgtacgcgtgatgtgtaggcggcgattaacgttgtataaagtttgttgtttagtgggatgtttagtcgttcgatttatcgtaaagcgaattcgtcggatgcgttaattatgatttttacgttgacgttcgatatttattcgtagggtgaattgtacgatttcgtttcgacgtagttggtttcgacgatttcgtaaatcgacggtgttggtgatgtcgatgtcggaggtagtttattgttcgtcgtacgcgtcgggttgaattcgtaggcgttgtttaattagggcgtgtcgttggacgacgtacgtatcgtcgttagtaatgttaacgtgcgtaaatcgtagggcgcgttggaagatggtatttatcgttggtagatttagattaatgatgagttaaaaatcgtcgttgaatattagtcgttgattatttattataataacggcggcgcggttcgtttgggcgatgtggcgacggtgatcgatttagtgtaggatgtgcgtaacgtcgggatgattaacgttaaatcggttattttattgatgattcgtaaattgtcggaagttaatattatttagacggttgatagtattcgggtaaaattatcg

SEQ ID NO: 13066 - DNA, 773 bp, Artificial Sequence
  chemically treated genomic DNA (Homo sapiens) CpG-island No: 13066
cgataattttacccgaatactatcaaccgtctaaataatattaacttccgacaatttacgaatcatcaataaaataaccgatttaacgttaatcatcccgacgttacgcacatcctacactaaatcgatcaccgtcgccacatcgcccaaacgaaccgcgccgccgttattataataaataatcaacgactaatattcaacgacgatttttaactcatcattaatctaaatctaccaacgataaataccatcttccaacgcgccctacgatttacgcacgttaacattactaacgacgatacgtacgtcgtccaacgacacgccctaattaaacaacgcctacgaattcaacccgacgcgtacgacgaacaataaactacctccgacatcgacatcaccaacaccgtcgatttacgaaatcgtcgaaaccaactacgtcgaaacgaaatcgtacaattcaccctacgaataaatatcgaacgtcaacgtaaaaatcataattaacgcatccgacgaattcgctttacgataaatcgaacgactaaacatcccactaaacaacaaactttatacaacgttaatcgccgcctacacatcacgcgtacgccgttaatatcccgatcaaaatcaaactacaaaataatacgcgtactaccgaacgaactactaaaaatcatttcactaactccgacaatacgcccaaataaacgctccaacgacgtaacaacgaaaaacgccattatttctaataacgcaccgaacaacgaaacgct

SEQ ID NO: 13067 - DNA, 773 bp, Artificial Sequence
  chemically treated genomic DNA (Homo sapiens) CpG-island No: 13067
cggtaattttgttcggatgttgttaatcgtttggataatattggttttcggtagtttgcggattattagtaaaatagtcggtttggcgttggttatttcggcgttgcgtatattttgtattgagtcggttatcgtcgttatatcgtttagacgaatcgcgtcgtcgttgttgtagtgaataattaacggttgatatttagcggcggtttttagtttattattggtttggatttgttagcggtgagtgttattttttagcgcgttttgcggtttacgtacgttggtattgttgacggcggtgcgtacgtcgtttagcgatacgttttgattaaatagcgtttgcggatttagttcgacgcgtacggcgggtagtgagttgttttcgatatcgatattattaatatcgtcgatttgcgaaatcgtcggagttagttgcgtcgaggcgaaatcgtatagtttattttgcgaataagtatcggacgttagcgtgaggattataattggcgtattcgacgggttcgttttgcgataggtcgggcggttgggtattttattgggtagtaaattttgtgtagcgttgatcgtcgtttgtatattacgcgtgcgtcgttgatatttcggttaaaattaaattgtaaaataatacgcgtgttgtcgagcgaattgttggaggttattttattgatttcggtaatgcgtttaagtgagcgttttagcggcgtggtaacggaagacgttattgtttttggtgacgtatcgggtagcgaggcgtt

SEQ ID NO: 13068 - DNA, 773 bp, Artificial Sequence
  chemically treated genomic DNA (Homo sapiens) CpG-island No: 13068
aacgcctcgctacccgatacgtcaccaaaaacaataacgtcttccgttaccacgccgctaaaacgctcacttaaacgcattaccgaaatcaataaaataacctccaacaattcgctcgacaacacgcgtattattttacaatttaattttaaccgaaatatcaacgacgcacgcgtaatatacaaacgacgatcaacgctacacaaaatttactacccaataaaatacccaaccgcccgacctatcgcaaaacgaacccgtcgaatacgccaattataatcctcacgctaacgtccgatacttattcgcaaaataaactatacgatttcgcctcgacgcaactaactccgacgatttcgcaaatcgacgatattaataatatcgatatcgaaaacaactcactacccgccgtacgcgtcgaactaaatccgcaaacgctatttaatcaaaacgtatcgctaaacgacgtacgcaccgccgtcaacaataccaacgtacgtaaaccgcaaaacgcgctaaaaaataacactcaccgctaacaaatccaaaccaataataaactaaaaaccgccgctaaatatcaaccgttaattattcactacaacaacgacgacgcgattcgtctaaacgatataacgacgataaccgactcaatacaaaatatacgcaacgccgaaataaccaacgccaaaccgactattttactaataatccgcaaactaccgaaaaccaatattatccaaacgattaacaacatccgaacaaaattaccg

SEQ ID NO: 13069 - DNA, 1286 bp, Artificial Sequence
  chemically treated genomic DNA (Homo sapiens) CpG-island No: 13069
ggttcgttatgaatagggcgcgggttttatcgtttagggaatggcgcgtatcgacggtaaatcggcggtttgtatggtttgtagcggatcgggtgcgattaatttggtgatcgttattgtcgatgcgcggttggattttatttcgttgatttgtattattggttaggttttcgtttcgatgatcggtatcgacgttttttaggaagtggatatttacggtatttttatttttattattaaatataattatttggttagatatatcgaagaattttcgtaggttatgagcgatgtttttcgtattgcgtaattaggtcgtttaggttcggtgtggatagatatttttaaggatgtgtaaacggtagtttttgagattgaaatatagttcgttatggtagaaaaagtcgtcgttttcgtttttagcgaagaaagtattcgtgacgtagcggcgatgattaacgttgttaaacgttcggtgttttatttgggcggcggtgtgattaatgcgttcgtacgggtgcgtgaattggcggagaaagcgtaattgtttattattatgattttaatggcgttgggtatgttgttaaaagcgtattcgttgtcgttgggtatgttggggatgtacggcgtgcgtagtattaattatattttgtaggaggcggattcgttgatagtgttcggtgcgcgttttgatgatcgggcgattggtaaaatcgagtagttttgttcgaatgttaaaattatttatgtcgatatcgatcgtgtagggatttcgtggattcgacgtgtatggtatcgttatagacgtgttgagtcgtgcggttgggagtattggcgtgatacgagagagtagttgcgttttggcgaatgggtagtacgggtgtttagttagcgtttggcgatattattcgtgtcggatcgtttattagcgggtttggtacgtgtagttcggttatcgttagtgagagattgtttgttaggcggttgttggagataagtttaatatcgtcgttttgttagacgcggatagtcggttttaggtaacgattattgattttttagatcgacgcgcgtgtttttggcgtaaatgattagtgcgtacgttgtatagttataaatagcggttgtttacggcgagatttaagtagcggcggaacgggtagcggttgttgttgtcgcggtgcgttggtttttaggggaatagcgtttgtataaagtgtaattttcgatgtttgaatgaattgacgtcgattgagtgatatatttgttttatgtaaaattggtta

SEQ ID NO: 13070 - DNA, 1286 bp, Artificial Sequence
  chemically treated genomic DNA (Homo sapiens) CpG-island No: 13070
taaccaattttacataaaacaaatatatcactcaatcgacgtcaattcattcaaacatcgaaaattacactttatacaaacgctattcccctaaaaaccaacgcaccgcgacaacaacaaccgctacccgttccgccgctacttaaatctcgccgtaaacaaccgctatttataactatacaacgtacgcactaatcatttacgccaaaaacacgcgcgtcgatctaaaaaatcaataatcgttacctaaaaccgactatccgcgtctaacaaaacgacgatattaaacttatctccaacaaccgcctaacaaacaatctctcactaacgataaccgaactacacgtaccaaacccgctaataaacgatccgacacgaataatatcgccaaacgctaactaaacacccgtactacccattcgccaaaacgcaactactctctcgtatcacgccaatactcccaaccgcacgactcaacacgtctataacgataccatacacgtcgaatccacgaaatccctacacgatcgatatcgacataaataattttaacattcgaacaaaactactcgattttaccaatcgcccgatcatcaaaacgcgcaccgaacactatcaacgaatccgcctcctacaaaatataattaatactacgcacgccgtacatccccaacatacccaacgacaacgaatacgcttttaacaacatacccaacgccattaaaatcataataataaacaattacgctttctccgccaattcacgcacccgtacgaacgcattaatcacaccgccgcccaaataaaacaccgaacgtttaacaacgttaatcatcgccgctacgtcacgaatactttcttcgctaaaaacgaaaacgacgactttttctaccataacgaactatatttcaatctcaaaaactaccgtttacacatccttaaaaatatctatccacaccgaacctaaacgacctaattacgcaatacgaaaaacatcgctcataacctacgaaaattcttcgatatatctaaccaaataattatatttaataataaaaataaaaataccgtaaatatccacttcctaaaaaacgtcgataccgatcatcgaaacgaaaacctaaccaataatacaaatcaacgaaataaaatccaaccgcgcatcgacaataacgatcaccaaattaatcgcacccgatccgctacaaaccatacaaaccgccgatttaccgtcgatacgcgccattccctaaacgataaaacccgcgccctattcataacgaacc

SEQ ID NO: 13071 - DNA, 1286 bp, Artificial Sequence
  chemically treated genomic DNA (Homo sapiens) CpG-island No: 13071
tagttagttttatatggagtaaatatgttatttagtcggcgttagtttatttaggtatcggggattgtattttgtgtaggcgttgtttttttgaaggttagcgtatcgcggtaatagtaatcgttattcgtttcgtcgttatttgaatttcgtcgtgggtaatcgttgtttatgattgtataacgtgcgtattggttatttacgttagggatacgcgcgtcggtttggggaattaatggtcgttatttggggtcgattattcgcgtttggtagggcgacgatgttaagtttatttttagtaatcgtttgatagataattttttattgacggtggtcgggttatacgtattaggttcgttgatgggcggttcggtacggatgatgtcgttaaacgttgattgggtattcgtattgtttattcgttagaacgtagttattttttcgtattacgttaatatttttaatcgtacggtttagtacgtttataacgatgttatgtacgtcgagtttacgagatttttgtacggtcgatatcgatatgaatgattttggtattcggatagaattgttcggttttgttaatcgttcggttattaaaacgcgtatcgagtattattaacgaattcgttttttgtaaaatatagttggtgttgcgtacgtcgtgtatttttagtatatttagcgataacggatgcgtttttggtaatatgtttagcgttattaaagttatggtggtaggtagttgcgtttttttcgttagtttacgtattcgtgcgggcgtattgattatatcgtcgtttagataaagtatcgggcgtttggtagcgttaattatcgtcgttgcgttacgaatgtttttttcgttaaaggcgggggcggcggttttttttgttatagcgggttgtgttttaattttaaaaattgtcgtttgtatatttttaggaatgtttatttatatcgggtttgggcggtttgattgcgtaatgcggaaggtatcgtttatgatttgcgggagtttttcgatatgtttgattagatagttgtgtttggtgatggggatagagatgtcgtaggtgtttattttttggaaggcgtcggtgtcgattatcgaggcgggaatttgattagtgatgtaaattagcgggatggagtttagtcgcgtatcggtaatggcggttattaggttagtcgtattcggttcgttataggttatatagatcgtcggtttatcgtcggtgcgcgttattttttgagcgataaagttcgcgttttgtttatgacgggtt

SEQ ID NO: 13072 - DNA, 1286 bp, Artificial Sequence
  chemically treated genomic DNA (Homo sapiens) CpG-island No: 13072
aacccgtcataaacaaaacgcgaactttatcgctcaaaaaataacgcgcaccgacgataaaccgacgatctatataacctataacgaaccgaatacgactaacctaataaccgccattaccgatacgcgactaaactccatcccgctaatttacatcactaatcaaattcccgcctcgataatcgacaccgacgccttccaaaaaataaacacctacgacatctctatccccatcaccaaacacaactatctaatcaaacatatcgaaaaactcccgcaaatcataaacgataccttccgcattacgcaatcaaaccgcccaaacccgatataaataaacattcctaaaaatatacaaacgacaatttttaaaattaaaacacaacccgctataacaaaaaaaaccgccgcccccgcctttaacgaaaaaaacattcgtaacgcaacgacgataattaacgctaccaaacgcccgatactttatctaaacgacgatataatcaatacgcccgcacgaatacgtaaactaacgaaaaaaacgcaactacctaccaccataactttaataacgctaaacatattaccaaaaacgcatccgttatcgctaaatatactaaaaatacacgacgtacgcaacaccaactatattttacaaaaaacgaattcgttaataatactcgatacgcgttttaataaccgaacgattaacaaaaccgaacaattctatccgaataccaaaatcattcatatcgatatcgaccgtacaaaaatctcgtaaactcgacgtacataacatcgttataaacgtactaaaccgtacgattaaaaatattaacgtaatacgaaaaaataactacgttctaacgaataaacaatacgaatacccaatcaacgtttaacgacatcatccgtaccgaaccgcccatcaacgaacctaatacgtataacccgaccaccgtcaataaaaaattatctatcaaacgattactaaaaataaacttaacatcgtcgccctaccaaacgcgaataatcgaccccaaataacgaccattaattccccaaaccgacgcgcgtatccctaacgtaaataaccaatacgcacgttatacaatcataaacaacgattacccacgacgaaattcaaataacgacgaaacgaataacgattactattaccgcgatacgctaaccttcaaaaaaacaacgcctacacaaaatacaatccccgatacctaaataaactaacgccgactaaataacatatttactccatataaaactaacta

SEQ ID NO: 13073 - DNA, 1171 bp, Artificial Sequence
  chemically treated genomic DNA (Homo sapiens) CpG-island No: 13073
tttggtacggattttatcgttaatttgtattacgtattagttttagatttttttttaggtttgtagcgttatcgtcgagcgtttggagtaggggcgtatcgtcgaattgttgcgcgtgtttatcgagcgtaggttggttttggttcgtcgcgcgtaggacgtcgacgatttgttcggcgtattggtttattcggacgatggtatcgtcgtattgattttttgcgacggcgttttggttatgttcggcggtcgtattttgagtattcgtagcgatttcgagcgttaggtcgggaatattttgtaacgtttgtagcgcgattcggaacgggatatttattatatcgataattggtcgtagtttagttttgatttttcggacggcggcgattgttgcggtgtgttggcgattcgtttttatcgttaggaatcgggttggattttttggtttcgttacgaggaagtgtatcgtattcgttggggcggtaagtcggaaaagttgttgattatcggttttttcggttcgtagttgatttcgcgcggttcgttcgaggtttgggaggaagtggttcgcggttattttacgttttggagcgaaatcgatttggcgatcgtcgaaaagttgcgtttggatttgatggaattgtgttttaattatgcggtcgaggtcgatcgtatgcgttacgtttgatcgcggtgttcggttacgatttgcgtaattcgttgtagtcgatttttatggcggcggttttgttgttttttagcgatattcgtattatcgaattgcgttaatatattttcgcgtttagtagtcgtatggagcggttgtttagttagattttcgatatgagtcgtttgtaatcgggtatcggttttatcgtgaattcggtcgatatcgacgtttcgtaattggtgcggtagatcgtttgcgaaatcgacgtcgtttatttcggtttggtgatcgagatcgttatcgattcgtatgttcgtgtacgtggtcgattcggatcgttacgtttaggtcgtcgttaatttgttgagtaacgttcgttattacggttttgttcggcggttcggtgttggtttatttgattcgtatgttgacgatgtgttttttatcgtgtttaacgaaattagttggttttttcgaaatcgtagtggttttaattttgtt

SEQ ID NO: 13074 - DNA, 1171 bp, Artificial Sequence
  chemically treated genomic DNA (Homo sapiens) CpG-island No: 13074
aacaaaattaaaaccactacgatttcgaaaaaaccaactaatttcgttaaacacgataaaaaacacatcgtcaacatacgaatcaaataaaccaacaccgaaccgccgaacaaaaccgtaataacgaacgttactcaacaaattaacgacgacctaaacgtaacgatccgaatcgaccacgtacacgaacatacgaatcgataacgatctcgatcaccaaaccgaaataaacgacgtcgatttcgcaaacgatctaccgcaccaattacgaaacgtcgatatcgaccgaattcacgataaaaccgatacccgattacaaacgactcatatcgaaaatctaactaaacaaccgctccatacgactactaaacgcgaaaatatattaacgcaattcgataatacgaatatcgctaaaaaacaacaaaaccgccgccataaaaatcgactacaacgaattacgcaaatcgtaaccgaacaccgcgatcaaacgtaacgcatacgatcgacctcgaccgcataattaaaacacaattccatcaaatccaaacgcaacttttcgacgatcgccaaatcgatttcgctccaaaacgtaaaataaccgcgaaccacttcctcccaaacctcgaacgaaccgcgcgaaatcaactacgaaccgaaaaaaccgataatcaacaacttttccgacttaccgccccaacgaatacgatacacttcctcgtaacgaaaccaaaaaatccaacccgattcctaacgataaaaacgaatcgccaacacaccgcaacaatcgccgccgtccgaaaaatcaaaactaaactacgaccaattatcgatataataaatatcccgttccgaatcgcgctacaaacgttacaaaatattcccgacctaacgctcgaaatcgctacgaatactcaaaatacgaccgccgaacataaccaaaacgccgtcgcaaaaaatcaatacgacgataccatcgtccgaataaaccaatacgccgaacaaatcgtcgacgtcctacgcgcgacgaaccaaaaccaacctacgctcgataaacacgcgcaacaattcgacgatacgcccctactccaaacgctcgacgataacgctacaaacctaaaaaaaaatctaaaactaatacgtaatacaaattaacgataaaatccgtaccaaa

SEQ ID NO: 13075 - DNA, 1171 bp, Artificial Sequence
  chemically treated genomic DNA (Homo sapiens) CpG-island No: 13075
aataagattgaagttattgcgatttcggagaagttagttggtttcgttgagtacgataaggaatatatcgttagtatgcgagttaggtagattagtatcgggtcgtcgggtaaggtcgtgatgacggacgttgtttagtaggttggcggcgatttgggcgtagcggttcgggtcgattacgtgtacgaatatgcgggtcgatggcgatttcgattattaggtcgggataggcgacgtcggtttcgtagacgatttgtcgtattagttgcgagacgtcggtgtcgatcgggtttacggtgaggtcgatgttcgattgtaggcggtttatgtcgaggatttggttgaatagtcgttttatgcggttgttggacgcggaaatgtgttggcgtagttcggtggtgcgggtgtcgttggaggatagtagggtcgtcgttatggagatcgattgtaacgggttgcgtaggtcgtggtcgagtatcgcgattaggcgtggcgtatgcggtcgatttcggtcgtatggttgaggtatagttttattaggtttaggcgtagtttttcggcgatcgttaggtcggtttcgttttagggcgtggagtggtcgcggattatttttttttaggtttcgaacgagtcgcgcggggttagttgcgggtcggaggggtcgatggttaatagttttttcggtttgtcgttttagcggatgcggtgtattttttcgtggcggaattagaagatttagttcgatttttggcggtggaaacggatcgttagtatatcgtagtagtcgtcgtcgttcggagagttaaagttgggttgcggttagttgtcggtgtggtagatgtttcgtttcgggtcgcgttgtaggcgttgtaggatattttcggtttggcgttcgaagtcgttgcggatgtttagggtgcggtcgtcgagtatgattagggcgtcgtcgtagggaattagtgcggcgatgttatcgttcgggtgggttagtgcgtcgaataggtcgtcggcgttttgcgcgcggcgagttagggttagtttgcgttcggtggatacgcgtagtagttcggcgatacgtttttgttttaggcgttcgacgatggcgttgtagatttgggagaagatttggaattggtacgtggtgtaggttaacggtaaagttcgtgttaaa

SEQ ID NO: 13076 - DNA, 1171 bp, Artificial Sequence
  chemically treated genomic DNA (Homo sapiens) CpG-island No: 13076
tttaacacgaactttaccgttaacctacaccacgtaccaattccaaatcttctcccaaatctacaacgccatcgtcgaacgcctaaaacaaaaacgtatcgccgaactactacgcgtatccaccgaacgcaaactaaccctaactcgccgcgcgcaaaacgccgacgacctattcgacgcactaacccacccgaacgataacatcgccgcactaattccctacgacgacgccctaatcatactcgacgaccgcaccctaaacatccgcaacgacttcgaacgccaaaccgaaaatatcctacaacgcctacaacgcgacccgaaacgaaacatctaccacaccgacaactaaccgcaacccaactttaactctccgaacgacgacgactactacgatatactaacgatccgtttccaccgccaaaaatcgaactaaatcttctaattccgccacgaaaaaatacaccgcatccgctaaaacgacaaaccgaaaaaactattaaccatcgacccctccgacccgcaactaaccccgcgcgactcgttcgaaacctaaaaaaaaataatccgcgaccactccacgccctaaaacgaaaccgacctaacgatcgccgaaaaactacgcctaaacctaataaaactatacctcaaccatacgaccgaaatcgaccgcatacgccacgcctaatcgcgatactcgaccacgacctacgcaacccgttacaatcgatctccataacgacgaccctactatcctccaacgacacccgcaccaccgaactacgccaacacatttccgcgtccaacaaccgcataaaacgactattcaaccaaatcctcgacataaaccgcctacaatcgaacatcgacctcaccgtaaacccgatcgacaccgacgtctcgcaactaatacgacaaatcgtctacgaaaccgacgtcgcctatcccgacctaataatcgaaatcgccatcgacccgcatattcgtacacgtaatcgacccgaaccgctacgcccaaatcgccgccaacctactaaacaacgtccgtcatcacgaccttacccgacgacccgatactaatctacctaactcgcatactaacgatatattccttatcgtactcaacgaaaccaactaacttctccgaaatcgcaataacttcaatcttatt

SEQ ID NO: 13077 - DNA, 588 bp, Artificial Sequence
  chemically treated genomic DNA (Homo sapiens) CpG-island No: 13077
gcgatcgcgttacgtttgatattattttttaggtttttttttattagcgagtgatggggaaagtttttgatgatcgtttcggttgttatttgttggtgacgttattgcgcgaattgtacgacgtcgaattatttgcggaagtgtggttggtggtaagttttagcgaagaggtgggattacgcggcgggtaaattgttattcgcgcggtgtcgtcggacgtcgttattgtgtttgatatcgtttgttgggcgaaaaattttgattatggcgcggttaattatcgttagattggtaacgggtcgatgttggtgttaagcgataagtcgttgattgcgtcgttaaaatttatcgtttgggtcgaaatcgtggcggtagaaattggcgtgtcgttgtaggtagatatgtttagtaacggcggtacggacggcggggcggtgtatttaatcggtatcggcgtgtttatagtggtgatggggttagtaattcgttatggatattgcgtcgtatcgattgtcgattgtcgcgatattttgtagatgtagtaatttttatttgtttttatttaacgttttacgcgtgagacggttg

SEQ ID NO: 13078 - DNA, 588 bp, Artificial Sequence
  chemically treated genomic DNA (Homo sapiens) CpG-island No: 13078
caaccgtctcacgcgtaaaacgttaaataaaaacaaataaaaattactacatctacaaaatatcgcgacaatcgacaatcgatacgacgcaatatccataacgaattactaaccccatcaccactataaacacgccgataccgattaaatacaccgccccgccgtccgtaccgccgttactaaacatatctacctacaacgacacgccaatttctaccgccacgatttcgacccaaacgataaattttaacgacgcaatcaacgacttatcgcttaacaccaacatcgacccgttaccaatctaacgataattaaccgcgccataatcaaaatttttcgcccaacaaacgatatcaaacacaataacgacgtccgacgacaccgcgcgaataacaatttacccgccgcgtaatcccacctcttcgctaaaacttaccaccaaccacacttccgcaaataattcgacgtcgtacaattcgcgcaataacgtcaccaacaaataacaaccgaaacgatcatcaaaaactttccccatcactcgctaataaaaaaaaacctaaaaaataatatcaaacgtaacgcgatcgc

SEQ ID NO: 13079 - DNA, 588 bp, Artificial Sequence
  chemically treated genomic DNA (Homo sapiens) CpG-island No: 13079
taatcgttttacgcgtaagacgttgaataagggtagataaaagttgttgtatttgtaaaatgtcgcggtaatcggtaatcgatgcggcgtaatgtttatggcgggttgttggttttattattattgtgggtacgtcggtgtcggttaagtgtatcgtttcgtcgttcgtgtcgtcgttgttgaatatatttgtttgtaacggtacgttaatttttgtcgttacggtttcgatttaggcggtaagttttggcggcgtaattagcgatttgtcgtttaatattagtatcggttcgttattaatttggcgatggttagtcgcgttataattaaagtttttcgtttagtaggcggtattaagtataatggcgacgttcggcgatatcgcgcgggtggtagtttgttcgtcgcgtaattttattttttcgttggaatttgttattagttatattttcgtaggtagttcggcgtcgtgtagttcgcgtagtaacgttattagtagatagtaatcgaggcggttattaaaggttttttttattattcgttggtgagggagaatttgaaaagtggtattaaacgtgacgcgatcgt

SEQ ID NO: 13080 - DNA, 588 bp, Artificial Sequence
  chemically treated genomic DNA (Homo sapiens) CpG-island No: 13080
acgatcgcgtcacgtttaataccacttttcaaattctccctcaccaacgaataataaaaaaaacctttaataaccgcctcgattactatctactaataacgttactacgcgaactacacgacgccgaactacctacgaaaatataactaataacaaattccaacgaaaaaataaaattacgcgacgaacaaactaccacccgcgcgatatcgccgaacgtcgccattatacttaataccgcctactaaacgaaaaactttaattataacgcgactaaccatcgccaaattaataacgaaccgatactaatattaaacgacaaatcgctaattacgccgccaaaacttaccgcctaaatcgaaaccgtaacgacaaaaattaacgtaccgttacaaacaaatatattcaacaacgacgacacgaacgacgaaacgatacacttaaccgacaccgacgtacccacaataataataaaaccaacaacccgccataaacattacgccgcatcgattaccgattaccgcgacattttacaaatacaacaacttttatctacccttattcaacgtcttacgcgtaaaacgatta

SEQ ID NO: 13081 - DNA, 511 bp, Artificial Sequence
  chemically treated genomic DNA (Homo sapiens) CpG-island No: 13081
ttgtggtaacgcgttgagcgtattagcgtcggtttttagcgtattgtttcgggcgcgaaggcgttggacggttttatatcgcgtggttttgacgattatagtaaatttttttttttttaatttgacgtttattttgtgtcgttaacggtaacggaagagggtatcgtttggtcggaaggattacgtttatcgtcgcgtgattatacgtcgttgtatgacgaattacgttatgaattggcgattgatttttttatttacgacggtggggtcgttagcggttgggcgatgtaggcgtaatcgggcgataaatttacggtggtaggttcgcgcggttcgttggtggtgtcggaagattacgcgtattagttgtatgtttgcgatgaattcggaatgtttgtattgcgtcgtcgtttggaaacgttgagtaaatttgtcgttaaatcgtaagttagtgcgttggttagcgtgcgggataacgtttgttaggattatttcgcgtattttgatggtt

SEQ ID NO: 13082 - DNA, 511 bp, Artificial Sequence
  chemically treated genomic DNA (Homo sapiens) CpG-island No: 13082
aaccatcaaaatacgcgaaataatcctaacaaacgttatcccgcacgctaaccaacgcactaacttacgatttaacgacaaatttactcaacgtttccaaacgacgacgcaatacaaacattccgaattcatcgcaaacatacaactaatacgcgtaatcttccgacaccaccaacgaaccgcgcgaacctaccaccgtaaatttatcgcccgattacgcctacatcgcccaaccgctaacgaccccaccgtcgtaaataaaaaaatcaatcgccaattcataacgtaattcgtcatacaacgacgtataatcacgcgacgataaacgtaatccttccgaccaaacgataccctcttccgttaccgttaacgacacaaaataaacgtcaaattaaaaaaaaaaaaatttactataatcgtcaaaaccacgcgatataaaaccgtccaacgccttcgcgcccgaaacaatacgctaaaaaccgacgctaatacgctcaacgcgttaccacaa

SEQ ID NO: 13083 - DNA, 511 bp, Artificial Sequence
  chemically treated genomic DNA (Homo sapiens) CpG-island No: 13083
aattattaaggtgcgcgagataattttgataggcgttatttcgtacgttaattagcgtattaatttgcggtttaacggtaagtttgtttaacgtttttaggcggcggcgtaatgtaggtatttcggatttatcgtagatatatagttgatacgcgtaatttttcggtattattagcgaatcgcgcggatttgttatcgtaagtttatcgttcggttgcgtttgtatcgtttagtcgttggcgattttatcgtcgtgaataaagaaattaatcgttagtttatggcgtagttcgttatatagcggcgtatagttacgcgacggtgggcgtggttttttcggttagacgatgttttttttcgttatcgttggcggtataaagtgagcgttaggttgaggaaagaagagtttgttgtgatcgttaaagttacgcgatgtaaaatcgtttagcgttttcgcgttcgagataatgcgttgaaaatcggcgttgatgcgtttaacgcgttattatag

SEQ ID NO: 13084 - DNA, 511 bp, Artificial Sequence
  chemically treated genomic DNA (Homo sapiens) CpG-island No: 13084
ctataataacgcgttaaacgcatcaacgccgattttcaacgcattatctcgaacgcgaaaacgctaaacgattttacatcgcgtaactttaacgatcacaacaaactcttctttcctcaacctaacgctcactttataccgccaacgataacgaaaaaaaacatcgtctaaccgaaaaaaccacgcccaccgtcgcgtaactatacgccgctatataacgaactacgccataaactaacgattaatttctttattcacgacgataaaatcgccaacgactaaacgatacaaacgcaaccgaacgataaacttacgataacaaatccgcgcgattcgctaataataccgaaaaattacgcgtatcaactatatatctacgataaatccgaaatacctacattacgccgccgcctaaaaacgttaaacaaacttaccgttaaaccgcaaattaatacgctaattaacgtacgaaataacgcctatcaaaattatctcgcgcaccttaataatt

SEQ ID NO: 13085 - DNA, 1286 bp, Artificial Sequence
  chemically treated genomic DNA (Homo sapiens) CpG-island No: 13085
  misc_feature (402)..(402): n is either a, c, g or t
tcgtcgcgattttgtttaggtggagcgattcgtcggtttcgtcgtcgatcggttgcggttggatcgagtttagtatcgcggtatcgtcgttttcgtatttgtaggtatgcgtttgttggtcgacgatgtattcgtcgtcgcgttcgtagtgggttattaattcgagtaggttgtttatggtttcggtcggtacgaagagcgtcgcggcgaagtttaggcgcgtcgttagttcggtttttaggcggttgatcgtggggttttcgttatagacgtcgtcgtttagttcggtcgcggttatggttcgcgtatgtcggcggtgggttgggtgacggtgttcgtgcgtaggtcgatgataggtacggagggtttttcggttcggcggaaaagttcgatttacggcgnttatcgatagttataagggaagtcgggaaattttttcggtcgtaacggaaacgacgtcgaagcgtttcgttatgatcgagagggaaggtcgatacgttttagagtttggtcggtattattaggatttcggtacgtaggtcgttttttattcgtggattggggaagatgatgcgcgcgtcgatttcgtttattatttagcgcgtgtcgtcgatattttcggttagtaggtagttcggcgagagttcggtgaagttggttacgtcgtcgtcgaggtgtaggcggaagtggtcgttgtgtttgattatttcgcgcgatacgttgaatagtttgaggtcgtcgagtcgggagtcgttcggttgtttttcgttgtcgtcgattagtagttttaggtttcgttttaggcgttttaggttgattttttggtttttttcgaacggacgtgttttgtttagttttagggtaaaggtttcggcgtcgagttggtcgtaggtgtaggtgttgaaggtgatgttcggtttgttttgtaatagtatcgtttcgatgtcggcgtcgcgtaagcgggttagttcgttgtcggaatgttggcggttttcggtttaggggtagacggcgaattgttcgattttcgagtcgcggatcgtcgtatgtaggttttagtgtaggtggagtcgttcggttttgttgaataatatttgggttaagcgttttagttcggcggtacggaaggtttcgttggtatgtttttttcgtggcgatcgttgaataggtcgtttatgttttgttcgacgtaacggttttattttattcgtgatcggtttgaagtatggaagaagtataaatttgataatagtaagaagtgtttatgggttatcgatgaagagtag

SEQ ID NO: 13086 - DNA, 1286 bp, Artificial Sequence
  chemically treated genomic DNA (Homo sapiens) CpG-island No: 13086
  misc_feature (885)..(885): n is either a, c, g or t
ctactcttcatcgataacccataaacacttcttactattatcaaatttatacttcttccatacttcaaaccgatcacgaataaaataaaaccgttacgtcgaacaaaacataaacgacctattcaacgatcgccacgaaaaaaacataccaacgaaaccttccgtaccgccgaactaaaacgcttaacccaaatattattcaacaaaaccgaacgactccacctacactaaaacctacatacgacgatccgcgactcgaaaatcgaacaattcgccgtctacccctaaaccgaaaaccgccaacattccgacaacgaactaacccgcttacgcgacgccgacatcgaaacgatactattacaaaacaaaccgaacatcaccttcaacacctacacctacgaccaactcgacgccgaaacctttaccctaaaactaaacaaaacacgtccgttcgaaaaaaaccaaaaaatcaacctaaaacgcctaaaacgaaacctaaaactactaatcgacgacaacgaaaaacaaccgaacgactcccgactcgacgacctcaaactattcaacgtatcgcgcgaaataatcaaacacaacgaccacttccgcctacacctcgacgacgacgtaaccaacttcaccgaactctcgccgaactacctactaaccgaaaatatcgacgacacgcgctaaataataaacgaaatcgacgcgcgcatcatcttccccaatccacgaataaaaaacgacctacgtaccgaaatcctaataataccgaccaaactctaaaacgtatcgaccttccctctcgatcataacgaaacgcttcgacgtcgtttccgttacgaccgaaaaaatttcccgacttcccttataactatcgataancgccgtaaatcgaacttttccgccgaaccgaaaaaccctccgtacctatcatcgacctacgcacgaacaccgtcacccaacccaccgccgacatacgcgaaccataaccgcgaccgaactaaacgacgacgtctataacgaaaaccccacgatcaaccgcctaaaaaccgaactaacgacgcgcctaaacttcgccgcgacgctcttcgtaccgaccgaaaccataaacaacctactcgaattaataacccactacgaacgcgacgacgaatacatcgtcgaccaacaaacgcatacctacaaatacgaaaacgacgataccgcgatactaaactcgatccaaccgcaaccgatcgacgacgaaaccgacgaatcgctccacctaaacaaaatcgcgacga

SEQ ID NO: 13087 - DNA, 1286 bp, Artificial Sequence
  chemically treated genomic DNA (Homo sapiens) CpG-island No: 13087
  misc_feature (885)..(885): n is either a, c, g or t
ttgttttttatcggtgatttatggatattttttgttgttgttagatttgtattttttttatgttttagatcggttacggatggagtaggatcgttacgtcgaataggatatgaacggtttgtttaacggtcgttacgaggagggtatgttaacgaggtttttcgtgtcgtcgagttggagcgtttggtttaggtgttgtttagtaagatcgagcgattttatttgtattaggatttgtatacggcgattcgcggttcgaagatcgagtagttcgtcgtttatttttgggtcgagggtcgttagtatttcggtagcgaattggttcgtttgcgcgacgtcggtatcgaggcggtgttgttgtagaataagtcgggtattatttttagtatttatatttacggttagttcggcgtcgaggtttttattttggaattgggtaaggtacgttcgttcggagagaattaggaggttaatttggagcgtttggagcggagtttggagttgttgatcgacggtagcgaggaatagtcggacggttttcggttcgacggttttaagttgtttagcgtgtcgcgcgaggtgattaagtatagcgattattttcgtttgtatttcgacgacgacgtggttaattttatcgaattttcgtcgggttatttgttggtcgaggatatcggcggtacgcgttgggtggtggacgaggtcggcgcgcgtattattttttttaatttacgggtgaagaacggtttgcgtgtcggaattttggtggtgtcggttaagttttgaggcgtatcggttttttttttcgattatgacggagcgtttcggcgtcgttttcgttgcggtcgggaagatttttcgattttttttgtggttgtcggtagncgtcgtagatcgggttttttcgtcgaatcgaggagtttttcgtgtttgttatcgatttgcgtacggatatcgttatttagtttatcgtcggtatgcgcgaattatggtcgcggtcgaattgggcgacgacgtttatggcgaggattttacggttaatcgtttggaggtcgaattggcggcgcgtttgggtttcgtcgcggcgtttttcgtatcgatcgggattatgagtaatttgttcggattgatggtttattgcgagcgcggcgacgaatatatcgtcggttagtaggcgtatatttataaatacgagggcggcggtgtcgcggtgttgggttcgatttagtcgtagtcgatcgacggcgaggtcgacggatcgttttatttggataaggtcgcggcgg

SEQ ID NO: 13088 - DNA, 1286 bp, Artificial Sequence
  chemically treated genomic DNA (Homo sapiens) CpG-island No: 13088
  misc_feature (402)..(402): n is either a, c, g or t
ccgccgcgaccttatccaaataaaacgatccgtcgacctcgccgtcgatcgactacgactaaatcgaacccaacaccgcgacaccgccgccctcgtatttataaatatacgcctactaaccgacgatatattcgtcgccgcgctcgcaataaaccatcaatccgaacaaattactcataatcccgatcgatacgaaaaacgccgcgacgaaacccaaacgcgccgccaattcgacctccaaacgattaaccgtaaaatcctcgccataaacgtcgtcgcccaattcgaccgcgaccataattcgcgcataccgacgataaactaaataacgatatccgtacgcaaatcgataacaaacacgaaaaactcctcgattcgacgaaaaaacccgatctacgacgnctaccgacaaccacaaaaaaaatcgaaaaatcttcccgaccgcaacgaaaacgacgccgaaacgctccgtcataatcgaaaaaaaaaaccgatacgcctcaaaacttaaccgacaccaccaaaattccgacacgcaaaccgttcttcacccgtaaattaaaaaaaataatacgcgcgccgacctcgtccaccacccaacgcgtaccgccgatatcctcgaccaacaaataacccgacgaaaattcgataaaattaaccacgtcgtcgtcgaaatacaaacgaaaataatcgctatacttaatcacctcgcgcgacacgctaaacaacttaaaaccgtcgaaccgaaaaccgtccgactattcctcgctaccgtcgatcaacaactccaaactccgctccaaacgctccaaattaacctcctaattctctccgaacgaacgtaccttacccaattccaaaataaaaacctcgacgccgaactaaccgtaaatataaatactaaaaataatacccgacttattctacaacaacaccgcctcgataccgacgtcgcgcaaacgaaccaattcgctaccgaaatactaacgaccctcgacccaaaaataaacgacgaactactcgatcttcgaaccgcgaatcgccgtatacaaatcctaatacaaataaaatcgctcgatcttactaaacaacacctaaaccaaacgctccaactcgacgacacgaaaaacctcgttaacataccctcctcgtaacgaccgttaaacaaaccgttcatatcctattcgacgtaacgatcctactccatccgtaaccgatctaaaacataaaaaaaatacaaatctaacaacaacaaaaaatatccataaatcaccgataaaaaacaa

SEQ ID NO: 13089 - DNA, 569 bp, Artificial Sequence
  chemically treated genomic DNA (Homo sapiens) CpG-island No: 13089
gcggtttgcgttttatcgtcgattttttttagtaggcgttcgtatagtggattgtcggtggttttacgtagataggcgatgcgtaattcgtggatattgttacggatacgatcgcgtaattttgtcgtggtagtttcggtaaaggtgattattagtagttttttaacggttagcgggcggggaaaggcggcggaatcgttagtttaagtaataggcgtaaatagagcgtcgtaatcgtaaaggttttgtttgtgtcggtagaggttttaattaggcgtttattttgtaagggtaagcgtaaaggatttagtgtttcggcgatattatttattttttttatttattaggggtattgtttgttgtaacgcgttgacgtttttttatattttttagtttttagggtgtatatattcggttttttcgttttggttgtcggaaatttgcgatagaatagttatgttttgcggttcgattatcgtttgatggaagaaattagtaagtttttgcggcgttacgagttttatttgggttacgattttattacgcgaatcgaagcgtatattgtcgcg

SEQ ID NO: 13090 - DNA, 569 bp, Artificial Sequence
  chemically treated genomic DNA (Homo sapiens) CpG-island No: 13090
cgcgacaatatacgcttcgattcgcgtaataaaatcgtaacccaaataaaactcgtaacgccgcaaaaacttactaatttcttccatcaaacgataatcgaaccgcaaaacataactattctatcgcaaatttccgacaaccaaaacgaaaaaaccgaatatatacaccctaaaaactaaaaaatataaaaaaacgtcaacgcgttacaacaaacaatacccctaataaataaaaaaaataaataatatcgccgaaacactaaatcctttacgcttacccttacaaaataaacgcctaattaaaacctctaccgacacaaacaaaacctttacgattacgacgctctatttacgcctattacttaaactaacgattccgccgcctttccccgcccgctaaccgttaaaaaactactaataatcacctttaccgaaactaccacgacaaaattacgcgatcgtatccgtaacaatatccacgaattacgcatcgcctatctacgtaaaaccaccgacaatccactatacgaacgcctactaaaaaaaatcgacgataaaacgcaaaccgc

SEQ ID NO: 13091 - DNA, 569 bp, Artificial Sequence
  chemically treated genomic DNA (Homo sapiens) CpG-island No: 13091
cgcggtaatatgcgtttcgattcgcgtgataaaatcgtggtttagataaaattcgtgacgtcgtaaaaatttgttgattttttttattaggcggtggtcgagtcgtaaggtatggttattttgtcgtagattttcggtagttagaacgggaaagtcgaatatgtatattttgaaggttggaaagtgtgggagaacgttagcgcgttgtagtaaataatgtttttgatgagtgaaaagaatgagtgatgtcgtcgagatattagattttttgcgtttgtttttatagggtgagcgtttgattgaagtttttgtcggtataggtaaaatttttacgattgcggcgttttatttgcgtttgttatttggattagcggtttcgtcgttttttttcgttcgttgatcgttgaagaattgttggtggttatttttatcgaggttgttacggtagaattgcgcggtcgtattcgtagtaatatttacgagttgcgtatcgtttgtttgcgtgaaattatcgataatttattgtacgaacgtttgttggaagagatcgacgataaagcgtaagtcgt

SEQ ID NO: 13092 - DNA, 569 bp, Artificial Sequence
  chemically treated genomic DNA (Homo sapiens) CpG-island No: 13092
acgacttacgctttatcgtcgatctcttccaacaaacgttcgtacaataaattatcgataatttcacgcaaacaaacgatacgcaactcgtaaatattactacgaatacgaccgcgcaattctaccgtaacaacctcgataaaaataaccaccaacaattcttcaacgatcaacgaacgaaaaaaaacgacgaaaccgctaatccaaataacaaacgcaaataaaacgccgcaatcgtaaaaattttacctataccgacaaaaacttcaatcaaacgctcaccctataaaaacaaacgcaaaaaatctaatatctcgacgacatcactcattcttttcactcatcaaaaacattatttactacaacgcgctaacgttctcccacactttccaaccttcaaaatatacatattcgactttcccgttctaactaccgaaaatctacgacaaaataaccataccttacgactcgaccaccgcctaataaaaaaaatcaacaaatttttacgacgtcacgaattttatctaaaccacgattttatcacgcgaatcgaaacgcatattaccgcg

SEQ ID NO: 13093 - DNA, 1037 bp, Artificial Sequence
  chemically treated genomic DNA (Homo sapiens) CpG-island No: 13093
agttggcgatgatcgtgcgtgaatcggtcggcgtgattgtcgttatcgtgtcgtggaatttttcgttgttgttgatttgttggaaattcggttcggcgttggcggcgggaaatagcgtgattttaaaatcgtttgaaaaattatcgtttagtgcgattcgtttcgcggggttggcgaaagaagtaggtttgtcggatggtgtgttgaacgtggtgacgggttttggttatgaagtcgggtaggcgttgtcgcgttataacgatatcgacgttattgtttttatcggtttaattcgtatcgggaaatagttgttgaaagatgcgggcgatataatatgaaacgcgtttggttggaagcgggcggtaaaagcgttaatatcgttttcgttgattgttcggatttgtaataggcggtaagcgttatcgtagtaggtattttttataattagggataggtgtgtatcgtcggaacgcgtttgttgttggaagagagtatcgtcgatgaatttttagttttgttaaaatagtaggcgtaaaattggtagtcgggttatttatttgatttcgtaattattatgggtattttaatcgattgcgtttacgtcgattcggtttatagttttattcgggaaggcgaaagtaaagggtaattgttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgattcgacgtttgatagtcggtttcgttttttttaattattattacgacggcgatatgatcgtttcgtttggcggttattagtagagcggtaacggtcgttataaatttttgtatgttttttataaatttattgaattgaaaattatttggataagtttggagg

SEQ ID NO: 13094 - DNA, 1037 bp, Artificial Sequence
  chemically treated genomic DNA (Homo sapiens) CpG-island No: 13094
cctccaaacttatccaaataattttcaattcaataaatttataaaaaacatacaaaaatttataacgaccgttaccgctctactaataaccgccaaacgaaacgatcatatcgccgtcgtaataataattaaaaaaaacgaaaccgactatcaaacgtcgaatcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaacaattaccctttactttcgccttcccgaataaaactataaaccgaatcgacgtaaacgcaatcgattaaaatacccataataattacgaaatcaaataaataacccgactaccaattttacgcctactattttaacaaaactaaaaattcatcgacgatactctcttccaacaacaaacgcgttccgacgatacacacctatccctaattataaaaaatacctactacgataacgcttaccgcctattacaaatccgaacaatcaacgaaaacgatattaacgcttttaccgcccgcttccaaccaaacgcgtttcatattatatcgcccgcatctttcaacaactatttcccgatacgaattaaaccgataaaaacaataacgtcgatatcgttataacgcgacaacgcctacccgacttcataaccaaaacccgtcaccacgttcaacacaccatccgacaaacctacttctttcgccaaccccgcgaaacgaatcgcactaaacgataatttttcaaacgattttaaaatcacgctatttcccgccgccaacgccgaaccgaatttccaacaaatcaacaacaacgaaaaattccacgacacgataacgacaatcacgccgaccgattcacgcacgatcatcgccaact

SEQ ID NO: 13095 - DNA, 1037 bp, Artificial Sequence
  chemically treated genomic DNA (Homo sapiens) CpG-island No: 13095
tttttaggtttatttagatggtttttagtttagtgaatttgtgaagggtatgtagggatttgtggcgatcgttgtcgttttgttgatagtcgttaaacgggacggttatatcgtcgtcgtggtagtgattgaggaagacggaatcggttgttaggcgtcgggttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataatagttgttttttgttttcgttttttcgaataaagttatggatcgagtcggcgtgggcgtagtcgattaaggtgtttatggtggttgcgggattaagtggatggttcggttgttagttttgcgtttgttgttttaatagggttaagaatttatcggcgatgtttttttttagtaataggcgcgtttcggcgatgtatatttgtttttggttgtagaaaatgtttgttgcggtggcgtttgtcgtttgttgtaaattcgggtagttagcgaaaacgatgttggcgtttttgtcgttcgtttttagttagacgcgttttatgttgtgtcgttcgtattttttagtagttgtttttcggtacgggttgaatcggtaaaggtaatggcgtcgatatcgttatgacgcgatagcgtttgttcggttttatgattaaaattcgttattacgtttaatatattattcggtaagtttgtttttttcgttagtttcgcgagacgaatcgtattgagcggtgattttttagacggttttagaattacgttgtttttcgtcgttagcgtcgggtcgagtttttagtaagttagtaatagcgggaagttttacggtacgatggcggtaattacgtcgatcggtttacgtacgattatcgttagtt

SEQ ID NO: 13096 - DNA, 1037 bp, Artificial Sequence
  chemically treated genomic DNA (Homo sapiens) CpG-island No: 13096
aactaacgataatcgtacgtaaaccgatcgacgtaattaccgccatcgtaccgtaaaacttcccgctattactaacttactaaaaactcgacccgacgctaacgacgaaaaacaacgtaattctaaaaccgtctaaaaaatcaccgctcaatacgattcgtctcgcgaaactaacgaaaaaaacaaacttaccgaataatatattaaacgtaataacgaattttaatcataaaaccgaacaaacgctatcgcgtcataacgatatcgacgccattacctttaccgattcaacccgtaccgaaaaacaactactaaaaaatacgaacgacacaacataaaacgcgtctaactaaaaacgaacgacaaaaacgccaacatcgttttcgctaactacccgaatttacaacaaacgacaaacgccaccgcaacaaacattttctacaaccaaaaacaaatatacatcgccgaaacgcgcctattactaaaaaaaaacatcgccgataaattcttaaccctattaaaacaacaaacgcaaaactaacaaccgaaccatccacttaatcccgcaaccaccataaacaccttaatcgactacgcccacgccgactcgatccataactttattcgaaaaaacgaaaacaaaaaacaactattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataacccgacgcctaacaaccgattccgtcttcctcaatcactaccacgacgacgatataaccgtcccgtttaacgactatcaacaaaacgacaacgatcgccacaaatccctacatacccttcacaaattcactaaactaaaaaccatctaaataaacctaaaaa

SEQ ID NO: 13097 - DNA, 1551 bp, Artificial Sequence
  chemically treated genomic DNA (Homo sapiens) CpG-island No: 13097
  misc_feature (1410)..(1410): n is either a, c, g or t
gaacgagacgttattgtttagagaacgttttttttttagacggttgattatgcgttcgatattttttatcggttcgataattattcgtttggagtaatttgttagacgagtcgattcgagtcggggttacggagttttatgtttgtttattcgcgaaatttttgtatttatcgatggtttttgcgggtcgttggaagttttgtatttcgatttgttcgatgttcgcggcgtcgttttggtttgttattcgtattcgttgttcgtcggtattatgtagaataaggtggtcgttattttgtaacgtacgttcgcgatgtcggtttggcgattttgcgttttaattttcgtggcgttggttagagcgttggtagttatggcgaggggatcggcgagatcgacgacgtcgaggtcgtcgcgcgtatggttgttggtacgttattcggggttgtcgttgatattgatgggtttttttttcggtttttgcgtcgtcggtaatttggcggggcgtttggaagcgtagggcgtggggttggcgcggttgtttatgatcgcgtcgtcggtggaacgtttcgcggttagtttgtttgcgcgttgttcgttgatcgtggtgtagtcggaggacgacgacgtggttacgtcggtcgcggtatatgtttggagcgagtttttggtacgatcgtacgagttgttgcgggtggtagaaagcggatattttttttatggtaagttgatcgatttgaaggatttgttgttgttacgtttgtaggattgacgtcgtcgcgtcggttttgttattattcggcgcgttatttttttttttgtttgatatttggtatcgtatgattattcgtattttgatcggtattatttttatcggtatttcgtatttgggtaattacgtcggcgttattcgttcggcgattttcgttagtcgtcggagcgacgtggattcgttttattttttggcggattattacgttttgattaagtgcgacgatttcgttcgtatttagcgttcgcgtttggaaatcgtcgcgatttggttggtcggcggtatggacgtcgagcgtgcgattttttatcggtagtcggatattttcgagattttcgagttgatttggttgtttatttgcgttagtgttaagggtttgtttaatcgcgcgtatgtttataaggtcgcggtggatcgtaatgtcgaggtcggcgaagattcggacgtcggcgtgattatgggtttttatagttattcggtgttgatggtcgcggatattttgatgtttaacgcgtataagatttcggtcggtcgcgattaggtgtagtacgtggagatggttcgcgatatcggttagcggtttaaataatttgttcggtaacggtcgtcgagtttttttcgttttgttacgaagcggntgatcgaaggaaaacgtcggtatttttgtcggggtttggaacgggcgatgtcgttattattttatcgcgaggaaagatatgaacggtttatttcgtattcgttagcgttattaggggtttgtttagagtgataaaaaattg

SEQ ID NO: 13098 - DNA, 1551 bp, Artificial Sequence
  chemically treated genomic DNA (Homo sapiens) CpG-island No: 13098
  misc_feature (142)..(142): n is either a, c, g or t
caattttttatcactctaaacaaacccctaataacgctaacgaatacgaaataaaccgttcatatctttcctcgcgataaaataataacgacatcgcccgttccaaaccccgacaaaaataccgacgttttccttcgatcanccgcttcgtaacaaaacgaaaaaaactcgacgaccgttaccgaacaaattatttaaaccgctaaccgatatcgcgaaccatctccacgtactacacctaatcgcgaccgaccgaaatcttatacgcgttaaacatcaaaatatccgcgaccatcaacaccgaataactataaaaacccataatcacgccgacgtccgaatcttcgccgacctcgacattacgatccaccgcgaccttataaacatacgcgcgattaaacaaacccttaacactaacgcaaataaacaaccaaatcaactcgaaaatctcgaaaatatccgactaccgataaaaaatcgcacgctcgacgtccataccgccgaccaaccaaatcgcgacgatttccaaacgcgaacgctaaatacgaacgaaatcgtcgcacttaatcaaaacgtaataatccgccaaaaaataaaacgaatccacgtcgctccgacgactaacgaaaatcgccgaacgaataacgccgacgtaattacccaaatacgaaataccgataaaaataataccgatcaaaatacgaataatcatacgataccaaatatcaaacaaaaaaaaaaataacgcgccgaataataacaaaaccgacgcgacgacgtcaatcctacaaacgtaacaacaacaaatccttcaaatcgatcaacttaccataaaaaaaatatccgctttctaccacccgcaacaactcgtacgatcgtaccaaaaactcgctccaaacatataccgcgaccgacgtaaccacgtcgtcgtcctccgactacaccacgatcaacgaacaacgcgcaaacaaactaaccgcgaaacgttccaccgacgacgcgatcataaacaaccgcgccaaccccacgccctacgcttccaaacgccccgccaaattaccgacgacgcaaaaaccgaaaaaaaaacccatcaatatcaacgacaaccccgaataacgtaccaacaaccatacgcgcgacgacctcgacgtcgtcgatctcgccgatcccctcgccataactaccaacgctctaaccaacgccacgaaaattaaaacgcaaaatcgccaaaccgacatcgcgaacgtacgttacaaaataacgaccaccttattctacataataccgacgaacaacgaatacgaataacaaaccaaaacgacgccgcgaacatcgaacaaatcgaaatacaaaacttccaacgacccgcaaaaaccatcgataaatacaaaaatttcgcgaataaacaaacataaaactccgtaaccccgactcgaatcgactcgtctaacaaattactccaaacgaataattatcgaaccgataaaaaatatcgaacgcataatcaaccgtctaaaaaaaaaacgttctctaaacaataacgtctcgttc

SEQ ID NO: 13099 - DNA, 1551 bp, Artificial Sequence
  chemically treated genomic DNA (Homo sapiens) CpG-island No: 13099
  misc_feature (142)..(142): n is either a, c, g or t
tagttttttattattttgggtaagtttttggtaacgttgacggatacgaagtaagtcgtttatattttttttcgcgatgaaatagtggcgatatcgttcgttttaggtttcggtaggggtgtcgacgttttttttcgattantcgtttcgtggtaggacgaaagaaattcggcggtcgttgtcgaataggttgtttgaatcgttggtcgatgtcgcgggttatttttacgtgttgtatttggtcgcggtcgatcggaattttgtgcgcgttgaatattaggatgttcgcggttattagtatcggatagttgtagaggtttatggttacgtcggcgttcgggttttcgtcggtttcgatattgcggtttatcgcggttttgtaggtatgcgcgcggttgagtaggtttttggtattgacgtaggtgagtaattaggttagttcgggaatttcggggatgttcgattgtcggtagaaggtcgtacgttcgacgtttatgtcgtcggttagttaggtcgcggcgatttttaggcgcgagcgttggatacgagcgggatcgtcgtatttgattaaggcgtggtagttcgttaggaagtagaacgaatttacgtcgtttcgacggttggcgaggatcgtcgggcggatggcgtcggcgtagttgtttaggtgcggagtgtcggtaggagtgatgtcggttaggatacgagtagttatgcgatattagatgttaggtaaagaaaagaatggcgcgtcggatggtagtagggtcggcgcgacgacgttagttttgtaggcgtggtagtaataggttttttagatcgattagtttgttatggaagaaatgttcgttttttgttattcgtaatagttcgtgcggtcgtgttagggattcgttttaggtatatatcgcggtcggcgtgattacgtcgtcgtttttcggttgtattacggttagcgggtaacgcgtaggtaggttgatcgcgaagcgttttatcggcggcgcgattatgaatagtcgcgttagttttacgttttgcgtttttaggcgtttcgttagattgtcggcgacgtaggagtcgaaggaaaagtttattagtgttagcggtaatttcggatggcgtgttagtaattatgcgcgcggcggtttcggcgtcgtcgatttcgtcgattttttcgttatagttgttagcgttttggttaacgttacggaagttgaaacgtagggtcgttaggtcggtatcgcgggcgtgcgttgtagagtggcgattattttgttttgtatggtgtcggcgaatagcgggtgcggatggtagattagggcgacgtcgcgggtatcgggtagatcgaggtgtagggtttttagcggttcgtaggggttatcgatggatatagggatttcgcgggtagataaatatggaatttcgtgatttcggttcgggtcgattcgtttagtagattattttaagcgaatgattatcgggtcggtgaaaaatatcgagcgtatgattaatcgtttgggggaagggcgttttttgggtaatagcgtttcgttt

SEQ ID NO: 13100 - DNA, 1551 bp, Artificial Sequence
  chemically treated genomic DNA (Homo sapiens) CpG-island No: 13100
  misc_feature (1410)..(1410): n is either a, c, g or t
aaacgaaacgctattacccaaaaaacgcccttcccccaaacgattaatcatacgctcgatatttttcaccgacccgataatcattcgcttaaaataatctactaaacgaatcgacccgaaccgaaatcacgaaattccatatttatctacccgcgaaatccctatatccatcgataacccctacgaaccgctaaaaaccctacacctcgatctacccgatacccgcgacgtcgccctaatctaccatccgcacccgctattcgccgacaccatacaaaacaaaataatcgccactctacaacgcacgcccgcgataccgacctaacgaccctacgtttcaacttccgtaacgttaaccaaaacgctaacaactataacgaaaaaatcgacgaaatcgacgacgccgaaaccgccgcgcgcataattactaacacgccatccgaaattaccgctaacactaataaacttttccttcgactcctacgtcgccgacaatctaacgaaacgcctaaaaacgcaaaacgtaaaactaacgcgactattcataatcgcgccgccgataaaacgcttcgcgatcaacctacctacgcgttacccgctaaccgtaatacaaccgaaaaacgacgacgtaatcacgccgaccgcgatatatacctaaaacgaatccctaacacgaccgcacgaactattacgaataacaaaaaacgaacatttcttccataacaaactaatcgatctaaaaaacctattactaccacgcctacaaaactaacgtcgtcgcgccgaccctactaccatccgacgcgccattcttttctttacctaacatctaatatcgcataactactcgtatcctaaccgacatcactcctaccgacactccgcacctaaacaactacgccgacgccatccgcccgacgatcctcgccaaccgtcgaaacgacgtaaattcgttctacttcctaacgaactaccacgccttaatcaaatacgacgatcccgctcgtatccaacgctcgcgcctaaaaatcgccgcgacctaactaaccgacgacataaacgtcgaacgtacgaccttctaccgacaatcgaacatccccgaaattcccgaactaacctaattactcacctacgtcaataccaaaaacctactcaaccgcgcgcatacctacaaaaccgcgataaaccgcaatatcgaaaccgacgaaaacccgaacgccgacgtaaccataaacctctacaactatccgatactaataaccgcgaacatcctaatattcaacgcgcacaaaattccgatcgaccgcgaccaaatacaacacgtaaaaataacccgcgacatcgaccaacgattcaaacaacctattcgacaacgaccgccgaatttctttcgtcctaccacgaaacgantaatcgaaaaaaaacgtcgacacccctaccgaaacctaaaacgaacgatatcgccactatttcatcgcgaaaaaaaatataaacgacttacttcgtatccgtcaacgttaccaaaaacttacccaaaataataaaaaacta

SEQ ID NO: 13101 - DNA, 916 bp, Artificial Sequence
  chemically treated genomic DNA (Homo sapiens) CpG-island No: 13101
  misc_feature (798)..(798): n is either a, c, g or t
ggttttggtcggcggtttggcgtaggttttttttggttgtcgcgatgatgcggatatttagcgggattaattggttggagtcgagtcgttcgattattcgtttttgtagtaggcgtaatagtttgatttgtacgtttaggtttatgttttcgatttcgtcgaggaatagggtgtcgttattggcgtattcgaatttgtcgatgcggcgtttttgtcgtcggatgaaggcgtcggtttcgtgatcgaatagttcgttttttattatcgattcggcgagggcgtcggcgttgatcgcgacgaacggttcgtcgcgtttgttcgataggttatgtagggttcgcgcgattatttttttgtcggcgtcggtttcgttaaggattagtacgtcggtttggatcgtcgttagcgagtcgatttgttcgcgtagcgttgtatgtcggtcgagcgttcgattaggcgtttatgtagttcgtggcgttcggttagggttaggcgtagggtgcggttttttaggattagtcggcgtatttttagggcgcggcgtacgttgtcgagtagggcgtcgttggggaagggtttttttaggaagttataggcgtcgcgcgtatggtttggatcgttagcggacgtcgtcgtggtcggtgattaggattacggtaggtcggcgttttgttcgtgtaattggcggatagttttatgttatcgatgtcgggtatgcggatgtcgttgattataattttgggtaagttttgtattgcgcggtattaatttgcgcgcgtcgttaaggtcgcgatttgnattcggtaaggttaacgtttggcgtagggttttttataatagtcgggcggcgtaaatttggtggtagtaaaattagagtaaatgtgtgtagtttgttaattttttcgtttggtatttg

SEQ ID NO: 13102 - DNA, 916 bp, Artificial Sequence
  chemically treated genomic DNA (Homo sapiens) CpG-island No: 13102
  misc_feature (119)..(119): n is either a, c, g or t
caaataccaaacgaaaaaattaacaaactacacacatttactctaattttactaccaccaaatttacgccgcccgactattataaaaaaccctacgccaaacgttaaccttaccgaatncaaatcgcgaccttaacgacgcgcgcaaattaataccgcgcaatacaaaacttacccaaaattataatcaacgacatccgcatacccgacatcgataacataaaactatccgccaattacacgaacaaaacgccgacctaccgtaatcctaatcaccgaccacgacgacgtccgctaacgatccaaaccatacgcgcgacgcctataacttcctaaaaaaacccttccccaacgacgccctactcgacaacgtacgccgcgccctaaaaatacgccgactaatcctaaaaaaccgcaccctacgcctaaccctaaccgaacgccacgaactacataaacgcctaatcgaacgctcgaccgacatacaacgctacgcgaacaaatcgactcgctaacgacgatccaaaccgacgtactaatccttaacgaaaccgacgccgacaaaaaaataatcgcgcgaaccctacataacctatcgaacaaacgcgacgaaccgttcgtcgcgatcaacgccgacgccctcgccgaatcgataataaaaaacgaactattcgatcacgaaaccgacgccttcatccgacgacaaaaacgccgcatcgacaaattcgaatacgccaataacgacaccctattcctcgacgaaatcgaaaacataaacctaaacgtacaaatcaaactattacgcctactacaaaaacgaataatcgaacgactcgactccaaccaattaatcccgctaaatatccgcatcatcgcgacaaccaaaaaaaacctacgccaaaccgccgaccaaaacc

SEQ ID NO: 13103 - DNA, 916 bp, Artificial Sequence
  chemically treated genomic DNA (Homo sapiens) CpG-island No: 13103
  misc_feature (119)..(119): n is either a, c, g or t
tagatattagacggaaagattggtaaattgtatatatttgttttgattttgttgttattagatttgcgtcgttcgattattataaaaggttttgcgttagacgttgattttgtcgggtntaagtcgcgattttgacgacgcgcgtaagttgatatcgcgtagtgtaagatttgtttagggttgtggttagcgatattcgtatgttcggtatcgatggtatggaattgttcgttaattgtacgaataggacgtcgatttgtcgtgattttgattatcggttacggcgacgttcgttggcggtttaggttatgcgcgcggcgtttatgattttttggaaaagtttttttttagcgacgttttgttcgatagcgtgcgtcgcgttttggaggtgcgtcggttggttttggagaatcgtattttgcgtttggttttggtcgaacgttacgagttgtatgggcgtttgatcggacgttcggtcggtatgtagcgttgcgcgagtaggtcggttcgttggcggcgatttaggtcgacgtgttggtttttggcgaaatcggcgtcggtaaggaggtggtcgcgcgggttttgtatgatttgtcgagtagacgcgacggatcgttcgtcgcgattaacgtcggcgttttcgtcgaatcggtggtggaaagcgaattgttcggttacgaggtcggcgtttttattcggcggtagaagcgtcgtatcggtaagttcgagtacgttaatggcggtattttgtttttcgacgagatcgagagtatgagtttggacgtgtaggttaagttgttgcgtttgttgtaggaacgggtagtcgagcggttcggttttaattagttgatttcgttggatattcgtattatcgcggtaattaaggaagatttgcgttaggtcgtcgattagggtt

SEQ ID NO: 13104 - DNA, 916 bp, Artificial Sequence
  chemically treated genomic DNA (Homo sapiens) CpG-island No: 13104
  misc_feature (798)..(798): n is either a, c, g or t
aaccctaatcgacgacctaacgcaaatcttccttaattaccgcgataatacgaatatccaacgaaatcaactaattaaaaccgaaccgctcgactacccgttcctacaacaaacgcaacaacttaacctacacgtccaaactcatactctcgatctcgtcgaaaaacaaaataccgccattaacgtactcgaacttaccgatacgacgcttctaccgccgaataaaaacgccgacctcgtaaccgaacaattcgctttccaccaccgattcgacgaaaacgccgacgttaatcgcgacgaacgatccgtcgcgtctactcgacaaatcatacaaaacccgcgcgaccacctccttaccgacgccgatttcgccaaaaaccaacacgtcgacctaaatcgccgccaacgaaccgacctactcgcgcaacgctacataccgaccgaacgtccgatcaaacgcccatacaactcgtaacgttcgaccaaaaccaaacgcaaaatacgattctccaaaaccaaccgacgcacctccaaaacgcgacgcacgctatcgaacaaaacgtcgctaaaaaaaaacttttccaaaaaatcataaacgccgcgcgcataacctaaaccgccaacgaacgtcgccgtaaccgataatcaaaatcacgacaaatcgacgtcctattcgtacaattaacgaacaattccataccatcgataccgaacatacgaatatcgctaaccacaaccctaaacaaatcttacactacgcgatatcaacttacgcgcgtcgtcaaaatcgcgacttanacccgacaaaatcaacgtctaacgcaaaaccttttataataatcgaacgacgcaaatctaataacaacaaaatcaaaacaaatatatacaatttaccaatctttccgtctaatatcta

SEQ ID NO: 13105 - DNA, 612 bp, Artificial Sequence
  chemically treated genomic DNA (Homo sapiens) CpG-island No: 13105
tcgtcgattatttttagttcgtcgttaatcggaacgttatgagcgattcggttggtttttacgttatattgcgcgtaaagttcggtaatgtagttagcggtattttatttttaatcgtggggttggtggcgaggattattttagtgatttttttttttgttagacgttgttttagacgattaagttcgatattattcggatcgatgtcgtttagcggtgatagatgttttattaatattaaataacgatttgaaaattgtttcgtttgtttaatggcgtagatgttcgtcggattttttattacgtagatttgatcgtttttttgacgacgcggattcgaatagatgttatagattttttgttcggtgaaagtgcggtaatcggcgtagtggtcgattttcgatatcgttcgggtgagcgtttgcgttagacgtatttcgtcgttacgatcgcgttgaagtagcgtgaacgttatacgttgcgtcgatttcgggttaacgttcggtagatagcgtagtgtttttataagttgtgttaatacggtgttggtttgtattagaacggtattttaaagttaggcggtagttgtatttcggaagatatagagggtat

SEQ ID NO: 13106 - DNA, 612 bp, Artificial Sequence
  chemically treated genomic DNA (Homo sapiens) CpG-island No: 13106
ataccctctatatcttccgaaatacaactaccgcctaactttaaaataccgttctaatacaaaccaacaccgtattaacacaacttataaaaacactacgctatctaccgaacgttaacccgaaatcgacgcaacgtataacgttcacgctacttcaacgcgatcgtaacgacgaaatacgtctaacgcaaacgctcacccgaacgatatcgaaaatcgaccactacgccgattaccgcactttcaccgaacaaaaaatctataacatctattcgaatccgcgtcgtcaaaaaaacgatcaaatctacgtaataaaaaatccgacgaacatctacgccattaaacaaacgaaacaattttcaaatcgttatttaatattaataaaacatctatcaccgctaaacgacatcgatccgaataatatcgaacttaatcgtctaaaacaacgtctaacaaaaaaaaaaatcactaaaataatcctcgccaccaaccccacgattaaaaataaaataccgctaactacattaccgaactttacgcgcaatataacgtaaaaaccaaccgaatcgctcataacgttccgattaacgacgaactaaaaataatcgacga

SEQ ID NO: 13107 - DNA, 612 bp, Artificial Sequence
  chemically treated genomic DNA (Homo sapiens) CpG-island No: 13107
atgttttttgtatttttcggaatgtagttgtcgtttggttttaagatgtcgttttgatgtaaattagtatcgtgttaatatagtttatggaagtattgcgttgtttgtcgggcgttggttcgaagtcggcgtagcgtatggcgtttacgttgttttagcgcgatcgtagcggcgggatgcgtttggcgtaggcgtttattcgggcgatgtcggaaatcggttattgcgtcgattgtcgtatttttatcgaataggaagtttgtaatatttgttcgaattcgcgtcgttaggaaaacggttaaatttgcgtggtggagagttcggcggatatttacgttattgagtagacggggtagtttttaggtcgttatttggtgttgatggggtatttgttatcgttggacggtatcggttcggatgatatcgggtttgatcgtttggaatagcgtttggtagaggaaaaaattattgaagtgattttcgttattaattttacggttgaaggtgaagtatcgttaattatattgtcgagttttgcgcgtaatatgacgtggaagttagtcgaatcgtttatggcgtttcggttggcggcgagttggaaatggtcgacgg

SEQ ID NO: 13108 - DNA, 612 bp, Artificial Sequence
  chemically treated genomic DNA (Homo sapiens) CpG-island No: 13108
ccgtcgaccatttccaactcgccgccaaccgaaacgccataaacgattcgactaacttccacgtcatattacgcgcaaaactcgacaatataattaacgatacttcaccttcaaccgtaaaattaataacgaaaatcacttcaataattttttcctctaccaaacgctattccaaacgatcaaacccgatatcatccgaaccgataccgtccaacgataacaaataccccatcaacaccaaataacgacctaaaaactaccccgtctactcaataacgtaaatatccgccgaactctccaccacgcaaatttaaccgttttcctaacgacgcgaattcgaacaaatattacaaacttcctattcgataaaaatacgacaatcgacgcaataaccgatttccgacatcgcccgaataaacgcctacgccaaacgcatcccgccgctacgatcgcgctaaaacaacgtaaacgccatacgctacgccgacttcgaaccaacgcccgacaaacaacgcaatacttccataaactatattaacacgatactaatttacatcaaaacgacatcttaaaaccaaacgacaactacattccgaaaaatacaaaaaacat

SEQ ID NO: 13109 - DNA, 673 bp, Artificial Sequence
  chemically treated genomic DNA (Homo sapiens) CpG-island No: 13109
ttttggttgcggttatcgacggtacgttagcggcggatgttcgttcgttggtgcgttttttcgtgagcgttttcgtcgaagaagatggtaaacgcgaacgcggtgttagtggcggcggcggtcgttttggttatgaatttttttttgtcgatttcgacggcgaagttcgtgcggatgtatgggtaaaagaagtagtgcgtatggcgttggttaatttttttgtcgttgttgtattagcgggtattatgtcggtagtatttggcgtaggttggtcgggcgtgttgttgtatgaagcggttggttacggtttggaaggcgattttaatcgtcgtggtattttagtatttagtggataggtcggggagttggtggttttagaattgtgtatcgtggttgatgatggtacgatggtcgatcgtcgaggttcggtggcgattgatgacgaaggtacgttaggttagtataacgtgttgattgagaacggtattttgaaaggttatatgtaggataaatttaacgcgcgtttgatggggatgacgtcgattggtaacggtcgtcgtgaattttacgtttatttgtttatgtcgcgtatgattaatatttatatgttgtcgggtaaatcgatttcgtaggaaattattgaattcgttgagtacggtatttatgtatcgaa

SEQ ID NO: 13110 - DNA, 673 bp, Artificial Sequence
  chemically treated genomic DNA (Homo sapiens) CpG-island No: 13110
ttcgatacataaataccgtactcaacgaattcaataatttcctacgaaatcgatttacccgacaacatataaatattaatcatacgcgacataaacaaataaacgtaaaattcacgacgaccgttaccaatcgacgtcatccccatcaaacgcgcgttaaatttatcctacatataacctttcaaaataccgttctcaatcaacacgttatactaacctaacgtaccttcgtcatcaatcgccaccgaacctcgacgatcgaccatcgtaccatcatcaaccacgatacacaattctaaaaccaccaactccccgacctatccactaaatactaaaataccacgacgattaaaatcgccttccaaaccgtaaccaaccgcttcatacaacaacacgcccgaccaacctacgccaaatactaccgacataatacccgctaatacaacaacgacaaaaaaattaaccaacgccatacgcactacttcttttacccatacatccgcacgaacttcgccgtcgaaatcgacaaaaaaaaattcataaccaaaacgaccgccgccgccactaacaccgcgttcgcgtttaccatcttcttcgacgaaaacgctcacgaaaaaacgcaccaacgaacgaacatccgccgctaacgtaccgtcgataaccgcaaccaaaa

SEQ ID NO: 13111 - DNA, 673 bp, Artificial Sequence
  chemically treated genomic DNA (Homo sapiens) CpG-island No: 13111
ttcggtgtatagatatcgtatttaacggatttaataattttttgcggggtcgatttattcggtagtatataggtgttggttatacgcggtatgggtagatgggcgtaggatttacggcgatcgttgttagtcggcgttatttttattaaacgcgcgttgagtttattttgtatgtagttttttagaatgtcgtttttaattagtacgttgtattggtttggcgtattttcgttattaatcgttatcgaatttcggcgatcgattatcgtgttattattaattacggtatatagttttgaagttattagtttttcgatttgtttattaaatattgaagtgttacggcggttgaagtcgttttttagatcgtgattaatcgttttatgtaatagtacgttcggttaatttgcgttaagtattatcggtatggtgttcgttggtgtagtaacggtagaaagattgattagcgttatacgtattgttttttttgtttatgtattcgtacggatttcgtcgtcgagatcggtaaggaagaatttataattaaaacgatcgtcgtcgttattggtatcgcgttcgcgtttgttatttttttcgacgagaacgtttacggaaagacgtattagcggacggatattcgtcgttagcgtgtcgtcggtggtcgtaattaaaa

SEQ ID NO: 13112 - DNA, 673 bp, Artificial Sequence
  chemically treated genomic DNA (Homo sapiens) CpG-island No: 13112
ttttaattacgaccaccgacgacacgctaacgacgaatatccgtccgctaatacgtctttccgtaaacgttctcgtcgaaaaaaataacaaacgcgaacgcgataccaataacgacgacgatcgttttaattataaattcttccttaccgatctcgacgacgaaatccgtacgaatacataaacaaaaaaaacaatacgtataacgctaatcaatctttctaccgttactacaccaacgaacaccataccgataatacttaacgcaaattaaccgaacgtactattacataaaacgattaatcacgatctaaaaaacgacttcaaccgccgtaacacttcaatatttaataaacaaatcgaaaaactaataacttcaaaactatataccgtaattaataataacacgataatcgatcgccgaaattcgataacgattaataacgaaaatacgccaaaccaatacaacgtactaattaaaaacgacattctaaaaaactacatacaaaataaactcaacgcgcgtttaataaaaataacgccgactaacaacgatcgccgtaaatcctacgcccatctacccataccgcgtataaccaacacctatatactaccgaataaatcgaccccgcaaaaaattattaaatccgttaaatacgatatctatacaccgaa

SEQ ID NO: 13113 - DNA, 1384 bp, Artificial Sequence
  chemically treated genomic DNA (Homo sapiens) CpG-island No: 13113
cgtcggatagtggaaacgttatgaagcgaggtcgggcgaattgatcgttcgttagttcgtcgcggatgttttattatgggcgtttcggcggatttagtttcggcgtttttcgttagtatttatttttagtgattttcgttcgcgcgtttcggttaggggtgtcgaacgtttgttattgtgaggtaggtcggttcggcgggcgacgtttattggtatattttaatttacgtggtttttggtaggggttattattaggagaggaggcgttatgtttattattatttttttcgacggtagttaacgttttttcgattattcggttttcgtggtcgaggtggtttaatttatcggcgcgggtttggttaaggcgattttcgtcggtaaggtcgacggtcgtttggtcgacgtttgttatattatcgatcgtaacggattttgtagattattacgtttaaggacgaggaaggattggagattattcgttatttttgcgtttatttggtcggttatgcggttaagtagttttattcgatcgcgaagatggttatcggttcggtgatcgaggaaggtttttattacgatatttttttcgagcgtttttttattttcgaggatatggcggcgatttagtagcgtatgcgcgagttgatcgataaggattacgacgtgattaagaagatgatttcgcgcgtcgaggttatcgagttgtttaagtttcgtggcgaagattataagttgcgtttgatcgacgatatgtcggacgagaaggttatgggttgtatttttatgaggagtacgtggatatgtgtcgcggttcgtatgtgtcgaatattcgtttttttaaggcgttttaattgattaagattttcggcgtttattggcgcggcgattcgaagaacgagtagttgtaacgtatttacggtatcgtttgggtcgataagaagtaattggcggtttatatttagcgtatcgaagaggtcgagaagcgcgattatcgtcgtatcggtaagtagttcgatttgttttatttgtaggaagaagcgtcgggtatggtgttttggtattcgaatggttggagcgtttattaggtgttcgagtagtatatgcgtaaggtttagcgcgattatggttatgtcgaagtgcgtatttcgtaggtggtcgatcgtattttttgggagcgttcgggttattggtcgaattacgtcgagaatattgtttatattttttcggaaatcgcgattatcggttaaatcgatgaattgtttttatttatgttgtcggtcgattttagacgttttttttacgcggtatggtaattaaaacggagacgggacgttgaattagataattattagaggtgattattaatagatgaaataacgat

SEQ ID NO: 13114 - DNA, 1384 bp, Artificial Sequence
  chemically treated genomic DNA (Homo sapiens) CpG-island No: 13114
atcgttatttcatctattaataatcacctctaataattatctaattcaacgtcccgtctccgttttaattaccataccgcgtaaaaaaaacgtctaaaatcgaccgacaacataaataaaaacaattcatcgatttaaccgataatcgcgatttccgaaaaaatataaacaatattctcgacgtaattcgaccaataacccgaacgctcccaaaaaatacgatcgaccacctacgaaatacgcacttcgacataaccataatcgcgctaaaccttacgcatatactactcgaacacctaataaacgctccaaccattcgaataccaaaacaccatacccgacgcttcttcctacaaataaaacaaatcgaactacttaccgatacgacgataatcgcgcttctcgacctcttcgatacgctaaatataaaccgccaattacttcttatcgacccaaacgataccgtaaatacgttacaactactcgttcttcgaatcgccgcgccaataaacgccgaaaatcttaatcaattaaaacgccttaaaaaaacgaatattcgacacatacgaaccgcgacacatatccacgtactcctcataaaaatacaacccataaccttctcgtccgacatatcgtcgatcaaacgcaacttataatcttcgccacgaaacttaaacaactcgataacctcgacgcgcgaaatcatcttcttaatcacgtcgtaatccttatcgatcaactcgcgcatacgctactaaatcgccgccatatcctcgaaaataaaaaaacgctcgaaaaaaatatcgtaataaaaaccttcctcgatcaccgaaccgataaccatcttcgcgatcgaataaaactacttaaccgcataaccgaccaaataaacgcaaaaataacgaataatctccaatccttcctcgtccttaaacgtaataatctacaaaatccgttacgatcgataatataacaaacgtcgaccaaacgaccgtcgaccttaccgacgaaaatcgccttaaccaaacccgcgccgataaattaaaccacctcgaccacgaaaaccgaataatcgaaaaaacgttaactaccgtcgaaaaaaataataataaacataacgcctcctctcctaataataacccctaccaaaaaccacgtaaattaaaatataccaataaacgtcgcccgccgaaccgacctacctcacaataacaaacgttcgacacccctaaccgaaacgcgcgaacgaaaatcactaaaaataaatactaacgaaaaacgccgaaactaaatccgccgaaacgcccataataaaacatccgcgacgaactaacgaacgatcaattcgcccgacctcgcttcataacgtttccactatccgacg

SEQ ID NO: 13115 - DNA, 1384 bp, Artificial Sequence
  chemically treated genomic DNA (Homo sapiens) CpG-island No: 13115
atcgttattttatttgttggtgattatttttagtaattatttggtttagcgtttcgttttcgttttggttgttatatcgcgtggggggagcgtttagagtcgatcggtagtatggataggggtagtttatcggtttgatcggtagtcgcgattttcgaaggagtgtgaataatgttttcggcgtagttcgattagtggttcgaacgtttttagaggatgcggtcgattatttgcggggtacgtatttcgatatagttatggtcgcgttggattttgcgtatgtattgttcgagtatttggtagacgttttagttattcgggtgttagaatattatgttcggcgtttttttttgtaggtggaataggtcgagttgtttgtcgatgcggcgatggtcgcgtttttcggttttttcgatgcgttggatgtaggtcgttagttgttttttgtcggtttaggcggtgtcgtagatgcgttgtaattgttcgtttttcgagtcgtcgcgttagtaggcgtcggaaattttggttagttggaacgttttgaggaagcgggtgttcggtatatgcgggtcgcggtatatgtttacgtattttttatggaagtatagtttatggttttttcgttcggtatgtcgtcgattaggcgtagtttgtagttttcgttacgggatttgaatagttcgatgatttcggcgcgcggggttatttttttgattacgtcgtagtttttgtcgattagttcgcgtatgcgttgttggatcgtcgttatgttttcgggggtgaaggggcgttcgaagaaaatgtcgtagtagaagtttttttcgattatcgggtcgatgattattttcgcggtcggatagagttgtttgatcgtatggtcgattaggtgggcgtaggagtggcggatgatttttagttttttttcgtttttgggcgtgatgatttgtagggttcgttgcgatcgatggtgtggtaggcgtcgattaggcggtcgtcgattttgtcggcgagggtcgttttggttaggttcgcgtcgatggattgggttatttcggttacggagatcgggtgatcgaaggaacgttgattgtcgtcgggaagagtaatgatgggtatggcgtttttttttttagtggtgatttttattaaaggttacgtgggttgggatgtgttagtaagcgtcgttcgtcgggtcggtttgttttatagtggtaggcgttcggtatttttggtcgaagcgcgcggacggagattattgggaatggatattgacgaaaaacgtcggagttgagttcgtcgaagcgtttatggtaaagtattcgcggcgagttgacgagcggttagttcgttcggtttcgttttatgacgtttttattgttcggcg

SEQ ID NO: 13116 - DNA, 1384 bp, Artificial Sequence
  chemically treated genomic DNA (Homo sapiens) CpG-island No: 13116
cgccgaacaataaaaacgtcataaaacgaaaccgaacgaactaaccgctcgtcaactcgccgcgaatactttaccataaacgcttcgacgaactcaactccgacgtttttcgtcaatatccattcccaataatctccgtccgcgcgcttcgaccaaaaataccgaacgcctaccactataaaacaaaccgacccgacgaacgacgcttactaacacatcccaacccacgtaacctttaataaaaatcaccactaaaaaaaaaaacgccatacccatcattactcttcccgacgacaatcaacgttccttcgatcacccgatctccgtaaccgaaataacccaatccatcgacgcgaacctaaccaaaacgaccctcgccgacaaaatcgacgaccgcctaatcgacgcctaccacaccatcgatcgcaacgaaccctacaaatcatcacgcccaaaaacgaaaaaaaactaaaaatcatccgccactcctacgcccacctaatcgaccatacgatcaaacaactctatccgaccgcgaaaataatcatcgacccgataatcgaaaaaaacttctactacgacattttcttcgaacgccccttcacccccgaaaacataacgacgatccaacaacgcatacgcgaactaatcgacaaaaactacgacgtaatcaaaaaaataaccccgcgcgccgaaatcatcgaactattcaaatcccgtaacgaaaactacaaactacgcctaatcgacgacataccgaacgaaaaaaccataaactatacttccataaaaaatacgtaaacatataccgcgacccgcatataccgaacacccgcttcctcaaaacgttccaactaaccaaaatttccgacgcctactaacgcgacgactcgaaaaacgaacaattacaacgcatctacgacaccgcctaaaccgacaaaaaacaactaacgacctacatccaacgcatcgaaaaaaccgaaaaacgcgaccatcgccgcatcgacaaacaactcgacctattccacctacaaaaaaaaacgccgaacataatattctaacacccgaataactaaaacgtctaccaaatactcgaacaatacatacgcaaaatccaacgcgaccataactatatcgaaatacgtaccccgcaaataatcgaccgcatcctctaaaaacgttcgaaccactaatcgaactacgccgaaaacattattcacactccttcgaaaatcgcgactaccgatcaaaccgataaactacccctatccatactaccgatcgactctaaacgctccccccacgcgatataacaaccaaaacgaaaacgaaacgctaaaccaaataattactaaaaataatcaccaacaaataaaataacgat

SEQ ID NO: 13117 - DNA, 1197 bp, Artificial Sequence
  chemically treated genomic DNA (Homo sapiens) CpG-island No: 13117
ttggttgtttttgatttttcgtttcgtaagtaaggtacgtttttatttttcggatattttgcgtttgtggtttatcgattatcgttcggcgcgtcgttcgttacgcggttttcgtattcgtcgggtgtatatcgaggaggattgggcggcgattaatcgtttgtatttggcgcgcggtatgttttcggtgtagatcgagcgttttagttcgcgatattagggcgggtcgatttattggttggtcgaggacgtcgatattggcgtcgcggtaggtacggtgatgggttttaattacgttaaggcgttttaggattcggagggcggttttagtttttggtgtttggcggtggattcgtaatgtagtcggtcgggcgtcggcgaggcgttggtacggtatttggtcgagtattttatgagtcgcgaattggtttatttcgatttttcggtgttgtataataattagtaggttaaggcgttttatcgtaagttcggttttcgcgaattggcgatttttattattaagcgtaagaacggtattaattagtcgttgtttttcggtttcggttcggaggaagattttaatttttacgttcggattatcgtcgacgaagtttatcggcgcggtatcgaggtgcgcgtcgacgacgtcgagggcggtttgtttattttgatttagggcggtcggtagattcgttgtcgtgaatcgtttttcgatttgattacggcggtgagtatgattttttgttaggataaggtttttatttatcgcgttttgtagtacgtcggtttgcgttagttatagtagcgtttggtcggtagcgcggaggaaaacgtcgcgtttttcgtcgagtacggttcgttggtggttaagtcggtggacggcgagtagggttagggcgtggcggtggatttgcgtattcggaagaggtcgaggaggtatcgaggtcgttttattttattcgggtgttttgagattatacgcggtacgattggcgtttggtattgttacgagtgtgcgcgtatcgttttcgcgcgtatcgtacgttgttatatcgttattatgagttagacgcgcgtagcgtacggggaaacgatcgtgatagaatacgatttcgcgcgttatgtgatatttgtacggaattgttcggattattaacggattagatatattatcgttgaggtgattgtatttgaagt

SEQ ID NO: 13118 - DNA, 1197 bp, Artificial Sequence
  chemically treated genomic DNA (Homo sapiens) CpG-island No: 13118
acttcaaatacaatcacctcaacgataatatatctaatccgttaataatccgaacaattccgtacaaatatcacataacgcgcgaaatcgtattctatcacgatcgtttccccgtacgctacgcgcgtctaactcataataacgatataacaacgtacgatacgcgcgaaaacgatacgcgcacactcgtaacaataccaaacgccaatcgtaccgcgtataatctcaaaacacccgaataaaataaaacgacctcgatacctcctcgacctcttccgaatacgcaaatccaccgccacgccctaaccctactcgccgtccaccgacttaaccaccaacgaaccgtactcgacgaaaaacgcgacgttttcctccgcgctaccgaccaaacgctactataactaacgcaaaccgacgtactacaaaacgcgataaataaaaaccttatcctaacaaaaaatcatactcaccgccgtaatcaaatcgaaaaacgattcacgacaacgaatctaccgaccgccctaaatcaaaataaacaaaccgccctcgacgtcgtcgacgcgcacctcgataccgcgccgataaacttcgtcgacgataatccgaacgtaaaaattaaaatcttcctccgaaccgaaaccgaaaaacaacgactaattaataccgttcttacgcttaataataaaaatcgccaattcgcgaaaaccgaacttacgataaaacgccttaacctactaattattatacaacaccgaaaaatcgaaataaaccaattcgcgactcataaaatactcgaccaaataccgtaccaacgcctcgccgacgcccgaccgactacattacgaatccaccgccaaacaccaaaaactaaaaccgccctccgaatcctaaaacgccttaacgtaattaaaacccatcaccgtacctaccgcgacgccaatatcgacgtcctcgaccaaccaataaatcgacccgccctaatatcgcgaactaaaacgctcgatctacaccgaaaacataccgcgcgccaaatacaaacgattaatcgccgcccaatcctcctcgatatacacccgacgaatacgaaaaccgcgtaacgaacgacgcgccgaacgataatcgataaaccacaaacgcaaaatatccgaaaaataaaaacgtaccttacttacgaaacgaaaaatcaaaaacaaccaa
